United States Patent 7,365,185 (GENOMIC PLANT SEQUENCES AND USES THEREOF) - sequence listing, part 92

SEQ ID NO: 81642 - DNA, 91804 bp, Oryza sativa
catcagagctactttggtgattaacataaaagaagtaaaggtttaactgctgggttcagtagcattcgagaaatacaattatataaatacctcagttcttgtatttcaagtttaatcctgtacgttagatgcgctttttcagtctccatgactccatggaattaaggatgctaaacagctagtattgtctttagtgccatttcagaaggcatagaaaagatatataggcatatagcctcataattaccagaagttttggggaatgcaacattgtatcacacataaaaaaaaaatcagccacatcgcaaaataattacctttctttttctatcatcaaggggctgtacttcaatagctagtaatgtgtccacgtcatcggcagtaaccaaatagttaggttgtcttgctcctatgccaacagaaaacatttatttcccaactttcttgaaaatcatagaatcctatttaatgcaagtgacaagctcacagagctaaagtgacaaaaaaaagtaccttctatgaaatttacggagccatcttctaaatggcgcacccactgcacataggaaaatatattttttggacagtgagattgccatgaaagtttgaaactcatatgaacaatataaggtagagaagttcttttatccagaatgtggaatgacatgaattacgaagagcacctcaaaattacaactggtggttccattggtggagtacccgcttgcttggagttctcttccaggaaaagcttcacctgtgattcgaaggccctctatgcctggcagtggatcatcctcagcagctacatattcataaaagaggaatatatcatcagattgcattagtgttaaacaaatatataaatttatttctaatagtaattaccttcagagaaagaagatccaggctcctcaagaacagtaggaagatacggatatgaagggtttgtatcctcaatgccggataccaaattaactgagtctccatgaccccaatgagcagaatgttctcgtgcatgttggacttcagcaccctccgaagcatccgatacgtcacttctactaaggtgcttgaatggtgggttttgattctcgggctcaaagtccaatgggacagaatgtggatcatgctgagatacttgagaagaaacatccctcctgaattttaagctattaaatataaattataccacgtttaatgttcttgtgatgcctctatataataaaaaaaattattgactagaaaaatgattattaaatcttcctcaaaaacagtttagctatttgaaaatagtgcggcagcgacaaaaaacaaagagaattcaagaaatgccattgacaaacgctcaattccaagaaatgtcattgacaagtgcgagttccatgaaatgccatcgtacaagcgactttgtcccagaaatgccatcgccgttagggttccattagcagtcctccgttaagtgctataggataaacaacgcatttaacggtgtgggatggacgaaaccctaatggcaatggcatttctaggacaaagtcgcttgcacgatggcatttcatggaactcgcacttgtcgatggcatttattggaattgagagcttttcaatgatatttcttggattttctcaaaaagaaatgaaatgttcttgtagcaaattcccacatccctgaatttttcatgattgtagcatactaaagaaagtagagtgtaacatatcagaaattagtaaaagcaattcaagtaatgagtaatgactactagaagctgctagccaatttacataggtcaagaactggcaatcatagctgctaccttaagaatggaattatttcatcatgcgcaacggcaacgctggtagatagaataaagtcagtcaggaaggtacagtattaagcacttaaagaagatactacctgcttgaaagagagtttcttcccatgtcaccatgatcaacatttcttggaggaacatcagttggaatgacttgacggtttttgttccctgctacaccccaatcacctctaacttgaacaggggaagacattggagattgtatatgagggtacggtgtctgggtcacaatatcgaggttgcttttgttctgaaaaagtaaataggttagagcatttctgcaatagttatgacaagaactcaaggagtatagtgccatactgaagtcaccaatgcttttccaagaggatccgtaggtgagtgtacaggaagagtggcatcattcgccaattcagtttgccatggagtaatctgataacgtgactcttttaatttctcctgcaccatttaaatttgcacaaaaggaaacttcaaaattcagtcagaaaattttcggtagtaagtttgcatgcacgagagggacactattgggtacacttgcactgcccacccctagtgtctctgaaaataaatcgcttctttctttatgggaaaagtaaatgcatatttgcttgagcttattgagactcacctcagtgataataagttgctcctgcagatgcttaaacaaaacctgcagaaagggacacatttagtgaaaagtcaactcaataaggtacaagaacagaagcaacttgatgtgttgatcatgtgttatgaacctttttttaaaaaagaaaaatgcttaggttgctttttcaataatgaaagtatggcatatttctcagatgaaattaatgtcattgatctcttttcccttttttgccatttgcattcagtagtgaaatttatttctagttgctaacgtatacgacgttgcccccacgaaacggcagaaaaaatattagaaaaaagagtaaaccttcaaattgctgacgatggattgagcatcaagaacagaaggctgcaggttttcatattcagacagaagaggcagcaacgaagatatgaaagttgtcctttcttgttgtgcagcctatagcatatagtgacataagcaaaactcagtatagtatagaagaacaactacaatcttaactacaagccctgatttatcttatagtaacagctgcatagatccaaaatgaacatcaccatggcaatttatgatcctatctaatgttaagatgtacccatagaatagtaagagctgcatatatccaaaatgaacatcaccatgggccatggcaatgaatgatccaacctaatgttaagatgtattccataggatagaggtataaacagaaattttcaacaaatactaccttggtatagaccacaggaaaatccattagtcaagaccttgcatcaaacagctggttctaaaaactgttgtaaatatatggattaaaaaacagatatatcattctgcatcgttcctaacaattttgagctataacaccaagggacaaggtcaagtaagcacagaaaacaacattcattaaagcactacacgtgttatgatcatttctgtgcacgttttttaaattttgcagaaaggtattgaagtatgactggaagcataataagcctgactaatataacacaaacatactaatcgaatttcaaagaaatttccagtgacagagaactacctgcactgcatatgccagacggatgttttcctcaataatatcttgtctatatgataaagcttttgatgctgcatcaattaaatcttgttgctgctgatcaaatgcctgaaagatttttttttttgagataatatgatatactcactagttactccaagtgactaatagtttatgataaaaagaaatggcctaccatccgcatttgagcaatgcgcctttccaacatatatttatcatcgagtatccgtgcttgctgtcagggatattatgtagtcaggtacaagataataaggggaaaggcaacaaaaatgaagtactttccatttgtaaaaaaaaaaaaaaaggccaccttcaatgagtagtcagcaagatgttttcttaattgcgcaatctcttcctcattttctttgatcttagcagtaagatcctgcataggaattatcttcattagggatgatggatgatacaggtacaaatgacatttgcaagcaacttatactgacatgcttccatgacatgttcgaggccatctctgaagcaggcaataacccctgtccagctaggttcaacctaggatcatgctcgccttcttttctatgcctgtatggaagggcttctattttgtcaggatatcgcaagcaaacaagaccatcccacaaaaggaaggcctgcggcctaccgttgttctttttccccggcaacaaaaatggtagggaaaacatggagtgtggtcaggtgagttacctagtaggagaaagggaatgggaggatggagtagagaactgtgagacggcagcgctgtcgagggcaggctgctcccctgatgatcttttagatgctccattggacagggcattgttttgcctgatggtctgctgcattgaaggctctccactttcgaatgcgccattgtggtgaagggcagagggggtgcgggaattatctgaggacgcagcgctggcaggtgaccttgacgcatccatcttagtagcaacgaatgagcggcggtcttgggctactccactggaagaagcttgggatgcagcatcttcccgctgatcccaaaaattgaaagacgctgggtgttactacatggctacattttgtgcatatacatagctaaaaggaaaagaaaaaaaaagcaggcttacaatcctctgcaattgtcgcgttttctgcatcagttcctctttgaggcgattattctcttccaactagaaaagaaaaacatggaaacccaaaatcagctacttcagtggtgtgcggaaataaaatagggcgagttgggagtgggacaggaggggaattgtggaagaggcgatgaggaaggaattgcaagggtaggttcgtgggtaggaaaggataagaggtagacctggttgcggatggtggcctcggcgccctcgacggcgcgcatgacgtggaggaggtggtcggcgttggccccatcggtggcggcggcggaggaggaggaggggtggtcggagacggaggccgcggctaggcgccccgcgagggcgtccatggcgggggcggagtcgcgagggcgagtggagtccaagagaggagaggagagagtggaaattgaaggcggaggggaggcggaggcgaggtgggctttgggttaggtgggtgggcgcggacgctcacgaggaagacgatgacccagcctcctcgccttttttgccatttggatcggaataactacttcttcatcatttttctattttagatttatcctaaatcaatgcttttaaaattaaatttattattaaaaaaatatagtgctgtactatactctttattttacgttagaaatactgctatacagaagcttagcaccaactaaaacgacgaacaagatgagtagtgaagtctatggctctgtttgaatctcttaaaaataaagatggagataaaaattaagtgttttacataaaacgaggtggtaataacttgtgattaattgagttttaattattataaacttaaaaaaatagattgaacaactttaatatataaaattttcacacaaaacacaccgtttagcagtttggaaagtgtgctacgaaaatctagaaccctctcatacagggcctatgttgtctgtgttctaatcctgaataaaaataagtggatttctccataagcatcacgcatattcattaaaaacagagttttcttttttccttttgaccaaaaaatagaagagaatatatgtgtatactttgattccgttttattactaaaattgaagggtttttttgtcatctttgaagatatatatatagttaaacgccgtgtcgtcccatccaagcatactacaattgcaagtgaatttcgtttgcaacagcataagtagattgcacaacaaactaacttcgatggaaacgtgaaatctacgccatgcatactctattgcttatatcaccttttgttttggattcattattatcacttgagagatgatgagaaagggaaaaaagagagtgaatttactcggccattgtttgcctgccgtggccccaatcctagcccatatatgtgaatcttcagcgtcattcacagctcggcccatttcatgttacatctccttttttttcctttcctttacttttcttttggtaatggatataccttcttcgaatgggacaattcggtgccgtgcacccttcacatttcttcgataacgaactaaaaaaatgtgcagccttaacataattatggtactagatctcacaccccgtttgctttaaaactccatcaagatttatattgaacattggtttgtccaaatatataaaaaaacgcacatatgtatagcctaattaccccgatatgtgcatatttcacaacagaaatagaatatgaaaaacaaataatgaatataaaccattacgtccctcaaccattttgagatggcatacggggtacacagctcatataacctttttagcattgacggttatataattggtgtccataacttatacgaatatctccaaatgacgaatcacgaagttactcataaaacgtcaaacaatgatattaatagctaccacctctagaattatcgtgcaaaattaagttatgctccctccgtttcagattataagacattttaactttggttaattttttgagaattacgcagtacaacgcagactcgcactattgaaaaccattaaatcctgaaaaattcgttctgatggggagtcgaatccaggacctaatgtgctactgaggccctttcgcaaagtactctaagtttgactaattttgtagaaaaaaatagtaatatttttaacacaagacaaatatattatgaaaatttattcaattatagatttaatgaaattatgctgatgttgtaaatattactactttttttctataaaattagtccaacttaaagcaatttgattttgatcaaagtcaataacccgaaacggagggtgtatgagatgatcaaatacacattttgttcttgaaaaggaaatagtagtgacagattctcaaaaggtccaaacgtttggacgtgaaattcacttggacattgacttgcacggtttgtatttgtgatccaagtgaaaaggctactaaaggagggggggtagcagcagcggggggccccagttggcagccacttatctcatcgtagcccttatcttcctcacgggctcacgcgcggcggggagagagaggacgtcaccgatcggccatgtccgcagccaccgcgtgcgcctcgccggcggcggcgcgcccgcccctccacatccccctccgttcgcctccttccgccgggcactttccctccgccgccgcctcccgccgggcttcctccgccgcttgccgatgcaccgattcggcccctgcctccgcctggccctccacttgggattggacccgctggacccgccacttcgccgacgtcgaccaggccgagagttacgcctccctcctcaaggtaccctaccctcgccaccatccccccctaatctacttcctctctatccatttcaatccaccctaatccctacctatcttgtgcatccactctgcgcagttccagctcgaggaggccgtcgacaacgaggacttcgcggaagcctccaagctcaagaaggccatactcgaggccacgggcaacgacgccgtcgcccaagtcatgtctgaactcaaggtactctgcttcctgttcgtcgtccctttgtcaccgatccaggattgaggatctcaaccccagatgctgttgttgtagctagcgattctttttcactattgtttctccacccatgtagactgctatagaggaacagaggtatcaggacgcctcaaggttgacaaagcttgccagaaccaacttggtaattgattgaatcagattatctttaacaaacacatcacacataagcgatgtattctaacgacttgatttgcaggtaggttggtgggtggggtacgctaaggataccgatgattcgatcgggagaatcgtacggataagccccggtgttgggagatatgtggctaagagcttcagcccaaggtgcgtttatgtctctttgcaacctatgctaaaaccaagtaacttttgtctaggtgatccataattaagtgcatctttcctgtaggcaattggttactgcatcgtcaggaactccattatttgaaattttccttgtcagagatgacgatgagacatatacaatgaaggtgcactgatgaaactgatattagtagtttgtattatagtcttcacgcagttcacaaaaaaaacaagaactctgttatgtctagttgtgatatttgtatttacgaaatttttagacaggttgtacacatgcgaccaacaaaaggcacttcaagtgcatcatccgtatcatcagcaactgcagaaagtccagctaaggaagagaatgaaagctcattggaaagtagtgctatatctgagggcattaccgatgaagcgaatacagatactacattaaagggagatgaagatgttgaggataaagaacaagatgttggtaacgccaaggatagtagtgttgaagggttgaaaagcgttctgaatttcttcaagtctcggattcctgaattcaaagttcaagtaataaatgtagatgtgtctgaggaagctgaattagcttcagattcgtcagaagaattagtgcaagatgatgtgaagagcacgtcagagaactcattggaagattctaccactgaggagcttcagcaggatgatgttccagatggagattcagactcagctgaagatagtaaaagtccagaaatgaagctcttcattagtggagtggttcataacaaggaggatgctggagcaaaatcatatgttcgagttccagctgaaatcaataatttggaaaaggattccttcgaactttacattcctggaaaaggttctgatcgagatctggctgatacaaaggctgcaaaacagaaagttgctgatatggctgccaaattggcatcagaacttatgccttctgatgttgcgaaggcattatggggaacgaccaagagttcttcgaaggtgagcataacacttggtttagctatatataagtctggagtttagagcatttagtgaggtatgctttggtttattgaagtcttcacaattagttgaatagtatcatgtctttcacaaagtaacatattagtatatgagcattgagaaatagtttgacccattctatctatcaagtctattcttgtttcatccacttgtagtggtaattgtcaactctccattgtccctactccctagtattctaggctgtatttctttcatgcaatcaagttaactgtgaaatgatggattcactgcagataaataaagaagtacaagagctcttaaagcttaccctcagcaaggctcgagtcaagctgactgagaatacaattttcaataggatcattactgacagtaacggctcagatccatttagtggtaatgtcttgtcagttaaacggacgccttgatattttctctgctttgactgatggattcttggtgtacatgtaggtctctatgtgggagcatttagtccatatggaccagaagttgtgcagctccgtcgaaagttcggccattggaacagcacagatgaagtggagtttttcgagtatgttgaagcagtaaagttgactggtgatctgagtgtccctgctggacaggtttgcaggcattttgtatatttcaacgaacaagctggtcatctttctaatgaataatgttcaatacagataacattccgtgctaagattgggaagggcaaacgtcttgagaaccgtggtgcataccctgaagaatttggtgtggtaatttctatttatacttctgtttatttaattgttgtttcgaattgttagactagactgtaatggcatgcagtctgcgatgattcaaagtgtatttgtttaagcaaattaacagcttcttctgggccgtgtgtaacatatatcattttccaattaacttttcgattttgcagattgctagctataaaggtcaagggagaattgcacagcctggcttcaaaaatccccggtgggtggatggtgagctattggtgctcaatggcaaggtaaaataattttctgcagttgcaatggccctgaaatatattaaaaaattatgaccataacattgcttaacaaggttttctttaaccctatttcatgtcttgagtgaaagaatggctcacagctgaacatgtcgtttattgttgtcaacactgaaatacctttttttttttctaaactttggaagttttaggatatgaaattataccaccatggcaaatttgatgcttgtggagtgaaagaaagttttgatttctgctgcatcttttgtgctatgaactttcttcaattttgttttgggtcttgatctggagttctggaatgactgacactggaggaaatttaacacgaagttacaagaaaagcgttccttttaaaaatattagagcgtctgttgttagcctaacgtcgattgtcttatcaggtcattagtggagaaaatggttcttgtcaccagatcgaagcttagggtgacacttctatgagtgacttccacagttgaaaaaagttagtggtccaggtaccgaggtttgtatacggtacctgagaagtccaacattataggtcattttcatttgcaaattataaactgggcagaaggtatttgcataacaaaatctctagaacttatcaatgcaatttacattattttactcacctacccaatcctgcccagaacaatgatttcgttgaagtactttttacaagatcatccttgataattggtgttaaattcatttgcagagcacgatcccacaccttggaggtgcggagcttggtttcctgtacagcgtgcctgagcagagtttcttggtactctttgaccggcttaaacttccagagtgatgagattatgctgaatcgagctgttctcacatgcaaattgcatgagtacagagagaagctgacacagtttcaagagaaacgtatagatgtcccgtcatcttcctgaaatcctgagatgcctcagctcctttattagtcagctcctacttgacaggagctgacctgtttgagctttttcagggtataagagagctgactattctggtctaactgaatactgctattcttgtccaatggaaaactggagcttcatatgagatcatgctaggctcttagatgacgcggtatagatataatttgtgtgacagttttgcattcggttttgccttaataatgaaggatgggaaagttttgtattgtctggatgctacagataaataaagccttatctttcaatacagcatgcatggcttaattaatggttactttggttcctgattccaaactggcgcatctttacccaacccaatttttgacaggatcagtttgtcctaaattttgataggagcagtggcaaaaagaggtgtggaaaaaattccgttgccgggactcgaacccgggtctctcgggtgagagccgagtatcctaaccagctagactacaacggattgttgaagcaaggacactttcaacagctgacacatggtcgaatctatgagacgcaaaggcaaacagcaattcagttacgtgaaccaaacagcgacacagatcacggaacaaagcaatagttgtcacggtattcatctctttcgtcttctctttttatcagtatcaccgattcatcggtacagtgtttccagttctcaacatctcaggcacacgcgacaaaaaagatgaattttagtatttgcaatcaatactactccaaaacacaacgaaaaattgtttaacaaaatacaaagaaagataaaaattcacgggacaccttatcttcagctgtggtcccaaaacactccgtttaactgttacaacccgttagattagaaaatcaacaaatgtgaaaatgacagctcctaaagcacaactaagctccactatgtcagggttcttctgttagaccaataatgtcaggaacacaattcagcgccttctcggatgaagaagctgcaggatcatactagaattcaaatcagaccacaatagctccttgctgctgatcagatgcaagtgctactctatttggatctgatttaccctgctataccaaattgaatgtaatatcatgtggaagatgtcatacttgatgggatttggatgccaaataaagtgcttctgcacccgttgaacattcgactgcatagccatgtattgatcatcaggaattgccaataagatctgcttcagtttgggtacatccttttccggtatgaccacagagaacgcactccaattaagtgcatcatcaaatggaagcacaaaattgtccgcaattatcaccggaacacactcataatagattgcctcaactattcttgggctgtttacctcgtatcccatgggacaaatacagtatttacttgatttcatatgctgaatataattcatcctcctagtgattctgtgtggcaaacggtcatatattctcatgtctgcatcctttcctccccaatactggaggaggacaggtcgaactcgtccatgcatctgtcctgcaaagaaggctaggatagatctctctgcagcaggttttccaccaatgcctcttaagggtcttcttggtgatctaagaaatgtttcaggaagggacacatctcttccatgaatgaaaactccttctgagagatctgcattacatagagctttaatggtgttttttctcaattcatcatgcaatttggtagtgtatggtccctgcaaggaagggccagaatcagaaacagcatgttagcttctttcttgattaagtttcagcctccattcaaatttgtatgcactaatattcttgttcaatatgaccattcaacaacgagaagtactcaaaggaagaatacatacccagtcatgacaagcgacaaaaaaatgatcagctccttttgtcctattccaataggggaacttggtggagataaaatctatgtatttctttacaaagatagacaatggctcaattgtatttgacccaggcacataaagattgtgctctagctgacgagagctatacggtagatagaataggtgagctctgtttggatctctcacaacaaaatgttggttcccttccatcagtttcataaaccacccctcagatgcataaatgcctttcaactctggtgaatggaaaataggttttgctccatcatggtatacaaaaactttaagaagtctttccatcagttcatagctcctggaagcatgagaaaaaaaaatttaaatagtcatcttctgaaatgcagaagccattgaacaatggaacaaacaagcaatggcatgataatttataaacatgaaggaaatttaagctatcattacagtttcctctattaacattttcaatcacacgctaccaaaatagaatgtgagaggaaaaaattacacttatttaaggcaaactagtgagcgccacatgtactgaaactactacgaataactaggtgtgggaaaagtaacatgccaaccatgggaatttgtcagaaagcggatgtatgcaacactaaaacattgcttatcttcatgataaaaaaaaaagcaacaaaaaagttgtttccctccctaaaaagtttgttcaacatatagttgggcatgcaagtccataatcccctgataagaataatgctactcacaaattgttagctaaataatatatatgaagttaaaccatagtcatacctcctaaagacagacacattgcggaacagtggtgcatgcagatcagggtcattggacaccagcggtgcaatagtgatctctttctttgcatagattagctcttcatcagctgctgttgaccaaagaggtataggcacctgctaagtttacaggccaagaaaaagatatttaacatttttttactccaaatacaaagagctcacatcacattgtaaaggtgcgtaaagcatcaacctctggtcttggaggaagcattgcatggtccttcatgtcatgtcccttattatagatatcagacctccttataggagaaccactggaaatgggcttcacaagtaaggaggttaaaaaccagaaattatattagttacaagtctatgtattcggcgcagatatgtacctcttggagaaaaggagctgattccgccggtggattttcctgaagttaagtaaaactttgattagatgctattagattagatatatggatatccatcgatcttgcatgatatagtgatgtaggacaagatgaaaacatttgtaatatgctactgtacctaagagaaatatagaatggaattgtatgtatgaaaaagagggattggtggggcaggtgaggtgagtacctttaaatctggagggtcagtttcctccatagaaccatcatctaagttttctgctggagaaggtgaagggaccaaaaacatggaggggactgttgtaaacccagatggcaaattagtctgcaaaacaaagcaaattccgccatttgatgcactctgatatccaataatcttgacatgttacaataacccaatgtattcgcaaaatcacgcacatttactatttacaaagaaagaaatgatgattcatgaagaaggagagccttggaaagcagaaatctttaggacagaaaaggagaggagacctggagctggaggatggaagtggaaggaagcggcggttgggaggcggccgcggagtcgggctggttgcttgtgttgttgtggaggagggaggcgaggagatacgggtgggtggggtcctcggtgggaggggtggccagcaaaaagagcgccgccgcggccgtgagtgcggcgacggcagcgcaggcggtgagcgcgcggcggcgagtgaggaggttgcacgggagaggcgaaggcatttcggagggcgacggccggccgccgcgccggagcccggaccagtacagacagagaagatcgaggacacagcggtggggagtcgaatttacgcctttgccctccggccccacacgccaatttcccatttgcatcaaacttttttccaagtacaggagggctcgtttggtttagtacatatcaaacattggtagtatactgacaaaatctaggcatgtttagcactaacaatattttagtaggatagaattctacgcattcggcagctagagattgggaggagatttgtctcgttttctacgtgcacacttcctgaactattaaacggtgtgtttttttttgcaaaaaatatatataggaaagttgctttaaaaatcatattaatccatttttaaaatttaaaatagttaatatttaattaatcatgcactaatggcttaactcgttttgcatatcttctcaatcttctcttttcctttcctctcaaacacaaactaagggtgtgtttagtttacggcaaaattgaaagttcggttgaaattggaacaatatgatggaaaagttggaagtttatgtgagtataaaagtttgatgtgatggaaaaaattgaaagtttgaagaaaaatttgggatctaaacacaatgtaagtaatgtatttggattgatattaattgggagccaaattttatattatggtgaggaaagttctagaaatataccaaattaaacatgggcattaccatccattctaaaccaaaacatcatatttactattcaaactactaaaaatttggcatcaatcaaagtggcccaaaattcactgctagtgctgatcttgtcaccaaaacgagtaaccaaagctggaggagtactataagtttcacacatctcatacaatagcttcttttgaaacgcaagaatttataagaatttcatcgtttttagttaaatcctctattagacttgagtttgtttgtacatgtttcaaacttatctctcgttttcaacccacatgctttttaaattactaaatagtatgtatttttttaaaaaatatatatatagaaaaattgcttgaaaaatcatattaagcatcttttaccttttttcactaatacgtaattaatcatgtactaacttgtcactctgttttccctcctaggatgtaaggttcccaatcctcactttacaacacagtttaagagtttgtcaaagacacaaaatgcttacttttttacatttatataatagatatagacgcacacaaacaactacacataaacactgcatccatacatgcaactgtgaatgcaccctctaaggcatgctcaaagagatggaaaccatcacatctctgaacacattaaatttctattgaaaactcactcatatggtgtatgtaatattcgtggtcatttgaatttaaacgagtaaaatcatacaccaacgattttaccatcacattgtcggtgctttcccagagaaactttaatttttgcctaccatcagagaaggatgtaaaaagtatttctttttttttaacactgatattatttccttcctccagtggagtatatgagtatatttgacgctgaaagtaatttgagaatatagcaatggtatattttacgcaatactcctatataagcgcttttttaaaaccttttttaaaaaattttgcaacctgtggttgtcacacgtactgtgacggtactgtctctatcagatcgatggtcttacatcctgattcgtacatacggagtggagtactaataaagacggacacgcagcagcataattagtcataattatactgagtaagtagtttaggtagtacgtgggagtaataattcgttattagtcggtggcgtcgaggcaccagcagtagtagtccgaggtggacagctggaggagctcctccggcgacatgcgctccagctcccgctgcctccacgccgggaacgcctccgccggcgttggcggcggcgcgtgcggccccacgccggcgtccctgcaggtgtgcggccgcgcgccacgcatccggcggtagaggcgcagcgcggcgacgcagtcgtcgtaggggtggtggtggcggccggcgatctggatgtggtagccgaggtaggcgagggtgaggtacttgagcgagttgctgaggcggctgttgctcgtcttcatcagcgccgggtacctcgccgtgtcccgcttcaggtactccgggtagtccatgcccagcgactcgaggtcgtggtccaggccgtggccgaccaggatccgggccctcccgcggctgctccgcgccttccacgccggctcgccgttgagcagcagctcctgcacccggcgcgccgcctgcttgggcgtcatggcgtcgcgcaggtgctcggggcggatgccggtggtgtcgtagcggtagtgcgtgacggggatgtgcggcttgacgaaggtgtccaacaccacgcgctcctgctcgtccaccacgcacacgcgggcgcacacgtccagggacccgtcgctgccggcgcccaccatcttgcaccccagggcgaggacgccgccgagcggtggcgcggccgcggggcaggagtgggcggcggcggtgggcgggaggactacgtggaggcagagggggcagccgcgggaggcgaaggcggcggcgcactccggcttggggagggcgccggtgaggtggtcgcggagggcgtcgagggagcggcagtgcttgccgcagacgccgcagcgagggtcgtgcgccgaatgcagcgacgtccgcatgtgctccaccaggtgctccttcttgttgaactccctatagcacgccgcgcacctcttcctcctattcatattttttatttaacttaatcaatttctttctttctttctttctttcttttcttcatatatatatatatatatataatcagaatgtagttagaacattggctaatacctctgagaatctgaagaattatccattctcgatctgaagactactgcaggagtgcaggtgagtggccactggtgtagttagttgttgtgctgattggtgattgctatctgcacttgtttccgatgcctatttatacgcaaatccaacggacagaatttgattcttgacagtgttgtcgatcgaatgtgatgtccctgctagatactccctccgtttttgacatatcctctactacgaatctggacaggctccgtatccagattcatagtatataatgtgtcacatttcttcaaaatggtttatattttcgaaccgatggagtagaaagcttcaccaatattctgctgcatgctttacacatcatcatcttctggttttgaggatattattcaggacatgctcatgcacaaaacagctttagaaccaacactgttaaagaatgttctgaatgcatccatcactatgctacatttcctttctttctgttagcatgcaaaaatatgaaaaatatctctgatgaatatcataatttgcctgcaaaatgctaaccaaccctgcagaacattccacttctcaaggatatactgccaatattaataaagctctagatagctaactgcaaactccatttccatttcgacccccttttctttatatgctgtctgtctgcaacgttgtgacagccattcgccttgcaaagataaataggatgctttgtaccccatatatagttcatttgcattgtgcaaaagcagtactagctcttttgctgaaactgcaattgctttctctcaacgagtgagaggctctcactgatggcatattgatcctcagtcctcacttacaactgaatttttcctctcttcaaaatcccttgtccataaacaaaatcaaagcagcaatccattgacgagtaatctcagtatgacatatataatctgcaagagagtaagaatcaagtaactgaaagtcaccttgttgctcagtgttcagatttatctgaagatagaatgccatgaaatgcaatggaatgaggagatttgtatcacatgtttttcttttctatcccttgattgtttcaggaaaaatcacgtgcagtgcttacatatgcatacatcattaatcatttatgtagaaaaaagagagaatacgggtagataccctagtcaaaaggaatggtttgaaaaagctaactattacgacgatgctgatggaaagattgaaggattcttatgctgtgacaaatcattgggtggatcttttcttcggtgacgatcaagctagccgtgccgtggtgtctgtactgtaagcatcttctgttgtttatgtgacttgatcgaggacattgatcgtgccttactcaatctcattcagttcatgaagtttagagctcttacattgtctaaaaaaaattaagattaatttgaagcttgcccggctagctcttgacaattgtcgaagttgattgagcacagtgaaatgaagtacacaggttaatttagcgcgcggtgaaaggtaggagatcgaagagattcagttcaagcttacgctatctttccatgctcaatgtgctagcttttcattgtgagaagcatatgcattggtgggtgttgttaatttagatgaggggataatgacctggctcggctcgttattagtagtatcatgactagccagctcggcttattaattaaccctaacgagctaaaagcgtggctcggcttagcttacgagttggcttgttaagctcgttagtaagttcaatcttatttatatcaactttaaaatttcaatatttaccaatttatcatatgttagtataatataagcaataactagtaaaatattcactaaatacaaatagttagtttgctagtaaattaaaggactaacactacaccatggtccacttttgctaacaaaagtcagttggaaaaaagactaaattttggaacaaattatgtgtaggcaaacatataaaagggctgcaacaccgactgctgaaaattctgttggcacaggctttgccgatactttcttagttgccaaacatgacttttgtctacacaatggacggacggtgaacgtgggtcattgtgtagtgtaagtactcacaacttaagaagcactaaatatgaaaatatatagtgacttttgtactaatgagtagctcgatcatgagctggctcgttaaattaacttactaaaaaatggtcgcgacacggttcattatgattacgagtttgagccaatcttagccataagcttttttcacccctaatttggatcaggtgcaaatgcaacagaagaacgggtagatgttccaaaggagaagtgcctgctgtgtctcaactctccactgccaaatactggcaatattaaagctatggctacctaactgcaaagttcatttccatttcacccctttcttctttttgttactgtttgaaaagttgtgacagccacccgctatctgaaactgcaagttctttctctgaacaaagctcttgtcctcactaataactagtgatcgagatctcagagaaaacatatcagggtagcaactgaaaatctgctagcttattgctcaggattcagatttcctcaagatacattgcgatgaaatgcaatacagcaatcatatgtttccgtatattttccagaggaaagcaccatatgtatacatcaatctctttatgtagatcaaaaggaattgtttgaaaaagcaaggtgatgctgatgtaaagattggaggattcagatgcaagtcccatccgaaaccgatgtgtcgtccgaaaagaagaaaagaaaaccacagatgaacatgagcctagctgtgagagcgtgtgacaaatcattggatggatctttttttggtttggaggcagcagctgaagaagaagcaccggatatgctgtgaacataccgtttaatcttgtgcttttcttctcattgggatattgttctgatggcctcatcatgtccaaaaagaaaaaaagaagcatcactgttcgatctcaatctcgatctcgatcacgatgcaaaggcaggccagccggttctccgcatatatatatttggctataggtagtggcagaccgttcatgtcgatggagggcagatgtgtatatgtggtgtgtagtggaatggaatagattcagaagagcaaaactaataaaattctgatatgatcgatatgacagcaacatggcatggcatgtactctggcctatattctcatctcgtcgattggaagcatccctgatcaaagatcgtttctgcatttgccatttctccttgttaaattcagttctcttactactaagtatcgtttcacaaaaaaaaaaaaaaggagaagaaaatctcttgttcagttcagtttggcgttcagatgatggagggatggacgatggtcatggtctcatgtatggttgcaggcaagggaattttttttaaaaataatattattttaatggaaaattgcaaaagtagaagctgatcggttaaaattacaagtttaatgccctgtcgaacatccatagttcgacaggggtacatatcgaacaaccacaattcgatagggtacctgtcgaattgcgattgttcgacagggtataaaaaataccctatcgaactgcccctgttcgacaggggataaaaaatgatagaaaaaaagaagatcaatcactatgagcactgtacaccactgtgcatgcagacctatcgaactttggatgttcgataggccccctgccatgctctttcttgtccttttctgtttttttaagtgaaccacaaccctgtcgaacaactgtagttcgacaggtacctgtcgaactgtggttgttcgacagggtatcaaacttgcaattttagctaatcagctactacttttgcaattttccattaaaataatattatttctaaaaaaaattccaggcaaggcagctcgatagatctgctcagacagagataggtacagttaatttgctactactaccattactctttttttttttagataatgtactactaccattactcttactcttgatcatgcaaggcatgggtgttaggagccatgtgggctgcaatatgggctgaatcagctactttccaagaagtccaagcaagcccaagagaccagatcattgtccaaagggcggcacggcgacctggaggcgggcttgcctccttgtcgatctctccttccctctcttcttcttcctaccaaccaatgtatcctcttactcactgattcattcagaatcttctaaatcttgctcctgttagttgttgttccttccagcccacctatatactcgtgatttgtattggagcttaaacaagtgggtctctaacaatgggccaccatttacttaggatgagatcgaaaccgagggcatgaaatggatggcaagacgaagaaagggacagagacagatacatggagcaggaaaaaacagcaaagcagcagcaggatgagaggaggacatggatggcaacatggagatccagatgcagtgcagcactgcaggcagcacgacactcacgaccacgacaactgctggctgcttctacgagttactccatctgtaaaaacaagtaaagtaagggaagtgcttctatgcttcttaaaaaaaaaactgcacgaaagttaaagcacgtcaatggtgaggattaaaagttgattaaccgagtaatcaccattagcaaggggcaatttcgtccagaagtaaaagcccatatccgtatccacatcccttctcatggattgattcgcggccagcgcgcggcagttctcacgacgcattccggtgaacagcgccgcacgcccgcaccctcatcctctaccccctgtaactgtaagagtgttttccccttccgctactaaccacgccgtcgctgcttccttcaccggcgagctctctccttcggggagctgtgtgttgacgtgttgtgtaggtggtgctcgtcgtcgtgctttcaggttcgtcaatattctcgtggttcaggaaacatggctggttggctgattcattgagcacaacaccctcactcaccattatcaacaccttattctgcttcttcgtgattctcggcagagattaccaaagcttccatgtccattttattcctcagtatatggtgatacctctgatatgcattcagaattgaactgaacttaacacaaggctgatcacaatcttttgaatttacatagaattggttgtatgcgctgatcctatccgtctcggactgttcgcggccgcgtgcctatatataaactgcgtcggcttcttaccggccgcacgaagaatcgatggcgatggagattatgcaacagctcgccgccgccgccacggcaacggccctgtgccctgaaccatctctgatggcgatgacgacggccggcgcaggtggaggccgccatcgcgacgctgcatggcaagaagcaacgcctccgcgaggcctgcgacagcctcgtcctccactcgcccatcctcctccccttccgctggtccgacctcgactcccacctctcctccctccagtcctccatccacgcccgcttcagctagctgcaggccctccaggcttcccgccccgcggcccccgccgccgccgggagccatggcgaggacgtccaggaacagggagaggacgaagtgatggcagcggcggcggcgaagatggtgcctccgtttacggtgctgcaggtcaaggagaggagcccgcggaggcgccggcatgcgcgagcatggacgccacaaggctgtcgtcgaatgccgccggcaagcgtgccggcgtcgggcaagatgggttcgttcgacccggtgggatggcggtgccggcggcggcggcgaagatggcgcctccgtcaaaggtgcaagtcaaggaggaaccagtcgattctgatatgcggacagggtgggctagatatggtcagctttttcttaggacaaaattacccctcgttaaaggggattactctgttaatcaacttttaatcctcaccgttgatgtgctttaattttcgtgcatgttttttttaaagaagcatagaagcacttcccgtaaagtaattaattctaaagattaatgatagttgtttattcaaattcatcttaaaaaaatagttattagtagaaagtagtacatctttcatcttaaaataagttcatttctcatctatctcacatatatcaatgcaaacaattattttctattttatctattcctgatacagttattttatacttttacaaacttcgatggaataattgctttaaaaaaattactttgagataaataaaatgagctaaaaataaaattattacgatagagggagtactagtcacattaattatggggattgatcgatcagatcagatgagcatggtacgttgttgttaggcagggtcgcccgtgaagtagtcacgagcgaattgaatttgcaatcgatgtatgcctactactagctgctacgtataccgaggtacgtacgttctagatgaatgctgtaattcgtacgtatacgtacattctgattaaacaaattcgcagtttactctggtccaaacaaacaatattaacaggaatgcttccaattgagggattatcctgtattgagggggaaaaaaatccacccatacatacgaattatcctgtattgaggctcccccgttttatccgtttttttaaaactttttatatttttttattttaaaaacgaaccccctctaagacttaatttttaatatctgaatgttttgacacatcagtcaggctagcgtgaggacggatccagcatggggttgataaggctctcaagcctccactatcgatgcaagatttttgtctctacaaatcaagataaacgaagatttcattcgattatatatgttgtacacatatatctcaattaaatgcatgcacacaccacactttgggtagctttcttgccgtctctccctgccgtccaccaccgccgaacccaataaggatccaactcattgtcaattcctaaaaaaaagaaaaaaaaatcattgcaagttaattaagaaatcgagtattatcgtaacctttttttttttccttgaagataaagatgttgaattaattacttcgggcttaggaagcatgcaataagcattttttatatcctattgatagcaaatcaatatgattcaaaaaggtgtaataggggagagagggaagttgttcatataggtggcacacggaggtaggtgctgaggattaggtttcgacaccactttatttgacgctgagaccattcaacttcagctccaaatacccttggcaccgagctatgtatctattttttttattaagttttagaaaggcttaattgtaaaataagttttttttaaaaaaaagaaattgaaaccagcaggtatgcacgtgaagatagtactcacatgctcactactttgggtccacgctgaggtaaagagaaatttcacggtctttaattaagagaaaaactttaagcgtaagatctagagcttatgtacatgtcttggtatttggtattaacaggtgctactaaattttacatgatgacttttagtaatttttcaagagctgtaaaattactcaaacataaatgaggttatgagggcacagttatgctgttagcattggggaactgtatattattagccgttaatctgaaataaaagtacggaccattactataaaatcctccgtaggtaccgactcatggttgtcggttcatttaaaatcgatatctattaacctttttcgtttctatgggataaaaaaaaaactgacacctttgagcaactatagacaccggttctaatataaagaccagcaccaataatactagtgcggatttttttcaaaagaatcggcacctatacttatattataggtgtcggttttataaaaagctagcccgagccaatagatcatgggatggtgattccttttaaccccaccgagtcaaccagcccctccttatccatcccccctctctctctctctcacacacacacacttatcccgccgcccctcaacttcacaacctcgtcgccgctgcattgtcctctcctccctctttctcctcctcactgcatacgtgcctcctcgctgttgtcgcccatcctcacagcttgtgaaccactagaccaagctgcctggagctcgcgtgccactgatctggcggcgtcgacctcgacgcggagagggctagcctacgacgacgacgccgtcggtagtcattgtctcccacgccgctcctccttgccataaaccgctagcggaacacggtggtgcagattggcgacgatgacattagtggctccgctaggactggagggaggggggtagtgggttcttgatctcgtgtagtccttcatcttcctggtgttgatatatgatggatggggaataataattgaatttcttgatcagtgtggatggggattgttgttgttgaatcaatatggagttctagccggcgtctatgtattttctttaaattgtggggagcccaaaaatatcaattctatcaagtcattggtgacgaatatataattgttgccgactataaaaccggcacctatccaggtttacaaccgggaatttttagatgttctgtagtagtagtgaacaattataatttatatccctatatgtttacttacaagagataggtatattgtactccctccgtttcgttttatttgacaccattgactttttagcacatgtttgaccgcttgtcttatttaaaaaatttaaataattattaattcttttcctatcatttgattcatcgttaaatatacttttatgcatacgtataattttacatatttcacaaaagtttttgaataagacgaatggtcaaacatgtgataaaaagtcaacggcgtcaaataaaacgaaacggagggaatacaatatatatctgctctccaaagaccaagctcgcatgacaaccagatgtttttacacaccttggcaacttgtaagaagaaaaaggatgcaacaaatactagctagcctagcgtatatgttcatatttgtagcagtacgtggtggtggtggtgagctataactcgaggatcagctctcttctctactcatggccaagcatatatgatgtaatcaattgcatatatatatgtttggctgtctctatatataggggacaaaaacagggatggaaagtgagccgatccaacggaactaaacacattttaggcgaataattagaagggtgaatggacagttaattaccatctctatccaagtgtgacagagttaaaagcaggtagctagctagctgccgaaaacactttggcaaagcagctaggaaagaagacaataatgcgttagctgtatgtatgtaagcatctttggcatgtgattggttggaggattgaagggcacatgatgatggagatcgatccatcgttgtgcagctggtagggatcggatagcgatatcgatcgatcgattcatacatgcattatgttcacttacatttcaattaattattgttctagcatttaatttttttattaagatagtacttgttgttcttacatttcaaaataattttggtgctattttttcccctacccttcatcaatacagccatactcatacttatattaattagaagcttctaaaaaaataaataactatacctcttgaaagatgattataatgtaatcaatagcaatgcaatttatcgtacctcctagttcagcgtgagaattagtagaacggtaagcaaaatggaagcgggagtgtgtttaatttgcaactgtgcgataacggagagaattgagaaagtatattaattaagcagcatggtagctagtattatttttccattatctaaaaaccagtgcaaattaagtgtattttaaggaagagtttagtctgaatgaataactttggtcgatgctggttttaattaagtagagcatatgcaatgcaaggctgatagtgggcgtggcggacaagacaagtagttgagttgcttccgtatacggatgggtgatacggccgtccttcaaccatcccccacaaccaagttgcataaatactgtaggagtacatatatgcagtggtcctcctcccatattgtacaataatactggagtatatccgatccacttgctctctctaatctaatggccacttgctaattaaataactcatcatcatcatgcatgcaaatatgcaatgccttgatgagtggcctacggtacatactcgatcgatcgacaacaatatatgatccatcatatatatatgcgctgatctctaactaactaacaaatctagatttttaattgatcctgtatagtatagctaggtaggtaagtaccataacccaaatgactggcaattctttctactcttgctccagtattcccaggtcgttgtaccactgccgcccctcgcgtacaattcctgctctatttcaaactctgcttgtacaagcacaccggcctgaccacgctgtctacttgtaaaaatatgatattttctaatccatttagattagaaaatatcatatctatctattattatataattaaaggaatagaaaaatgagcctccacgttcgctctcatggcctagaaattctcacattaatcggagaaaaagaaaaagcagagtccatatagaaatacaatttagaaatagcttaaattcggaattaaaaaataaggaatattagaagaggagaccggagtccatatagaaatacaattaggaaatagctgaaattcggaattaaaaaataaggaatattagaagaggagaccggagtccatatagaaatacaattaggaaataactgaaatttggaattaaaaataaggaatattagaagtagagtatagagtccatgtagaaatacaattaggaaataactgaaattcggaattaaaaataaggaatattagaagtagagtatagagtctatatagaaacttaaaactaactaaaatttggaataaacataataaaattaaaagtagagtttagagtccgtataaaaatacaatttacaaatagttaaaattcgaaattaagaaaaaatgggaagaagagtttaatgctaatataggaatacaatttagaagtaactaaaattcgaaattaaaaattaaataatattgaaagatgagtttagagtccacatagaaatataattagaaataataaaatttcagaaataaaaataaataatattagaagaagaacatatagtctatatagaaatacaatttacagaaaaaagaaatattaaaagacgagtctagagtccatataggaatatatataatttacaaataactaaaattttatcttaaaaataattaataactaacacgtatataaaatgcaatatgaatattacacattagtagttttgtaaagttattgcaaaatttaaaattatgttgttattttaatatatttgaataatataatgagaaaacatatatgctattatatgagagaaaatataatgatgctagccgcgcaatctgcgcgggccatcatgctagttttttttaatttaggttaatatattttagaacgaatagagtactttctctgtaaaaatacatcaatttctgctttgaatttaaatatagcttatgtccagattgaaagctaggcgttggtttttgtaggatagatggtgtactccacttgtaaggaggttaacctgctgctataagtgaactgggatcaggcacagtttctataggaactgcatgttaagctataggagccatctactttgttgatgaacggaccagatcgtcagctacaagtagtggtgcaaagcgctttaaaaaaattgctacagtaagctacaatcctggacgtattttaaccattagaccaagatgcaggaagtattttattttttttacttgtgctgtgccgttacatatcaggcgaccgtgcgggcatctggttgatcacataaaacgctttcggtggcttattatttggctgcacaacttgtatctaagatgattcatatatacggtgtcaggtgtcgtttttattatttggaatacgcttgcgtatttacgagagagaagtgcaacagaatatacaacggcatttttttcaatgaacagaatacaacacaaaactaattatgcgaccttgggatctatactcagagttagatttaactaagggcacccgcaatggttatctataggctctctacaagagactcatgtcagcatattttcctacttggaagatattaaatgaagagagagcaaagctatctactaacttagagatagtctatagagaaaaacgagacaatgtatgagagagctatagatacctatatagacatactattgagatggtttactattaatctagtatattgttgagatatacatgttttatagagcaccttactttactatttcgtgtgctcgaatgaggaggaatcgaccgttctcacccacgtgcggtgatttgttcatgtctagtcggttgatccgttgatggatggatcgtgtagacgtgtagtcgtgtactgctccctgggaggctgggacatgatatactccctccgtttcgttttatttgacgccgttgactttttatcacatgtttgaccattcgtcttatttaaaaacttttgtgaaatatgtaaaattatacatatgcataaaagtatatttaacgatgaatcaaatgataggaaaaaaattaataattatttaaattttttgaataagacaagcggtcaaacatgtgctaaaaagtcaacggtgtcaaataaaacgaaacggagggagtatcaagttttgcaatacgaaatgttgggcatttcttcagagcttatcccgaatgcatggtctcccatggatggatgtcctgtgatttcttcctttcctacagaaaaagcagatctctttggcttggcagctcgctgtcctgtgattactgtactgtacttaaaagggaggaaggaaacatataaacgcgtcttctcttgagctaactaaaaagaaaagaaaagaaagagtgtcttctattgaggtgaggtcatctgtcgtggtgtcactcgacacttgcaatcaacagctgtttccgccaaaacaaacaaatctgttctaatctcggcacccctgaaccaccgaaaaagctcatcactctcttctcttcactaataacctgacgacctctgctggctgcacttgccacttcatcgtcgtcgtcttcttcttcttcttgttcgctttttacactctcatcaaaagaatcatctctctctctctctctctctttttcttgcttgccttgtttggatcgattcgattaggatgcgattgaatcgcccgtctcatcttcccagccacacccacaaataatgttgtctttccgcaaatcccctccgatatccgtgtcctgctctttttttttgttatcctctaccgaaaatcccgattttttcgctttgaatccgccttttatccttcctcccataaagctttgaatccccgcgagcgagagcgagattccaggcgccgattcgcttccacttccgcgagcgtttcgtgcattgattccaagaagatccaagcttatcgcggaaaagaaagaaagaaagaaaggaagaggagatgaaatgcttcaagcagcagcagcagcagggcggcggcaatggcggtgggcaggggaagaggctggagaggcggctgtcgctgggggagtacaagaaggcggtgtcgtggtccaagtacctggtggctccgccgggagccaagatccggggtggcggcgaggagctgtggagcgccgacctgtccaagctggagatccggaccaagttcgccaccggcaggcacagccgcgtctactccggccgctacgccgcccgcgacgttgccatcaagatggttagccagcctgaggaagacgccgccctcgccgccgagctcgagcgccagttcgcctccgaggtcgccctcctcctccgcctccgccaccccaacatcatctcggtacctttcttccttcttcttcgattcaatttcaatttctatttcttcttcttttctagtacctttattaataacttgttactattattatttcaattataatggattctgtcctgtgcatcttgtggggacttctccatcatttttgtgcacttccatccatcaagtccaatttaatttctagtgcgctcgtagatgtttactactaacacaagttgttgcgttttggtttggttggttttgtctgtaccagatattgaatactagattatctcacttgaacagcctgttagtttcacatcttagttcctttacgctttattggtgtgccccatgcgtgcactaggctgtaggatttgttatgctaaccgatcttcacattaaaggttcttactttatgccttgttttgattgggcggaaggatggggtcgagaagataagtctgggtgcgacatgattcatgcttgtttatactaacccaatgaggagggagtgaacatggcagaaaaaaaaaaacttctcttccagtagtatgatattgatagttaagatagcgaaatctgagtcacgtacaaatgttacagcaatactgttctcctccctactctttctctacgttcatatctcaccctttcgatccatcgagcagagagctggtaatgattgttagtgattttttgtgagatcctgaatgtttttttgtgcactttccatcatatatattacttaatagagcttcctttctttggagaaaactcaacagagcttcgtatttaatggagaagcacatctaataaacttctctaagccgcctaactatttttagccatccactggaggtggtttataggaaagtttaacccctctgtttctttgattggcggtatatcaggatatttttacacgagtgctgcaaaagctagccagtctttaggttaattgattagtccaatcactgtccgcaccacttttataacttatgtgaattggcttcattatgaagaagttgggtaaagagagccaccagccaatggttgtattcaggtttttatcctatgcttgatgagttcatgccatatacagcattataggtgataatgttagatacttgtatgagaagttaaaagatgctattttcctaattaaagtgcgtggtggaccatatatgacatccaaacttaactgctttcatatgccaagaaaagtgtctctcgtaagaatttaatacggagaattgactcagagagtgatagttcgtgactttgcctacagataaaaatctatgttacttttcactttatcaagtgcctacctggattactggtcccacagatcacatggaaagtatcactttgtcaaaccaaccgaagttgagtaagcacaaaaatcatgtgacatctatgcaagttgcactccaaatgttcttcagtaatactggcaaatttctgcaagaaccttaattatttgtgaaattggtttatatgagtgttaggccgcatttgatctcaaatcgttttcctctgttgcattatttgccgttataatattttagctgtccatgttaaatatattgctaaaataggtcttggttctgatagtttgatagataaactgttcatcccttcgtcaccccttttctaacctgttatcctctatttgccccttcgaaatttgcacagtgcgcagagtgatgggaggggcaaatagagggtaaaagttaagaacaagggtcattgaatggatgagcagtttcagagaggtaattaagggaagtggccaacttacagaggcaaataaagaatttctctacatataaagcatgctggatttgaaatgaaagatgcccactacttttaacttgtgaaggaactcttgtaaccaattaatctcgtttgctcattttgttgagtctcaaactgataagaaatatatctaaactcttgtttttcagtttgttgcagcatgcaagaaaccaccagtcttctgtatcattactgagtacatggcaggtggctcccttaggaaatatctacatcagcaagaacctcattctgttccaattgaattagtgttgaagttatccttagagattgctcgtggaatgagctacttacactcgcaaggcatacttcacagagacttgaagtcagagaatatacttctcgatggagatatgtcagtaaaggtggcagattttggaatttcgtgcttagaatcgcagtgcggaagtggtaagggttttactggaacgtataggtggatggctccagaaatgatcaaagagaaacaccatacgaggaaggttgatgtatacagctttggaattgtcttgtgggagattttgactgctttggtaccattcagtgagatgacacccgagcaagctgctgttgctgttgccttgaaggtatgaatttttgacatgccacctctccaatcttcatgtccatctttgtttccttggctataatgtaggctgttaaaatcatgagatgctgctgccttttcagtcgcagtaccagtagaaaattttggtttctttctgtaagagagtaaaaaatgttttttttcccttatggaaactatggcggacatttaattagcctgaactttattggtatcaaaattgcgggtaattagaggatttaattaagcctgaactttttttttgcttaaatcctctgtatcaccccaaaaattgtttgtaattctgttgacatggtttctagcttgaaaaaaaaaacatattaaacatgctcgatccatttaggtaattactgctcaactagcgatgaaatttgaataggctgaaaatatggtgtttttccacacattgtgttgcgcagcaaatatctatatgatcccataagtttggaaaataagagtcggttagcttgtcctatctgttactgatgaccttcatctattggacttttgcaactaatagcttttgtgcagaatgctaggccaccactgcctccttcatgccctgtggcaataagccatctgataactcagtgctgggcgaccaacccagacagaaggcctcagttcgacgacatcgtcgccatacttgagagctacatagaagctcttgaagaggatccatccttcttgcagtcatatataccgcctccgcatccgctgcaccatcaccatcaccagcatcataatcatcatcatcaacagagccttctccggtgcttccctcgctacagaaccacccgacgatctgcatctctgagagtataatctggatgacggcttcgtcttcgccgtgtatgatgtatgcactttgttttttcagtttcttttttcctttttcaatgcgccggccccctattatgcggcagtaaggcttgctatgatttagtattccccttctttcattttttttctgtttattattgacgattttccatcattaatgcctgcctcgatcgacttacttgagagacgacaagcagcagtttttctggtgattatctatctctgaatgtcgttttatttgggtggtggaacaatggacgagcatctgtaattgtaatataatcgagctcttccgtcaatctgctgtttttgttgtgatcactgcaatgttatgccttgaacaagtgcaatgtttatccatgcatggcaagtgagattttaaatatcaggttcaaaaagtgagattagttaggcactgcgttttttttcacattcatctctctgcgtatcattaagagaatcaccagtgtatctttaaaattgagaaggaataaacaatactactatcagtttatatacattataagactaataagtaacaaatacaatgtaatatacttaattacttagccataagaaataaataaataatttctttcatccctctctcatggctagtggttgttgggttagagattttgctaaaaaagcatatgcctttagcaagtactataagtggaatgtctgtcaatgtatattgttatgtttacattgtatatggtaagagacagtattaaggtggaccttacaaacacaagagtacccagagagaagtactacctaagggtgaaaatggtcatggaaattcccgattgaccaagcgttgtttctgtatgaagggcattgttttttatagttgctgatttcgtttttggctatatgtaaattttgtttttttttctcaatttctttctgtatcgtattggacaagtgtcgtttaaatgataaatatagtcaattaccgaccgatcgagcgtctttttgaaagagatgctaccgattccgttttcacccttagtactaccatgtgagagtgaagagtgactttttagttacttgtgggtggtctttatgcatatggccaccttaaccaaatgcctcctgtaagaattaatctcacaatgtataagatccaccttaaaggcttaagaccccccctatgttattgtcctaaaccccttaagtacttgcccctatatgccgtgtaggctcatttgcagatgtggaagagagaaaggattatattagagagtgaatgagctatccctcatgtaaagagcaaccattacacaaatttcagtaaaaatatgagagcattagagttattgggggtttgtgtgttagagtaactattattgtatactcccttcgtctaagaataatgttacttagtatggaatgtgatatattttagtactattaatttagatatactctgtctaaattcttagtactactatcatatctcataggtcaacttattatgggacgaaggtagctggttacctcttaaatctatataaagatgatatatatgaaattggaggtaacagtcacctatattataaaacttgctattatgaaaaaaggagaatcaatagaatattaatggattctaaacaaccactacattaaacatttatgaatgatgaatgtataaatgatgaaaaaactctgaaattgccctaatataatattccaatagaaacctatgttatatgggagtattcaagcactagtaataacaattgttggatcagtagaaactcctggcagagcgagtccaccaacttgagcctgagctcgagctagagcttgaggttgacgacgacgatggcggcgatggagaagggctcctccttgcctccttcttgtactgcggcggaggagaagggtttctctgctgacgtcgccgcgctaggtcatcatccgacgacgaggaggaggactcggatgatgaagacgaagacgaggacgaggactcggatgatgaagacgaagacgacgacgacgactcggaggaggaggaggtgtcggtgccatggctggagcgctggcggtccttaagggaagaagcagcaggagcctccggcggcgtggcattattgtcctcgtcctcccccgccggcgtctgcgtctgcgagtggagcgtggcgaggcggccgcagatgtcggcgtagcagacgagcacgatggcgacggtgaaggcggcgcaggcgaggctgatgacggtggaggggtcgagggcgcgggcggccgcattcatgtcggcggcgatcgcgcagagcgcctcggcgatgacggcgaggtggtcccggaaggtggccatggccggccgatcatctaatctaatctacctgcagtatccaagtgtacgtcgtgtagatgtagaggaagatatatctatatatatatatatatatatatatatatatatatatatatataattcgcagtgttggtgtttggtacggatacggataatgcttctgtttggtatcgtcgccgacatagccggaccccaaaccaaagcttatctcatatgggctttcggcctttattttcagcccacttcaaatcctctcaccttctggtcctcccctctctgcacattttcattttccccctcctccctcccgtgcgttgcagcgcctccgcctcttctcctccccgccgctacggcgcctcctctcattcccgtcgctccttctcgccatcccttctccgcctccgcctcctcctagccacgccccctcttcatccccaacagcaccacctcctcccatcgatcagagctctctccggcaatagcagggtataattcgaagcatggctccatccgatggcggcacgcatagaacgttactttacgaatcgccgtcgcctcgtcttttgcatctccactagagatccccttgacctcctctgcagtctgcagcgcctcgatccccttctccagttattcttctcgtccccctctggtgaagattgccaacggaaagactaaaggtcccaaaaactgcacgattggggaagtcaacatcgatagcagtggttagtataacttcttgctcctgccagtgttcattgtatatgatgtgcagataccaggtcttcagctaactctgagaagttgagcacattcttgtcctagctgctaaagtgggattaagtcagttaacagtacacgcctgagaattaagacctaaatcaaaaatagtaagtttggactaaaaaagatcaacaagttctaaaacggggtgtttaaaggcacttatgtatttgcattttttttattatgcaggtttcatttaagatcactgtaaaaagaacgtgtcctacaaacatagaaagattgtaagcaataaatattatagttatacaatagaaaaatgtgttgatggttcaaattcattaatgataaacaattacacgcacaattgaatttcatatatcatgttatactcatttcaaaatgcatatgaaaacaaatgggtttaaaactagcagcataatggtttgtaagtggattgagatagtatctttattacttttgcacacaaacatataaaattcagtttccaaataaattccatgagtattggattaattcgatatttgctaaaaaaaattagttgtgacaagttagctgctaaaaaaatttagttgtgacaagttgtgataagaaaaatctagaattatatgcaagttggctccttcagaagtcattgtattatatgctatagataagagtcatagaaatttacacattcttttttgttggtattgtgtctaacttctgggtgttgaaccataccaatattgttgaattgggctcctcgagtacattcatctgcactggaattccttatcaaccattagtcagtaagtgttcttccatgtcacactattgcctcaagtaaacaatctactgaaatttgtgtttaattattactttctgaggtcatagcaacaatagccgtggtaatatgaagcgttgaactgtctatcatatcctaaactaagaaggcaagtgggagggatactgtatttacatttgccatagtatgatatttatgaatgtgattacaggttggatctgtatactagactccacaccccttctctaaaaaaatactagaccccagccatgcttttgtgctacttacgatatgtttcagattttttgttgttgtacaattttcaaagttttttttagacattttctcttggtgtcaccatatatttatgatatgatattctttacatttgaagaggcagagaatgattgcaataagcataatcacattggagagcataagcaagcaatggatgatatattttgactgtcattcttttctttttttatattaactgttgtatcgatggacactaaaaactgaagagtaatatgtttaatttgttgtcagcattaatccaaaaaatcaaaagctcagtaagctgtattctgagttcaatatttatcatgtactatctcaggctgttatgtgggttttccttttacctctttggcacatgtgatggcgtaggtaatgagagtcgcgcaacacacgacttatgtggctagttgatttgatgatttcccttcccaaaatatcttaccaaatactccgtattaataaatttatagataaggtcaaaaaaaattatagattgcccaacaacaaacgatcgtgacactaaacattatgggtttaaacgatcataacaatctttcgaaaaatgcataagtactccctttcttttttttcttggagccgaacacacctaggataatactgtaggaaaaaaaatgcttgtgagcacatctttatttatcttttcaaaaattccttgtgaggtaggaggaatatagagtttctttaaaaaattattatggtatcatgtactacctcctagtattttatttactaaaaatcctaacatttttttgttttggaaaataaccacgcttaggatcttgttactactatttgatattcgagaatcaattttatacacctaggtggatgtccacctacgccaatctccatccaatgttctttaagatctgtgccacccatatcccacgcccatcaccgaatacgaatctgcctgtgcacatatctcgggggatgcatcgacggcacaacagttgggtggacatccacctatgcgatcggaataatctttctttgatattctatatatcacaatacaagaataaggctaagttatagtgtttgcaaaaaaaaaaaatatacgaaagttgtgtaaaaaaacatattaattcattttaatttttacctaatacttaactaattatgcattaataaaccacctttccaagcacagcctaagtggtggtggatctaccatcggcacgtcacaactacttttacacgttttataaatcagtccatgaaaatttttaaatatttatttaaatcaagtgaatatatatatatatatatatatatatatatatataaaagcatttgcaaaataaaacacggacattttttttacccatagccttctgttagtagatagaaaaaagaaagaaaaagaataaatgccgaactgcaagtgaccatcagtcctcaccacagttatccatggcaacacagagagaagaagagaaggggattgctttgatgaaattgtgtgtgagcgaagcgacacgtttcgtttcgttttcttggaggaaacaaaataaacaccctccgcgtgcagataaagtacatgtgaatatcgcacatgctcatcgctgcttctttcctccgacgactcgccgccgcctgaaatctctttcttgattcgtgcgctcctgagctaccccgatggccgcccaatcttccactccctcgccgcaaggtcaggtttttcttcccctctcttactgtctcatatcctccgaaaatcgtggcgctccccgtccaatcctttggatcaagatgacgcttttcttcagacttggaatcttggcgcttcttgctcgatgtttctatcccgccgattgttagccatataatttgggactgagtttatgagcaactcttctctttctgttgagagacgagggtttggtaattttgagggttagaacatgagaaccgccgaatcttgtaccgcgattgcctactggaataagcgtaagagtcctggctgctcatatcatcactaattctagcctcgttagcaagggcaactagcttttgaggcgattcagccaagacaagttcatgccctcttgtggttgtgggcacaagtccagtggctggctgcagtttttgctgcaaatatcgacaatttagaggtccatagcaccaaatgaatttggaaccaccggggagaaattggctattctgaaaccttgagttattatcttgttattttgttagttatagtcactcagattcccctgtcctgaaaatcgaactgcattcccatttgctcatgctgcagatggttctggtagaggtgaattctcagacaatttggtacttcaaaccccacagccaatgcgggaggattacatacagaatgctgttaactttcttggacatccaaaagtgaagggttctccagtattttacaggcgctcttttctggaaaagaaaggccttacaaaggaagaaatcgacgaggccttccgtcgggttcctgtatgatttactttctaccgcccctacatggctgtttgtatacctccaaatgaaaataagatgaaacgttcctgaaacagcttaatgtcttgtaggatccacagccaaacagtacagatgttgcagctgttgcttcacaacaaggtaccctattgctctacatgataaacatttagcactagcacagcaatgggttgcagtgatattatatcactgcgtttgtcttacttttggttgagtggattgtcctaatatagtattatgacataatagccaccaggctttgctatattgttgttggttaacttggacgcacacaacatgcagaagttttattggtttcactgagtttgctcaagtgatgatctattggcagcttcttttcttttgtttacttgattggaatgtcttattttcagctctttttcactaaattaattcaaattacatcaagattttagatctttagattggttctataaattattgtgctttgatagtagttcatatctgtgattgcaagtctgtacccaaaaatcttacaatacactgaaaaataaactctttttgttagcttgatcacttaaaggccgtgttattttctttgcttccagccggcatcgcaaatcaatctgctggagtacaaccttacgagacagttcaagcaccacaagccattaacactggtcctatcgttccacatgcgcagccgcaacttagctggtcccgtactctcattggtgtaggtgttttcctcggagttggggctagtgctgctgtcatcctcaaggtatatctcgtgaattttgcagactatcttaattttagcaagttcttgagaaattaactctatatgcgtgcatgttttgtacagaaattgtttgttcctaggctaaaatcttggatccaaggagcccatgttgaaggggatgaaatttctgggaatgaacttaaatccaagttttatgaagaaatcaaagcagccatacaagattctgcatcagcgttttctgatattgctaaaacaaaccaagagttgcttgcttcaaaggatgaaggtttcataattttccgttgatacattagcatgttttagcagaagaaatgtacaatagctatcactgtttcgggtttgatcgtcttaatgaatctcacttgtttatagataagaagatacttacaaagttggcacaagcatttgattcgcaagcagaggcgtttagatccttgagtgattccttgaatcgtatgagtgagaataggttttaccagtacaatctaatggaggatcattttcaatctgccccatggaatggttagaatcaattcttttttgttgcattggtttctttaaatctgttgctaatattgacgttatctgtctgaatagggccaactacaaattcatggagagcttctcaggtatagcttattgttatttaccccattgtgaactcattattcttatttaccctttctgtcaatacctttttttttaatctttgcatcattccgttgtagttctcattcggtttctctatttacagcaaacaaacgcatacaacacatcaccacgcagtgattttgactccggtaagtagcctccaccagaagcagcacaactttcttgtatcatcacctgagaatatttttttctgccttgcacttattttgtgtgccctctttcgtgttatctttatcagggaggcatccgttcatgccagtaccgggagaaccttcacctggagcatttccggcgagatcctatgttgaggtaggccatcgtatgatcatggattctaggtgcagtagacatgatagtattccaaaacttgatggtgtgtgagtacttatttcagcagcagcggatgcagaggcctgggtacggatttcagcctcagatgagcaatgacaggtggaaccctggctcgccattgacgaactaccacggtgctcctccgtatcagcagtatcaccatggatccaccaacgccatcgatgaagctccagctccagctccagttccagctccagctccaccagctgaaagcccgttccagcgtcgctgggttcccccacagccaccgggcgtcgtcatgccggaggccgtggccgccatacggcagccgaggcagcaagttgcagcggcatcgagaccgtcggaatccgccgcggcgacagagcagccacagtcaggtgacgtcgccggtggcgccgccatggccaatgcgggcaatggcgaggccgagcaagagcgggaagctgctgcttaattactccatttcttttttttttgtttgccacgcgatgcatgcgtctctcgtgtacaaaatacagactagtgacgattacctatgagaaaaagaagaggaacaaatgttgtgtattcattcactgtgggtgtgaatactgactctactgagattatactctgtctgtctctaaatataagggattatactatgtctgtctctagatataaaggattttagtcgaatgtgacatattctttttctgtctagattcgttattcgttattctaggatatgtcacgtttaaccaaaataacttatatttagggagggagggagtaatggccaagaaaaacaagatgctcgcgctgcttgctttcttgcgtaccttgtattttttttacaagaaaaacaacattattttcatgccttgttttacatgtggatctattatatctgggcgttagttatcgacaagtgcagacaatgcacatgggacacagacagagagtggctccaagtttcgtagtctgttgcatttctttgtttcctttcattttctccttggaaaaaaccaggccttgtgatggtgacatggcatctcctcctctcttcttctcttggtactccaaaaaaaaaatgtatggaaaaaaacatgccgagatgcagagacagaagtatatattatgatatttttcaaactcgtggttgttaatttcgttgctccttgtagtacaaaaacaagaaaaattcagacttggtttgacttgtggttggtcttgcgggatgtcgcaagtagggcaacacgtgaactagaaatccatgcatgttcaaagcatgcctgattatggtctcgtccatttcacagtcctactaattcaccggtcaaacctgcaattaacataataacaacatttggctggtgccttagctattcagttattcaaactcgtggctgggaaattccactgcatgcctctgaagctttgacgcactattatacatgcattggaaactgtcagatttcgagcatactgttgtgttgttttcagtctccctccacacgactgaagatcaggcacgcagatgttcagaaatgcagaagcagcttgacctcctctccaattggtaagtgcaaaattttaggtttgtacttattgagttgcacacgtaaggattggttcaactaaaaagcttaaactgatagaggaagacaagcaatttaccaaatactagtgctattagaagatacagttttaagaagaagatgaaagcacacaaatttctgtagtaaaatatcggcgaaacgcagtgcgtaactagctatagatagctcctcttttccatagtggtggcactatggactgattgaagcaggtcaaaagaaatgaaatgaaagggccagacctcaccttaatttgctgtgcatttccactaccaaaatttagagtcagtgatccagctgagtggatgcactagtatctcttcgcaagcagctgtacacgtgtcatacttctatcagatatacggagatgtgtatgtatgggttgatgagatacacacacatgtcgtgtcaagatggagtatgtcccatgtgtatgggtaattgtcatgttaagtagggtaggtcatcccacgaggccgaccggccgaccacgccattcgcctgcgaagaaagaaaatgcctgaatattcaaccacgccacaagtgctgcccacaattttattagcaataactcgttttagtttgtgcgacacatccataggcggcccactaaatctcccatttattcttccccctccttccaagtactgcactgcaatttaattactcacccaacaaaaatactactccctccatcccaaaacatgagagactgcttcacaatatttcaaagcccggaataacctaataattgcattgagtatttgctagaaaaaaatatttttttatcatacattagcattaaatttctactggatggttcgtcgggtggtggttccactactggtcgtaaggccgtaatatctcaaagcaaacaatatatctagttctatcattttacatacaattgattataacttataacacttattaatgtcttaaaaaaatttaaataaaacttttaatatactagaaaaaaaatactcgtgcgttgcaacgggtgaaggctattttaatcttattattgtttactgtgaaattttctgtaagaattcgcttgaatatatatttttcaagaaaataatgtcaagttagcatataagttttttaaagagatttctaatacggtatttttaaaaacgaacaaacttacggatatgtatttccaaaagcgaacaaacttaaaactgacttatacacagatggcgtaccaaagtactggtaaaaacatcttcagtttttataatagtagagattttataaacgacttaaaattcaatgatggaaaataaattataatgagaaaaacaatcaaaacaactctaaaattaagttttaaaacttaaattcggttgtggctgataagccaaagaacaaacgatgaagcataggagataagtatttaacccataaggaaagccagtaacatacgaatgtacgaagaatattataaatttgaccgagtttgaataaaatttatgcaagtgatgaatatgaaataaataaagtacggtacagtgatagagagggcatttcgtcctcacgttttgtttttgttttttcttttcttttctgttgggagtggcattcggaagaagaagagagaagtccatctccctcaaggagcatcggctgctggcgctgcagtccataggagtctcagattcccatctcgtcgtcttatccctccactccgctccacacaatcttcttcttcctcctctcctctgtttatatacaactccttccctcccccattcgcccgcttctgcatcccgaccagacgtcgagtcgagcattaactcagtcagggtggccatggcgctcaaggtcgtctctttccccggggacttggccgcggtctcattcctcgactccaacagaggaggagctttcaaccagctcaaaggttggatcttttcctctttcttatccccttccggatcaactttactgctctttcttgtttcttggccctcgacttgcttctgttttcctctcatcttgtttagacttcatttcgtctgtttagcctgtttcaagataatccgcagtgtgttcaaagagcacccattcctggtgccgattaaattaggcacttctactcactcgacacagccggcacccatgctgtgagtgggattaggaaagctgctgcttttgcaaggatttatgccacaattttggtttggattgcttgggctaaaataaaattggtcttcgttctcacagtgcatgggaatggcagcttctgagttctggagaacatagacacacagtcattgtaaagttgcaaactctgtgccttaactgttttgattttgacatctgaaaaggtggaatttccccggttcgcagaaaaaaaaggggtctgaattcatttctttgagattaaaaacgggttcagatttttctcttatacgggtataagacacaattcttccagaatttatgcaacttcctcttggtcgagaattatgctgttgtcagtattacgtgtctagaatcgaacccctttttgtaatcaactgggtggattaaattctgaaatatctgagcattatcttcatgcttgcaacttctatctttggaatatctagtgttctgagaatatattctgcatagattccaattcagtttctactttctagtgatatggttctattcagatgagttgcactactgtaacgtgcttttactctaaattgcttggtgcacatgaaacacgcagtctgccaaattgtcaagatcggcctcaattagctcaggcctcaggactattttttttttctgccatgtttcttgagcatattgcagcaaacgagttagcagagagttgtaggcacgtatatatgcctgaacattgattactagtactattttcattcatatatcttaatttggctgtctttattgcagtggacctcccgtttcaaacgagggacagaagagcagtttccctgagaaggacttgctgttcaatgcaacaggctccaccaccagcatggcctggtcgagccgttgttgaacctgggaggaggtcatgggatggccccaagcctatctcaattgttggctcaaccggttctattggcacacaggtaaatggaacatcaagatctaagattaacggatggaaattaatactccataccttttttatatctgtcagttgtgctagtacatcaatgtttggtcaattagttcatctaagagtaaatgtttgacctatttatctgatgatacgagttgaccctttcaagatcaatcaacatgtcttgagctattcattgaaattagttggacatgaaaatgcgacgtttatattctgtggtactaatagtgttttatcttttcttttctttgcataactaaaaagacattggacatagttgcggagaatccagataaattccgggttgttgctcttgctgctggctccaatgtgactcttctagctgatcaggtataatgattttgtgaggaaaatatcccttctttcgacctttcatggtaggattatggacatgaaagttaactgaatataggttgtttaactaagcaggtgaaaacattcaaaccaaagcttgttgctgtaagaaatgagtcattagttgatgagctaaaggaagccttagctgattgtgattggaagccagaaattattcctggtgagcaaggtgtcatagaggtgagtttttcatgtcatatttatgtttaaatagctgatgctttgctgtgaattttataaagattcaactctcatataataggttgctcgccacccagatgcagttacagttgttactgggatagtagggtgtgcaggactgaaggtaatctttctttttatattgcatattctttgctctgcttcctttaatattaggtgttaatattacaaaaactcaattatttctttgatgtttcaacaagtatattcaagaatttattgagaaagaaatgaaaatatatgtgcttgaaaattatattcccagtgttatattaccataacaacaggccattttaaacatatagtactgaaacacttggaatacatacgttattatggttacatgaatgtacttgcaatttttcaaggcgagtatgtttgaattggaagagctcatgccaaaacagtccttttgtagagttgctgattatctactcaaaagtgtctagcaatttgagattttttttaatagagttctgatgcaccaaaaaataaagtttgatatgcaacaactaaaacggtagtggtacatatatcctattcttatcttgtagaacattcgtgcatggaccgttttgtatatcaggtcacccatcataccttgatgatgctacttttagactactcaatatcttgatcttctttttggtacttatttcttaaaagtttgatttatctagacgaatgagttgtgtagccaaacgaaagaattgaatgcttgctgaagttctgtatgcatgcaaactacattaccagaatctggcaccacttgctgatttgcctacttaaatttctttgctctgccagcctacagttgctgcaattgaagctgggaaagatatagcattggcgaacaaagagacacttattgcaggtggtccttttgtgcttccccttgcacaaaagcacaaagtgaaaatacttcctgctgattctgagcactctgctatatttcaggtaccacagaaaataaattacctgtaactaattttacttggttcatctgatataagtttggtgtaaggttgtgatagtctggtacgtactcaacgttgcctgttcaaaaacctcttatacactagtggctttatctttaacacttaaacaaagtagcagtaagatgtatgttgcttgttatagtttactgttgttctattatatgctgatttgcagtttccctctactatcatagtgtatacaaggcttgcccgaaggagcacttcgccgcattattttgactgcatcaggtggtgctttcaggtaaatctactgacatacatgttatatatgtttttctactggacattggactccatcttatatccattgatgatgtcagggactggccagttgacaagttgaaagaagtaaaagttgctgatgctttaaagcacccgaactggaatatggggaagaagattactgtagattctgctacattattcaacaaggtgtttgcagtaaactttcagaattttactgaggtcatgttggcagtatttgcactaaaatgatcacttgattcatacagggtttagaagttattgaagcacattatttatttggtgctgaatacgatgacattgaaattgtgatccacccacaatctatcatacactctatgattgaaacccaggtgagtcctacagcacagctatggaaaatgtttagcggttatgctcaactgcagtggattttaaactgttaatgcatgcacacttaatcctgatatggcaaccgtattttcatgtttacgtttggcttaatattttttttcaagtattcatgaagttctgtttctccaggattcatctgtgttggctcaactgggatggccagatatgcggataccaatcttatacaccatgtcttggccagacagaatctattgctcagaggtcacctggccccgactagatctttgcaagtacaggctcttcccttaaatgctgtgctacttttgcattaccactgataattttgttcgagaatgacctcaaagaattttagctttcttattgttatcgcatggttctctcatagcccactcagattatcagtaagcttgagcagccatcctataacagttaatatgtggatctactctacttaaattcaatgaagctcgtatcgaaccttcatacaaagttcaatggatcgattaagtcccttttggctggttggttaccagtgatacgcaagtagttaacgcttgtaatgaattatgctttggttgttaggcatgaacgctgcttcatgttactagctatattttgggacgaagggagtagtaataaatttaaagaataaaaggttaataaagtaaaagaactagatgcaacaaaaaattgttaagttatagtacttaaccgtgaagaccttttttcattgcacgaagggttaatttttaatttgataatgcaggctgggttcactgacattcaaagctcctgacaatgtgaaatacccgtcgatggatctcgcctatgcagctggaagagctgggggcaccatgacaggagttctgagtgctgctaatgagaaggctgtggagttgttcatcgatgaaaagtatgacactcatcatcatcccttttcctctttccattgcatagtggattccatcgtctgattttgtttacgcacctattctctgcaattttaaaggagaattatgtcctgctgattgcagcaatgcagcaaaacgaataactggtatctaccaaagtccatagatatctcttgccctttggaaagtgagagctgaaaggagagagcatacatgtcgtcaaagctaatattctccggcactttctgagccttaagatatatcatggattataataaaccgacaacatcttgattgatgctagtaggcctgtttatatattgtaacttgctagcttagctgggggctacctattgttgtgaatgccatgctgtagccatgagaagttgaaaagagaacacatgtccttaaagcttaaatattctcagacactttctgagccttaatatctatcatggatcgtaaaaaaccagcaacgtctcaatttatgctagtagtaaaaggcctgattaaaccttggagcttagctggggtacctgttcttgcactgtagccatcagaaggtaaggtacctgttcttgcactgtcagaaggtaaggtacctgttcttgcactgtagccatcagaaggtaagtaccaaaatggtatccattggtgcaaaataaaaggtttgtttttgtcgaagggcgaattgttttctaaatggtgaatggctgacaaaacttcattgcaagttatttaaactggtgaattaatgtttccgcggctatttctttgcaagtagacattttcccgtcagataaactttacatatatataagcaaatgaatagatgattgtggttatgtttttgcaggatcgggtacctggacatcttcaaggtggtggagctgacatgcgacgctcatcggaatgagctagtaacaaggccatcactggaggagatcatacattatgatctgtgggcgagggagtatgctgccagcctacagccatccactggcctcagccctgtacctgtctagtacttgtagcaatacaaaattacagtagcattgtacactactgccgtgccagctccatgcatagtcagcagctggccactctctagctatatctagatgcgagagaattttaaggatgtaaatcatgccttcacatgaataaatcgttcgtccgtgcgttgtgtattcatgtaaattttgacggatggtcaagtaaaaataacaatggcaaattaatttagggaagaatcaaatatgtttgcgttccttttctgagccgtggatgttgttaatcagttctaccaatcgctatttgtaaaaagtttcttaaagaaatttccttcttgacatcaatcaaagtactatatataaatcttcaggataaggcacgtcgccgaccaaacagcatgcaaaccgccagaatctgatactccattcctaaccaacactggacaatttaaattattagtcgaaaggataaaccggccgacgacattcacaggctcgattccatgtcctggaaagctcagaaaagcaatcaaaagcaagcactggacttaaaatggtaccacagcttaaggcaaaatagagagagaaccgctgaatacaataatagcaagttgatatgtgacccacagaacattaatatgaaggatcttatgccatacagtaccctctctacaaatcatccaaacacaatccctgtatgggacaagtacgcacgataaacgtccagcgatagatgtaaggcatcaaaagaagctaacgatggagctgttcggcagatgatacggcttgtgtttgtagcgcagccgtggcaacaaacaagcgcagacagcaggtggtgtctagtgcccatatttctgaaattcccattcactgttatctgcaagatggaacaagagctattgatcagcacacaccaacatacttaactccaagaggaaatcatacacaggaactgcaactacctaacgggcacacttggcgagtcttgagccacctgctgatgcaatggaagtgaaaagcatgattacagacacctggtgtacacgaaagcaaatcatgttagatccagtaaagcttaagactcaacaattcaaccaagcaaatatcatatacaggaaaaccaagaataaatcagggatgaaatcaagcaccatcagaaaaggtaaagaatacatcagctatgcataaattctttgaatgttttttttaaaaaattaatccacatatacatttcttgcagtgatatttggttcatggctaacagagtatgtttggataatttacagagttttattattcaattatgaaggcagattataatatcaagggcctaggtctagagagtcattacatacttgttacttgtagtatatgcctggggaatttactccaaacaaatatcaatgattaacgaaacctagaaactggtattgttatcaaacattgaacattagaatttagcctgtcacagggtcatatctagattgccctgccagtaccagaacatacatcaaactgactccccttaagtaccatagaactacaagtctacgacgacatcaaccacacgaccaggtgtagcttcaacaatagctaatctcaaaattcttatgtctaataaagatctaaatccaaatacacatccaaatatgtctcaatgttaattgttaattcctttgttatagacaaaatatatgaaggaagctagaattccatggactcatggctgctccatcccaccattagacattagttcaagtctacaaccacacttgctttttcagttcaataaggaaccatcagcactgcaaactataaaactgggtgaacttctattacgaatactgtagtatgattagatatgagctgaggatggtcatttgacgaggaacatggaaaagacttaaatataatttcagaaacatgacttgactctatgagtaataagaataaagatgtgagcatggtagtggagttaatgcaacaaagctcaggaatatgcattgggtgaagaacgcttgggtgtcctccaatcttacctgatgatgtgttaaaatatggtttggaaccatatgcgcgtatccatgtaaaagaatacacaacttcttttcaaaatctcaactacactcttgttaacaaaaaccactacatcgcatgtagttagatttggtttcattttttttagcacataaacattttccttagcacatacacatgtatctttacactacattataagtcaatcactctctccaatttgaaaaaaatacgctacctggtatcctaaagttgaaaacacaacgattacatcattacactgagccatatccatcaagaacagaggcacagaacatgtgtagttcaaattggttagagactactggcctagtggactgacagttgatcaaccagaataacacattaacaggcatcagtcaatagctatatatatatgaatgggataattaagacattggtcatggcaaatggcggagtgatatatacatgaagatttgcttcctgaatggtgagccagtctagagaaaagtttagcatgcggcaattgaaacaaggtgtgattggttggtaaaagtggatggaagcgtaccccaagcgacagtgcactcctcactggtggcgctggcctggttcgcctggcactcgatgcctgcagccaaggaagcagattagtattcaaatcgcccttaataataagtaacagaaagaaggggaaataaaaagaacaagagaagagaagggagggcggactgacatagatccatgatgtggttgcggcagatggcgcagttgtcgacgacgatatctgaggaggaggaacaaggatcaaatcagaactcagaagattgttaagattattagggttaggggggagtagagaaggaaggatgcgcgtagggtaccccatgcccagagcgcgacggcgttccacttcttgatctcgaagcgcttgttgggcttgcgggaggaggggccggcggcagaggaggatccctcgccggcgccggcgggggcgggggcggggggcggcggcgcgttgatgtcggtctccatggccgacatcgtgagctctcgatcgacccggattcaggaattccaccagaccaggttgggattggaagatgagattttttttctttttttctttttatccctcagatcagatcagatatggactccacaaagcaggccatggcccatcatcatgcatccactgggccgtgccttctctttcaccctttcctccttttcttttccagttctttatttcggaaacaataacttcttatctattagtaatatataaatacgccctgaagtattttggggttgctcatattgtagccaaaataaattttactaaatttttgtattgtcaaaattttggtaagttgacaatattgccaagttttagcagaattacatacatctttaacaattttagccgaaaatgatatggtttgaaatgacataaatctaaacaacccctttatttccgttcgcgagtctatcaaccttttggtcatccctgctaacgtcgtcgcaccctattatatactcctatgtaattatatacaacatgcgatcgagtattgtaaccggttataccaacaaagttttctttaaaaaaattgttcatgtattgttcagttacgagttactaggacatcatatgtacatgcatattttagacgattgcagttctggcaccatgaaaatcgacaaaaaaaaaaaatcaaagcaccaccatacaatctgctctcaggagtcaggagacacatcaatgcagataacgactcattaacgcaaaactctgcctgttgggcaaaaatcgatcgatacataaggcgctgcgctgctcaaataatgatacaggaaaagctctttctacgataatgtacacgctcacgcaccaacagatggccaaaaaaaaaaaactatgtttttcgtttgtgtgtcagctctacattgcatcgtaacagggggttgaggaaacactcaacactgtacaccgcaccttgtttgtgcctgggcaaacgccaagaaaatcttctcatcgtgttcaactgcgaaaggcatcagctgtttgatgtatgtagacatgccctttgaatctttcaacaaccaaatgccactgtcttgtcattaactctactgctgtttgagtgagggcatcaattaaagaacccatcccatcccatacagtatgaatgtatgtgtgggagagcaccctgagggcatcaactaaaagcttcatgggcacatttttgccttggctcagattccatctttttgttcatagtggcatagtgcttactgcttacaaccatgctccccaccctggaaacatttggcacaaccggtccgcatctactgcatcctgtatcagttgttgcacctgaaacccaaacataaaggaatgtgtagttttgcatcaacaaatacaaacatcataaacatatatttcctctttgcaagcacacgcatcaccaagggtcaaagagtgcttggttacctggccctgtacacttctcatttcaccatcttcatatccatctagtttctgcttaacacggaggatagctcgggctgcatccttgttgccctcgcaagcctcttgcgagtcatccaagcacgagtcaatgtcttcactttcctgcaaaaatataggttagcatattcatttgctacataacttacgactgcatacttgtcttccacatagcggtgctaaaagtttacttgtgaatttacttgttatgcttgtaaaattgacagaccatttactcccgtgttttatacgtactaaaaaggctttaaagatacatttataataaacttttacatattttgatacaattatatataatccaacatattatctacattccatcattaactgcaggctgtcaacctgctgcatagaacctttatgggcataggtgtgtgtttctttaacactacctttgcctttgccattttttattttaaacccttttcaccatggcactgtagctgatgcagtaagacaaagcaaccttgccatagcatcatgacacaaataggggctcgctcctatggcattgccaaagggcttagttttgggaataacattccagcaagtttgtttgaatactaaatattggctggtactagtcataatgctgacagtccaaacagaatgtatgcccagtagatgctggttgtatgaaccctgcactggagtgcagtgaacaacattcagcactaatgggtaattccaacaactttcaatgtacattgaaaagagaaacaagatgaatcttagaacacagtagtgcacaccatgaggaaaattaatatattttcaattaccttttgacgctgtaaagccttcagtggtgaaagagcccatttatacaacggatcatggacgaagacctggcatattacatatgttaccaggggaaattgaaatattgatttttccagatacataaaaagccttttgataacaaacatacttcaataatagtgaccaacgcttctttatttgccctcatgaccgaaagagttttctcacaacaccttctaaatacaccttcaacgccagtaactcccatgccatctatcatgtccctcgtcaggcgaaatggaacctgcaagtagaggtataaaacttaattcaggctattacaaaagaaaaaaaatggaaaatacgtacgtacatataaagaaaatgacaatataaaacatccattttacgttaaaaaaaaactcacacacaccagagtttcacaaacgtaaacagcaagatgacaattttaggaatacaaatatgatgcttcatcacatacccgttcaggagttttaagcatgagaccctgttcaaatgcaacaccaagatctatgtgtacaacctcagctgtctcttgatcaatgagaatattctgggaatgacgatctccaagtcccacaatatatcctacctgaaccgacaaaattgacagccagtgcttatcattctccagtaaccagtacagatccagacaaatgatttcatatactgctcattaactacaaagattaccattgagcttgctgccacacttcttgtgtaagcaagtctactttggaaccaatctgcaggctgcaagaatctctcaaggaagaagtggtgcatcacaggcctggtattacaggacaaagaaatgtatgtgaatgccatgttttcatgtgtccccatattgtcctagtagcaaatgaatataagagataacagaagacctgaagttgttgcagactttgacaaacgccctcctcttgtctttttcctattaaaaaaaagaaatgcttttagattggagtattggacatatgttgtcatggtataaatagcaaatattttttaaaaaagttccacaagtaaacatacatttgtcatggtctccctgcattgatgatatgtccagtctccagttccatatcttccatgtgctccaccacttcttgtactgtatggaccaaaggggaaaaaaactacataaatataaagcatttgtaatgtatattgcataaaatagcaggaaccgtgcacgcagaataccttcccacaagatattcagcaagaggaacagtcccgtttacccattcaacaacaccagcacttggggtgaagggaacaacctaagttacataaactagttaaaattttgtgtaaactacaaagaaggtataatgaaaaactaagatggacatgaagatatctaagaacaataatgaaaagaaaaggagcgaatctcttgattaaattcaaattcatgaattttgtttctaccttatatgtgcgaattctcaatctcctctcagatgtatctctgtgattttgcaagaacatatttactagactgaaaaattgttccatcacctgtaaatgtactcaatatagcacaactcattcatccacaagataggccattgctgaaaaaaatttctccacgcaattcatttcaattgaccttagcagacagtgaccaaaaaatactgacagaactacaatggtagctggttgctatgtttacttcctgttgctaactcatcagtttggtgatagtctaaaaatgtgagataataacactgtaaagcactatgacaagagataaaagtatactgcaggcattattccaaaccatgtctcctttgtcccactaaacagaattgcttacggtaggtaacagatagtgttctacgatatggtcaaatgccagtagcccaactgttttagtcatactttgcactagctgttactagcaattgggtacacactagttgctatgcaaatacatgtactaatcatttccctgaaatacatatgtagtcttgctaatgaagacaaacatctagggcacttatgtggatcacaaattaacacacagatagacatcccatgatgcaagtttaaatgagcagattcatagtacataggctaggagaaaaagataaaataagaaagctagaactttgttggtacttgaaagctctcaaacaatacatggtaaatgcattcttgtaaaactttctcatgcttaaaatgtaggaataagaacatacagcatcttgtcgcaggtcatcatttccagattttgcgagttggcgatatttgttaccatcagagccaatacattcaataaccttcggagcattaattccattcattaccctaccacaatggaagagtcccaacagttaataaagatcaaaaggtaaatcttcagtcacaagtaatgggtaaattgcagaccaacttacataatagaatctgctagcccattaaaatgtggaaaggaaccttcttcatactgacaattaggatcgactggaatactagcagttacaacaggaacctaccaaaaccaaatagaaatggttcaaaaaaaaatgcagagaagtgaaatttctatggataatttgaaatggaccgccagtgctatcaataaactaaaagaatatggaatgaaggcaataatagaaaacaaaagctatcaaaattgctgtgacacaacgcatccgctagaatgttaggttttttaagtacataaaactatcttcttagtttcttcaaccaaagaataaaaaagtttataaacgaacagaacgaagcaattttgttccacctataagtttttaattcagagatttgagaggttctaccaagcactactagcatgtgatagcacaaaccagttatcccccatagaagtacaagaaaaagttcatagaagtaaaatttcccttacaagttcaagctgacaaatgctgcggatctccctaggtagtggaattcttttgttcgtgtcctgataataagatggacggcatcaatattttaacatggataatatggacaaaaatctagcacaagttgcttttgaaaagataactacctccttcttggtctctagttcagccaacttaatgtagatctcaaccatttgcttcatctacaagatgtgcaaatgaacataataaagagtacactttaacaataaatgcattttgacttccatctgagatgactgaataagaatatatagatatttgaaaagagtagcaaacctgacgaatcaaagctccatgagaagaagataaatcctttaacagattttcagcagcaagtttcttgtccatgtctacaataaaagaacttctactcctttgcttgtctttgacgcggtcaccatttgctagagccaaaagctgagtaccaaacaacatgcttaaaatggcaaaagagatgactcttaattctagagaatgattaaaatgcactgcagctgccttcaaatacataaagtacacgtaaatgagctaattgcagagtcatgtaagtgaacaaactgagaatgtgtgccattttaagcacatatgtaagtgcactaaaatatatttcattttcaagtttagaacttatgaattatatttttagatcagttgtaatgcaaaggtatttttattgccattaaaaaaacttagaaggaataagggtagagtcaagtatagatgtaataacactaaaaatgtattttattttcaagtttgacacgtttgactctaatcttattccaagtatttttttaataacaataaaaatacctgtgcattatagcagatctaaaaacataaatcataagtaataaacttgaaaacaaaatatattttttgaggaaaaacatatataattcacaatcaatccacaaaaagccaaaccaaatgcataaaagatatatataaccagctttagaagatccgcaactctggaggtggtgggatggcagattcaccatcaccaccatgtggttcttatatatagtagagatttgacaatgtttaagtgtattggatcctttcctcagtagaacttacccacagtcgtagttagacactggaacctctgtaatgagcctctaggtgtctagaatgatttcttactctcacccctcaaaaacgatgacctggctacaggtgatttgaaatgattcaaaggccccatcccagagctcatgtttggcagactatattagtatattttgccttagtgttagcggttacattactgaaatgtcatattgttttaggcattcagcaggctagttaatcctatctgacatatcatttagttcctttcgacatatataaagatcagcaactacaatacctgaaatattgtatgataaggatgatcaatggccattttcttcagaagagaagctagcgcattctgcaagaaaaaaaaaagatggcgttataagattcatgtttacccaatgcaaacaaatctctgaaagagtaagacatgtatacctggaagtttgttgagccctgcgcatcttttgagctaccaagtctagaagcaatttgatagaccaatggtatgaatttgtaggactggacctatacaataagaacatttccatgaagctgataaaagcaccaagagagtaataagtgaaatttgaagatttacctcttttgttgttttcatcattgctttcacaacttgctctcttgagaaaagactaaaccatagtgagaccaaccggaaaacctgaacgtatgtttagcactgctataaataacagtgtccctataccccgagatatacaaagagcacagcgtacaaaagaaactaaacaattttattgctgcaagcacattgtgactgaaacaggaagaactcttaacaagaaacgataacagcaatgacatataaaggacaatgggtgctttacaattatttgcaggagatgaatgcttcgcattaaatgttaaaagaataccagagcaactatgaagcatattgtgactaacacaagaaacaatactatatccgaaaatggatgattgcaacttgcaatgataagcaggaggtgaatacttcacaccatatgaaaacatttttatagtgacaacacaagcatattgtgactgaaataatatgaaacaataacaagcaggagatttcatatatgaacaggattacatattacacgacattaactggcacctgccgattcaaagattataagatcttgaaatggaaatggcataccacttgtagatcatatttcccaccgacaacgagtgagcgttggtacccctgaagcgctagattcaagaatttgtcccgatcatcctaataagagagttcagtgaatgtttaaaatagtaggtatacaatgcagagcagtaaacatgcaccatcgtatttcaaagctagaatattgtggtggcctgttctcctaaaaaatattatgtggtgtcactccatttgatattgagagttcaaatttcaagttaaatcaacatcctaatatataaatgagtttggatttgctgctcctattggcaattccaggtataaatattacaccattttaccaaaaatttcaaaaatcacttattcattttttttcaattttttgaataaatatagaaattaaagaaatgtagatgtataaatgcggaagagaggcaaaattttcagtacataaaattttgagtgtcaactttactccttaacctgtccggttttgtactggaatgcaagcattacactctcatttttctaaatcaaattattcacgcttgtccaaggatgtggctcttgtaattctatgcacatgcataatttcaaggtccaacttgtcgatattaaatactgtagatgacaaaaaaaaagggagtagtacaagacaatagcacatgatgcaggttctggataactgaaaagagtagtacaggagaatgatgcatgatagtggcaataatgtttgttaccttgctgcttttttgaattttagcgctaaatttggcatgtgtgcactgtgaaggcataaaatatcatccaggtgtttttgttagaaatttttttagaacaccgcatcatgcacacatagaaaaatgaacagtgtggttgctgtggccagaagcacaatatttgtggatatatggttattgatctggttagtactattgatatagtgcgtgatgaatttgtgatagcagcaaatgctatatttaagttggagtcaggacctcgatgttggataggtctgtgaccagataggcgtattgaaaatttgactgaatgcatcatgagaggcatattttatatactttaaactacacatgcacacctgaatcttccctgcctcttcttcgtcaagtgcaagttgtttctgtaactcttggattttcactgagtaatcagtcttttcactctgaaaattttaaggattagtatgcagtagccaacagtgcccatgctccttgacattttcagacaccatgaaaaaatgcagtgcttacctttgatgaacttttaagtcttttcatcagtgtatccagctccttagactgcattaaatagaaaatgtattgagatatacagtttcaagttcgatatcgatatgatgccactgtcaaacttagttccttaccttgtattttcttaatcgcagagctgcttgccattcgttggatgaaagtctttcctcatagcttttgaataagccatctgtgtaatgcgctagatggaaatatgttcggcactgcctagacttgtactttttgtctgggcacttgtgcaattcagtaaaatctacggaatgccttaggtagtcatcaatgatagttcttgaactacaatatatatatacatatatcacaaacagaaaatagagaacagttctcaatacatgaaacaagtgcaaagcacaaagtagaaataaatggttacttgctcgatcttgtttcagccaaccacttgccgactaatcgatagacatctgatacattcttcttatcaggatggttctttagaatgtatttcccaagatttatagccatatcatgctgcccttgagctctcagcagtttagcttcttcaagctggagtgtaaaggcaggacatgaacttcatggatcacagataattcacaacatataagcaatatatataaaccaatatgtgtaatattatcaacaaaggcagcttactttaggttttatttttccaaaccactataatattattatataggaaccaccaatcgaaaccagtgaaccagtgggcttgctggttcgagcgattcccagtttcaaagctatgataacaattctatgggcaactttagtcctatttgttttacatggattttataggaaacagggcaaattctctagaactatagagctcttttgtccccaacgggacactaatattaaaagatgacttatcaacaaatattaaaaagacaaggccgattaagaactaaatgtgtactggaaaggctacatggactgatcatttaaaaccagtactactagtacttaatttgttgggtacgaatgtatgatatgagaacagagggtaggaacctcatgtaaccatctgcgtcactattacatggttagaggctctgaggctagatcaaagaagaggagagtctaggaactttaagaacaaatgatgataatgaagtactgaagtactaatatataatagccaaacacctgaaccaatctatctgtttattaatatttgaataacacagctaacagacaaattagactaactatgctgacttaatgcaattaactgatatggtagccaacatatgcaacaagtttatcctgccttgctaaaagcagaaaggcaagtgctgctctgccagctgatggtgtgtgtagagctttgctatgtggctgatgctcacatgcccaaagccagcaacaaaggagaaaagtaggaggttaaatggcagctctcagaaatgctcttcgccactttttacaatgaaatttctcaaagtgctcatggattgaaataacaaattcaagtagctatacctttctacttacctttgggattatgttgaaaagaatagaaacatatgtttcagtagggagtacataaggtgattttttttaccttaaataggaaataagaatttggcatagcttgatgatccatgtggtaacgaagttctttgagttcatataaagcagctgcagccaaagaaaatcttgctccctgaatccagaaaaggaaccacagaattattatgagaaagagcatgaaactgtgactgcagttaaaagcagcaagacaaccttccggagtgctgaagcagattgaaataaatgttctctgagatgctcttcagaacctaagatcttaaggacggcactgcggaatgctagaaaaggttccaaaaggtcaaggttacgttctgtttgacacaggatgaaagtccactctttattcagcagttccaactacaaccaaaatatgtaggaaacgattagttcacaaggaaaattcaaatagttaaacaaggaatgttaaagagtaaagacagtggtaaaccacatatacatatgtgcattctcttcagagataaaagacttaaagttgttttctcggccaaacaaactcaagcagcttagtatggggaatgaaaaagaacatgtacatgtagctattctactatcttaggcatccaaagtgatttacaatcagtgggaggatacaaaagtcaatataagacagtgactggtctgtatcaacctcgatgcacatttgacagtgttacatgtatgtgaaggaaaccaattgtctattttgaacagaagatcatgtcagaactatctccataagaacagacaatgcatgctaaagtgttacatgtataatgctgtgaaacagtgggggtatttcttgcacatggcaacctttttcgcgaacgcttgcacatggcaacctaaaaaggttacataaatagatatagacacaacaacagttcccaaacttacatctgaaatctgaatgtaaattgagtcgcatttatttcaaacaaaataatgagagaactagccaaaatattatatatgactacaacagatgtgaaacaaacctgcatccttgtaggaacagttggaactggagaaaaatccttgtttccaacataagactttgatgtctgattgagacagaatttccatcgtaggtcccaagccatagtaagatgatctaacatctataaaataacaaaagagagtaacaatgtacctcataccaagtatcacaacaagtatatcattgtaagataacaagccagtacctgtagtttgataacagtagaatggatgtattttgtgctctccttgctagcatttgaaagagccagcacaagatcctaaaaggggataaaataataagtattagaagctagattcacaataaatccaacagagggaagtgaaccacagatgaaattaaataccatcttggagttagaaagcttcacatggaactcctcggaatcaccattctgcagagctcttaagcaactaaagcatggagaaataagttgtatatgagaagttaggtaacaggtttctattggtccgaagttagaactatttttcaacaaacccttgtttcatttatttcaaggatccagtaagccgaattaagaaagtacatgtattaactttgtaatccaacaatcaacaaagtgcaatgcacaccttctaatatattctagatagaatggcataaatagcacaattatattatgtacggatctgataatatgcatctaatatggtaaaaaatgcctaggtccaggtcgtacctatcttgcttagtcagttcatgccactgagtccttaaaattcaatcgaaggtaacaggttctacaatactataaattattaaccatgccttttgtttctcaacagtcaacacaatactaaagataataagctattctttcagctataaatatgcaaaagcattgagatgtgtaacttaagagtaaggaaaattagggacctgtgcaaatttccattgaaaaggcagtaactttgggaatgggtagaaggctgagaagagtatggaatgaaaaaggagaaatcccaatttccagctctccaagcagcttcatactgcatgacaggcaataaaaattaggccatactactggaaaaaatgttgcaggatgtaaggttatatgaaatatgtactaacttgcatatcaataaattctgaatcttgttgaagacaacttttttggttgcttaaaccttggcagtagacatcaaggacatgactacatccagtcttctgcaaagatctcatcagacctttgtgcatttgccagttcagcatcttctcttcagctttagaaggcacatcagatggtccagtcaatgctgtcccagccaaactgccatggttctcctttcgagttgatcttacaagtaaatcgtgatattcaagagcactactccaatcaccctcatgctcatatctaatgatttgtgaagttatctgctcaaagagaataataacgacaaacaagaggaaaacataactttaagatcttaacacttaaataatgggtctacacatgtatatctgatagccctaacttataagttcatacagaaatgtaccatgaccaatgaccactttaagaataacttggagttcatatagaaagtatgaacctaagcctaccaaaactcaacaaaaaatagtgagaatttttttatgagaaacctcattcgccagtgtgatcccataaatgctgtccagctcatttatgcgagtaaatgaagcaaccagtagatcaatatgtgggggcaactgtaaaaaggcaagaaacataaatgggcatgtggcaaaactacggtagagctaaaatcacacacaagaaagtaatagttgaagaaaggataagagacagaccgactcttcgtgcgaaaaatctggaggtcctaatgctagcatattgaatttttcctcacaccaaagctcaacatacattagtgttgcaaagtcacatgagcacctctgcaatgatccagaagttcaaaattaatacaaacaaaggaaacaggagaattgaggtacaaggcatttcaatcaccagtggcacatgtgtaaaaagtgcaagctcaagcatgaagcacaacaagcatttgcatggcctatagatgtcttcatggcccattgctagtccaaataaattctcgagaaaaaaaaactagtccaaataattattttgctacgtacaacgaagagtagtagggtaggaataggattgggtacaatggggtttcaggtgaaagagacgaccccttgctagctttaaggagcttgcagaacccatgcaaaacagcacaagtgttgtatcaatccagccattgatttttttaacaggaaccaaaccatgaactggaactagaatcagattacaaccctaagagttatgtggtagatgtatctttgtctgggctaagaaggccattaggattatagtgtcaaatgcaatacatgtatctctgttgagtgttgacaaggccaagtggaaaatctagcctaaggttggcctatgatgtcttgtgtatcatataatttacccatgaacaacatgtccagttttgaatggcctctaaacttaatatcaagttccagaaaatattttgaatgtaaagtcgagtctggtataatacagtacaaaggaactaaacagcataatgatgtagctgtgggcagggtagcacacttacattagcagctctggcagccacaagataatcaactgaaagccagtacacctgtcgaataaacgatgtgttaagattctggacatcagctgcaaaattttccctagcttacaacctccaatcacatgtgccagctgaaccacagaaaaatagcaggtccattgaagcataggtaaaagcaaaagctctttcatttgcaaatagccaatcaatccttacaatagcacaagaatctaccttatgcatacaataatccatctagaaagcctgacataacagcaaaaaagctaaatgctggaatcatttgctaacagtaacatcaattgaattcaagttttccaaggagtgtacaggactatagtcatttgtacttggtaatcacaatttttttccgaaagaaattagactgacaatgccacactcttatgcactgctatactatgacaataaaaacagaagaaacgtactagcaaatgttactccaggatgtgtgtgtgtgtgtgcgtgagagagagagagagagagtagaataaaataccttcttccaggaggatgatggggtggtggttggtgatcgacttttggatctaacagatctaccatcctacaaggttcaatacgtagttcaaaagacaaataaacagaaacaagtatatcaagtgctcaatattaatgatgaaaaatattactccccctgtcccaaaatataacaacttctagcattcaaaaattgtcccaaaatataacaacttctcacctacattcttttctcaaccaatcacaaccttccacaattcaaattctccacctacttttcttctcagccaatcatactttcttaatacccgtgtctaagcctaaaactccttattttgggacggaggtagtaatagagtaacaatgacattacaaataacatctgtgtattgattatgatatgataacatatatttctttcctgacacaattataaattaacagtaacagaataccttgagagtatttgaagggcaacctctggctttttctgcaacataataagacctgacaacattcagcgcatccaaaaacagataaactgacttcatcaaatgattggagtcacaaaatattttttcctccacctaaagtaaaacataagtcatcaacagattggcaataatccaaccgtgcaaccttcaagtaatcaaataacttgggatgcaacaaaccatagatgaaattaatctgcagatgccagcatttgaatccaaattgcccgcaatgttcacaagagcacttgcaagcaaaagttcagcaacctcaactttgagaaaagcaatactcctacaaagtctataagaagaacatcatttcaaacagcaacaatacagtcacattgaagaagatgtgttaagctttagttactgttacaggtgtatttctcagttgaaactggtacctcaagatgatgtcatcacaatgacaaattagtgagcccaccaaggtgcatagccattgcttgtaagtccgaccatcagttctccataaatctgaatcttcaagtgaaactatcgagccaaagtttggcaggaaaaaagagagaataataaatgtcataccatagggagcataataaacaagcactgcaccatggagaagcttgttcaatagtgttctacattatggatgctttcctaattaaacaagacattacatcaatgtttttttataaaaaaaaaaacggatgcagtgcaacacccttttattctcttgttttaccagaagaaataattcacaaattatgtgcatgtggacagaacggggatcatgagattgacccatagatttatgaatgagtgattgttttttatgaatgtgcaatgtggtagatctttacaacattgatttagagcagtgtgctggcaactattggcatagacgtgcttgagatcataaactatgactcaccaccagaaaccttttccatgcccaaaagtgtttgttcaactacctgagcatttatgcctcgtgaatgaacctatgcagtaaaggtagttaggaaattgaacttagtaataagcaaaacaaaatgacaagacaacatagtaccacataccatcagcaaagacctatcaagagaatcaaggcaatgcagagcattcagaccccttgccgttgacagaactccctgttcatgaaaaaacaagaaaaagttttgcagcacccgtaataaaatagcttccagctaccgcattcaaaatcattcatctgcgatttcgatctcaaaatcacaattgttgtttcaacaacacaattacacaaatactgtattgtattgcatctgcataaggagtcaaaacaaatatagtgggaacatttttgtgaatatttaacaaattgggtactattaagtattttaatcgagagatgtctaaagaaatcaaacttgatttgatcaaaacaagagggtctaagtctaggatcagcagatggaaaatcgcatatacagcaattggtccacttgatttctcttctttttttacaactcagcctctttgcaactaaaataataggataacctgtgcacgaccacatactaagaaattcagtaaatgaaatgcatcttggaagtaatacttgaggctccaaatttattacagtatgggcttggctgaccccgtagaaagtttaatcagtgcattctatttgtgggtatgccactatccagtgtggttttggtacagaaaattcatgatagcaacaagaaaaaagagaacagtgcttacaaatttcaaggggataagtccagtcagataaaaaaattacaggacacacctgtcatgctctacaacgttctttcaagaatcggagggagttaagagcaaaaataacactaaacgacttaccctcagtgtccgtgaagtaacatctattatttcagctgactcatcagacaaacaagctttcaaaagtttcagaagaccaaccaaaatatcatcagaaatgccatagtccgagggcaatttatcctccttggaaatatgtggttgtatgggatacttttcagtaagattcggcacatgaaatatcacttgatgcacatcagatatgccagcctgcattagtttaaagagatcgagttattgcgacgagaaaaatgcaaatcaacaacataatggaggagcatgccaatggattaagaataaagactgaaagcacaccctagaaataaaatcagcaagcaccgatgaagcttcatttgccacagacgatgagctacagaggtcaacaagagtccatacagcagaaacaacatccgggtcactgtgccaacagctaattgtgtctgcattatccacagatacatcgcctctatatatgatctctcccaataataacttcttgtgatgcatacgaagacttaaaagtacaagaatagaaggaaataaattatgttagaacaatgaaaaacaccatacctccttgaaaagaaacacaagatgcattttaacacatttacacacaattaacagagaaaccccattagaaaaggctcttagacttgagagagaattaaggaaattatacctcagcagaaacagctctggtggcaagtgaggagccctgctaacaaactacaggaagtaaaaacagtgcattagctcatagtgaatgtaaactcaaaaaaaatgagaatttaaaatagcaacctttagaaactgatctcttgaatcataggaaccagaaagtgaagcatggaacacttgtatatcttttaagcaatcaaagctaggaagtggctccaaatcctgtaagatcattaagaactaagcaaatcaatggcagattaaaaaatatgaagcaatggatcgtaaagaataagcaaagaaccaatcagaatagatggagagtggagatgagtcatactcttatgtaatcataaagcaatggatcagcatcaactgtcaattgacgaagcaaagataaaactcttgatgagtctgcaatagcacctttccctcccttctcattacgaaggcaacaagtgaccaattttggaactaagagctgtacaaagtccatttataaggagtaagcgagcagacatactatcgataaattatgaaaaactatttatgaggaccacctgaagctgcttgccaagcgcagcatcagtttcagtagaacagttcgaattgaaagcagccaacaacttggacaagatattgcagcattggtcttgcaatggttgtctctggatgtaactccccactatacaaataatatagctgcagttgaaaaagatgattgctcaaacgttaatataaatacacaagcagataaatccacaaacgatctccaacacatagtaaaaacaaaataaataatccgcaacatgaaaatcaagtcaataggccataatcgcaagcttatatgcaagccaacacatgctatcagtgtgttagtctatccagaaaaaaatgggacttgaaagaaacgacgaattgacacaaaggaagtaatattcaacttaaagtgggacttgaactcttaattagtgccagtatgtacagctagtactccttggaggttactaaacatttatgttcacataagcaacatattctttttggacaagaacatgtccaaaagtgaatcattgtacaattcctgaggccttttttttttgtgtgtgtgtgtgtgtgtttgtagcgtgcgtgtgtggaggggctcaactacaattaggaaagagaatagataaaaacactcacaaccaagtgctgtaaagagccactctatgcccaagtacatctatcaaaacctcaatggcacaaagccgatggcgaatatgcctaggatggctagcatctgcaatttgctgatgtattgccaacagaaactgcaatgggaagcaaattagatggaacttggtcaaatccaattatgatcataaaaacaatataatatgtagattagaacgaaatgatgaatgtcttgcaactccgttaaaataacaactggatgatagtaaaaagtcatagcaaaaccggtagcaacttgtactataaaatgtacaagaaaacaagtataattccccctaaacaataaaatatgttaacaactggtacgtttaacatattcaatctctattctcatcggccactgagattgaagatgggttgtttacgagataaacaatttttttagatctataccagttaacattaaccgtgacaaccaagaatacacttaaatagagaaacctaaaccttgggctctccattacagttcttgatgtcttagaaaatgataaactttatctataaaagaaaatgatataatagaaaaagacattccaattctgttttagttcagagattagacaagcatgcaacaagatgtagatcgggtaccttaaaaaccctgtctgaacggaatatattgattttatcaataacaactgtttcagccaaattaccatccctgaaatgtggaaaatcacaacaatgctactgaattggcatgtaagcattatgtatgtattgaaaatgaaaaaaagaagagtatacattgcatccataaatccgtcaacaactgttttcaccgagtgtgccacagcctccttggagaagtgtgggatttctggctgacgtgaagaagatgaaactgatagcaaaaagccaactatggaaacctagaaaacaggagaagagtgagaaaaaaaaaagtacaaaaatgtggatcggtttatagctctgtagattatcaagtagactaaactagtcagcggcggagctagggcccagcaacccggggcagctgcccgggctccggcgccgcatgcatcattagattagttctaaatctcggtgcttagccacagtatacagcagccagcatgaagcaacataagtacgttttaataatctgttaatagatgttacatacacaatcatctagagtagcctgaagcaccatgattgtttactagatcattttatctactacttgagtggaagctattagacatctgcagcctgaaggcaaagtaaattttctagcacccattatatttttttcaagataacaaattactaggccctgtttgttccagcttatgattattataatctagattattaagtctataatgccctcagctatctgttcggttgatggcataggtgggtaatttttctcaagtatgtaggggtagtgggtctttagccactcgataatctgaaaaaagctcctttagagcagcttattagattataataatctggcttatagtttataataatctgctataataatctacttgtttgtttcagcttactcctaatagctagattataataatcctaagctgaatcaaacagggcctaagtcccatagtttgcaaaaacacaaccataggtttcctctaaattagaatatgataaaaaaatgttatatgatacatagtctatggagttatatgggatctgttggcgttgttaattagacttgcccaggctcataaatatttctagatccgccaccgaaactagtcaaccgcagtggaatagagatgccaaaatgtgagcaaaggggcaatggaaacttagaaataaaaaagtgaaagtgatgaggactaaagtaatataaaattattttagcacaacacaacacccagtcataaaagaagcctaaacaatatcacttatatatgtactgtaatgcaagacatacatctgaatttaatatttagctattttggaaaattcactgaacaagagagaatgtaaatgtgccagatgacaaagttgcagcaaattacatagaaagaatgaaacagaatgcaatgcatgcagattgaagggaaaaggctattcagggagcataccatatgttttttaatgagatcatcgcgctcaggctcagaaatttcaccaagctgcaaaagggattcacataagacagtctctgctaagtccttttctggccctgagccatatctggcagcaatgcacaatccaaagatcgggacaaagtatccctttataacagcagacaaaggttgagacaaaatctgagtaagaaatacacataaaaagagagattaggaccagatcaggttacacaaatacatagaacgaagtaccatcgaaacactcaaacaaattttgaaaagggaaaatacttcacagtttgataattttaagggaaattggtgtttgacatgttacacagtatgaccactttctacagttaagttaaaaaaatcaggggtataaaagtttattaaaccaacaagttaggaccatatttaggagttccacatggagatcctagtccttaacacggtgacagttaaataaaaaactggcaagcttccagaattttagaataacaataaacacaacaaatattgaactacatgactgccaatattaaaacaaatatccattcaccttggatagccaattaagatcggcagtctcacccctcagaataaggaaagaaagtaaccatgagcagcaatgttcaatgaagttctttggctcatccgatttaaagccaaacatttctttcacctgtatatgataaataaaatacagcaaaacatatgaatgattcaaaaatatgatgaaactgaaagatttacaggcaacagcatggatcgaattactataaataacctgcttctctgacgactcttcatcaagaaaagaacgaaagcaaaacaacacaaatagaaaaataaaagcagaacagccacgaaaaatttagtgtagagaaaccttctgtaggtcagtaacttattatccttgtggaggcacgtggtttaaccattaaataatgatgtttgtatatcaatctttcgtaacagttaataaaagttcaagtctacgatgttcattacttcaatgacaaacccaggtggtttcaccaaggagaagaacaccgaaaaggcaccaactacacaccaataccttcacacaaaagcaccaacagttccaggacttgcagagaaccagtatcaggctgaccagtaaagtgaattattttttaacaaaattcaataattgacatacgaaaagcactggagcagaagattacctcaacaagcgaaactaggctcacttcacaagcaacccaccggaaaagaattggacctatcagttggtccaaatactgcaaaaaaaaaaagaggaaatcatggtataaattttattttgcatgaaccgaacaattatcctttacaataaaccaaacaaacaagttatctcaagatccaattaacatgctcacaatactcagcaaagtaacaaaagagacatgctactcaccttacttcgtgaagcataattgagcctctttgagacagaatcaaatagagcataagttaattctctgaaatggaagtagcatgaaaataagaagcaaagaacatgtgcatgcaccaatgtaaatagtttattcgtagtgagaaataccgctgagaaggctctatagcagcaacagcggaaatcatgaatacacactgcaacatcagaaataaaaggcataactctgttgtataaattaagtgcaaactgaatacagtacatactatatacatcaaagatcagaccaatacgtttatcacacaacccaatccaagagaactcagtagggtacgcaaatcaatatgacacatatactcttatttcaaaataaaagctggtgagatcaaagcatacctcaacctcaatatcctcactttgtaaggacaaatgagctagtgtaatcagagcagtttcaataataggaacaggctgtggaccaatagccaacacttctctagctctaactggattttcatttgaaaactgcaccatcttgacaccaatactggagctgttttccattaaaaaagagagtatttattaacagaaaacttggtaggctaactatcacactttctttttcctttttaactacaagacacacatgtgtgcgcgtgcacacaccaccatgtgtgcacctcgaagtgcagccgcttagcacatgcttgaactaacaaaggtcaaggataaatccaagaacctcacaaaatcctaataaagcacactcacctatgaacaagtttggatactaggatttgaaccaagtgggtggagtcatgcatccacaattccaccaccccaccaagaggtggttccagctctcacacttattataacaaacgtaaatgaaaagtcccctggatccaaacagtccctaattctaaacttctacggtgagtaaaatattttcccagcattttaaaaattgtaagcataaatcaactagcccctcgtgaataaagagaaacattttttagtttgatcaaaaatagaataagtaagtagcaattatgatttgcactgcagtaacagaaagaacatcgcaaacaacttattatttaacatatccgaccactcttacagcatcaatagcaacccatgtagaaatattggctctgttaacacatcctcttgctttgcattgctttcatagtctaaaaggtctagtatacctatctactactagtacttaaaagagtgacagtaccacaataaaattttgatctgaaattggccaatacaaagcatgagaaataatatcagtatctaatacttcagaaatgtagctcagcattattttatcataattgtttcacttaccaaacatcatggaacaactcgctgtgtccttcccatatttggaatagcacaacaattttccgagccaaatacaacctaacacggtaatcagtatcatgcagcatgctaagcaaatgaccaatcatgtcctgcaatcagaataatggattacacacacaatgaatctagtggatgtgaccctcctagtacaatgaatctggacaacactctgtccagattcgttgtactaggaggggatgtgacccctcctagattgccttttttttgggacggagggagtatttgagatggtagtgcttgataacagataaaggaaataacctgtgcgacatcagggaacagataaataaagttggagatgcaattaatcagcctgatgcggaaaaaccaatctgtgaaactgatctctgtagccttgtttagtaagtctaagaagacatcctggttctggaataagtgcgaaagaactagcagttatcacaactttaaaatagaagataaaacatgtaagacatcattttagcatgactatagattatgaactagtccaaccaggttcaccaaaagaaaacatttgggaaccagttgcccatagtaaacctactgtacaatggactgtactaaaagtttcatttttttatttatgaatgattctagccgatttatgggttttctagggaactgcagaggatgaatttgttaatgagaacatatctctaaatactgaatgacacataacatttatcaacgatagccaggactaaaggattttcaaccaccaaatttagtcaatcaaggccaccgactgtctgaagaaagtggtagtgtgctactactagatattggagaaaggatccagttacacaaaaaaaaaatattgataaatatgctgttgttcaagaaaggtgtatatgctctgaaatggcgctttaatacatcactacatgatgaaaaatcataatatatggagtatactgaccaagtgaacatcagcagaaaatgattttgtttaaattacaccttagatatttcttctaactgtatttcttgttcagcatgtatttaagtgcaaaagaactagcagtccatccaataacatgatgactgtgattgccaggtctgcaaatagtacttaattttgagtaatttaattatatctatagctatactctatactcttctaaaagaaggcaatggtagattggtagaggcagtgaatttgccaccccaccaactctattttatattttcttaccaactactccttatgtacttccatattactacaagatagtatttctatatattgtggttatctagtcaatctctaaaatctacagggacgagtgcatgcatccgtagcaaagcacatgtatttagctagttattaaaaaaagacaccaactgtataaaactagtaaaactggtgttcactcatgaaaacctataactgaaggtatgttgtcacagaacaaaagttataaagttaagagaaatatttagcgaaggctaacagaaacatgctaaattgtatcatatgtcaaatagcaacctcattggatgccactttacatccttgtgaccttccatcagtattatgcccaacatcacaattagctgtcaaattccttagcaaggcatggacatgtgctaaacaatctgcagagctaagtagtgtacaagcacttctttcccacatatcaactacaagattgagctgcatgaccgaagcaaaaggataaaatcagataaatgcctgagtggataaaactcacaagaccaccagcacaaccacagattgaagtacgatttaatggaagtcaagacagtaccacagaagataaactacttgatgaggcagagatatttgtgcaaagttcaagcaagatagcctggccaacctgcaaatggaaataataaaccaagaatacaattgaagcaaaggacaagagggatattttagtggatactactgcaacttcgtaccttgatattgacctctttgtcagctaagttgtacaagacttcccaggtatgaagcggcacaacagagaaaaaagttgaaataatacagactagttctagcttgcactccaaaggccgtggtgagatacccatacttccacttccacctgctgtgacaggatctacttcaccagagccagtcatatcaagatccatatcaacaaaactacttctgttgtcaggatgtaggtcctctgacaaactgacaaaaggcactggcaacattttactaggattgtctccatcaaaattgttcatcaaactagagaactgagcaaatagctcagaaattgcctctaagagttcatcaagtaattcggtgacaccaagcacagaactagttttgttattaactctccacagactaaataatggagaatgcatgaagctcttaaatgaggataaggctgagccagttgtgtcaaatactgatcctagattggtaagaccatgagaaagttcagcatgttccttcataaccactgacacaatatgttttatggcattggtgacataatccaacataacttgcagaaaagaagatttttcttcaaagaccctgaaaagcaacattggaataaagaactttgtgggatcaaatactcaacagatgggagagaacaaggaaaggaggggcataattacattttcataaacaaaaactagttcagaaagatctggaagtttgaacttaatctcgttttagtgcaaattatcacagattttgattatgtgtactggccactgactgtaaaaataggacggaaccaagcacatatgattataaaacaaataccttgacaacagcgaacaatgaattagattgcagactagagagcaggcataaacaagattaggtaagtccactttctcaaactgtttatttgaggacatgaatcctttggtgaactctagaagctccaggagcaagggttgctgaatatgccgaggaaggtgcgctcggctgcatttctcagacatggcctgttaaacaaataagtttaacttctgtagttaccaccaattagaacacccaaagggaaatcatatgagtaaacactatattttcataagtttgcttctgcccccaaatccaaattttgtccaacagagcataccagatttccatgctacattactaagcttgtagtagcagatacatcataagatttcccaacttcatttagcatctaagctccagaatttgagatctaaaggcccatatgttgcacgtgggcacacagatttttttactccgcgtggtcaaagtacaaattaaaacatgccatattgaattatgcatacaaaaaagacatgatattggctttcatgaagttccaaatgatctaacaggaagattccaattctcttaatgattagtgttcagaattgagatttgaagttaatcataagcatcataatgaatagttctccacatatttcagtcaaaatggcattcagttgcaagtgaagtcagatgagttgaagacttccattatgaagtctccaagtttacaagatttgccacacaatctgttggataagaaaatttattactgacttaaaaaatgaaaagaagtgccacaagttttacacgcataaatagatgcacctcactggccaagatcaataagaagagcaacatagaaaacattcagctaccaggattaaagcaccttggtaggactttccagattgatctccgatagagtttccacagaataacctagttcttcctcgtgagaccagcacttgtccttcggaaacaaatatagcaaaccaaattagaaaaagttcaccagatagaaacattcttcaggattcaactgcaacatcctaactgacagctaaacagaaacataccttagataagtttttacattcaccaaacagttgcgatgtatctgctgagttaatcactggcgaggaaaaaccagcacagagagaaaaaatggtttcaggaatcatcagaacactttgttcattcaaaagagagaaaccctgccaaaaatatcagcaattgaacttacaaatctcggaaaaaatagagaaaatattgacagcccactccagaatgtagtttggaaatggatcataatgtaaattgaaaaatggataatcactaaccacaaacacaaataaatgcatgatgaaatgataattaaaggtccaaataatgggaccatctatctggatttttttcccttttgtagctcacatttgtatgttgaactattcaagaaccattaaaattagttatgtgattcaactagtgaaagcatcacacttccattgcagaatttaagttacaataaattacttagatgagctctatatatatcacaaatatgaagggcatctgtatatatctaggaataatcagaaggaatataaagcatacaaatgtcaaataagtccttgtgatgattacagtgataaataattatgttctactgttgcctaaatgtgtgatacttgtataaagtttactgatctatcaccataggaaactatgcatccacattcaaaacactaatgcagctaaacataaatttataatttgtcaagggaaaaattgtctcagttagcaaaaagtggtcgatacaaatgttgatagtatctttgtgaaggagaggatacacaaaattaaacaaaagcataaatggaataaacaaaatacagttgtctggtaaaatataaataattaccttggagtgcactaactcaaaagttgatcttaacagattctttctaataaatatggaattggatacatcgccctgcatataatgatattgaagaacaaaagtatgctttgagcatgtttgatataaaaagaaaaaaatctgaaatacagaaagtaggagtaactagtaataatagtcaaaggctcaaagcacaatagttgggaaggtaaaatgattagctccagtatattgaatagctaaggtgattagattttgtgcagatgttcctttttctacatcatcatactagcctatcattcacaaatttgtagcagttatttctagacaggctgtttactgaaacatcaagaagaaaggtagcaaccatagaaagcacacgaaactgtggggtggttttgctctttttcaacttcggccatagaaagtacaggcaaacgtgagcatttgccaactctgtagttactttgtgtgctttcatacttaatcatccaaaaagagttacatgacagttcaggaaataacaagcagtgtattttgtgagattgctgaacaataaattagcaagaatatgaaacaattagaattatatttgagaaggatagatccaaaacaattaaacaaacattttggcaccaaccaaactttaaaaattgggaaagactacaatgatgaatgccctctttttggcttgatctggtgaatttaccctaattagtgagttaagaacatgaatccttgtcatactttgaacaaaagagttgcataagagttttggacagtctatttgtttcctaaatgtatgggattgatcaactccactactccactgtaaccataagcagtaaacaactaaaatagtgcaagacagcaagcatacctgaaaacctatctttgaaaagtaacaagcaatgaagtacagagtagacctacagtaagaattgggggccaaaacgaattgtaagtataatcccaatgtcaaaaaaacaattataagaattagctcacaatgaaatgtaagtaagtataggccaaaatgttcacatcagttaaggatattgaaggaaaggttaggcaacaatggcaaggacataacagaatgacaaaacagcataactatgagtttattacaccatgcaatgtcttccacagttcagctaacagcaattgtaaggactaaggaatgtgtgctgcattagttatttcttttcatagcggcaggataacaacctgtggtttcttcatatgcaagaaaaatataaatcacaatcaggttggtactatcctagtgcactaagagcctaagaggctcatggctcttctatttgataggatttaactctcttaattcttagtccaaggataacgccaactgagcacacatacatctactgatttatatagttcacagctaaaccaataagatgggatcaatacatcataacagcagcaacatattcagatttcatggacctctgtttactgatgtgctatgtaagcaacagtgctcaccactcactcatttctcttaacgatttcccacgaaaggaaggatattattttacattattcaccagaccatcagaaaagtggattttggacttatttggcaacagaaatttcaaccaattttctgggacattccgcagataattaggatagtggcaactgattatttatgatccaagcagaatggtgattaaacaggaagcactgaaactagtcattgttggaagttcaggcaacaaagctactggtatttgagaagaatacacagtttattttttttatttgtccatcatctctagaaatcaagatgcagtttaactgtatgcaatatattctagaataggagatatttaccgtgagaagaaagactagtaggtagggtcacatgacaatagaaaataactgacatgaaaatagcatgcaaaaacaagttaaatgtattcaggtacatagatagcactgtgctgaaggtagtttaggagctttttactgacacatgcatatctcactacatgcaggtactcctccatccaaaaatataaggatttctggagtttctccacctacttcctcctcttaacctatcacaacatttccccagttaattccacctactttcttaatacccatggtcagcctcaaatattcttatattttttaacggaggttgtactgaaaaaatgaggcaagattacaactaataaatggtcagtctcacagaaagagggcatacgtacgatgatggtaattgtttaaatatttgtaggtcccatgtatcttctgacacaaatgatgcatgaacttggtccttgaagaaggaaagcacaaaatatcaatgatatctcgaaataactataactggcctgaaattatgcacagaatatgttagagcttctgttaagataattgggaatgagaagctcacccgcatgatcatttcacccaacaacctcagaactgaatcaacctataaatgtgcaataaaataccaatcaaatttttagatgttctagaaatcatacagtgatatttcacaaccacttgggtactctaaatgcaggttatattgacaattatcattccatttttagtgttcagtccctgaaggactaaaaaataaatggagatatggtaaagagcgcaaacactgataacatcagagtcatatacactctttaattgataattcaattttagtagtagtaaacagttgtttcagaagcacagcacaaaaaactgattaggcaccttttttcaaacaagaatgttatgaacttataacaattataagttttgaaatatcataagagaagggtcaatttctgatactcacgactagagctgtggtgctaaacaaaggaagtgcgtgaataagagaattccaggtatcttgccaataaccttccaaaattgacatctgcggaaaaaaggtgattggttgtgtcatatgtgggtataactatgaacatcacaagtctagaaaatacttagtagtgatagggggaccacaagagatagtggtagattcgtataagctctttagcctcaggctaattaactgaaatgtaaatggcacagcaaaacagaaataaatttacctcgtcatttgttaaccaaaatggtggtgcatccctagcactagacatgagaagcgcagagaactccttgagaaccctgttaaggtaagtgaaagtttgacatattccacttgctagctagaatgtacagaacaatttcagtaatcatctggttacataaagcagcacagaacaagacatttaagccaccaacaaaaacaaaaggtaccatcaaaacaaacctgataagccaaagcagtgaatcttgaaaccgtagggcatttgcattgctcaaaacactgggcaaccatagaaaaaatagaacattcaatgaactatacaatgcatgctcatggtaggtgaatacctataataaaatttggtactagaaatccctagagcacatgaataactactaatgacataatactatactagtgactaataatagcatgtactccctctgtctcaaaatataagggtttctgaagttttgcacacggtgattaaggaagtacgtggaactaaatgggggttgttgtgattggttgagattaggaagtaggtgtagaagttgctatattctgggacaaattttgaacactagaagttgctatatttgctatatttcagatcaatgattgattgtcgattccaaagttgtgcagtaaaagttatccacaagagtgattttgcactatcttgcatgcatgtgcatttcagacacgctccatataatacatatctagagtgagtgtcatatactgaaaaactcaaagaacataatcacagatctacttaccaacaagcattaaataacagaaagtaaagcaggttgctattttctttaattttgcagttgccgattgccacagaaaatattacatcaacaaaaaataaggcagttgcataaccttttcaaacccttacaggtcgccttgaaccaattgatcaacaaagatttatccactcggtacccatacttgtgaataagacaacaaatagaaccactcctgcgaaaagacaaagataataataggtatacaaaatcaaacacgttcaacagatttagtggtcctcgtgcttaacaaggaataagggattacatctcaccacagggaacatctgtggcaagtgctactatatatcacaccgacgtgcaacaagtttatcagttgtaacttgtaagggggcagtgagaaataacacagcatgaggcaactaaggaacagaacagtacatgctagccttgggattcaacaatgggagacacctccaaataatcaatttctagcacatggttaggccatatgcctacaagaacatttagtttaagggtttaagaagcaacatgtcaaaattgaaacttcacagagcatgaaagctaattgctcgaaaaggtggtgtcactgataagcactgtgttggtactaacttagaaaaatgcgagtgattttatacatatttcataatatcaaaatagaactgaattggaagcagcaagtaaaaggcatggaaaatgcacaggatgaggcatgtttaataaaagagattcttgaatttcgactgtttacctcaggttttaacaaacccaaggttgtcaggatacgcatatgagatttcagagataaacaatgccttcttttgaagtggatagatggtgcataccaaacaagggatcctctcagcaggctatccatgatggcggtcataacatgctccgtctttaactttttcttgttatgtgatgtcctcggtgtgcatttgtaggcctaaatattccgaacaatttaagctgttttcgagcgaaaacagaacaatgaaatgttgcgcgtgcaagtctgagcacatgtgtgtgcaactgtgtatagatgcagatccaataccagatataaggcagtagcagatagatccatcaattcttcctggaagcacctcaaggagccagctttctcgtctcgaggtgcctcgcacctatatttattgtatttcatcagaaaagaaatcaaaatcataaagcattttcaaaagaataacagtatccctaccatactaaaccggctccagtattaaaattttggtctaattccttaatgatgacatcaagaagtttttccaaaatctcaggaatagccctagcaagttccagctgaacctttgcataggtgatgaacaagctctggaaaaagggtaaaaattgttgcttgaatacaacacaaaagatgtaatgaaggtataatcaaaattatgtaataaagatgcagtagtgcaagtcaggctatcagaaccttcaaagccctgtcgtgggtcacaggccaagaatggaacataaaatcttgaacagcattatggatatcaacagatttgcatcccaggtttggcccatccttcagtagaaaggtgttaacgcattctataagtttgcgggtcagctttccctcttccctgattccacaaattaagtttatttcagttgcaactcagaaaagcagcgggagacaaaaaatataaaaatgcaaaccattcttcttaggaggaagtgggttcaagaggagcgtcaaaaggacatgagcaaacaatacatgcctaatatttgagcatattgcacaaaacccacaaaggacctcctccctcatgatatcagggtaatcacccggtgggttttcaagtagaacgtgaagggtcagtgtacaacggaaggattcctccttggagctggcctgattactgattttttcatcaaaaccagtcgcaactttcttcatgtagagcacaacaaaacctgaaaaaatataagaataataaaggaacaaaagtgtcaatgggatgaaaagataggagatctggcaagggaactcactgctatatgttcgaggtttcatctgataccggtactccttaacagttaaaagctgcctaagaattatgctgtactctatcagaaagctgggagcatcttttacaacctcccatatatgactgaaaagtttcttagcgacggaaatcaaaagtaacgaccgccctgcagagacaatgaacctcttgtttatcgtcatacagaatgtaaaatattccacttcaaagcaattgaaaaggatgtttgcatatctggttaaacgcgaagcatactgctgggtgtctggcaagtggcaagtgagaagatgcataaataaacaagagtacatgaaaatcaggagcatcccaacaccaaaggtatgagcattactagcaggcatgcatgaaagagaatgcctgagcacctcctttcagccctcagcagtattctttattggaagttccacgcagaaatttacgagtgaacattaatgctgtcatgttggagtagacatttgacaaaaaggaacggatgcggataaaataaacgttaaattgggttaggaataggtaggcaagatgagtcggggtaattgtacacatagcataagtcatggaatgtgcaagtagctgcaaaatgtgtatctggtgagcacgatagaagattatgttgtgtgtttgtgcatcattattgagtactctctccgtttcatattataagtcgtttgagttttttcctaatcaagtttgacaaagcttatagaaaaatttagcaacatctaaaataccaaactagtttcataaaatctaacattgaatatattttgataatatgtttgttttgtgttgaaaatattaatatatttttctataaagttggtcaaatttgactaggaaacttataatatgaaacggagggagtaggcagcaggctgcccaagtttgtggggatccatgcatgaaacgatgtgaactcaagcagtgtataaaatggtggcagcgcattgcgtgagaaaactagtgagaatgcagaatcatcaaaactagttgtgaagatagatagataaacaaaagattgattaaaatcagcagcgcagggcaggttgtcatttgtaccaaagttagagagcaacctccgtgaccgtgacatacatagaaatacaaagtggatgaaaaggagggcagagagcaggaaaatgttgtttggaaagaaaggtaaccaacctgagaggcggaagtcttgagcgcactggacggcgaggcggagcatcctggcagcggcgctcttgggagagcgcttcttgccggagatgtcggcgatgacgcatttggtgagcgccatgatgaggaagggccatgtggcggctgcaaaacaaacacgaaagaatcatgagatactactgtattgtacataggagtagcagtagtagatgggagagacagacagacaggcggggagatgggcgggcttgaggttggcggtgttgcgggcgaggaggcggcagaaggagaaggcgcggtcgccttgcagccaggtgcccagcagcttcaccccctcctgcgggcgagtccatggggcgaatcaaccaatcaggcaacatccaaattcaatctaggaagggaggaagggaggggagtgtactcac

SEQ ID NO: 81643 - DNA, 17634 bp, Oryza sativa
caccttatgaaaatactacaaatctaaaaaaaatagaagaattacactaaattcttggacagaactatcattcaagatttcgttaacccgtcctctcctctgtcatgagtcatcgctcattttttccattttttttctcctctccccctaaatatttcggcagaggtagcggtgaggaatggactcatcggacgaagattttaagggtaggagcaatggaatcggtctaaggccattcactccgcagtgcatgttacctcttttgcatgactttaattgaggcgagctactcttcaggctacacatctcacaaatgcatgtgaccaagcctagcaaaggtatcccagcccaaggattaaattcctccaactaccctttctgcttatctggacacatcgcctcaagccctcgtctcctagtctaccatgccgcttcatctcccagtcagcgcgctgcttcgcctcccaatccactgtgccgcatttgccgaccactatgccccgccacagtcagttgttggcgatgaaactctagagtggactggtgcagctcctacccaggtataccccgtccaggaagacaagggcgaggggagaaagaaaaagggcaaggcggcgagaggagttgctagaacctcacgctacagtgctccgtcgacctcggctccggcggagagctcaaactcgttgattgagatgtggaccaaacctagcgtccaagttgtgattgacatcgacggtgtaccggtctgatcatccctgactgctggttggactagtctaatgccgcctgttggactagccccgtatatatgaaaggcacgggtcttttccaattaaatctggtcatgttttcctatttttgtttagatgctaaaatttggatgttaacaagagtatttctatatataatataaagttttatatgtataaactttggttgaaaagagaaagggaagtggggtgttcgtcttgagcgaacttgtctccttcgttggactcctacccccgagcccgtggggcccgcggaagctgagacgtagtgctagagctgtacacgctatcttttctctaactaaccgcgcgtcaagttcgcatctttgatctttccaaattccccgatgattaaatcacccaaccccgactaataaatataaacactagcaatcatcgtcatcatccacaaaaccctaaacccaccaaacccgcgaaggcggcgacggagcatctatcggcttctccgatcgtacctacgcgcgtgccctaaaaagctagcgccggccggcgcgccgtacgtacgtccgccatgttgccggcgatgccgtcgttggcgatgctgttcgccgtcctcctcctctgcgtcgccaacaccctcgccttctccttcttggcggtcaggatcttccgcgccgacggcggcccatccaagctgaccgcgtccagcgtccgcaggtcgaccaagtgcatcctcgtcctcgcctgcgtcgtcgaggtcgccgtcctcttcgcctccctccgactcgccgccgaccgtcacgccctctccggcgaggtcgaccacatgcgcgaccagatcgaaaccctgcgtgagtagattaattcgttaccaatttgatctatcgactttcttaattaattttagattgattaccaatttaatctatcgacttgctaattaatttagattgattatcaatttaatctatcgactttctaactaattttctcgtattaagtagttagatccaaattaatataccatattcttgaacactagcatatttaccacacgtattattatggttgcatgtaccttgggcattgcttgaaatagattactcaaatacttattgctatggatgattctgtagataaaataaatatttttaaaaataagcttaagaaataactttaaataatacaatgttgtagaattttttttaaaaaacatcaatttttagaggcatggagtaaataattcgcggatattatatttatatggtgaagtagccgaaaataattgattgggttttgtgttcttcttaattttgaatttgtagagcttaattacttgttctgaattatttaaatagaggatgagatgaatggtttgcatgtactaaatttattgggctttgtgtgctccttaattatggatttgttatacttaattaattgttttcacttttaacagaggatgatttgaaggttgttatacttaattaattgttttcacttttaacagaggatgatttgaagcagtatgagcaaccgttctctgcgttgagtgattatctcggcctcagcgtgctagagctgggtagcgccgttggacgcttacgtgagtatcatcgcatcgtttaaatagtttctccaatatgtatatggcatgccttatttaccttggcgcacttaatttgcttatataattaatcattttatgcttaatttgcattgatcatgattactacgacaagaacaagtacatctagaataaattggtttcactgagctattttatcttgaagagaaataaatacagtttcagaaatgacatgcagtccagtggttacagtgacctgagtaccacctaaagatctgagttcaaatctccataagagttcagattgggttatttgaagtctaaattccttgtttgataggctaagttcctaattttaaaaaataccattctctcttaaaaaagtacagtttcaggaatatatctgtaggttcagtggacatttagtcctgggttattatggtgattgaaaataaaactactatagcaaacactcgctatgattacatagttaaatttgtctgtgctctaaacgtttcctgtagctcctagcaaatacgcatgatcgagtattcgttgcagttattgatgctttattccaccatatgtaattattgtatatctagattagataattttagtctgcttgatatttattttacgttctttttttccttcttgtgttctttgattaattaggtgataaggaggaacatctagtcaaggaatatcgtgatctgaaactcgagattgaacaaattaaatctgatatacagtctctgcgacatgagaaggaagggagaggctaccataaggttttttctttttctgctttcatgtcgctttataaaactcttttttttccctcataccaatagctttttcattgtaattgttacacaggaaacattaggtggcacctcaaatcagcaaaaacaagagaataacgagaaaacaaagtatgttgatcagaccttttttgggggcaatttttataagttcctgttaatttattatttgagttacggatatgatatggatttataattggaataatgaatttgtctgaattttcatgttcaaccaggcaaccagcgatagatggtattatgaagtcattacgagcaaaagcaacaaagttgcagcaggtcaagataaggtagtctctgattgatgcgcattagcaatttaaccaaaataaatcaagtatataatacagaatgaagttaaaacattctttttacctttttttttcttcgcagctttccttgggagaagatgaagaaagccaagaatatattcagcatggatttcaagctacggccgtagattagtttaagaagttcccgaaaacgaatttaatctagtcatcaaacaagaaatgcagatgtgtaattgtgataattcacatttggatggtctcagtgtactttagtcagagttttgttatttatgaaccgtttttctagagtagatacctcgtggattcttcgtattttcatcctaattgtgttatcaagcttgttgtgcaaatggtatgcccttatgtcaagcataaatagctatactagaaaaaaattaaatttcatgagttgcaacggttgataacatttttagattgctatacattttactcttttattttggaccaaaagcttattcttccctttcttttcagtcctagtccactaaaatataagcaccaaaagctcattctttccttccttttcagtcccagcccactacttcagctcattctttccttccttttcagtcccagcccgctacttcttaaaatatattatttccttccttttcagtcccagcccactacttcttaaaatataagcatatgtcatatgtccagattcatagccaaaagttatgttttaggacggccaaaagttattctttcccttctttttcagtcctagcccatataagcaccagaagctcattcgtctcagcccactacttcttaaaatataagcattttctaggtatgaatctggacaactgtatgtccagtcctagcccactacttcttaaaatataagcattttctaggtatgaatctggacaactgtatgtccagtcccagcccactacttcttaaaatataagcattttctaggtatatgtccagattcatagccaaaagttatattttaggacggtcaaaagttatattttgggacggaggtagtaccttcctctgctctttcaccaaacccaaaacccacgaatggagccgtaggtccagcttgcatagctaactgtacatcaaatccctcgcatagctgactaaatctcgcatagctcactgaatctttcgtgtccatacgatgccattctcgatctatagggcttttgatacactcgatctcctctcaaatccatttatcgatcttctctttatgtttctattaaaatcggagcgattctccatctttagggcttttgatacactcgaagcttttgatacactccatctcctctttctgtttttatcaaaatcgatcttctctttctgtttttatcaaaatcgaagcaattctcgatctttagggcttttgatacactcgatctcctcttttgatttttatcaaaatcggagtgaatccgattctcgatctttagggcgatctttagggcttttgatatactcgatctcctctttctgtttttatcaaaatcggagcaaatcataggaaaaatgaggaggggtagtggggaatcgatgaacgcatggtttggtcgggcggcaaaaaaaaacatggcacataaaaaaacaaacaccgtgtacgcatatccttcggcgtgcgaaaaaatacagcgtaaaagaatagcgatgaaaaaaaaacaaaaccgaaaaaaagggtaaatcccggctgatggaaaaaaaaccaaaaaaggcgaagacaaaaggcggacgaaaaaaagccgaaaaaaagtggacggaaaaaacagcgaaaagaatggactaacggaaaaaaataaacagctgaaaaaaagcatacaaaatagacagaagaaaaggaaaaaaaggaaaaacgagagaaaaaaagggaaaaaataaaaggaaaaaccgcagcaaagaaaaaaggtggatgaaatatagaaaaaaaggacggaagaaaaggaaaaaaagggaaaaaagggagaaaaaagggaaaaaataaaaggaaagaccacgacaaagaaaaaagacggatgaaatattttacggaaaccttgtgtttttttaattaggtatatatatatatataggtatagatactaaaaatgtgacgagtggtctaacaaaacagttcatcttcccattacgataaaatatctcactgaatttatagtgaacttaattattattcttaggattacgaaaatgtacaaaacgatgatttgtaagaggaaaaaaggaaaaattaaacacatgacctgaatttgttgacaacaaattaagacttgaaaaattacatagcttatccccttcattgtgaaatataaacagttttagttttatactaagtcaaattattttaaaattaattaagtttagtttatagatgagagtatttttcctccggtttttttacaaagtatttgcaaacggtaaaaaggtgccttcctgaagtgtattagagcattaccaacagcttatcatcctatttccttcccaaaactaatttttagggtttttgtaaaaaaaacagatcaaacagatcctctaaagtcctgcactagttttatatttcgttttgtggattcgagggcgagagagcgactcccaatctcttgttcatgcgtctctcctccttccccatgcttctcctctctttctgtgtaagcggagaaaatttatgtagggagcgcgcggatgatcgcgatctctttctgcgagcgtggaaggaaaaaaaacaaaaattttcgttggtagtttaacagaagggtccagttttagtttttttttattgaatttaggctatgtcttggagggataagttttttcacttcctattttcagtttaggaaacccaaaaatcaatatgttggtgatgtcttacatcgtaaatggaagtataaaacttttgttccctttacactactggagaaatcatctttgctgggttggtaaaaaaatatattagccctggttccaatagtaaccgggactaaaaaaaacatttttagtcccggtttaaaactccaacgggactagatgacctttagtcttggtttaccctcttatagagtctctgccttgtcagagggttatcaggggctagggagccgagaatctttagtcctagttggtgttaccatccaagagtaataatgataaaagttaaagttgtcgtttatttaaaaatgagagattaacatgtaccacgtcaaataacaaaacaatgaaaacatataatcgatataatgattctcatttcatatcttaaccattatattttataaacccgtcgaaaacttacgatagttattttagaaaaaattcgcttttatattttaaggatagagggagcaccgttcttgtgagaatattggtaccggtagcctgggactctttattagtaccgatcagccaaccaaaaccttgtgttagattaggataattattcaagacggcgtgtcttgttagcctttcttcataaagctccgcccatggacatatcggccaggcttcttctgcgattgaaaacgacgcaggcgtctctcatgttaaacattcttttgtataggatatagcaggtgatttatcttgtacttaactggtagtcgaaattttggcaatataaaaagggtaacgaataagctataaagtggatgggttaggaggcaaagctctatagatactctataatcataactgactaggactacgggacatgatataaaagttaacataatacccgagtccttatctatatatattctatccatatgaactatcccctataccagtcggatagcatagccatatggatatacggtatccataatctctgatgtggataagggttctcggtcttccgaaaggttatcgtggagattatgactaccgtatatccacatggcaatgctatccgactattataggggatagtttacgtatatggaatacgtatagataaggattcgggtattatgtatacttgtgtatcaaggtaatgtctgtagtcccagtcggttacggctacagggagttctagaccgtaagggatagagttccatattgtgatccgagctcctctacctatataaaggggggtcgggacgtccccttagagtagatagaacatcatacacaatcatattttccatcaatacaaacacggtgaaacatctcgccggataggagtagggtattacttcttattgagaaggcctgaacctgtataaaccctttttgccatctaacccatccactttcttagcttgtacgcaaccccttttattattgccgaaatctagtttcgacagttggcacgccaggtaggggtagcgtcaattttttcgccgactagtgcgatgggatctacatcaggcattgacgaccttgccttacctcctggccaggcgtaccgcttcagcagcctcgacttcatcaccgacaacttcggcaagatatctcttctcgactcgaattcgaaccagtcaggaggagacgacgactcggctccgttcggtctcccgaactcggccaagatctactccaatacgttttctgccgagttgaccacaaaccacccaggcgaaagcatcaagacttcaactccttcaccaagcttcgtgggagacacgccagcatacccggagatcaccatgcgacttcccgatgatcttgcatgcatggtgttcgactctagaggatccccgcgctctcccccgtaggactcggtccgatctagcctcggctcagattagatctagcttcagggaagtcggcgtcatccttcagccactcaattcgtgttcatcgaccgagatcgccgagtacatcagcgagtctgactgtgacttggccacgaatatagaacacatcaactatggtgatttcgacgaccacttcgacttcgacaacttctcctgctacgacggctactatgacgacttcgacgacgactacacacccctttattttggagtgttcatggccgacaatgagacggaagcacagaaggtagcccgactagcggaagaagaatggcttaggctagaacgagaagaacaagagcactagctcaaggaagatgaagaccgccgacagtgagaggacgaggagcgtcgacgcagagacttggccaatcgtgggcgtaatgtccaacagcgtattgaccagaccatcgtcgataacaccaacgttttcctcacaccacagcagaatgcagttgctgctggacaccattatccctcaagccccggtgcatctcacgccaacactgaataggatgaaaactatgatcgctgcaacagtcccggatgacttaggaggcaacaggcaacctgtcgacgttagatgtcgcgattccgatatttgcacagtatgaggatcgttggtactaggatatacgcgagacttaggtaaaagagacggagacaaggatttttatacaggttagggcccctgaattgtcaggtaataaccgtactcctgttggccgaagccggtcgttgctcttattcatcataatcatgccagtacaatatttggggtagcctatctatatgttgtcgacttggcggccataaaaacatcccgcagtcgacaatagagtagtcttcctcctcgaatccatgtccggcgagatcagagacagcactagatccctcctaacagtagtcgtaggaaccgtatggggactactaggcttatctccaatgttgatatccggcggcttgtcttggcgtatgttggcttgtatgttgatcttgtgtcttgatccattgttccgtgtcccctctcctcctagggggccttgtatttatacccataggtgtccccttgtccaagtaaaactagggaaaccaatatggatacaatccgagtagtccttgtcatttccatgtagaattctattcatccttccttatgcggaactcctcctatatccgaaggttttttccgtataagacatggtatgtagtgggtcctaccgagatttagtcaactactattaggtatgtggtatccataaccctgacacaaccaacagcttcgacacacacacacaccttcaggaagccgactgccctccatacgctcgggagatcgccagcagcccgagtacagccggattgactcccgactgccccactcgggaagacaccattaggatcagtctgtacactcttcagctcgcgcgcgaaggaatcaacgagcgcactcggaatatcagagttcctcccgagtacctgatcttcgagacacactcaatgcacgatgccgagtacgacacgaagggtatcatcaccgagagcgacgccactcacccgacaacgacgatgaaggagtcaccgccttcacaagcgacctgcgtcgagtgaattggctagctggcttcaaaccaactggcattgagaagtatgatggcaagactgatcctgaatcatggctcaccgtctacacttgcaattcgcgcagcaggaggagacagcaaagcaatggccaattatttgcctgttgccctagccatctcggctaggaactggctcgttgggttaccgcgaggctcaatcagatcatggggcgagctccgcgaccacttcgttgcaaatttccaagggacctttgagcggccgggaactcattttgaactctacaatgtgatccagaaacctgacgaatctttgagtgattacattcgacgtttttccgagaagcgcaacaagatctccaacatcactgttgacaacattattgctgcattcaccaatgatcaactcatcggcaagttcgaacgcaaacctcctagaacggtcaagcagatgtatgaaggcaaaatttgccacaagacacgcaaagattatggtctttgctgtgggacacccgaagatcgtgtttttgctcgtggacaccgcaaaaatgtggtaattagctagaggacaccagccgcattattttattatttgtcgtcgaaacggagagagaaatagcgttgaaagtaccaaaatgcccctagacactgttcttcttccttctctttgcttctcttctcttcttcagcgagggagcataatccccaacttcaccggcacgttggcggtgagccgctcctggtgaactgtcgtcatcgtcatccaaccatcaccacaccaccacgtcctggtcgtctccaaccaaccaaattcttgcacacacacacgcttgcacgcagctccatcgagctatggctggagtgaacaacaacctcgtcagcctcaagcctgccgcggcggttccgcagtcggtcgcctcgtcggcgctgccaaagcgcgtgcacgtcgcgtttgtcacaccctaaaaatccccatgtataaattgttgtttaattggaattattagaaatgattttaaaagcctacaagaaaagatctaattttaaataataaattccaatataaaagtgggctagataaaattttattaaatacttctcttaattctatagttcctagatttttctgggatttatttgagccaagaaagtatttttaataaatggaattgcatttcatgaataatttaaattgaaaaaggttttaaaaatcttccttttggttttgggcccaaaaccccctccctctctctccccggcccaatcgcgcccgacctagtccgccgagccgagcagccgctcgccctcctctctcccgctgacagatggggcccacctgtcagggccgtcgttttcctcccgccacagccgcgccctaacgcgcgcaagccaccgctgccacccttccaaattcgaccgctccttttccgatccgatcgaatcaatagaggggaaatgatcctcgggatcccttctatcttttctcttttggaatcgtcgtctaaattcgtttggaaatcgtgggattcgagctcgattcggattcctttttccacccgaaccctaaaccttccatcgccgtcgctggtcaccgtgggcctccatcgccgccctctagccctttataaggacccctgggacctcctctgtccgccgtcaccctcgcctcagctcgtcgccgccagtagcgccgcctccgcgtttgcccttgcgccgtcgtcgccgccgcaagtccagccgtgcgccgccgccgctccatcgtcgtcgtcgctcgggaaggccaccgtcgggttcgccaggtcgtcgccgtcctcgtccacccctccgtttctgccaaggatcgccggagcaccgccgtcgtcgtcgacccgatcgtcaccgccgcttcaacctcgtcgtcgtcgccgtcgccgttcggttgccgtccgccgccgtccgtgcctcggtaaggttcgccgcgtcacccgctacgtgtagatgccctccgtttgtgccgccgggccgtcgatcgccggcgagcatgcctggccgagccgccgccggtggtgacgtcatcgccgacgtcattgtcgacgtcagccgtagaccgcggtagaccgattcgatctcggccgttcgtttccttataccgtcccgtgcacccggtccaccgtgaacccgagccgctgacacaataattcctttttccttttcaaaaataattctttattgcgtcataattcaattaaaatctatataaatgatttaatccgatttaatctttaaaaattcataactaattcatcttagctcggatttagttggttcaagtctctaaatttttctaatattgagatctacatgttaaaaatatccacatgtactgttcatgattgtttatgtgctgttttggtgatttttctcttttctgcttatattccgacattcccggagagtccgattttgcaggagaagactttgaagagttccaaggccaggaaggcaagtcacacagatcccaaacacccctttgagcatgttgatcccgtttaaagctattgtttctattcaactattgcatttatttctgaatgtcattgggtgggaataacctattgcttttgttatagcccttttgctattgattacctattctttgtcacttggttaataattggattagctagaacattatatggttttagctaaagtgattaggatgcttagccatgcttagagacactagctcatatatttgggataacttatgattcactattatttaatgatggcttaatgatagctcatgatggttgatcgtgatttgttaattaattaatttgtcaactaaaacctaataatggtgggttgtgagcacatggttttgatggtcgtgctcatgacaattaaggactggttcacggttttcggttgtgaaacattaaccgtgccaaccacaagccagcgtgggcaacggctttactttctgtatagtatggttcattatagagcaccagactgtgaagtggcggagataagcccacgggggtcgctggggagtccatgccttgtttacaagggggtgattatgatccgggaatggtgcactgctttgaattgtgttatgcagagggtattgtcacaatctctattcgggtacttgttaagtatcgcgacgcatggttgacatgatgttgaggttgtgtcttgtgggtacagtggtacacctctggctagagtaaaactattcgaatagtcgtgcccgcagttatgggtgggtctaacaatgtctttcgtgattagtttcacacctctcaccataataaatgatgctgtaattggtaataatttgtgtagctcctggtttggaatgttacattcctggtttggagatagaactgtgcagtcgggaatggttgttcagaatggttggacctatgcaacgggtatgttgtatagtgttggattaatattgtttaattaataccttactgttttattaaattctgaaatatttattaaatgccgtttatgcaaatgagactatattatgccatcctttgttatatcttgcatttgcatatttgctgcgtggcttgttgagtatatcctatactcaccttgcaatcattcatcagaggaggagtgctacagtgatgttgatggtgtagaggattaggcgtagccctggtcaagctgcttgtgggatggagtcgtctgcgccgtttatcttattttccgctgcttagaactttattatttgagaggaactatctacctctgtaatgacattatattcgcttattaattagagtaataattgtactctattatcaatctattatcaatttgttattgtgtgcctcggctaattcctggacaagggtttatacacatgtaagcgtttgaaattttggatagaaattccgggcgtgacaggtgccgcccaagctggagcagcagggcggcggcagccgcgccgcgctgctgggtctcgccgccatgttcgccgccaccgccgccgggcaggccgggcaagccagggccagcgtgttcgacgagtacgtcgagaagagcaagaccaacaagatgagaatgtgagattgatcgatgattcgttaagtctcgggttataattaattcatgatttcgctgcttcgatgagctgatccatcgatcgattgattgatcgtcaggaactgaacaacaagaagaggctggcaacgagcggcatggatctgcttgttgcccgtggccgcctatcgctcccgctccctgcctccacgggcggtcccgctcccgctccgtgcctcatgcgtgcctcatttagcagcaccgcccgtcttccagtcgcgcggtggcggggtacgcggcagtgttggccgatgcgtcgctctgcgtgcgggacgctgtcaagggctgcctgccacgcgctcgcgctgctcgtctcggacgccgccgccatcgacattgctgaggaagaagaggaagagagaaagagaggatttgtgagattgacaagtgggcccatgggtaaacttgtctttaaccattgtttctctctccgtttccaccgaaaataataaaataatgcggccggtgtcctctagctaattaccacatttttacggtgtccacgagcaaatacacgatcttcgggtgtcccacagcaaagaccataatctttgcgtgtcctgtggcaaattttgccatgtatgaaaaagccaatgaatatgacaaggtggatgatgtggtcaaggcctccaagcagtcggctggtagttggaaacccaagaaagacaataatcatggagctagtgggagcggaacaaaccacaaggattgcaagcgcaagccggaggacctcgtcggtaccacttcaaatttccaacaccagcggccccgagtcaatacttatgatgagataatgaacggtccatgcactcatcacaccaattccaagcatgatgccaaggactgcttcatctacaagcaatttgctgaacaatatgccgcccaatccaagaagccgactgatggagaagccgggacgtccactcggaagaaggatgacgcagaactcggacaaaggcgcttttcaggaccatagcatggagcttaatcatatttttggagggccactcgcctatgaatccaagagaaagcagaagttgactgagagggaaatcaatgccgtacagccgacaacaccatagtatttgatatggtctgaagtcacaattcggtttgactgctcggatcatcctgaccgagtggcccacccggggcggtaccccctggtactagacccagtggttcgtaatgtcaaactcaagcgagtccttattgatggtggaagcgcactcaacatcctcttcgccaagaccctggatgagatgtagatcccaagatctgagttacgaccgagtactgcgccctttcatggagtcatcccagggctgtcagccacgccactcagccagatcactctaccggtcacctttggcactcgggagaatttccacacgtagaatatttgttttgaagttgctgacttcgagacagcatatcatgccatactcggacggccggcgttagccaagtttatggctgttccgcactacacctacatgatgatgaagatgccgggtccgcgaggagttataccccttcaaagcaacgttaagtaagttgttacctgcgataaagaaagttgtgagttggcccaagtccgggagaaagaactcaaccgagaagaaatccgactggccacgtgctcaacacccgaaggagaaatgcctactaccaaatccctcaagacaggcgaaggcgatgcaaagacaaagaaaattccacttgatccctctaattcttctaaaattgcagtaattggtgctgagttagattgtaaataggaaagcgtgctcatcacctttcttcaagctaataaagatatctttgtgtggaaaccatctgatatgccgagtattcccagagaggtgattgagcattctttgaatgttagagaagacgtgttaacgaccaaatttggtaaatcacacattggatttgaagttagaaccgaagcggatttggaggagcttggcggttgcggaaacagagtgcaaatcggttgacaactgaatcgggtatagtgtacatcggctgaggcagaatcggatcaggatagtcgatgtagccgattccaataaggagaaggctggatcattgtcggattcggttggagtgcttcatgaggattgccatgtgcggattgagtccggagaaggcaattgtatctattaattaggatattttcttaatttccttatagatattgtcggttagagtttgtgttagggagttttccttaatttatgttgtaatagagataggagtcgtgtctgacaaggacatcttatgtaattttgggtataaaaaggacccaaggttgtgtaatcaaaataacaatcagttcaataacaatctcggcgcatcgccaccttttacttctttactttcgacaagttcttgctttcgagttgggctgcatcggcttcgatctccagcaggaggtaaaacttgttatggcgggttgtgttctcgggattagtgcttccatctttatgatactctaatcttgtttatgtaaatcgtcgagtttcatatatactatataatctagatgaatattgattatatgaccccatcggctagtatctactgtcagaagatagccgatagggttatatatcaatgttgttccagattatatagtgtatctaccatctcaaaaaggttctcattaacttgattgtctagatattgtgtttctttacatacttagtgctgcatcagttaggtttgatctactaagttgtgtttagaattataatctctagcgtgtttatggttgctaatagagatagcatcgaggtttcagccggtcttacctgatttagttatcttgttatcttgatatgctaaatctatccgttatattgagatcttaccataataaaatatattaagctttctgttaatctagttaggtcatcctaatatcagatcaatacttatttaatatattttgtttataataatatctcagtatagagtggtatcggagtactagccgatacatgttagatttgcctaatcggctatgttatgaataaatataatatctgccttaatgtatatttacacataagtgatttatactgtctcggcgccctgtccgatctatcccaatcacttagtttaagtatattttgagatttggattatattatattgatatctacagccgattgagtaaatttaatcttctttttctttattcatcatagccgatttgatacatgttatatcggcttaatgctcaatgatatgtcataagcaaaccagtcgatcggctatcattgaaggactcatttcgttttctttctatatttcttattggttgcaggatcaaaccaattggcatgcctagaacccgaaagcaatatttaggacctgcactagagttaagcaaatctctcaggccaatgtgtgtttttttgcatcaacacgcttttggcatgccaggtgggaccatttcttgaagaatttgctagatggtggacacaaagacatctgatgttagtccagacaatgtcattccaataacaatggacaaattaacaccagagcaaaaggcagaatatgaagatctgatgaataagctctaaaatcaatacttgcattcccttgttcagaccagatcaggaacagtaattcagaggtataaagtaaatcttctaag

SEQ ID NO: 81644 - DNA, 17890 bp, Oryza sativa
gaagtcaagcaggaagaaactcctgaagaattcaagagtttacaagacaggattgattatgctgtacacaatgctttgatcaatcaatcaggagtgcttgtcaatactttgacttatatgaccaagtctgtagttgatggtactattgctgaacatcatgccaaggggccaatattcttgccagagggagtttttccacaatacaggccattgataaccaatcagcaacaacccgtgccaggactagtgccagaacagccgatatcagcaacatcagctatgattaagcaggaggtgtcagcatcggcacagaatcaacctggattcaatcctcaagttctgatgagacaacaacctcaacacatagggcagaacattcctagagtttctcctaaacaagttgcagctatgtttggccctaatcagtcagttgttcagccgatcttgcagacaccaacaaggcagcaagtaccaatcccacagcagcaacctgtcaatgcccaatttacccctgatcaacaagcttttatggccaatcagttgcctcaaagtcacataaggggtaataccaactaccaatttcaacctcattcacctcaaaggtagtatcggctagaagcatcacctcagcctcagtatcaacctcaaatcggccagttcgagccgatgcagcaacaagtgcaaggaggacagaagccttgggccgatatgatagccgatgtaatgagggagcaatttggtctcaagccaaaggatggtgacaatctgtatcggcatccatatccagaatactttgaaagagtacctctgccaagccgatacaaagtcctcaacttctctaaattttcaggacaggacaatgtgtcaacctacgagcatgtcagccgatttttagctcaatgtggtgaggcatcggctactgatgctctaagagtcaaattattccctttgtctttatctggatcggctttcacatgattttcttctttaccatacaacttcattcatagctgggccaatttggaaaaacagtttcataaattcttctacagtgggattcatgagatgaaactatctgatctgacggcaatcaagcaaaaacatgaagaatctgtccaatattatattcaaaggttcagagatgtcagaaatagatgctatagtttggccttaacagactctcagctagctgatttggctttccagggcttattatcaccaatcaaggaaagattttcgcctcaagactttaagagtttggctcacttggctcagaaaatagcaacgcatgaacagaggttccaagaggccaagaaagcatttaaaaaggttaattatatcagcccttatgtctcttaatctgaagaagaagaggatcctgaagtagcaacagccgaatgggtgagaagaaagaaggtggtttcatgtcaatgggttaagaattctggaaatgaagaaagatatgactttgatatcaccaaagctgacagaatttttgatttattgctccgggagttatagattaagctccctgctggtcatgtgattccatcggctgatgaattaggaaagagaaaatattgcaagtggcataatacaggatctcacagtaccaatgaatgcaaagtttttagacagcagattcaattggccattgagctaaggtaaaatcaaatttgatgattcaaagaagccgatgaaaattgatggtaacccttttactgtcaacatggttaacacaagtaggaagatagccgacagaaagaaaaatcggcttgattctattagaatgattaacaaatatcagagaagatatgatcagtaggaggagcaatatttcagggatgatgacagtgttgatccacactggagttgtgaatttttcaggttttgctggaatgaagggatgagactgccatcagtacgagattgcccaggttgcagaaattctggggatcatagccgatttcattctagagaagatcggtttttacagagaaagttgcatgttcaccaaaggttgggccctattcatcaagattatctctaggaagaagttgctgaggaggttgcaaatccacaatggtgtccttctggtattttttccaagagtcagaagagaagggttcaaagaatgaggaacatggagcaatttcaagaaaatcaacaagatataggtcgacggctgaaaagagcaaaaacaaaacaagtttggcgtgttaaaagcaaagtggtgtcagccgatgagattaaagccgatgaagcagagagattggctaaaggaaaggctattgcttcttcatcggttaacatggtgtttgtgttacctgcagaatttggaattgatcaaaggcatgcagacatcatggaggaatcttgtgctcaaatgattttgtcaccagaacaagctatctttgagaagccagaagggacagagaatcggcactttaagccattgtgtgttaagggatttgttaatggcaagccgatgtctaaaatgttagttgatggtggagctgctgtaaatttgatgccatatgttacattcaagaaatcgggcaggagtgcagatgatctcatcaagactaagatggttcttaaggattttggtggcaatcatacagagactaaaggagttttgaacgtagagttgacagtcggtagcaagattgttcctaccacattttttgtcatcgatgggaagggttcatatagcctgctgcttggaagggactggattcatgctaattgttgtattccttcaaccatgcatcacagtttgattcaatggcaaggtgacaagattgaggtagtcccagccgataggtcagcaaatgttgccaatgccaatttaactgtttcggagatggatggtattgattgtttgtctggaaaaaatctggcaaggagattatttaaaagtgtctgattgtgatatccagctagttgaagatggagaaccccaattgttgctttgagggtgttgtggagggttcaaatttctacaccaagaacactgtagatgatctcgatggcaaattagggcaagctttcatgtcggctgataatttggaagaagtggatattggtccaggagatagacctaggccgacatttatcagtaaaaatttatcatctgaatttaaaaccaagttaattgaattattgaaggaacatagagattgctttgcttgggaatattttgagatatcaggactcagccgatcgattgttgaacatcagttacctatcaagccaggatattggccacacaaacaaccacctagaagatgtaaagccgatatgtatgatgcaattaaagctgaaattacacgattatataatgttggttttattcgtccatgccgatatgttgagtaggtttctaatatagttctagttatcaagaaaaatggcaaacttagggtttgtattgacttcagagatttgaataaagctacatctaaggatgaatacccaatgccgattgccgatcagttggtagatgctgcttcagggcacaagattataagttttatcgatggcaatgctggatataatcaaatttttatggtagaagaggatattcataagactgctttcagatgtcttggtgcaatcggcttatatgaataggttgtaatgacttttggattaaaaagtgctggagctacatatcaaagagttatgaattacatttttcatgatttgatcggcttgttggtagaaatttatatcgatgatgtagtggtgaagtccaaggaagtcaaaggtcatatagctgatttgagaaaagtttttgagagaacaagaaaatatggcttgaagatgaagcccacaaagtgttcttttggtgtatcggctggacaatttttaggttttcttgtgcatgagaggggtattgaaatgccacaaaggagtattaatgctattcagaagatcaaacctccagaagacaagaaacaattgcaatctttgatcggcaagatgaattttattagaaggtttatttctaatttgtctgggagattagagccatttacatccttgctcagacttaaagccgatcaggaatttgcattgggggcagagcagcaaaaggccttggatagtattaaagaatatctaagttcccctccagttttaatttctccacaaaaaaggggtgcctttcaggttgtatctatcggccgatgtgaagtcaatcggctcaattttgactcaagagtttgaaggtaaagagagggcaatcttttatttaagcagaaggcttttggatgcagagacaaggtattcttcagtggagaagttatgtttgtgcttatatttttcgtgtacaaagttaaggcattatttgttatcaaatgagtgcactgtggtttgcaaagccgatgtggtcagatatatgctatcggctccagtgttaaaagggagaattggcaagtggatttatgctttaaaagagtttgatcttagatatgagtcacccaaagctatcaagggacaggctatagccaattttattgtagagcatcgagatgattcaatcggctcagttgaaatagtgccttggacgttgttctttgatggttctgtttgcactcatggttgtggcatcggcttggttatcatgtcaccaaggggggcaagttttgagtttgcttatactataaaatcttatgttacaaataatcaagctgaatatgaagcagttcttaagggtttgtaacttttgaaggagattgaagccgatgctattgaaattatgggtgattctttattagtaattaatcaactagctggagaatatgagtgtaaaatgatttattgatgatttatcatgagaggtgcaaggaattgatgaatggatttcggttggtcacattgaaacatattcctcgagagcagaacatggaagctaatgatttggctcagggggcatcaggatataaaccgatgatgaaaggtgttgacatagagattgctgcaattacagccgatgattggagatatgatgtgttcaattatttgaagaatccttctcaatcggcttcaaggaaattaagatataaagctttgggatatgttttgttggatggtgaactatattataggacgattgatggagtattgctttaaatgtttaagtgccgatcaagctaaagttgtaatgggagaagtacatgaaggaatttgtgatactcatcaatcggctcataaaatgaagtggtttcttagaagagttggatatttttggccgacaatgctggaagattgctttagatattataaagggtgtcaagactgtcagaaatttggagctattcaatgggcaccagcatcggctatgaatcctataatcaagccttggccgtttagaggatggggtattgatatgatcggccagattaatccaccttcaagtaaaggatataagtttatattggtggcaaccgattatttcactaagtgggtagaagcagtcccattgaagaaagttgattctgaagatgccatccagtttgtcaaggagtatatcatttaccgatttagtgttccacaaacaatcacaactgatcagggatctatctttgtgtcagatgagtttgttcaatttgcagagggtatgagaactaaattgttaaattcttcaccatattatgaacaagccaatggacaagcagaagcatctaacaagagtttgatcagactgataaagaggaagattgtcgattttccaaaacaatggcataaccgattggctgaggcattgcggtcatatagaatggcttgtcatgggtcaattcaagttcctccttataagtcagtttatgggcatgaagcagttttgccatgggaacatgtcatcggctcaagaagaattgagttgcaagatgagctgacagccgataattatcataatcttatggtagatgaatcagaacatttagttcaatctagaatgcatgctctagaaaaagtgacaagagataaggagagaattgcacgtcattataacaaaaaggttgtgccgaaaacatttgaggagggtgaattagtttggaagttgattttactgattgggactcgtgataataaattcggcaagtggtcaccaaattaggaaggaccttttagaatttacaaatctgtgtccaaaggagcatacatgttgcaaggacttgatggtgaagtttttggaagggctcttaatggaaagtatttgaaaaaaatattatccaagtgtttgaattaattcatgattcggctgtgttatgccgatacatattagccgatgtgttgacatcgcctttagatggccggtatgtgtaatatcgtccttagttatttgttttattgcaatcggttgtgttctgctcatattagttagccgattgtatttttgtgatgtttctcccacatgacaaaattaagggggcatatatatacacatcattggaaaaaaaattatattgttgcattgcacaaaagggagttttatattacaaaacacttgttcagcttattacaagcttatgaatagtcgatattgccctttgcatgatttgttctacttcttcgattgcttgggcatcggctgcatctgtgcttgggatcggtttcacagtcttatttagttcggctaagtgcttgattgaagacttcagcttgggtttttgttcttcgatggctcttggcagatcggcaagcttatgttcttctaaagctagttcagcattacatgcttcaagttcagccagcaattcaatttttctgtttttcagccgatctatgttagattggataggattgggtccagagatcattgcatcaagcttagctttttcttcaataatggattgccgattggattgaatggtggcttcaagatcttttctttccctcctatcggctatcctttgtcttgctctctccagtttgtgccgatattgctcaaggaagactgctggagagatgatctcaaaccttgccctgattagaccacagtccgcaactagagcatccaaagaactttcaagctgatgagctatatccttaagtgtggttttcaagtcatcggctagaggagcttgtgttttgctggttgtttcttcctcttcatccataaactgcatgatgtcaaatgaaaacatatcagctaaggcctgaaagaaagaaaggatgatttattgatcaataaaatgttggagtagccaattttggattacaaaaattgtacaagtacttacaggaatggcaggaatcggctggtcttcaatttggtggctacctctagccgatggcgtatgtttacttgattcatgttggattggagttggagaccgaatccgctgaggaaaaggagttaagttagtatcaattaattgaaaattgaagagaatttgtaaggcaaaatttgccacaggacacgcaaagattgtggtctttactgtgggacactcgaagatcgtgtatttgctcgtggacaccgtaaaaatatgataattagctggaggacaccggccgtattattttattattttcggtggaaacggagagagaaacaatggttaaaggcaagtttacccatgggcccacttgtcaatctcacatatcctctctttctctcttcctcttcttcctcagcaatgtcgacggcggcggcgtccgagactagcagcgcgagcgcgtggtgggcggcccttgacagcgtcccgtgcgcggagcgacgcatcggccaacgccgccacgtaccccgccaccgcgcgactggaagacgggcggtgctgctgctaaacgacaggggcaacagccgccgccaagcacgcgagtgtcctgctgctgggccgaggcggcggcggtggcggagcaggcggggttgagatggtcgagcgcgcatgaggcagggagcgggagcgggagcgcccgtggaggcggggagcgggagcgacaagcggccacgggcaacaagcagatccacgacgagcgagtgagcgacaaggccgacacgcgattgacgacgaggatgacgagatggcgaagagcggcggtgtgaggaaccgcgacgagcagcagacctgcctctattggtgctgcttgttgatgcttctgttacttcaggggaactggcagctgccgaactcgacggtgtacgccctcgcgaagttggcgccgctcgtcgccagcctcttcttgtcgttcagctcctgcacgatcaatcaatcgatagatggatcagctcatcgaagcagtgaaatcatgaattaattataacccgaggcaatgaatgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacacgcgcgcgctcgctcgcctggcctggcaggcggcgcgcgtgcacgatgtacgcgtcgaatggtccgaaaaattggctcctcacccttgcgcagatgcagtcttcttttgcagttttgttttgctgcaaattcggattcgtttttgttttggaaacgttccgaaaaatccggtgcgtgcaaacggcgtggagttcggataaggtacgcgcgacttatccggttcggttacgcgcagtagagatcgtgcgggcgccctgatcaagcgacccttctctatataaaccgacccgccgtcttcacgcagtatatgttacgcgcgacttatccggttcggttacgcgcagtagagatcgtgcgggcgccctgatcaagcgacccttctctatataaaccgacccgccgtcttcacgcagtatatgcgaaaatcaatctagggtttgcctcctactctgtactgcgccgtcgctcgtagactactccatcccgctcgccggcgtgcaccagcgatcgggagagcaggtctccggaacctctgcctttaacgtcctgcaccgggagaaggcggcaataaggtttttgggaagcgcttcgcgcgactgctccctgttcgttcgcgacggctcgccttcctcttcgctcgcgtgtttcgtgccttcgtagacacctgtgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatagagcagtttcatgactacaagatggctgacaaccgttctgtaatcgaacaggctcatgagatacaaaccatggctaaggaactcgaactccgtaagtgtgtcttacccgacaaatttgtggctgggtgcattattgcgaaactaccttcatcttggagaagtttcggtactgcactcaaacacaagagacaggaatactccgttgaggggttgatagcgtctcttgatgttgaggagaaagctcgggaaaaagatgccgcgtctaagggcgatggtggacagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaatttgtgggttgatactggggccaatgtacatgtttgtgctgacatctcattgttttcttcttatcaggtcgcacggggttccaccgtcctaatggggaatgggtcacaagcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattcattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaatagaaataaggacaaaacaccatatgagatatggattgatagaaaaccatcactttcttatttgcgcacatgggggtgcttggcgaaggtcaatgtaccaataacgaagaagcgcaaacttggacctaagactgtggactgtgtttttctgggatatgcttatcatagcattgcctatagatttttaatagttaaatccgaggtaccggacatgcatgttggtacaattatggagtctcgtgatgctaccttctttgagagctttttcccaatgaaagatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgatggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatgtatcaacctgatgggtttgtagttgaaggtcaagaaggcaaagtgtgcaaattattgaagtctttgtatggtctgaaacaagctcctaagcaatggcatgagaaatttgacaaaacattgacatctgcaggctttgcggtcaatgaggcagataaatgtgtgtactatcgccatggtgggggtgagggagttattttgtgcttgtatgttgacgacatactgatatttggaacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgataaacaatgcatcgaaggagatgggtttgagacccatgtgagttatactatggtggtaacccagtctatgtgatcggagatcccgtgaattagatcctgggaagaacaaaccattagtaaactagaggagagtatcaatatatataccctctccaagtgaagatacatgtactctcgtgagctgcaaggcaggttggctatgccttaatgagttctgttggctttaattagcgaagatgttgtcctgcagagcattcttgaaagaactcacctttgtgagcttgactgttggtcgtagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtccccatcgaaccgctggtatataaacagtacattggaaaaggcaaatctcagtgagattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacacgcgcgcgctcgctcgcctcgcctggcctggcctggcagggcagggcaggcggcgcgcgtgcacgacgtacgcgtcgaatggtccgaaaaattggctcctcacccttgcgcagatgcagtctccttttgcagttttgttttgctgcaaattcggattcgtttttgttttggaaacgttccgaaaaatccggtgcgtgcaaacgacgtggagtccggataagttacgcgcgacttatccggttcggttacgcgcagtagagatcgtgcgggcgccctgatcaagcgacccttctctatataaaccgacccgccgtcttcacgcagtatatgcgaaaatcaatctagggtttgcctcctactctgtactgcgccgtcgctcgtacactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgtttgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaataaattaaatcattatatgcccataatctcaacaatgaatcatcgatcaatctcacattctcaccttgttggccttgctcttctcaaggtactcgtcgaacacgccggccctggcctgcccggccttgcgcagcggcggaggcggcgatcacggcggcgagacccagcagcgcggcgcgcctgccgccgccctgctcagcttgggcggtgccgcgacgtgcacgcgcttcggcagcgccggcgagccggccgactgcggcaccgccgcggcgggcttgaggccgacaaggctgttgttcactccggccatggctcgattgagctgcgtgcaagcgtgcgtttgtgcaagaagaaaaagagaagagaagcaaagagaaggaagaagaacagtgtgcaggggcattttggtaatttcaacgctctttctctctctgtttcgacaacaaataataaaataatacgaccgctgtcctccagctaattaccacatttttacggtgtccacgagcaaatacacaatcttcgagtgtcccacagaaaagaccacaatttttacgtgtcctgtggcaaattttactaatttgtaaaggtatgttaccgatggaggtggtgcaggtttctttctagcagctagcttctttttctgcaaaatgaaaggagtttaagttaaaatcggcaagaagagttttggaagaaattaagttgtagactcattgttggtatttcttacgaccacaggtaaatccgcaagcgcacggaataccgctatagcacttcaccttcgggtgaccccaaaagtatatcgaactcagggaacgtgtgtaatctacctaaggctaaaacaatccaaggacaacaactataggtaggctaggcaggctagagaggactttctatgtgttttaattatctaagctaagcaaaggtaatttcctatcggttgcttcaggcaccgacccctactggtctgccagtgtggttccggctatagctccatgatgtatccgaacgtggaggattactaggacgagattcagggctgtcaccacctgccgcctacctctgacaaatccgtgggatacacaacaaacaaaggtaatctctaacctagaaaccacgtctaaattattaattactactctaatacttgtacaggaacttccttctttatccagagtcatagtactagagcacttaatatgaatactaaacaatgaacccgcaaagatgaaaatatatcttactcagactaaataattaaataacataagaaaggaacagcttacctaatagaagaaggttctccgaacccggagcagagtgtaccgacagctccggtactcctccagaattcctcctaggaagctacactcgtcgagaaagaagtcggagagagcgccaaaccttccgggcacccctccagagctttccctcactttctaccttattctaatgtacaaaagatacaatagagcctcttgtaattcagctcaaagttgtgtgttgtgaagtgtgaaggagagctctatttatagcctccatatgacagttacagctatgggaattgtccaaaacaccctcaaccgtcattgggaaggcatcagcaacgtacacgtggagggccaggatgaggggtgcctgtggataatcagataagattatttatgatatgatgatcacttcaatatctgttcctaatttactactacatctacatgcaagctttgctcctaatttactacttctacaagtggtttagatttaacacctctgtatgttattatctttgttacccttacattacttccttaaaccattaacatctgaattctcttatgttcaatatatgttcctaatttactactgcgtctcttatgttcagtatctgttcctaaattactattacatctacatgtaatatttcttactaataatgtaattaaattatttttggtacacttccattgcttcctaaaaccatcatgacatctaggagtctcttcagtatgtggaatttctgtatttgtgtgtggaccgtgtactccataattaatatagatttatctgtattctagcttctgtcttgattcatttgctcataggcctatcttcttttggtatgtacagatgcagatctttgtgaagacactcactggcaataccataaggttgagtcctctgacacgattgacaatgtcaaggccaagattcaggacaaggagggtattccacctgaccagcagcgcctcatctttgcgggcaagcaacttgaggacggacgcaccctcgcagattacaacattcagaaagagtccaccctccaccttgtccttcgcctcaggggaggaatgcagatctttgtgaagaccttgacaagaaagacccatcactttggaggttgagtcctcagacacgattgacaacgtgaaggcaaagatccaggataaggagtgtatccccccctgaccagcagcgtctttatctttgctggcaagcagcttgaggatggtcggaccttggcggactacaacatttagaaagagtccactcttcaccttgtgcttaggttgaggggaggcatgcagatttttgtcaagaccctgaccggaaagaccattacgcttgaggtcgagtcttctgatacaatcaacaatgagaaggcgaagatttaggacaaggagggcatccccccggaccagcagcgcctcatcttcgccggcaagcagctcaaggacggacgcaccctggctgactacaatatccagaaggagtctacccttcacctagtgctcaggctcaggggtggaatgcaaatctttgtcaagacattgaccggcaaaaccattaccttggaggttgagtcgtcggacacaattgacaacgtgaaagcaaagattcaggacaaggagggcattcccccggatcagcagcgactgatctttgctggcaagcagctcgaggatggccgcaccttagcaggttacaacatccagaaggagtccaccttgcacctggcgctccgtctccgtggtggcctgtaagttctcggcagatttggttcacatgttcgctgcgcctggtggtctctactaatgaag

SEQ ID NO: 81645 - DNA, 2492 bp, Oryza sativa
gaaaatattacagtacaaggttgatatgaaaatagtaaagtacaaggttgataggtaagttaatacactctaatgttgttgaggttgacctccaaatttctgccacatgtgctctatcaaatgttccttgagacgccgatgtgtagatcgatcacgaatagccctgtttttctctagtacctatgcaaatccatatattggtccgtggtcaagtcctgttatctgagcagagaattgaccttgttcatatgttttgtcatccggtatgtcataggaacctttctcatcctcaactatcatgttgggcaaaataatacaactatacattatatctgctagctcttctctttcccaaactcttgccgggtgacgtattatggcccaacgtttctgtagaaccccaaaggctctttccacatcttttctagctgattcctgatgttgtgcatacaatttatgcttagcgctctgtggtctgatgattgatttggcaaatgttgcccactctggatagataccatcagctagatagtatcccatgttgtaatctgactcattgagagtatattgaacaggaggtgctcttccttgtaggacatcagtaaataatggggattggtctaacacattaatatcattatttgaaccagcggcaccaaaaaaagcatgccaaatccataagtcttttgaggcaaccgcttcaagcatgatagtgggtaccccataatcaccacgtgtgaattgtcccttccatgcaaccggacaattttgccattcccaatgcatgcaatcaacactacccaacatgccaggaaatccatgtgcctctccaaactgaagtaagcgttgaatatcctcttcggtaggcctacgtaaatattgtttaccaaatatgtgcctcacaccttgaacaaaattgatcatacactccattgctgtgctttcagctaccccaaaagtctcatccataagatcagctggagtaccatatgccaacattcgcatggcagcagtgcatttttgaaatggtgaaagacccacctttccaaatgcatctgtcctaagacaaaaatatggagaccactcgccaagagcttgtacaatgtgcaaaaaaagatgcctcctcatgcgaaatctcctacggaattgatcatcggtgtacaaaggattgtctgaaaaatatttagcaaataacctgttgtgatcgtcttcatgatctctactgatgtacctgcgtgtgtagcctccacgctgattagagttcccagctaggcgtgccatcaatttcatctcaagttgagcttcaagccgggcttctagctgagcttcagtaggatcattaatttcttcccacatcatatcttccaaattctcactagtgatggactcatcagaatgactagaatggacttgtgaatcactagacatctttgtgggaactaggtggctttgttgagaatgaactgaattaaaggcaatggtatatatcttgctgaactgcataccctgtttcatagaagatacaactgaatggatatgtgctaacatctcagtgttgcttttgttccaacagctagtttccaacagctatattccatacaactatgtcatgacttgttgtttggatgtattccaacagctagattcacagcaggcatgccttgctgtttggatgtattccaacagctagattcttagtagccatgtcttgctttttatatatttaaacaatagttttataaacatccatgtcttgctttttatatattgaaacaacagttttataaacatcaatgtcttgctttacaactattttaaactatcacaacagcaagattataaataattgtgctaattattgctgctacatatgtattttgtaggctgctgttaaatcaagtgctaagaaattatgggccaacaacttcaaataagttcaattaagactgtgggctacatattatcagtacataacatcttctacaggtacaaagatacaaccatcattcactaagtttacaatccaacatttacttagcctacaaacttaacactgagttcacaagtctaataattgctaagtctaaatcctagcagcaaattgatcatagaccacatagtggcacactaagtaacagggatacaacatcacttggtgatcatttattcttcagcaagttctgtagctagcttttcgaggacagcttcatgcctcttcagttttgcatcactaaaatttgaagtgtctttgtccaacaattttaagtatgtctgatacttctccattcttgtgtattccttctttgcttcagctgatttcgatgttgcttctgcagatttcagcatcgcttctgctttcacttttatagcttcattgtaaagaacaaagtcttgacatggctggtctcccaaaggagaaggtgcgacatttttacctctcccttttaacttggctttggcttttttctgtccctcagggcgcttctttttgc

SEQ ID NO: 81646 - DNA, 14243 bp, Oryza sativa
tgtcgcatctgaacgtgtcgagtcacaattgtgtgttaggtccgatcgtacgtgacttgtcgtatctgaacgtgtcgagtcacacctgtgtgttaggtccgatcgtacgtgacttgtcgcatctgaacgtgtcgagtcacacctgtctgttaggtccgatcgtatgtgacttgtagcatctaaacgtgtcgagtcacacctgtctgttaggtccgatcgtacgtgacttgtcgcatctgaacgtgtcgagtcacacctgtgtgttaggtccgatcgtacgtgacttgtcgcatctgaacgtgtcgagtcacacctgtgtgttaggtccgatcgtatgtgacttgtagcatctgaacgtgtcgagtcacacctgtctgttaggtccgatcgtacgtgacttgtcgcatctgaacgtgtcgagtcacaattgtctgttaggtccgatcgtacgtgacttgtcgtatctgaacgtgtcgagtcacacctgtgtgttaggtccgatcgtacgcgacttgtcgcatttgaacgtgtcgagtcacaattgtgtgttaggtccgatcgtacgtgacttgtcgcatctgaacgtgtcgagtcacacctgtctgttaggtccgatcgtacgtgacttgtcgcatctgaacgtgtcgagtcacacctgtctgttaggtccgatcgtacgtgacttgtcgcatctgaacttgtcgctcattggaatattaatcatgttttatcatctaacaacaatgaaaatacgaattataaaaaaaattcacataagacgaacacacaggtatgacttggaaaatgtctggttagtctttttttttttacggagggagtagtcgtgtgcacttgtgtacatgtatatgactgatttatgacagccgtgcatgtgtatttgtgtacgcctaatttaatgtgcaactactactaaatgccaagcaatgaaagcaacagtcccaatgcgtccttatatactacttccattcttctctgatgcatcctgttctccaccattccatctcttctctttctgcctgagctgcatccccagttggcgaacatgaaagacaaggtatgtccgatcgtgtaaatcgttcgtagcgttagtattattagtttaagcgtcgccgttacttcgagttgactcgttctgttcatttgattttttgctagtttcaccgttctggactttgcttggaagttcccatgtatattgacgacggcgagtattttggggatgaaaccggtacccagctgaaatgtcgtcatggcctccgcccgaagagaagaactgcatgggaatggaaggacaccggaagaaggtttcttggttgcccactggaggaagaggaccagtgcgacgctttgttttgggttgacgaagaatggcaaccaagaatacaaaaggcatttgagatgctctggcttgcattggaccatgcaagtacacgcaaccctaccaaggcgcagtaccaatggtcaaattttgtagacagaacaatagtcgaagaagacaaaatgaagttagaatttcagatggcttcacagatctcggcaatcgaagcaaaacataagaagagagtttccaggataaaaaaggaaacagaagacctcaaggcttggcttatgggttccctagtcgttattgcatttcttttatttaaaattatcgaaaatatgtatcagggatgttgatgcttcaaatatgtatgacgtgtgttgatgcggctttaaatttgtgtcaatctatttcattgctaattatcacgtcacaaaagcccattgagtggcccgtttattgaagcccataaggtggcccattttatagacaataaaaggcacactctctagggtttcccccatccacaaccttcatcccatctgaccgaccatgtgaggagccagccgaccccgccgccgacacctccgatcccgccgtcgacgccgacccctccgaccccgccgtcgacccctccgaccccgccgtcgaccccgacgacgactcccccgccgacgaccacgccgacggtcctgaccccgccgtcgacccctcagaccccgccgtcgacgccgacccctccgaccccgccgaccccgccgacgacgccgacgactccgatccctcagatcccgccgtcgacgccgacccctccgaccccgccgacgacgccgatgactccgaccccgccgactgcgccgccgactccgacgtggcttcaacccctccgactgcccgacctcgcctacgcagccgactatggtgaacaacaggaaggttgttatccaagtcgacagtgacacgggtaatgttttgcatccatcgatttgtgttaacatttttttgatgaccgtgaattgagcaattgatttgtgttaacatagatgaagaggtaaaatccgacagtgacactgagacagaatccgagagtcatatggaagaggaagtagacccttcatcgttttttgctagtgtgcggcgcgaaactatcaagtgtggttagtatgcttgttttaccgagactatcaattgaggtgattgagtttttttttttttggtattatctattgtggttactatgtcggttcatttgtgcagggccaaacggcctgcagtacgctggaggctttcatagtagatgctggtatgaaaacgatgtgtacttgacaagggcataccaaatgaatgttttttttgttttttttgtatccttccattgctcactgcacaataaatgtacaattcgaactgcacagcaatggcagccgcaataaacagcaattcgtgattcgctgtaacttaagcaaaacagacttaaatcacataacagacacaagagcagcatttcaatcccaaaatacaagtcaaacacaagagcatatcattctacaacgcacagcaatgccaatacagactgaacatcaataataaaagcaagttgcatactgccagtacgtctcacattaagttcttaatacatatattcatcaatgccatacaccacaaatattcatcaagttccaccccatgttgcttcatctcagaacataaacaaactaacaaaaaatacatgttcctttcctgtcttattcaacgatgcaatttgacggccaactccatcgttctcacacatcaacacgtactttcctgaaaaaaattgtgaaccaattaaatacgcaggtattttttccaattgaactagcttgacttgtcacatataaattacctctcgtaaattggacacgaacgaatggtatggccaccgttacggcaatagccacaacgcctaacacgcttctccaaaaaacctctcaatctttttcgcggtgctcccttcggaactacctccatgggatcatgtaccaaaacatggccactaatgtctgtacgtaaactttgacctaccacgtgaccacacagtgtcctctctatttcgttaccatcacaatcttcagtttctaaatccaacttttctagcatctccatcaccttcaatgtacattcctcagatatggagcacttcattagtacttcgctaccgaagctacgcaacatgcgatacctttccatttggtccgaccatgaaaatgtctcaccatatctatccgacggaaagacacttttggctttcacagtccacctgcgaactatgcaactttcaggaatggcatccatcttcaaataaaacagaactgcaaacatgtgctgacatggaaggctttcacaatcaagtttcatgcaagggcaactcattgtcttcaaaaatgattcctcataagtacagttcaaaatcttcagcttctcattgttctctttcaagcacatgacatacttcactactgtatcctcatcaataaaatctattacttcccaatccatggatttaataatctcaaacttaaccttcttgaaaattgcaggtgtatatatgcgcgctacttctttctcaattaaacttgcatctgtacacgtgaaggggactgattgtgaagcttttgaatctagctcagcctccctatgtcttatacgcgacacgcaatgttcgtaatgctcaaccaatacaactaaactcattgtacgatccaaatgcttatgaagttttgaattcaaactttcactatgctggttgcttttcattcctagaaagtacttaccttttaaataagcagcagcccatttcttccttaagttgtacattctaaccaaccattgattatcttcacccactttatgtttgtccttgaactcaacccacttattctcaaactcttccggaccataagtagaatggataagtgccctgaaatcagccaacatttcaggccggagatgtcttgccatattctattctatatgccaagtgcacaacctatgctcagaatgtggcatcacagatgaaattgccctacgcatagaattgtctccatccgttatcaaacctctgggatgtttctgacccatgcaatccaaaaactgcttcagaatccactcataagatgcaaccttctcatcagccacaatagcacacgcaaaaatgacagtcgaaccatggtgattcacaccaacgaatgggatgaaaggcaagttatatttgtttacccgatatgtgctatcaaaaacaactacatcaccaaacgcatcataatctatacgagattgagggtctgcccagaataaccttttcaatcgaccagcctcatcggtctcatactcaaaaaagtactccatgtcatctttttgcctagcttgcatgtattttataacatgatctgcatctccacctaatatctgtttcttcttctgtcttacaaaaaaattataaaggtccctactcacaaaaccagtagactcaaaaccaccatgacgcctctccatgacatccatcacttggtgctgacgcaaaccaacttctctcaactccacaacatttgccttctgagcaatgctaatatttcggtgagaacgaaggaaaggaacttcatcagatttagccaaactatgactgtgctttgccacaaacttcatacaaaccaatcaccctgtttcttgtcaagtctaatctcaaatatagctttgcatccacaacgagttagtgctctaggttctctgcttttgttaccaatatccatataaacatctctcctatacccttctcttgagcaagtgtactgcctaaatataacatcagcagtcacaggatcacgcctagcaaaatttttccttatactaaatcctttccctttcgcatacctgttatagaacgtgaacccgtcgttctcgctcttaaacctcattgccatgaacgtagcatactcctcttcctcctctaagctactgaaattgtctgccatctcatcaaccatcatgattctgccaaaaaaataacaataatctcaatatataaaacaaattacacagtatcacttcaaacaatttacgacacatcgatttacctgtaacaggaaacacacggccgttgcagaatactgaaacggcggcagtaccttctggcgatgaacaagattgctccagcgactcagacaacggcgactgctacggcggagatgtgatttggcgcggcggctccttccggcggcgatgtgatttggcgcggcggctccttccggcggcgatgtgatttggggcggcgatgtgattaggggcggcaagtgcttccggcgatgtgaattgggccggatgttgcttccgccgtcgggcgccgatgtgagtgaggcgcgattcagagcgatgaaatttgggcgggcggtgggtcggggcgatactgaaggcggctagggtttgcgtctcgcgtctgatttggggagtagataccgattgcggtgcgccggcgccaattccaatcctacccgccacaaaatcaacggctggatgggttttggtaccacgcggtacaagtaccacgcggtacaaaacgcaggacgggagcattgctcttccatattagttttctttgcagcccggctaaatataggtctcaataaaccggaaagagcatatcaaatacaatttagaattaactaattaattaatacatcataagatcaattgcattttggattgaaaaatataataatttagaagttttttccataagaacttcaaattgaaaatcctttagtaacttctatttgaataaaaccgtggttgtgttcggcaatagtgatttgggagaaaatcccccttgttattcatgtgcacgttttctaaattgctaaatgatgtgctttttcaaaagaagttttatagaaaagttactttaaaaaatgtattaattcatttttaaaatttaaaaataattaatactcaattaatcatgcgttaatggttcaactcgttttgcatattttttcgatcttctcttttctcctcctcttaaacacaacccttagatcaaaaattgttgtctaaatgggacatcattcttgattttttttatctattgtaggatgaaaaatagatgtttgagatttgtttacgtcatcctaactaaaagttttacttatggtttaatttgggagtaaaagttttacttgatatgacgtgtacaaaatttatacgtctatttttacatcctacaatattttttaggtttccattacatattagccacacaaagtcgtgcatttgcgcgaccaagagatgcatctttgttaaatatcttaagatttttctcttacaattatagtggctttgctttcttgcccctaaatattactactgcgaagtagcccataaattacataccactacaacaatatctttatgtttttttacacaacaccaattcatgtatgtttgttttacttatttcacttctcaaatttaatcagcacgagatcaaatagtgtaatcatttcccatgcaaatcaatatcccatagtgtattttccatgcggtggactcttgttgcttgcgatgtgtcaaaggggagacgctagaagacacaggagggaagtgcctagtgcatgtattttcttttactgcatggatgttctatgatcggatggccatcttttatccaaacattcatccgatggggcgatggccattgtttttcggattacgtggtccaatatgctgtcaagaatgattctttctttcattactttagatatctaggaagcatattctaggatataatcattagttgcacaccgaactggtattatgtgccatggcatatcaaataataattcaaatttgttaatttgttcgtgtgatacaataattttatgtcctgaaacatttatgaggagcaacggaaaattgtagtaaagtgtatttgtggagtttttctttcaaggatatttgtgcagttttttttttgaatggctaaatagttgttgataggaaatcagggccaaaatcttgcaaatttctaatcataaaatttgcttcgtgattcacactctggcgaccttatttctatctgccctatctccagcgatgccatttcctccagctctgctgaccgacgatggcccgatgagttagggtttagggtcccgggtaggataggggtagggcagagggaagaggaaggagatcgtcgggcttggagggatggccgtggaaggcgaacatggataggactccagtgttggagccaaggtgttggaggagatggcagcgggccgacgttggttgcgagggccaaacagagcttgtggttaggcggtggcgaccggtggtggtggaggggagtcacaggacacgaagaagatggtggggggcacttgctaccgtcgtcgccttagggaagagaggggggggggggaggtggcttgatggcgccgtggaccccgttcggctagacggcgatgtggggcagtagtggtgcaggaggcgacgggcgggaccgaggaaggaaaggagaaaacaatagggtttgaatacgttacatgaatcttaaagcgatccaatggtctagaattttgtaagatttaaaagttttttttcctaccaaaagccatgtaggcaaactttcttttttaagataatccaagaaatgccattgacaagcgtccaagtcccagaaatgctatcaacaagtgtgagttccaagaaatgtcatcatacaaacgattttatcctaaaaataccatcaccgttagggttccgtccattttgtgacattaaaaacactgttcatcctatagaacttaacggcgcaaaatggacagaaccctaacggcgatagcatttttgggacaaagtcgtttgtacgatcgtatttcttggaactcacacttgtcgatggcatttctaggatttggatgcttgtcaatagcatttcttggattttctcttctttctttcttttttcttttttggcaaggatacctgtggtgggttttatgggcatggaacgtaaggacaccacgttgtcctcatgacaaatgggctaacttgtttgatcttagatactactccctccttttctaaatgtttaacgccgttgatttttttaaacatgtttgaccgttcgtcttattcaaaaacttttgtgagctgtgtaaaactatatctatccataaaagtatatttaacaataaatcaaacgataggaaaagaattaataattacttaaattttttgaataagacaaacggtcaaacatttttaaaaaaatcaacggcgtcaaacattttgggatggagggagtatatctctctcctttaatatttgacgttggttagtatcatatttagctagccaacgtcatatataatagtggaagggagtaaattttaaattcctacttgttcttaatacttattgttctattgttctagtagtccaccgtttttcttggattttcttcaaaaagtgaagaaatttacgtgattatgagtgaggtaaggaaaaaaatgaagaaatacgatttgtccatcagtccattggaaacgttttcggcaaattcaaatattccacgttgtaggtgagctctgcttttgggaaagtcagttgttgacgccgccaaaaattccagtcctctccatggtagtcaacgtcaatttctcacttgtactatatcctaacgagtttttggttcacacctgtttaatctctgttcgaaatcaagaaaagctggatggagtagaggatctatgtcgagtttagctccaaactttttctttaaacttttaacttttccatcacatcaaaactttcctacacacaaacttttaatttttctatcacatcgtttcaattttaaccaaacttttaattttagtgtgaacgaaacacaccctagcatgtatggcattgtgccaagcgtcgtgtcctgaactccagaactccagaattccatatccatatcgtacctacagcgaagggaaggttcagatttcagactcgctgtggtaggtcagctcggacagtttgaccacgccttggccacttccgctactccactccactcgcacggtcgcctacccagttttctggccttagcggcacatagatttccgcccaaaaccatccaccttttgccgcctccgctcgtgcgcagcagcgcagctgccttgccgtttcccaattcccacacgccatgacgccaaccaacccaagcacagcagtacaccacacgatgtcacgactcacggacacacgggctatatatatcgacgtgccacaccacaccgtacccaagcaaacagatttccaactaaacttgtaccaaaacacaaacgacatcggtcccagtcaagcggagcgcacgaacacaacgcagagcatggcagcctccgtggtgagggtggccatcgccaccggggcgtcgttggcggtgcatttgttcgtcaagtcgttcttgcaggcgcagcatcctgctctcaccttgctgctgccggtggctgtgtttgccggcattgcggtgggcgcgaagggcgggaacgggggcgacgggaaggcgccgccggggccggcggccgtgccggtgttcggcaactggctgcacgtcgggaacgacctgaaccacaggttcctcgcggcgatgtcggcgcggtacgggcccgtgttccgtctgcggctgggcgtgcgcaacctggtggtggtgtcggacccgaagctggcgacggaggtgctgcacacgcagggcgtggagttcggctcccgcccgcgcaacgtcgtcttcgacatcttcaccgccaacggcgccgacatggtgttcaccgagtacggcgaccactggcgacgcatgcgccgcgtcatgacgctgccgttcttcacggcgcgcgtcgtgcagcagtacaaggccatgtgggaggccgagatggacgccgtcgtggacgacgtgcgcggcgacgcggtggcgcagggcaccggcttcgtggtgcgacgcaggctgcagctcatgctgtacaacatcatgtaccggatgatgttcgacgcgcggttcgagtcggtggacgaccccatgttcatcgaggccaccaggttcaactccgagcgcagccgcctcgcgcagagcttcgagtacaactacggcgacttcatccccatcctccgtcccttcttgcggggctacctcaacaagtgccgtgacctccagagcaggaggctcgccttcttcaacaacaactacgtcgagaagagaaggtacattccatttttcttactttactgcattccctatccattcttgtcatggaaaaaatgaggattgcaaggtaaatttgttcgtgtctaatcaacaaaaatcttgatatgaaatgcaggaaggtgatggacactccgggagacaggaacaagctccggtgcgcgatcgaccatatccttgaggcggagaagaacggcgagctgacggcggagaacgtgatctacatcgtggagaacatcaacgtggccgccatcgagacgacgctctggtccatcgagtgggcgctggccgaggtcgtcaaccacccggcggtgcagagcaaggtccgcgccgagatcaacgacgtgctcggcgacgacgagcccatcaccgagtccagcatccacaagctgacttacctgcaggccgtgatcaaggagacgctgcggctgcactccccgatcccgctgctggtgccgcacatgaacctggaggaggccaagctcggcgggtacaccatccccaagggatccaaggtggtggtgaacgcgtggtggctggccaacaacccggcgctgtgggagaaccccgaggagttccggcctgagcggttcttggagaaggagagcggcgtggacgccaccgtcgccgggaaggtggacttcaggttcctgcccttcggcgtgggccgccgcagctgcccggggatcatcctggcgctgcccatcctggcgctcatcgtcgggaagctggtgaggagcttcgagatggtgccgccgccgggcgtggagaagctggacgtgagcgagaaaggcgggcagttcagcctccacatcgccaagcactccgtcgtcgccttccaccccatctctgcctgaactcatcgaatccctttaaattatgattgtgtcaggagcagattaaggatattatacagcattaatttcgatttgtcgaacaaaattagacaatagtaataatgcaagggattttacatgttctgttagaaaatatattttgtgaactgatcttatcattgtcagtaaacaagtgtggatagtactgttttccataaaaatcaaatttagtcatttttatttttatctggtgttggtagattgctctggtcgctgactgaatttttttattaattttctttttttatatattttttagaggagggtaaaaactgttttccatgaaaatcaaatttagtcatttttatctggtgttggtagattgctctggtcgctgactgaatattaattttattaattttctattttttattaattttatttatttttttagaggagggtatttttactcgtcctctacatctaaccggatatatggagcctttttaaaattattaggaacttagcccatcggacagagaacttaacttagccctcaaataacccaattcgaaattcgatactcaggtcagtgcaatcactaggctacatgccctttcacactgcaaccattattaatttatttttgcggggaacaagggatttactcgaataaacgagtcctcgcacacaaggtgcgagatcatattacaattatcgtctggccagaattccatcatggattcacaacggcctttatttgctaaaaagtgactaactctattttggttcctatgcactttggcaaaagacacttcctttgttccagtcatgagaaagcgaatctccctgactataaatccttcggctgacagcagcttctcctttgaattcaacagctgaataatttccagacaatcagattcaacggcaatcggaagcagggtccactgcaacgccaggttgaggccatctctgcaagcaatcagctctgattccagggccccattgcatctgccaatgaaaccacacgtggagaagattactcttccgaaactctctctcaagacagcaccagtacctcctctcccatcttgagggccatacgacccatcaatattaagcttcatccatcccggttttggccttgaccatctgggtgggttagttgaacatttaggggctgtttggttcaatgcttcaacttgccacaccacacttcacactttaggctgccacacctccttagccttgtgtttggttcattaccttagttatggcaagccacactttcttactatcttaccctatatgtcatagactcaatcttttgcctaactttactacaagtgtggcttacaatttgtaggccacaaaaagtgtggcaagccacacttgcctaacattgactaaagtgagttatggcaatgttagttaagaaccaaacatgctgttagccttaactctgctccccattccttcaggtttacaacatgcttccctttcataagatttgcaaaaggatgctgcttgatttccactagggaatgaacataactcaggataaaatgagtcgaggcctctagaggaggggccggctttccgtgagttaattcgttgcggatgtaccagatgcgctaaagcatcatcagcacaagggcctgttcatcgtccggtaccaactgaagcatgtttaaaatccagtctggccctgcccagccagctgaaaataggcttgagatatgcttttccttcaccatcgactgccacatactcctagcatgagggcatctgtataacgcatgacccacatcttcctgttcatggccacaaatactgcacacgtccaacaattccaaaattcctcttcttcttgttttccatagttggtaagctatttgtggctgctctccaaccaaagattttcactttttggggcacattacaggaccagatcaggttccaccctttcttgatggcgtagtccgaggagcacgagcattcatcctgtcgagcaatttgcattgccaactgataagcacttcttaccgaaaaacgaccaagccgatcaggaaaccaaacaacaaaatcctcctcttggcgggaggatatcttgatctttacaatttcttcaacatccaccgggaggaagattgcagaaaccaagttctcgtcccaagaaccatccggtttcaggatgtcagaaacccactttaatctattgttccttttcattgtgattggccggcgagacatgttcctgggaatccagggatcccgccacaaccggatagaacccccatttcccactctccagataatccccttctttaggagttccaggccgtactcgattgctttctagcctggcgaagcattgcccgtaaagctagtgtcagtgagactaccacatggataatacttcgctttgagaattcttccacacagtgaatctggattatcgatgagcctccaagcctgacgtgcaaggagtgcctgattgaacaatctgaagtccctaaaacccaagccaccgctatgttttggtttagttatgattatataaaaaaatatacacatacacaccacaacacacgtacatcacactcactagccacatgcgcgttgcgcgactctgattacttgcaccgtcacatgtgccaaagaggtaaaaggaatatccacataacagtgtgagatagtataggataaatattgatctcaaaatacagcttacagagcttttgatttttttttattaatgctgacaacaaattaa

SEQ ID NO: 81647 - DNA, 15920 bp, Oryza sativa
ttcatacaaaattttatcagatctcgcagaactaaatcaaggaatactttactagatacggagttttgtaactgaacagcagatgtgaatatattagatagatttcagtgtcaaagaaatgaacttatttgttgtgatacatgaatgatgaagatcctaaggtcgaaaattttcaaatattcttttttaactgcccagagcagagcaagaaggaactgaactgaaagctgttgatctgctaccatttctagactttgttcgacggaacaatctgcagatggaattcttctctattggctcaaaccggtgtaagagactcacattatgaatctgaatcaaccgtaccactcatagaaacgtcaaacgctaattttatatttgttatctccagcaatattgtgattgccagttctgcatttacagatttggtcacctcaatccatgaacactggttctgtgctcgttgcgttaatgcagtacagccagaaggtgaaggtgttatagttatggagattggagcttacttgttagtttgtatgtacgtatctcattgttcaacttttgatttacagaactctaaataccaggtttcctttaattacttccattatacaaatgtgttcctgccaaaaatttattttactggcattgctatctgaatgcacaggtatgatggttctcttggttctgcttcacaagcaatggtggctgttgatcagtttgcatggcactttaatcgaagaactcactaactgctgatttttgttagtttcaggtgtgagatctgagatgagtctagacattgttgattgaaatcattcttctaaactttagtgtaactgcctaatattactgttctcttgggtttagttgtaatcgctattagctgttttctgtaagacagatgtgtttgaggcaatttaactaaacttattagggcatatctactcggtagtcgtaagtccacataagctttgtatattttgtgagaatgctttaggttttgaatatttgacctgatgtagtggcgagatattcaatggcatatcatttaatgttaaagctgaccatgtttgtaagaacgaaagggagaaaatatgtcagattttcctattcttgttattaatgtaggtgtgtctaggacataaaaactgaaccgaagtaactagtgaagtgaagagttttaatttaatatttgcctatcatacaagtgctaaatgtattgaatataattatttgtaaggtagtaccttgcacatatcttcatctatcggacctgttcgatgcactgattgtcgttaggtaatgaactgaactctgaagctagcgatatccttccaagcattgccaagtgcaaatgacagaaaacagcgtactccctccattttaaattattctaacttttaaaatttgtgtcaagatacttatcattctcacgttagaaagcacttgcgtctttctcttaatttgtaccctttatcaatgcaactatagtagtactttgaaaggaatttttaatgcttgctttaaaaagatgattaaattataattaataagggtatcttaggagatttactataacaagaagtaaattgaaaaggagggagtatattaagcggtgatgatcacaagaaaaagaggcaaaattggttcttgaacatttgcattaattggcactcattcaccaaaacataccacaatataattctcatattgcctgaaagacgctactctctctatgccaaaaatgcaatattataatatgttttatcctatcctaatttgttatattttaaaacggagtaaatacattttaaccaatctcatttataccaatacaaatacaaagcgattagaatgcccttcactttagcgaaattcaaatgtattgattgcttcaaagataaagtctttatggttaaaataaaatgtgctaaaaatataataaatcactaaggacaggaaatagtctaccaccacacttattttcttatggaagtctgaaaatcagccctaactatttctttcaaactagatactattcacccattgactctcccctctcccctcccctagaccttttagctttttacttatatagaagtctgaaaatctaccctaatattttttttaacctagatactctttccgtacttgtaaaggaagccgttttggacagtgacatggtcttcaaaacacaactttaacttcttgtttctataaaaatatttattaaaaagtgatatgtgtatgattttataaaagtatttttcaagacaaatctattcatataatttttacgttttcaaactcaacaacttgagagttatttatgatttatctcccaaggtttaacttaaacattgtcataactgacttcctttacgaatacggagagggtactattcaccgattgagtctccccggcccctctcctagacttttaacttgttacctatgtatgaaagtcaaccctatattttttttcaggctagactattaatcccttgacttttcaaaacattcactttacacccttcaacctaaacctggctgttatttagttataaataaattagtatatcaaatataaaatatcattcaaatacattctagcgaaaatataaccatacaactttcgttcaccatagttgaacaatttagaaaggattaagcttcacaattactccagttcaacgaattatgaagattaagctatcacggtccactgagtttatgggaattaatctgagtttatggggattatttagtgaagaaccaaccaccgagtagatcacttccgtgcaagttggttgacaagtataaaagcatgacccaaacaaacatacacttaaacatagattcagctaaccttaatggacaatgacgatgtaactgaactgcttcaagtgtaatcatgcatttgtctcccacaattaaatactaaaccaagatcaaatccaagcattaatgtctggattgagtgctgccttgtacatgtctccaacaacaagaagaaagtcaatattaacaaccccaactcttactcctcctcattggccaaatggtcatcactctgtcttctggacaaaacaaaaacaaacaaataaattatcctgtgaattaactatgctgctaattgcttcagctaccctataatgcatgtaattaattaacattgcaattaagcacataagttaatcacccacatgtacaggtgttactacattgcaaagatgaacatgcattaatttgggcatatgcacttgataatttttgagctagagcctagagggttagcatgttcttgtccgggatctcgccggcggtgcaccatgacctgcagccgggcggccgtagtccgtacgacggcgacgacggcgaccgcacgctggtggtgctgctcaccttcggcatcttcttctccttcgtcatcctctacctcgtcgccggcctcatctgggccgtcgtcatcaccgccgccgccgtcgtgctgtccttcctctacctcagggtccggcggcggcgcgccgccgtgggcggcacggcggcggcggcggcgcccaacgacgtggtcttcatcgtgggggctcatcaggctgctcggagcaccggcagcagcggcggcggcggtgatgtcgccgccgcggccatcgtgtcggcgatcccggcgttcgagtacaagagggtgaacggcggcggcggcgaggacggcggcgcggcggccgggtcggggtgggcgcagtgcgtgatatgcctggggctggtgcaggtcggcgaggtggtgcggcggctgccggcgtgcaagcacatgttccacgtggagtgcatcgacgcgtggctgagctcgcactcgacttgcccgatctgccgcgccgacgtcgtcgacgagctcgccgccgccgccgccggcggccggttagagctgccggtttgatcgatcagctcagctcagctgctggctgatgctgccattggagattagctagctgttgcttgttgtgtcagattatcatgttaatttagttcgagatgaagcttgacaagttgacataatgtacagaatgtttacctattgatgataatctaatgtgtatatatattcatgtataattttacattacatgatagtattgctggttccattttaggctttctctttctccctacggaactgaactaattcatatgaaattcataacagaattcctgtagaattgagaatttgagattgtatagatgtgcacgctattggcttttgcaagagttttcttagcaaagactttggtcgaaaaacaagaaaaagtcacgacgaggagatcgactgctaaggcaggttacaaaatgagatcattaattcaaattgaagtttggctggagggcgccactgcaacggctccagtgctgaggatgaagagtgcacatgttgctgcttcaaaaagaacatattccacttcttttgctagccttcaggacagcagtgcaatgcactagttttatgttgcttaatttgtgtttctttggactccatgatttaaactttgtaggacaccatggacttttttgagatacgtttcaccgttcatctttattaaaaaaattatgtaattattatttattttattgtgacttgatttatcgatttattaccgaatgtttctttaaggatgatttaaatatttttatatttacataaaaaatttaaataagataaatgatcaagcatcatacattaaaaacgaagatagtagttgctaaaactttgaacagactttcctacgaatgtgtgagcgaaggatgggatggcattcccagcgcatcattcagcgtatttcatgtctgcttttgtaaaatcaggcaaaggcttccttagcccacagttttaatcctatagctaacttatcatttgctaagtccctttgtaataaaataaaacaaaattgacttttgcaaggttagtcaccgtgattctttccgtgaggtgtgaaaagtactctcacgggttagcttgttaattttccccttttgagtggagaattctgacacgctccatctaataatgggcatgttcggctgccggggctacggctacgccacttctagcacgaagctgcactcccaatatataatgactaatcgtcgacaggttcagaatttaatggtggtttcatatataatctctatgtatgaaatcgttagttattcatcatattcaaaatttaatataaatataaaaaaataagtcatttaaattacctttggcgtgataaaacacgtaacaacaaatatatatacttacataattttaaactaataagacaaatgatggaatggtttcatatattgaaaaataaagatacggagtattatatttcttttttttatcagtgctaaaggatttgacttttttgagccatcgaccgtccgtacgtgttctagctagttcgctagctagtgttcgcgagagcgacttgtgactgaatttgacaatatcaaaattcggatatgccgtacatgtgcttttacacgtacaacgctgcaagaggatgacagaatattgatatgacgtgtcgaacacctggaagccttgagcaacccaacttataaccatcgttctttttatataaactaaaaaaataccggtatgttgcgaagatgaaggctatcttaatcttattattattatatggtttagctaaaatgaaattcattgtaggaatttgcttggatattgcttttacaagatcatgagctacaattaggagtccaatcatcttaaattagcatatgagttttttaaagagatctcttatatgactcttatattttcaaaagcaaatgaatttaaaatctactcaaatacaaatctgaaattccaaaagcgaatgaacttgaaaactaacttaaacacggatgacgtatcaaagtaccggcaaaaatatctttaatttttataatagtagagatatatgttagtaaaattgtagttttgttatactccctccgtttcaggttaaaagacgttttgactttgatcaaagtcaaacaatttaaagtttgactaagtttatagacaaatatagtaatatttataataccaaattagtttcgttaaatcaataattggatatatttttataataaatttatcttgggttgaaaatattattattttcttttacaaacttagtcacacttgaagcagcttgacttcgatcaaagtcaaaacgtcttataacctgaaacggagggaacggagagagtactatagtagaattttttaagtgataatcttgagactagagaactgatcatatttactatttctaattcatcagtcagacggagcgggagcaatagttttaattttaagttggttcaggatattattgttttaagttggttcaggatattattgtgcttggatatgatttggatttgctataattttttaaaattggtaggagataaggtctgacacactgactggtttaatatattagtaatgtgaataattagatctattattacttgttggatccaaccctcgtttcctttttttttttttttcatgtttgggtgactacgacaaatatcttggttgatgatgtaacagaggtaaagaaaaaaattgcttggagacaacacatttgtctcaacaattggatacagagacgcgtgtctgagttcacccaaccaaatcttcagtcaccagaaaaaaaggaaaggaaaatgtcgaactagcccaagcatatataatttctgatttttgtagcttgttcaagtacaaaccatgattctattttgtatgaaattgtactatcgctcctgtcatgttgctgattatatagatgagaatccaaagtgttgcgagagatttacacaacgaaatactacacttgtaatgtcccagatacatttgttttgtatgaaggcggattcgttttatggttttgtgcaagctatcttagatcaaccatggaaatgctaaataaaaaattaaattgtaagctaataaatccaggcaaactatgttaatgattaggttgccttgtgtcctttgaactatgtcaaaatgatgtggcttaaccagaagaaaaagagagatttcataatgatataccccatccattcaaaaaaaaaatccaatctaattaaagttaagacattaagacacaacataatacaacgaaactgaattgtcatgtcacatccttagctaggttgggtttttctatacggaggaagtaataaatactccctccgcattttaatgtatgacgtcgttgactttttgatcaacgtttgaccattcgtcttattcaaaaaagttatgtaattattatttattttattgtcacttaatttatcatcaaatattctttaagtatggcataaatatttttgtatttgtataaaatttttgaataagacgaatggtcaaacgttgtttaaaaagtcaacggcgtcatacgttaaaatacggagggagtaataaaggattggaagaaaaaaaaggaaaaggttgtgtaggacaactactcacccttgtacctaacattttagaccaaatgcagggctgagagcaacagtgataggaaatttgaagcaaatgaaattgtctatttacgtcatgacaacatttgcgaaaaaaaaaacctgtcaatttctcttgaaaccctcaccagaaagagacaataacgaattacgtatagctgctcaaacttaagagcatcatcaaaagtccaaatagccaaggaaggggaaaatgggatgatggaggctttgtttctgcgggtttttagcagttataatttacaaaaaaaaaaaaaatgcatcggtagcttttgctgttcaaagcgaaatcgacaataacaaacaagatgagatacagcaggcacctagattgttataaatcttacagctcattttatttctcggaggcaatacagatcgatcaaagcagctacccaactatatccacagattcaactccttatgcgctcttcatttgctgcatcaatcacaagaacaagatggaaccagctcaaagatcaattaggcgcacaaactcaaactggactagcatgtcatgtatgctcaaccactcaggcaatggagtttcacttagaagatcaagatataagctaaggtcgttcgaattgtctattgaatgatgttcttttccaaaccccaaaacaggacgtgcacatatatccatattaatttcatttacccttcaagtgatgtttatttgtaaaccccaaaagatgatagtggaaactcttggtctttctttttttacattttgtgctttcatgcttggctgtattagcaaccaaagtatcttctgattcttgccatgttgaaaaaagtttacaaaatttccaaacaaaacccaaaaattttcaggttgcttcaaatgtgtgtactagtgtagtttatgttactttcagttgcaatggttcctctaaaaaaaagaagtaacgttagggtgcattgcaaatattgagatttagaatgtatatagtatacacacataccgttttctcttcttcaatcttagccttgatataagaatagagtgcaacaccagctatggcaatgcaagtgccaattcctgtttgtgtggtgatcttgttgcctgttcaacattaagttcaccaagtattacacaaaaacatcagatcatttgcacactaaaactatgtatatgaagttctacaaaaaaagagtacaacacttgccaatggcaagaacaagaatatgcatactgatcgacaatcattatgaaagattaaaattaaaagtaccgaatgcaatgattgagaagccaatgacgaagacacgttttaacacattgccaacagcatgtgttagaggggtcaccctttctaatgtgtttgtagcaacctggataaaagagagaataccaactatcatcacaaaatggcagaaaatttatccatatttgcctaatactatgatttatttctatatctgaacaactataaaaagttttagtttcaaaatattgatagttacgaacttacgatgtgggaaatgcttgtttttattcttgacatgtggactaagttatttgaggatgttgtttgtaatagtgattaaagttgtttttaaccttcatctataaaccatgttgtttcatgatattcttgatctatgggcaaattatgacattaagctatttacctggttataaaggtgatagaacaagcccaccacaaggagattagaaaccaactttgctaatccaactttagcaatagcatctttgaatccatgctgcactagttgaggtccttcaatctgcaaaatttgtgttataaagaatcaacatgaaagtcaatgataatgcgtaggtgactttaaaggtatcttgcggacttaagaaatcatgagaaagggcatgtagcctagtggttgcagtgacctgagtagtaccccaaggtcttgagttcaaatcttcataggagcgaatttcagattgtattgtttgaggggctaagttcctaatttaaatggttatatatatccgattggatatagaggccgggtaaaaaataccttctctaaaaaaaagaaatcatataaaagaattttattaaccacactactatgggctaaggccctgcgggtagctgagcatgccttcctacagtacggttagttcacatgagcagtacctacatctatggtttaaccttgccttgcctcaagagcctgtaccacatcatgcaagggacctgccaatagctagatgagtgggaatccctacccttgatcctcacaaccagtacattgtaccatcagtccagggactaataccaaagacaaatgcataagacatgtacaggcgaacatcaaaattggattaggccacttgcaggcctgtcaaccatacatacacctatacaaacagcatataagcatgagcacatttctaaacagacgttccaatttcctctggagggacagggagaggccggtacaggccaggttagttagcagggcaggaatacaaaacatattatttggtttgtccaatttcctcccaaatgtggccaccaaccacagctaattaacaggaagctgtgacatcagtttcaagttttctcaacctcacaagcagagtgattttcatttcttagtagtcaatcatgatgttcaaattactttagtagcaaggttacagtggatctccgattattttcagactatttctctaccgctctgcgctttggacccagtttgaactttgaaggcattgtgctctgctgcaacatggaatctggaatgagaaaacaacaggagctttgcaaaaagtaaactgctaaaatcactttttctaatatgtattcgcaaactgtaataaatggttattatcagggttatagaaaaacaacaacaattttgagtaaaatcctgctcctaggctggtattccacgcaggtaatatcttaaatttctaattttaaaagtaaatgcagttacttgcttactgcaaaagatcatgtgcaagcacatgaagcgatgtttcgtgatggaactaaattttcaaatgttgtgcagtttttcaaagggatagaggaacagtggtttgagcatgaaagggaaaattggattttaccatgtcagaacacatgattagggtaattagagaaatggaggtgttgcatacactaggtagttttgaccttaggaggaaaatcaggaattgttgtcaaatgaatacaatcattgtgaccatctttctttatgcccccacattagtctgaattgaaaaaatgccttatattatttaccaacaaacacaagagttgcatgcatgcataaatcacaactacttgcaagagtattgcaaaacatggttactcacaacaatgaactcctaaaaattgctaaattatgtagtggtttactggtttatggatcaaattctatccttggtggttggcaattgtagaacacatgcatgatattctttcgtagtttcttcaaattcatataatcaaaatttgccttttttgtaacatacgcaatatggtcagtgcacaaaatccaggccaggtcagaaaaactggtaactactagttactagttctctccatggattcgaactgtagactctggtcattacactcctttacttgttttcctacatagtgaatactgaataattttctactgtatttcaaatcctctccaataaatcaacgacaaaatatcatcagcacagtgataaacaacaagatggtgagaacttgataaatatgctatgcttaacatcggctatgttgcgatatgcctttttaggtatctatagacctatatgctaccaacagctgaagtgttaaatatgtaacaaacatgcataaagataaaattagacttacaataattgcaggagggatgcagacaaggagagcaattattgagatgtacgcatacaggttggtgctatccatgtcagtctgtgataaagaacagcaacaaagtaaaaaaatgaaacgggagtatcaaaaggaagagtgaatatgcatgcagatcattagaggtaacaagcaaaccatagccttcttggaataaacgctccgtaatgtgaaggagatattagaaatcatggcattaacgaaaccagtccaattgaatgaaagttcagtgagagatgccattgaaacacctgattatttcaaaacagaatatactccaaatgattaccaatgcacagaagtagagatgctatagagacaactagaaagtcctaaaacataatatgcttgaaatgattaaagatgcatggaggctgtgaggaatgttactgagacaactgatagtaaagagtatccctggttccctggtcatcttatataatatctagaatattaatattaatttcctatctaagcatgtcatggaggaatctgtggaattaagcaataaacagtgaaataatcaaactgtagtttctccaaggttcttcaatctcatctttagtctgttccctcctcccgaataaccaaggcagctcagcctaccccccccccccccccccacaaagcccacacacagagttgcgtttatcgcacgataaggtaggtttcattaagcatgccatcgtgtagcacaccacttattgatatgccattgtaatatcatgatgaccagaattcaggagaaagaaatggtcattacgctataggaattagagagaaataagaaagaaataaagaaggcccaaggcccaacctactaggaacatgtgtccactctgcacaacagaaaggactataagtatcaatttggctctttctcatttgccctcatcataaggcaaggcatctgatcatggaaatgttactggagtgcttggatgctgaggcatcacctgcacaggggccttgacaaccatgaaacctactttcatatgtccttatttgcattgatgttaagatacaagtgatgtactgctaggaacacaagcaaaaggcataatgagattacctatcacaaccggagcaagagataaccacagcgtcaatggaacttgctggccaaggataaactgtgaagcagccgcattgaaaaatggttcaagagctgcaatcattttatttgcaggaaaaatctcagcataaagaagaaacgcaaaaggccaaaaatacaaaaataaaatcaagatactgttgcagtacctttaatggtgtgggcaaatgagacagctacagcagcaaaggacacggtgcttgttacatgaccaatagcatggcagacagcaactgggaacagtagcttcagaaccgttgagttgatcggctacaaaagttcaaactttcccaagtttgactattgccttccagaaatgatatcattaacgtaaaaaattttggatatgaaacaactgatgatacatacaaatatacaactttttcagtatgtatactagcttgatgtatttagggagttttttgtggattctactttgataagtttggcaatttgttgccaaacttgggatgccacactttcttaaccccatgtccaatatgccattgatacaagttctcaaattttgcgcatcaattttcttgccacaaaaatcatggtatgccacattattgggacaactagaagtgcgcatatgtgtttagacggaaatttattttccttatactaaaagcataaaaaaaactaattttccaacaggaaataagattttatatatgtatcagtaagttgatgtgaagtcggagcaaggatgagaatgtagaacggctatcaccaccaattactccaatattaaaagtagagaaagagtggcaaactgcagcaatttaccaaatgagcccttaggctgtgttcgcatgtggtggatgggaacttattccctccgcacagaaaacggagcggtccattagcgcgtgattaattaagtattacctaattgtttttcaaaaatggattaatttgatttttttaagcaactttcttatagaaactttttgcaaaaagcacaccgtttagcagtttgaaaagcgtgcaagcggaaaatgaggaagaggggttgggaacaaggggttgcaaacacagccttaaccctttcttttacaagtgctcttcacatgattttcatcgacatctaaagttcgcggacaccagtagcaagtcaaagacttgaaatctagtagctggctgccgatcctcccttcccctctacaaggtagacatataaccaaaatacttgaaaatgccctaatgtaggagatcaggtaatattgatcctaattgaacacaaacaggtaaagccacagaaaaaaattattcctggcctgtttaaatccaatttacgtattcgtccagaacgcttgtcagtcagaaacatcacacataagaatgaataagtgattttgttatattttgagggccataaagcatttcattataggttttcagctaatggagatgtaaaagaccagcaattttgctctatcatggctgcacattatttgacaattgccattggcaatgatatatgttgaccaacaacccctaataattttgtgtattcatgctcattattgaaaggaatcatggttgaagaagggcatgggcatgagaataccgcgcgctttgggagaccaaaactccagccgacaaggcagtacaagactcctaccaaaagatggctcaccgacacaaaactatattaacaagaaagaggttttagatcatgaagatgcatgttgtcacatgaaaggaaaaagaaaaggaggcacacatataaagcaaacgtactatggataggggaagtagtcgaagatcttcttgttaaggatgttaaatatcacgttcagaaaatacctacaaaatcatattgtgaattggcaatagctaaaccacattaggcagcaacttctcagttcgctcacctgcaattgtaaattctaaagtgcgctcaggtgagtaagcataccacatgaagaaaaagaaaccggtgacaagagcagggtatctctctgcaaatcccacaggctttgcttccctgtaaagtgtaatagcaatttctcagttcccgaaattgaagttacatatacagggtggtgagaagaattggaattagttcaaatagagaatgatcacttaaaagtttggcacggttcttttgtttaggaggcgttgtccaactagtgaaaaagttaccggattcatagcttgtccctaattgctgcaaacctatcttcctagctcttaactttccattaatgaaagagcatgctagcctattgattcaaaaagaaaatgcatatctacaaatatccactgagaataaagtaactccatcgcctagactctactgtcttaaaaacttgccacaatcagaacctgtgttggaacatatgagaacataacaagaatataaatgcagaaaaaaaacaaaacagaagatgagaaagcatagaaacttggtgtttgagacacaggaattgttatccatcattccaatggaatatttcccttgtcttcagttcatttttattttcctttgtgaagtacatgaaagagcaaaacttcaaaggaatctggcctattcatccattccaattgctacaatcggtgaaagaacacttatccgagaggggaaagcactatatgtttgtgtctttgtgatatgggccatttgtccaacaataattataaatgagtggatattttgcagtcacaaataaattggaccaatcatcagatgtattcatgaacaatgccaactttccttatttgtttctttttaaaagtattcatttttcagtaaaggactcatgtgctatatagaaattatggttaacactaagttaatgtaaactccaaaacagaccttaaaaagtgcacacgactctgaaaaactcaaatcagccttatctgacctccattggttcatgatggaatacaaatagaaatcacgaagggaatttcaaggtcccaaatgcaagtaattgtccatgcatagcctagcggcatattttgccagctactctaaaatcgacccatacattgttccttgccagttatctaatttgaatgctcttttagttagtatttgactcttctcctaattcaatagtgaaatatataagaaaccaattcctcatacatatatttggtccagtaatgaacatcgctacactactcattcagcttagagtaaagtccatcaccggtccctaaacttgtaccgttgtgtcatcccagtccctaaaatcgcaaatcgaccgttcaggtcctcaaacttgttcgactatgtcatcccggtccctaaacttgcagatcactcgtttaggtcctccaacttgttcagctgtgtcacaacggtccctaaacaggacggtctaaaaactttatat

SEQ ID NO: 81648 - DNA, 41620 bp, Oryza sativa
taatgttgcagcaaaccaatagttttgtcactgaagttgcagtttttatgaaatttactctatttcagtatgttgcttcattattttttataatatcctatgtacctatttagttcatcttcacttagttgttatttctcccttctctaattaagccatataacatcaattgcttttagcgcttaaatgattaatctatggtccaattatctccctccttttcttctctcgttaagttatatcacctcaattgttttaagcccttagataattaaaatatggtccaaactatctccctacttttattctctcgtaaaaccatatcatattacttttatatttgaattatcattttatataatatttaaatttaaattatcacaaaccacatcaacttacataatcttatatagtgtaactatcttacacattatttttacttattgatatcctactgaacttccacagcaacacacaaagtttcacctagtttaactaaagctaggtgacagtggtgacatgtggtcacattgttatggacccacatattagtgggtcaagggcacctaccgttacgatagaggagctgcttccggaaaattgaacacactcaaatagtgtcaggttaatttctttgtactagctatcatcgttaacactgaaacatatcaagacaaaattataaaaattaaagatgtttttgccggtattttgctacgtcatccgtgtatgagtcggtttttaagttcgtttgcttttgaaaatacatatccgtatttgagttggattttaaaattgttcacttttgttaatacagaaagaattatataagaaatttatttaaaaaaactcgcatgctaacttgagacgatcggagtcctaactgcagctcatgattttctaaaaaatatatatccaagcgaactcccacagtgaatttcatcttaactaaaccatataataacaagattaaaataaattttacccgttgcaacgcacatttttttctagtcatcaagacaaaagtaaaacaactactatagttattaatttagatccagacaaaaatgaaacaacgcccatagctattaattttattaacttgtactccttcagtactaaaatataaaaatctaaaatcggattggatattttttaatttcttatattttgtgagggaatataaatttatagagttacatatagaatactgaagtatatactagttgcgtaattgtgacgccccgattttcgttcgggattaaaaatcatttaataaggcattttctagaaattaaataaaagttaaagctagttaatcaagtgaaattattgagggaattaaaatttcctttaaaattcatggccgggaatattttgtaatattctttgtgccctaatgtactctccggaattttccgtgaattttcggagctcaagaagtaattttaatagcacaaagttcatttaaccaattagaataaaaagaaaagaaaaataattttccccttccttgctttcgggctcggcccaaattcctcccctccccatctcgggctctctctctccctcggcccagctcgccgctcggccctctcctccccgaagtctactttgcctccccagccggcctccctctcctctttggccgacaggtgggacccatgggcccacctgtcatccccaacctcaggccggcaactgccgttgccgccatggccgccgaaaaccgcccacgtcgccaccattcccggcctcctcgagccctctctcgcgtgggaccgggagccacccctctcctccacctcctcccccgcttttccccaaattttggcgccgaatcgagccccacttcgcccacgatgtcgcccacgtcgccggccgttgccgcttcaaatccgccacatccggccacgatttctcctccccgagcctataaaaatgatccccgtgccatcctcccccttttccccaattttcccgaacccgctgcactccctaccgctctcccctcgttgctcccgcgctctgctgctttccggcgagctccggctgtacgccgccgtcgctgtagccgccgccgcgccgcgccgctgcaccgtcggctccgccgctctttgccgcacaccggccaccgccccgtttccacaaaactccgccgaaacaccacatccaccgtgcacccgagccacagccgcctctcgtcacctccagtcgcgcgccaccaccgctcccgtcgctgccgcgctgcgctaccaccgccatcggcatcgccgttcctcgccgcaccccggcccctactccgtttcccctccctgcccctggaacgccgccgccgcgttcaccatctctctccgccgccaccgccgactccagccgcgtcgcgccgccgcttcggtcgacgtcgactcgcgccgttgcctccctcagctccgcaaggacgaggaggacctcggccgccgcccctcttcgccggaaatccgccggagctcctccttcctcggtcgccggtgagctctacctcttgtcatcgccatcggccttcgtttccagtcaccccgcatcggtcctcccctccctaactccctcttctccttctgaaggtcaagggcgaccccgtccgccctccgtcctcgcaagccgccattgggcaatcgtcgtcgccgtcctcttcctccgcgtcggccgccgcttccggtaaggatctctcctcccttccttttttttcccgtccccctttcttgccgaccgccgcctcttggggtgcgtcgccgtccccgtgcgcgccgctgtcctccggccgcccgccgccgttccacgtcgccggctgctgcagccggttgccgcctcccccttgccgcctcccccttgccgccgcctcccccttgccgcctcccccttgccgccgcctcccccttgccgcctcccccttgccgccgccgcgccatgtctcggccgagccggcttcatgccgtgcccgtgccccagccgcgccgcctcgtggccgtccgatcggctttgggccgatccgggccgtcggttcctgtggaccgcctcggtggtcccagtccacggtggaccggcgcccttgtgccgctgaccggtggggcccgcttgccggcgccgcccctcccccttgatgacgtcagcgagttccatttcctttgtaaaaataaataataattgcgcaataaatcgagtttaattctagaaattcatttaaatggctcaaaacttctaaaattcatatctaattcattcgaactccgaattgagccattcaacttgcaaaattcatctaaaattgagctctacatgtttgtttactttttatgtactgttttcttggtttttattagagtttttcctcgttttgcgtgccagcgtgtagaatccgttgtttcggaagtccgcggtcgcgaggaaaagagttcggaagattgttttgaagaagcaaggcaagtcacacattccccttgagcatgtttatcctaatttataaatgttttaccgtttacaaataaatatgcatgttttgctaattacatgggatctgggtattacctatctgctcgcttgtgccatgtttacttgatatctgttctttgtcaaccttgggtaataaatcgactagctcatgttacttatgtgacctagctagaactatatgcttagccatgcttaattactactagctcagttgatgggataattacagtattagacctttttagtatcagaatgagctatgtgctcaagacatctggccatgcttcatggttataattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgttttgttcaataaaatgttttacaaccgcctttatgcaaatagccacaaaccgtccttgtgttccccttgcacgcctgcatcgttggtgtggcttgctgagtacggtggttgtactcagccttgctattattccctcttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttgggactgtgtattacttgtcgttttgtgtaccctggctggtcctggacagggatttaatacacaaaatagtctggaaatttgggctaaatttctgggcgtgacagtaatcatgtacgactttgcattctagaacccctttatcccagtagcaccatcccatttgctgcccatgctaacctctcctcagacctagcttccatctctacctccgctggcgcaccgccctgaacatcagcctcctcttgctcgtcgacggcatccccattcttctcctccggcaaagcctccacaaccgctaatgctcctcccgatgacagcgacgatgatcaatttgttagtgtgaacgcaaatatgatcttgcggctaaaccaagtcggcagagagatttttttggacgatcgctacagtgatcgacctctcaagaacatccctgatcgggggatttaccgcctcttctagtgccggttccccctgtgtatagtggctataaatagagataaatacctaagtattaaaccctaagttttcctttgctacccgatcaagcaaaacccactgaaaacacagggaagaaccgagacacgattatctctgtgcttccaaacgaaaagagaagaaagaagaacaaaagacagagacatgggaactcctggagatcaaggtatgacccaatcccattccaatttgtagttccattttgtgccaaaccgatccaaatcatgcaatccaacaatggtatcagagcaaggttggcctcaaattggaactcagtaagtgttctgtgcaatccaattaaatttgttttagtgtttatgttcaagttgttcttcgtgttcatgcccaaatccctctgttaaagttgaattgagcccaaatcatgcaatcctgaggtataagaaacgaaattaggcctactagggtttcggcttgaagaaaatagaagaaggggaaggcaaatttcatgcaaatctcagaaattccccaagaaccaaaaccctagcaacagtaaaccccccccccccaaaaaaaaattccccaaatcatggtaccctaaccctaaaatcatggggaaaaggagcgcggcgggcttacctaagggccatggtggccggtggcaaccaccgtgtcgccaccgacgctgtaagaggcgagcgtgcgctcgaggacttggtccccgagcggcctcgtgacccgccgtgctggcccggctcctccttgcatgcttgctgtcgctgaggtagccgttgccggccccgtctcgccgtcgctgccgcagatctcccttgcgcgagcgaccggcgggtacattagggcaccgtcgagcaacgctcaacggggatgcgcgccagctatggcggcacgcagccccggcgagcaaggctcggtggcaccatcaccgaccccgtcgtgcgccgtttcgccgccgtcgtcgtcgtctcgctcacgtcgccgcgggtgtgagagaaagagaagaggagagaatgggggctagggtttctcggggggcggccgccgcgccggttttgtcccgcgcgggagcgatcccggccgtccgatgagatggacggctcggatcggctcgctcccgacgcaggctgacgaggccgtgcgtaaggggtcgaacgccggcccaggcccaggttgttgggcctggagcccaggcgggaggcggcgcggctgtgatgggccaggccaaatgcggcctagctcggggaagaggcccagctaaagtttcaataaaaaaattaaattatatttggtttaattcttaaattggctgcatagtaacgggctgcatagtaacgtgtctaagaaaaggattgggctaaaatgatattacaattaaatttttctttttaaagaattatgattatgattattgtgtttaaactttaaatatattttataatgctttagttaataataataaaaataataagtgactttattatatggtaaaattctcttttatttatctgtttattttatgatcattacattatgtttattacttaaagttattattattttatgcattgtgagtttatttgcgctgcaaataaatattgtaattaagtgtgacaaacaattgtcattctggccaaagctgattgaattttatttgatcacaaaattttattaattcaattcaaatctggccaaagttgttctgattgaattaataaaaggagttttttttaaacaaattaataaagtgtggtttgtatttattattctggccaaagctgttatggatttgaccagcatcttatgcctcacaaattgctggaataatgggcaatattgaacaacttaatggaagtaattatgcttcatggaaggagaagctggaaattactctagctctgttggatattgattacgccctccataataatcctttgattgagcctagaccggaaaatgagaattatgagacccttaaaaaggaatatgatgaagtaaaggcaaaatgggatatttcaaaccgtaaattccttatgattatcaagagctccattattgacgcaataagaggagcagtcccagagactcagacagccagagaatatcttgctaaagttgaggaacagtttaaaggctcttctaaagtttatgccaccactcttattaaaagattggtcaatgaaaaatatgattttactggaaatctgagggaacatgttatgaagaaatgtcacgtggcctttaagcttaaatcaatggaaatgaaaatctccgaaggtttacttgtccatttcattatgtcatctctgccccaggaattttctccgtttacgatcgattataatgcaatgaagatcaagtggggcattgatgaattaatagccatgtgtgtgcaagaagaggaaaggcttaaggcagaaagagttgatcatgcgaatctatttaaacactccgagaagaaaaggtataaaaaatttaagaaagagtttttgaagcctaagcctagtcaatttaaagaaaaggggaaatgttcaaatcaatcccagtagaataaatctggaggaaatccctatacagaagaaaagggaaaagaaaaggatgggtgctacttttgtggaaagagtggacaccgccaaaaggactgtattgggtttatgagatggctcagtaagaaaggtactgatgttatttcttttgttgatgaatccctgaatattgattatgccatcaattcttggtggattgactcaggagcaacaattcatgttgcaaattccttgcagggattcactatgaggaggaccctaagaagaggggaaagaagaattaaagttgctaatggagttgaaactgaagttaaggccattggagacttcattctcacacttcatactggcttcaaatttcagctgcatgacgtcctttatgtaccctctatgaaaaggaacttaatttccgtttcacgtttagataacggtggttactattgtacttttggaaacaatagatgtataattatgcatgataataaagaggttggtctcgccgatgggcaggaacaactttatcaaatctccgtgtgcgatgccacctataatgttgactcctccttaaatgcaaatgtcagtaccaaacgaaaacataacgataatgagacttcttcgaaattatggcactatcgtttgggccatatttcgagggggagaattgagcgtctcattaaagaaaacatcctctatcctttggacttctcggatgcagacattgatcactgcattgattgcatcaaaggaaaatattcaaagcaaatcaagaaaggtgcaaatcgaagtatgggagttttggaaatcatccacacagacatatgtggtccatttaatgtaaagtcagtggatggatttgatttattcataacattcaccgatgactactctcgttatggatatatctatccaatcaaagaaagatctgaggcattagacaaatttaaaattttcaaagcagaagttgagaatcaacatgattgaaagatcaaaattgtaaggtctgaccgtggtggtgaatactatggtagacatactacttatggtcaaattcctagaccttttgcgaggttcttacaggaaaatggcattaaggcccagtactcagcaccgagcgaaccccagcaaaatggagtagctgaaaggcgtaatcgcactcttatggatatggtacgaagtatgttaagtcactccattctgccggtaaagttatggatggaagctcttcagacagctgcacacattcttaacagggttcccagtaaattagttcctaagacacctaagacagctgcacacattcttaacagggttcccagtaaattagttcctaagacaccttttgaattatggactgggaagaaaccaaccctaaattattttcatgtgtggggttgtcctgctggagcatgagtttttaatccaaacatgagaaaagttagacctcaaaacaatcagttgtcattttatcggttatcctgataagtcaaaaggcatatagattctactgcccaaatcagtttacaaagtttattgagacaagacacgatgtgttcttggaaaatgacataatcaaggggagtatgacacccagagaagttgttctggaagagaaactgaattacgttccaatgcctctaattgaagaacccgttttctcaacacatactcgtgttacaccttcaatagaaagaaataatgatgcaacatctgctgaagctcctgcaactacttctagtagtatatcaaatgatgagaataatgaggatactcagcagccccaagttgtgatagatgagcaaaataacgaacccgtcagaagatcacaacgagttagaaagtcagcaattccaagtgactatgttacttacatgaataaagaggtgaatgaacctatgagtgaagaggtgaatgagcctatattagacattgatcccatctcatttaaagaagcaatgaagagtgaacattcgtctgaatggttaaatgctatgaaagacgaaatgaagtccatgagtactaataaagtctgggacttaatagaaattcccgaaggagccaaaacagttggctgcaaatgggtctataagactaaacgtgaccctaagggaaatatcgaaaggttcaaagcaaggcttgtagcaaaatgatttacgcaaagagaagggattgattataatgaaacattttctctagtctctactaaggactcattcagaattattatggcactagttgcccattatgatttggaattataccaaatggatgttaagacggcattcctgaacggtgatttatatgaagatgtatacatggcacaaccagaaggttttgttactaaaggaaaagaacatatgggatgtcatctaaacaaatcaatttatggactaaagcaagcatcaaggcagtggtatctaaagtttgaccaaatcataagacaatttggttttaaagagaataaaaaggataattgtatatacgctaactttaaggagagtaagttcatcttcctaatattatatgtcgatgatatactcttggccagtaatgacaaaaatatgctactggaaacaaagaaatttatggcctctaagtttgaaatgaaagatctcggtgaagccacctatgtgttgggtatagaaatttaccgagacagatcgaatggtgttttggggctatcctagaaagcatatatagaaaaagtactgaagaagtataatatgcataattgttcagcctcgcctgctcctataatgaagggtgataagtatgaaaaattccaatgtcctaagaatgagtatgaagctgcacagatgaagtcaataccatatgcttcagctgttggaagcataatgtatgcacaagtgtgcactcgccctgacttagcatttgttaccgggatgcttggcagatatcaatctaatccaggtctagagcactggaaattagctaagaagaccttacgttatctacaaggcactaaagacctcatgctcacatatagaaagtctaaaaaccttgaagttgttggttgttcggactctgatcttgcagggtgtgttgatgataagaaatccacgtcaggttacattttcacccttgcaaggggagctatatcatggaaaagctccgaacaaagagttactgcatcgtcgacaatgcaggctgagtatgtggcatgttatgaagctactggacaggcaatatggctgaagaattttatcctgggattgagagtggtcgacagtatatcaaaaccactcaaattatactgtgataacaaaccagcagtatactatgcgagtagcaacaaatcaagtgcttctgccaagtacattgatatcaagtaccatgttgtgaaagaaatgattcaggatcagacaataagcgttgaatatataaacactaagttgatgttagcggatccactcacaaaaggcctaacacccgttgtatttaaagagcatgttgccggcatgggtttggtagaaaagcctttgatcctggaataagaaggaacctatatggcactgactccccataaaactaaggcggactcattttgaaattaaataggaaccatagtcacttggttcagtggtgcttaattgattactgtaatctaatgtcttgatgtactgttttaatgaaaagtgagtccataagtttgtatatgcctaatgtaataagttcaaagagctcgtaagattaaagaagtttattttaaaatataatggtgtgctatagtcactggattctgttatgctttatattggtcactgtaatcttttatcttggtatgctattatgttgagagatggacttataaatttagcctcacgattaagggggagaatgttagtgtgaaagcaaatatgatcttgcggctaaaccaagtcggcagagatattttttttgggcgatcgctatagtgaacgacctctcaagagcatcctttattgggggatttaccgcctcttctagtgccggttccccctgtgtgcagtggctataaatagagataaatacctaagtgttaaaccctaagttttcctttgctacccgattaagcaaaacccactaaaacatagggaagaaccgagaaatgattctctctgtgcttccaaatgaaaagagaagaaagaagaacaaagacagagagatgggaactcctagagatcaaggtatgacccaatcccatttcaatttgtagttccattttgtgccaaaccgatccaaatcatgcaatccaacaccattctcctccttattcttcttcttcttcaccttcgatgatgacgatgacgatgatccagtctcctccttattcttcttcaacttcgccttccgcacctgcattagggcgtcgtggacgttcatggcagcgtcggcgtgcggggcgtcgcctctgaatgcattagggcgtcgtggacgttcatggcggcgtcggcgtgcggggcgtcgcctctgaagtagtgcaccatgaccagcccgagccggccgtcctcatggccatccacgccatggctcagccaccgggaacggaacgcccacagatcgatcatggcttcgttggccatggcggcgttcttgtccttgacgtcaaggtggttttctttaaggaattcggaccattccaggatgagccggtaggcgtcgttgcagttgaggaacttgcacttgaggtcgtagtcccggccggtgcggtcgtaggcctgcactcgcaggccctcgtcgccgtcggcggcggccttctccgccggcgtcaggagctcctcgaacgggaacggctcgtcgccgccgcggtgcgtgttgtgccagcccttgcacgacatgagcagccggtgctgggcgacgctccggtccgtgaacgtcatcttcttgccgtagacgcgcgccggcggccgccacggcgaggcgacgaggtaccaaaggttcgcgcggaggttgtcgtcgacgacggcgatgttgtcgagcgtcgcgcccgtgtcggaccccgccgaggtcgtcgacgccatgtcgtgccctagtgcggtccagaagaacgcgcggtggtcaggcttgggcttcttggctcccggcggcggcgtcgcctcatccgcggcgacgtgcggtggtcggccggctcccaggatggcggcgccgccgatgagcttcttctcgacgggacggggacgccggcgcgcggccggagcggcggccctcaggccggccagcttgcacttccggacattctctttcatgctcggcgtcatcattgcaatggcgtcttcttgccgtcgaacacccaggaggagggtgtcagtgtcaccgccgggaggcaggtcagccggtgcgccgccgctgacgctcggcgggctctggtcctcggcgaccatcttccccttccgcagccggccctcgcccaccaacgtctcgccgccggtggcgcacggcgcgctctggtccgcggccgccgccggagctccaccatctggattgccgaccatggacggcgtcgacggcggcggcgcctgagtcacagtcgccatctcctcctccaacgccgccgccggcgatgtctcccgccgggagaccgcgtcgaacgacatcggaaagacgaaaacctgaaagaaatcgacgaacgatctgggagtccggaagaatgacggtcggtgcaatttatttataaactgttatgcgtatagataccatttgtactggtaactgtagcagatgcgaactctatctcgttattttgtattttaaattttatagatagaaaggtttagagattcaccgggttatcttttgtcgttttatattccaaaaatattaaaacataaaagtaaattaaagtcacaggtggttccatggtctagcggttaggacattggactctgaatccagtaacccgagttcaaatctcggtggaacctgtttttgcaacttttttttaacttttttttccagtggtgtaacgagcatatgatgtttaaatttcattgtcaagataaatctcctatgaaatcgcaattctcaagctgattatttcattgttaagataaatttcctatgaaatcgcaccgaattttctcaagctgattaggacccctttgaatcgcaggattgagaaaacgtaggattttataggaatataagtgtaaaacataggattgcaaaagcacatgaataactattcgattgaaccgcaggaaaaacacatgaattggatgagaaagataaactcaaaggaaagttaccaagagattgaagctcttactaaattttctccaaaatctctatagaattatccattccaaaggaatttcaaaggattggatagaatacaatcatttgtttcaaaggtcttcataggaaattttcctataggattgaaatcctccaaaattcctgtcacagcctgaatttcgtttcaggatttataaattatttaataaattattaatagaatttatattaaatgttcattaatttacaagtgaagttaaatgtgggaaataaaatttcctaaatataaagcatggttggatttaatttttattaaattctccatgattaattatactctctggaattttcttggattcttcagagctcaattattaattttaataatacaaagaacagtttagcaattatttaaataataaattaattattaaatgatctggatattattatattaaatactttgagtgtccaagtatgttcaagatttttcttggaattatttgagcattggaagtatttttaacaattgaaagatcatctcattagttaatttatttggaaaagtaaataaaaatcctcctcctcagcctgggccgaatccagcccattccctcctttcccctctcccttcctctcagcccagataaagtctgtttaacctccctggcgctacagtactccatcttcctcctccagccgactgtctcccgtgccgtgcacagtgccgccgcctcctcccaccaatccgacctccccgttgctcctctttccaaattagttgcgggaatggaatcccctcaatctcctcttccttttccccaagaaatccccaaaattttctatggaaattctttccaatttcgcggatcaaatccttcctttttccggcgagaaccctagactttcccgagtttttcccgtcgttgtgggcttgatcccgagctcccgtgcctatataaaggaccccctagtcgtcctctacccatcccctcaagtcccgtccgccgtcgtcgccggaatcgctctccccgcgctctccctctctctccacctctggcagccgctccagccgccgtgcgccgtcgacccggccgtcgccggtcagtgccgccacttccctcggtttcgcagtgaagagctctaccccggccacccgttcttttgcgccgaaccccgccagaagtcgccgtccccgtgaaggccgaaccgttgccatgttttgatctccggcgaggccctgctgctcatcccgtcgtcgccttcggtcgccgtcgcctcctttgggttggcagctgcgaggtgatggccgtccacccctccgttatcgctgctcgtcgccggaaagtcgtcgccgccatggacagtacctcgccgcccttcgaagctcgttgtcggccatcttccgtcgctgtccgtcgttgcgtaagtgttggtaagaatcgccgtcgccttctctacctcccggtgccctccgtttgcatttttttgtgccgttgttcgccggcaaccgccgctcccatgccgttcgccggtgtaggtttttccctagggtcttaatccaatataatctaatccgcggtttgtctagcgttgtcgtctccatgtgttgctatcggaacgttgtcatcatctctccctctccgatcattttggttcggtgagacttctatccgttttccctcggtttagtttttaatctcccgtttttgttgtcgagtagtcgtcgctctgccgtagccgtgtgccgttgtcgctgtgccgtcgccctaaccccagccgcgtgtctccgccgagtcgccgccgcctagccgagccaagtcgccctagtgccgccgtgtcgcagctgtgtgcctcttaaacctagccaccggtttagccgcggtcgttgttgagtcgttcgctcgttcgttcgaacgaggtgttccccgtgcttcgtccgttcgtctgtgttgagtcgtcctttagtttagagcctttcagagccgccggttccgttcgccggtttcggttgatcatttgggtgatcccgtgtcacgtagaattgactcgttgagtcggtatctcgtgaggttcgcttgcaagattaatcttagccgtccaaaattgatataaatccgttctttcttttcaatgacatattattcctttttaatatatgtcatctaccaaatatgatctaatctttttccggaggatgttttaatcttctgtctcagctataaatcatttgtaaattgtttaattaatttggaatagtcttttctttaataggtttaattggaatttaatcttgtaaaatttgtaactaattcatatgaaatcggaatgaggccgttcaagtctctaaattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaaaaccgattattgcaaggcaagtcacacagatcctaaacacaatcctttgagcatgttgatcctatatttaaattctttatttatttcaactgtgcatttattttcgaatgtcactgggtggtgtgaatctattcctttgttatggcatgtttgcattgattactttattccttgataccttgggttattataacatgactagttgggctatatatattggttcagctagatattagatatgattacttagccatgcttagaaacattagcacactattgggataacttatgactcattattatttaatgatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacggaggtcgctggggagtccatgccttgtttataagagggtgattatgatccaggaaaggtgcgctgtggtggattgtgttgtgcaaggggtattgtcacagctcctttccgagataccgtggtggtattgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaatagttatggatgttatacctagtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaaagctgcttttgcaaatgagccaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgtctcttaaggaagtatttatcgttttagttaatttgatgaatctgtatattaaattgtcagtttgtgtacctcggctgattcctggacgaggattttatgcacaaataagttcggaaattactagtgaatttccggacgtgacaattcctatgtttttcctccaattcaaatgggcccttagtggatttgctcctcgtcaatttgctgacactgatagagagaagagggaggagtgaggataacatgtggggcctaccatttttaattattttgtgtgtcgctgacacgtgggcccacggttttattatttttccgggatcaaattgccacataagcgccacatcaatgccacgtgagacgaatacctagtcaaaagagccacataggtgcaacgtcagccaaaatcaccttgggacttatgttgcaccggttttgaccattgagggacccgttgtatctggttttctggttgaaggatgaaataagtttagggaccttagatgaacttattcctttaaactatggcagaatatatttagggaaggcaacgggacgggtcgggggtgggtggaggtagaatgcccccggccctggcccagcattcttcgccccgcccccgacccagaccaagagttcggggcgaaatctacccccacccccgccccaggcgggtccccggaacccgaccgggcccccgcattggatgcacaacagcaaaggagaacgatgggggcagcacaacgaagcttgtgggcggaagacgttgatggtagtggggaagcagcgaagagggttggagctgtgcttgacctgcacgttgggggacgatctcaaccatcatgcatctgagggctaggaatcaacaaaagacgtcggtcttcaattcacgcgagcattctcttgtttgaggctaccctttcaggcttcaactcgggaggaataggagaggagaacgtgcgccgagggcacaacgacgtggtgcggcgccgggcgcaaggaaatgcgcggtgcggtgccggacgcgattgcgcgaggagcagtgttgggcggttgcgcaacaggtatgcggcggcaggagatggatggggattagggttgaggtggattgcattgcatctatacctgctcgtgtgggcttctttgggctgattttttaatgggctatcggattgctgctggacagattatacaagtttgtcttaggctggattttcctatggtctactggatgtccgggtccccatgggggcccgcgggtgaactagctgccccgcccccgtccctgcttgtttgcggagccccgccccccacggggtcatctttcgccctgtccctggccctgtaggggcgggtccccacagggaaattgccatccctaaatatatttaaaccatggccctgcgtttgggtttgcacgggccgaaagaagggagaccccaacagcaaaactcctgaaccacaaacgaaaggggaaagagaagagtgatcgcgtcatccacgtagcagcgaccaatcgcctattaggacatgtacaaccaaagccactctatggatgctctcactaactgaagccacttaataggacacacatctcccaaagtcatatacttacagctggggcttcaaaatctcaagcaactgatgaagataccctagcccacaatggggtgccccaacccacgtagccacatatatgatttccttccctacccctagcccaccgagcatccaccgtcttctcccttctcttctcttttccttcggcatttttttcaccgattttcttggccttatcccctcgccgcttctcctctccctcctcgcccagatgcgccgccgcctcccgctctctctcccctccgtcgctctcctctctctccctctctgactcgtcgctgctctatccctctctatcccggtggccgtcgccgtttctcctactctttcctgttgccggtcgctgtccacctcaccggcagctggatccactctcccacatcctttctctcccgccgcctctctctctctcttgccgccactcgtcgtcgccgcctctctctctcccgtcaccgctgacggagaacgacgcgcagggctcggtggccgacagtaggggtgaaaacggtacggaaacggatggaaacgacctttaacattttcgttttcatattttttccgaaatcggaatcggaaacaccggaaacgaaaatggaaacgaatagtatcgaaaccgaaaacggagcgaaaacgaaccggcgcggatacgataacgaaaatttatcggaatacaaaaacccctcaaacttttgtcaagtccaattctcaagtctcaacagtcaacaattcatcataaaacacaattatatcaagactaattgtttagtatcaacagcaaaatatattcttctataacttcatataatttgcataacaaatattctaaaagaatacagcaaaacacaatggtataaggtatacacaattcaggtgctatactgctatcagcctatctctccaggaaatgggtttgagaacaacaacagaacatcagtccatcaatacttagttcatcaatcatcacagaacagcaacttctactcttgccactgcacccacatttgtggtaggatctcctacatttgcaagggttggttgtgatgctggcaaagctacaatgcccgcattgcatacacttgcactgctgctacttgcatttgatgattccatcacaaatctgcagcataaaagaaatcaaatcaatggtttaggctcaagaccacagtctgtccttagctggacatagtagcatatattatttttcagctgcatttgtattattccccacaaacaaagcagtatttctataattggagtgcttggcaaatggcaatagagcatattaataacttctacaaaattaacagaacaaaataaaatccagaagcaagaaggcataaacatataaagaaaataaaacctacacagtattcaagctccctacacagaatgtaatataaccaagctccttagtacaaagaaaataaaagacatcaatcattcaacattcactcaaatatatagagcctacacagtaacactaacacagagtgacagaggtggaggttaaggaatgaggaataacacctgctggttgctcagttgctgccgctgggctgctggctactgcgaggcgaggagtcgtcggcgttggtggcggtgaggaagagtcgccagtggggcttgaggtgtcatcggtggtggtggctgtcgcgtcgtcgtcggtggtggtggcggcggtgaaacggcgagacgtggcgggacggcgtcgtgagataacggggaccgagcaggccggcggaggtgcgagatggtggcggcggccagcggcgaaacggcgaagagcgagggcggcgcgagatggtgggggcgaggataggacggcggaccaggtggcgagcggtggcgcgggcggtgggcgcgggggcgcgcgatgccgcgatctggatgcaccacagccgccgctccgccgccggctcgcgtttgcgtctgtctgtctctctcctctctagggttagccggttagagacttgagttagggtagatgccgcgatttgggttgcgctggaaagttggggatgaattatggactattgaatctatgggcctttttaacttcggaaattccgacaatttttccggaatgtttccgaccgtttccgagttccaacggaaactgctattatcatatttgattccgtttctgggaaaatatttctgttttcgattccgtttccgaaaaaatctgaccggccgattccatttctgaaaacatgaccggaatctggaaaaattccgtaccattttcactcctagcagatggcgagcggaagccaagcccgtcgccgactggtggccggcggcggccgcggcgcgaggaagccgtctccgcccgtcaccggctggtgaccgacggctaccgcggcgcgctgtggccggatctagtcgtcgtggatccttgtggccatcgcagatctgtcgacgtcgcctctctctctcatcgccatgccgctggtgaggggcaagaaggggaaacaccaggggaggaggtaggggacagggcactgggtcgccccaacgcgtagtctcgaggaagtgtctctggaaaagagaaaaagagagctgaggagccagaggcgtgcgttcccctcgtgggggtcgcgcctccctacagggacacgccgcgcggacgtagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgtgcacagtttttttttttaaaaaaaaagcaaaggaaatgtgtaaggaaaaaaaaattaaaaatggaaataaaatgtttaaaaaaaagtaatgatttactaatgttaaaaaatgaaaaaatggtatttaaaaaatggaaataaaagttttttaaaaaagtaatgatatgctaatgttaaaaaaaagaaaaaatggtatttttttgttgtgttgaaaaatttaaaaatatagattgtgattcattattatgaaataatttaaaggtaaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtaacaatttcaagaaggttgtgcaaaattatattagcagttggataataaacatgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagctctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactctccaaagttaaggggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacacaggaggttctcgatctcttcgagccggtgtgtgtcgaaacacttccgctcgcggttccggaaaatccttccgaagctgtcgcctcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaaatgcacacttgagaacaaagagagcacttaaaacacttgagagcacaagatgaggagtgtgggatgaggagaaatggctggggttcatgccctatttatagggcgaaatttgagattttttggaattttttcggaatttttatgaattttttagcctcccaacggttattttcaaatttcaacggtcaaatagccgttagtgccacgtgtcgccgtcccattggaccgccgcccgcctgccgcgcctgacgggccgccgccgtgccgtgccgggccgtgccgtgccggcccgctacagtagccgtgccgtgccgtgccggcccgcgtgctcggccagcggcccaagcacggcacggccaaacgggccgtgccggcacggcccgttactgtagcaggccgtgccgggccgtgcctgctacaggtccggccgtgccgcgcgcggcccgtttggcccggcccatttggccacctctacgcggacggtgtgagctggggaacgatccaggggcacgcattgaacagcccttaggaatgcttcctgtcacaagtttcagctgtaccggataattctgatggcacttagcatcaatacaggagctttggaagagtttccgctcagtaccgtacgtcatcattcttagtgttagtctacagataattagaatcaacagaaggaaatttactagtcacaactcacaagtcataaccatttgtcttagaggccaaaagactgggcaatggcagccaaactaagagtttacaatcactcatccaggagcatcagtgcatcactaccgagttcaggccagatctgaacactacatatcacagtctacagcaccaaaaattgcttattctatgagcagaaagggggtgaaacaaacaaagaaaaaaaaaacagggatgtaaatagtgtacacactacagactacattagccatcattgcattggcctcttcaaacggagctgctttcttctgggagtggcaagtatatgaagacagcgactaacaagatcaggaatgccacggtgatgtacttccagttcagcactgacggctgtatggtccggactgcctcagcagtgccctccccgccagagtcatcatcctctgaagacctcgtcttctcttcctcattgctagggtctacaggtttctcagcctgtacacaatttcagtaacgcaacaagagtttgaaaacctcagaagtcggatcaagatattatccatgttctaaaaggcatttagaaataatcaatcaactatgataatgtcttgcgctgacagctacgtctgagatctcaaacagatatgctgcttacaaacttgtgcgtctttattagaaagaagaaagcggaattacattgcaacagaaccaagagaaaactgtttcatacatctgtgtgttaatccaagaaatttcaatacagttgtacaattaattcatgtaaacataattatataactatagctcaattgttaaaagaagttttactacacaatattttaaaagtaatgagatagactgacttgagtacatacaaatgcgtacttactacgaatgagagattgactgacttgagtacatactacgaaagtgtagttactaccaatgggtacttgggcttttagttgctaacacaacccaagtcgtacctgagaggttgagcccaatctggccatcttacacaaagctcaacctaaccacaaacttaaattggcaggttcagcccaaacccaagctagacctaattacttcaccacagcaaatgttaacttactaatggcatgagtatcaaatagttgtggatgatgtcgaccaagcagcagcaatttataccttttttgtacagtatgaaaaagagaatcaactaaagataattttcaccttagtctgtgatgaagaaaaatcaggaactatttcctccgctaatttagtagaatgaagctcaacatctttgccagtaacatttttgctcaattgagtgtcatccttaacacttcctttgcacttctgagccaatatcttgtttttctttgtcaacaacgaaatctggagccatcagaaaagaaatcatcaaataaatatggaacagcaacagttcaacttactgcttaacatagattaattcagatttggtagaatatgagttcacactgtatttagtgtagcacgagtcatacgaaagttttccttcctaaaataatccaaaacacttaccattgcttgaattggaaaacaaaacacaccatgaaaatagtatcatgtcagcttttttccaccacaaagttttagattttctgtttacattcaaaaggtacatgcagatctttgaactttgatgcactaaagctaggtcacaatcccccactgtctaagtctcactcacatcatgtattgtcttgtttacctttgtcaacaagaataaccaaactttgcaaataatgaaaatggttcatcggtctaaacacaagcatggacttcgaacatagtcataaacagatatttggatttacttagaatactaaaaggtaaggttaacatctagtcttttttgtatcaactcatgtcttgctaaatttggaagcaagaccaatccacagtgtcattcaacacagtaaaattaaaaggtctaattgaagatttgtatctttttcttgaatcatgtgtttccaaactatgcacgagtagcatgtatatataaaaaagctaaagtattgacaacggcaacaaaagtgtattcggtcgcgtatagacctgttgatgaagtcgttctctttccaatgcaagttttgtgaccaaatcagtaattatttttgttctgattccaatatccttgacggtagacatcttaacatggttggcttcatgtaatgagttctctagactttctgctcgacccctcagaaacgatagctcctcactaagttctaagttagtgtctgttaacaatgtacacttagattcagcattctctgctctggtttcagcttttaaaacctttcccttcagatcatcaatcatatgttccatgtccgacattgtagatctcagcatactctgctgttcaacagtggcatcaagagatgcctttgcatgctctaattgggtatgtgactccttaagtttcctctccaaaaggctagtcttttctgaaccatgacttttaagagagtttagctccccattaagttctatgttagcttcagttagctgcatgcaccttaactcagcattttgtgctctactttctgctcttgagacatcttctttgagactcttaataatgttttctaatgtgcttatctcggcatgcagcacattctgctcctcctgaaaagtttctgctgatgcctttgccaactgcaactgtgaatcagattccctcaactgtttttctagctccttaaccttatcctgcaaggatggcaattcaggacttggatgagtttctgtgcctccactatgttgactcccttcttgaatattctctgcgttgacttgcagtgaagataatcccatcaagctttctcctaacttcgactccagatcacccttcctacatcttgatgcacttagatggcactctacggtactaactttgtccacaagttcctttgaagttcccaagagtacctcagaagcgttttctgctgcaaatgttttcccacataatgattcgatagattcctccaggaaatatttttcctgatcatgatgatggagctttagtttgagttcttctataatacatcttgattcagagagcttcttttcaagatccagctcacttgctatcgattgttctaacatctgcaaaacatttcttcgttgatcctctgtcctcatgctagtgtgggatgacacaataccattttcatacccagcgtctccagtaatgcctgtataattgtagttagaaaagagtgctaattgatgcatataaaacccagggtaactgagcattaccttctttgtcatggggaaactctatggctttctcaaacttggctgactcttttctgatatcagaaactaattccttcatctgctttaaagacaccatagcagcatctagcctagctttaatcttgcctccagattcatcttgacaaaccatatgctcaacattttgaatatcagtctcaagagtactgatcatgtcatctaactcccctacttctgcatctagaaaaccatataggatgtccaattcaaaagcactctcggcagtttcagaagaaacagattcgtcttccaatgtaggaggctcaaaatcagtagccttgcgagctatctccatcaccaacatctctagatttagtaatttctcagaggcaaatgcaagctcaagttccactctagtaataatttccatacttcctccttctacattcattccatctccattacccatgttttgttggaaatggtcatcatccatactgttctcaacatccataactccttttctgcctgctacacatttggttatacacaaaaagggagacatgtgagatacaagaaatgcacaaataggaatattaaagaccaaaataaataaaatgaaaaagaaacaataaaaaaaattatctatcataagtgacgtttgtagcttctggttcatctgatggaccaaaggttttaagagctaatagcattccaaaaacacctaagagtgtttatattaaaaaaaaatcagaaaatgtacacatcagaaaaccaatcatgttggagcctgattggacaagaacattatgggaaaatcaagcttatcaggcatcggtccaaaatgacataggtaggtagaaaaggcccagcttacatgttcccccgatatcgtcaaccaatttaacaagcattaacctcggtaaggactgggacgcaatactactatttgagagaaaaaatggagggacagaaagaaacacctccccgaatgaactaacaagaacagatcagaaggaaattcaacctcatgatccaacaccaaatagaatgacaattcgtcctatgtgctccattcagcacaggaaatgctgaaattgggcttctcctaactcgggtcagtaatcctgatggattccccctctcctccaagtcggatttgctgttcatggtcactatgaccgtacaaaagtgctctgctttcgtgcgcactacatcatacaaaaccaaaccaaagcgccgtatcagccgttatcccaattcccaccagcaccagctagtccccccacccacggggtgatccagattcggcggccctccgcgcgcgagcggttgacccgaatctctcgctgctcgcagctaaaagcaacaacctacctaccagtgaaccacacggactagactacagagcaggaggcatcctcacgccgcgcgcgagcaggaggcggcgagatgggagaggttgcctgcggcttgccgttacctgggctcgtcggaggcagcttgccgccgccgccgccgtcgccctcgcgatctccgccgggaagcgaggcgagatgatgaggtggccggattcggatgctgctccactcctctgcctcgcctcctctttgcctttctctctcctccctttccttttcagaaaattaaaaggaaatggaaaaaacgaaagaagtgggggagacgtgcgtgccaactaggcgcacgtgcggcccagaaacggacgacgtggaaacagcccacgggccggagagcccctttgccttcgtcctcctcagcccagaacagccgatagagagacgtccattgccgccgagaaaattgggtattcctaatgggcgggtgatcgccgagaatgctaatgctaataggcgggtgatcgctcctccgtccgcccagcgatcacccgcccgccccctcccctataccgtacacttatccctcctctccctccttcctcctccccttcttctcttcctattacagtacaccacataaaatttttttaaaaaaataaaaaattagaaaaatttatgtatagaaatacttatatataaaaattttgaattcaaattcaaatttaaatcgggtatataaacttttgacttataaactttgggtctataaactttaggtgtataaactttagatgtatagaaatactatatatatagaaaatatttgaattcaaatttgaatttgaattcaaattcaaatttgaatcgggtatgtaaacttttgacttataaactttgggtctataaactttaggtgtataaactttagatgtatagaaatactatatatagaaaatatttgaattcaaattcaaatttgaatcgggtatgtaaacttttgacttataaactttaggtctataaactttaggtgtataaactttagatgtatagaaatactatatataaaaaaatatttgaattcaaattcaaatttgaatcggatatataaacttttgacttataaacttttggtctctgaactttagatgtgtaaacttaaggtgtataaactttatgtgtataaatttactaaaataggaaagtaatgcggtgccaaaaaagaaaaccaggtggaggggtagagggagggaggggggaggggatcgatcgctaccccagtatccgggcaatcgatcgcccattaggatcccccgctttgtatgccatattgtattttgatctctctaaattactattttcaaatgatgtttagtttggtctatccatagaaaaacagacctataacctatacagttgggtggcacacgtctgataggatgtcaatggcatgctagttagacgatgtacttctccatatccctctcttgcagcacataacgacgatgggccaaacaaataaagtgaggccaccggagttttagggcctcatcttttcgtgtatgctgcttatcagctaaaatttgaattttcaatcttaaatttgaaactgattttgagatttttttttatcaaagtttacttttcagcctttgattttagatcgctaagaatacgtatataaaatttatattcagcatttgcaaataagccatttcgtttattccgcaaagagatgccaaagtgcattatcttttaaagtgataatttaatgaagccaaaataacccgtcgttgaagattgcatagcaattttctcatggccgccgcggccgtggtggattggttgactggagggagctgttcgtctttgacgccttgacgggttcccgcgggtaaggagaagtaggggccaagaaaccctaggtttccagttgattggagggtttgactgctttgcagcgagtacaaaaactgggctcgacggcggccatgtcgcagcactctttccgcctccaaaccactggagcagccgcagcaagcaacctcttcttcttgttctttcgccgcctcacaaatcacaatccccccggtatgcaaatgcaattcctccttgttcaaatgttgaggatgcgatacttcatttttgtttaaatttttttagggttgaggggattatgtcaagtactgtagtaacattttggtttgcgttttttttccatgtgcttcatcagggtgtaaatgaactaaggggaaggaagggttctagactggagattgcattctggtcatataccaaggtactagatttttgctttgattgtgataaatctacaggaacgaattagattgtagataagaatcacagttttcaatagcctctgtttgcctgcaaattatcatttaaatatcaaatctcgttgtagcaaacttggaataatcccataccttcaattgtttttgaaaaaccaacctctttgcatgtatttcatcagaaaatgtttaaactcaggtctgagttattatttcagaaattttagtgaattagatatgaaaagtgaaatagggacgagatggctaatattgaagtagatatggactatccatataaacgaatagatatttcaaaattgaaattcgaatataatcttgccattaaaactagactaccaaatgtgctggggatggggatctgaaggtttacagcagtgtggccaacttccaaaaacaaaagctttaaaatttaaaaagcatgacaacctgaaacatttcctgaaaggcatgtcttttctgtgatagttgtgatttagtgagaactttcaacaaatttgctctgtacatattattgaatcaaaataatctactcatagatggtattgtctgttaccctccttgctttgttggattttgctactttgcatcaactatagctttccatatacttcacaagataactatttatctgatctgtttcatgcgactttctttgtcttgcattatgcaaataattctaacttttttgccacaatattctgttattctgttgtttactctcagtaaccactttattttctatcacaaatcaaagctgttcacaagtacagtttatttgggggttttgcatactgcattttaaatcaatctaccattggaccatacactggattcgtttgtagtttgtttcaggttttttgtacattacaaaaaatgtttatttctgtatttaacacccttttgttggttcattaggaaaagagaaaatgtcatctagttatgatgaagggaaaagttttgctcggagggaccttttgcttaagatccaatctgaagtgcaaaaatgttgggaagagaacaaggttttcgaagcaaaggctggtgatacacctccaagccctggtgaaaaattctttgggaatttcacatacccatacatgaatggcatgctacatttaggccatgccttcacactatcgaagcttgagtttgctgcagcataccacagactccatggctcaaatgtccttttaccctttgctttccactgtactggaatgccaatcaagccatcagctgataagcttggtaaagagatacaacagtatggaaatcctccagtgctcccacctgccaacaaaaactcaaaatttgagttgacaaatgatagaatttatggccagaccactgctagtgcccaagataagtacaggagcaagagatctaagtcagtagcaaaatctggctcatacaaatcccagtgggagatcatgaggagctttggcattgctgatggagagattgtggaatttcaaaatcttcatcattggttaagctactttcctccgctggccatggaagatctcgaggattttgggctaagttgtgattggaggcgttcatttataaccactgatatgaatccattttatgatgcttttgtccaatggcagatgagaaagttgaagaaaatgcacaggattgtcaaaggcaagcagtacatgatctactccccattagatcgccaaccttgtcttggccatgatcgggcatcaggtgaagaggtcgagccacaggaatatgtactgattaagatgaaggttattccgccatttccacccaagttgatggtcctggaaggcagaaatgtgtatttggccgcagcaacactcagacctgagacaatatatggtcaaaccgggggcgaagctacaggtaatcatcggggtcagtagaccccaacgatgttttgctaatgtccagtacccctcttattttaccagctatgcccccaatgaagagctaaactagaccccagtgacatccttgattgttccatcaaagagcaattctatactagtggtacctcatggtacctcctcaagaaccgtaaaattgctctccatcaaagctcaactggttactataggaacgagatactagcaagcagcaaatagaaaatgaactagcagttatgattatacaatggcccaatatgcatatacgattgatatttgagcccataaataagatcggaagacactactccacaaattccctggttgcatcatcatattcctcgttgtattgcatcggcatcgcacgtcctgacatcatatttatcatattttattttatttccagcataatggaaggcaaataattagtggttttgataatctttgatgcatttggtgtcttttacagcttgtaaaataatccaataatgtacatgttttaataattttatcgacagaagctgtaataggcaagatgtaacactactacaacaggagttggctttattttaataattttgtctcgtagtatgtagtctctaattacaagctgtaataattatgtagttttatttccgatttactgttggattccaaccagccgtatggcatttttcgcaaaaatttgattaatcttgatcaaattttggtctacttttttttattcaaaaaataattctcgaagaccattcaaaatttcactcggaatctacttttgccctgcgtggaaacatcaaaattgcatggttttcgatcggttttggttgaaaacgtaaatcctgattagtacgaatactgaccgcggtaactatttatcctggcttcgcccctgggtcaaacaaactgttgggtcctccttgatggaaagtatgggccttttgagataaatgaaaccgatgtttttatattgacagcaagagctgcacgtaatcttgcttaccagatgctatccagagttccagaaaagccaacttgcttagttgagctgcttggcacagatctgattggtttgccattgaagtcacctcttgcctccaacgaagtcatatatgttcttccaatgcagaacatattagtagataaaggcactggaattgtgactagtgttccaagtgatacaccggatgatttcatcgcattacaagagttggtaaaaaatcaagattttagagtggcatgtggagtgaaagatgagtgggttttcccctttgaagttataccaataattgatgttccaagttttggaaataaatcagcagagaaggtttgttttgatctgaaaatggatagtccagatgagaaagaaaaacttgctaaagcaaaagagatcacatatttgaaaggcttcgatgatggcataatgattgttggtgagtttagcaaccgaaaggttcaagaagtgaagccattgataaaggaaaagctattgaaggcagatatggctgttttgtactatgagcctcaggagaaggtcatttccaggtcaggtgatgactgtgttgttgctctcacagatcaatggctcataacatatggtgaggctgaatggaaacaaaaggctatagaatgcttggacaagatgaatacattctcagttgaagcccgtaatagttttgagcacacattgaactggctgacttcacgggcccgttcatgttcttttggactaggtactcggattccatgggatgagaagtttcttgtagattctctttctgattcaactttgtacatggcctactacaccattgcacatatactgcaaaatggtaacatttatggatctgacaactcttatataaggccagaacaaatgactgatgaagtatgggattatgtgttctgtaatggtccggcaccaaaaactagcatcccctctactgttttgacaaaaatgaagcaagagtttgagtactggtatcccttcgatcttcgaatttcaggtaaggaccttatgcagaaccatctggccttctgtatcttcaatcacacaacacttcttccaaaacatcattggccccgcggattccgttgcaacagacaccttctgcttaattctgagaagatgtctaagtccacaggaaatttcaggacccttcgacaggccatagaggaattttcgtctgatgccactaggtttgcacttgctgatgttggtgacggtatggatgatgaaaactttgtctctgagactgcaaattctgctgcactaagactgacaaaagaaatttcatggatgaaagaagtttttgatgataaatcttcctttcgacttgggccaccatctacttatgctgatcgcgtctttgctaacgagataaactttgccatcaaagacacggaaataattatgatgcttccatgttttgagatgctctaaaagccggattttatgatctacaggcagcacgagatgagtacagattttcatgtggagcaggaggtataaaccgtgaattattgtggcgttttatggatgtccagaccaggcttatcactcctatttgtccacactatgctgagcatgtgtggcaaaagatactgaagaatgaaagatttgtagtgagagctggctggccgattgctgatgatccagattctactttacgaattacaaacaagtacttgcagtcctgcatagttttgatgaggaaatcgcttcataagcaggaatcttgtcacaaagtggccaagaagggagctgcagcctctacaacatttgcggaaaataaattatcagttggtctaatatatgtgaatgaacactatgatggctggaaagagcaatgtttgagagtactccaggacaaatttgacactgaagcaagatccttcactcctgatgaagacattattgatgctctggtgaattgctcttttggacaggagctaaacttgaaacaaataaaaaagttaagtgtatgcctttcattaagttcaagaaagatgaagcacagaatgttggttttcaggccctgtaaccaaatcttccttttggtgaaatggagattcttgaagcgaacaaggaacagatcaaaagacagttgggtcttaatcacatagagatattgtcatcctcagatcctctgatgaggctggtgcaaacagagctggttcatatgcttccgtgctcaggaaaaatccaccttctcctggaaaccctattgcaatattcttaagtaaactggagttccagagtcaaacttgaaaatcactcacttggtttcggtaataacagaacactcaggttgctcctaacttgtcttatgcagataccactcatgctgcctttcaaacaaatagtttgttgtgtataaaatttgtcttacagtttagaaagcacaaactgtatatgaacctcgtatagaaataaatcattgtctgaacattgtacagaaatgaaccttgtaaataagtgtcattctatctgaaatttgtaaaggaatgaacctttgttatgtagactttgtttttagttgtatgtagtatgtactgctaatcattgcttcttcagtgccttgtgttcatcgtcccactgttgtttagttattagcagtagaagttccttaatttgagagaatccattatatgccactgattttgtcacacgtctacaatttaccatcgactttatcatgttctataatataccatcgacttttgcttaaattctacgatttaccatcaccatccggttagcctccgttgtactgtacaattttgtccaaataaccgaaatacccctaggacaaaaactttcaaaatttggataacaaattcaaaatatcatattataaatataagattgtaaacatccaaaatttggccaaaaacataaaatcttatattttagaatttttatccaaattttgaaagcttttgccccaagggtattttggtcattttgacaaatttgtacactaacggagactaaccggacagcgatggtaaattgtagaagttaagcaaaagtcaatggcatattatagaacgtgataaagtcagtgacaaatcgtggacgtgtcacaaagtcagtggcatgtaatggattctctcttaattttaacagatactacatgctgtctatctcgttgtggacttgtggtagagttcgctaaagaagtacggagtactaaattgaacaaattattggtctgcattagtattctatatttttgtatcgtactattgtagtagctcaaagtgatagccggacacagtggaatgctgccggtgatctcaaataaaacattagagatttttatagactacaaccgcttaggaatgtttttttttctttttctttttcttttttttaaaaaagagcatgcatgttaaaatatgtctcacagacaaaagaatgaaaaaaaaatggtcatatgtatctctactattataaaaattgaagatgttttgccggtattttggtacgtcattcgtgtatgaatcggtttttaaattcgttcgcttttggaaatacatattcgtatttgagtcgggttttaagttcatttgcttttagaaatacagaaggagtaggataagaaatctctttttttttaaaaaaaaatatcgcatgctaactttagatgatcggtctcctaattgcagctcatgattttgtagaaaaatatatccaaatgaattctcatagtaaatttcaccttaactaaactttataacaataataagattaaaatagcttcctttgcaatgcacaggtattttttctagtattaaaaggagagaaaaattaacgtgcttttttataacctatgtctttatcttaaacttcagttaacactacacctagtttgaacttatttgcaacacatggattttgcagcacttttatataaattaaattgattcatgaatgaatgctttatatatagttcttgcattctaaagaatgcctttggtatgatctgaaaccattcaagcgaattgcgccctcaaatttccttgaatttatttctgaaacaagtagttgtaaattgttttgataaaaatatatatattgagaagtaataggcaatagcacttgatttcccaagaggtgagttcaccatcaaatggtagaggcaaccaaactcaaccatatgcaagtacccaaacacattctcagcgcatctggcatcccgtccatctcttatacaaccaaccaaacactatcttacactatccagcctcatatgatacagacaaccaaacactttattttgcactcactcatccaggctcatgtcagcctggatggttcatacgggtcagggccaggttggagtggtgcaaacaaccaagcacacccttatttactggatgacatatactgcatagaaatattattctttgttggctaattactctcacacgtgggccggttgttgaaggacaaacttaggacaagtatgcgtataaaaaagagtaaattacacgaaaccactaaaattatagtgcaagttacataaaaatatacaaactagatgaaaccccgcgcattgctgcgagaatttaatatgataacaataaaaaaaatagcgtgtaagatagctagataacattaagattaagtaaattaatgtgatttataataatttaaatttaaatagtatgtagaatggtgattcaaacgtaaaaagtaaggtggtatgactttatggaagaagaaaaatagggggatagtttggaccgtagattaatcatctaaaggctaaaacaattgatgtgatatgacttaattagagaaaaaaagaagaaagataatttggaccatagattaatcatttaagcactaagtgaggatgaactatataagtatataggatatcataaaacataacaaagatatacattgaaacattatgtgaattatgttggatgataatttaacatatttgtatttgaaaagctcttaaattataaaaactataaagatatagcatgtttgcatgatgtttaaatgtgatgattgttagtggataatgatgtgacatcttgttaattagtggataatgatatgacatcttgttagtggatgatgatgtggcatctttgcaggttaagcttaacgagttagtgggggataactttatattaagataggatttggtaagtagcatataatccaatatattatggtaaaatttactttgagacacatttgattaccgatattttactttggattactgtttaaccaatgatttcactttggattaccatactctcttctgaagcatatgaacgatagtttgtcgactcttactaatcaatgaacttccacatctatatgtacgaccatttctgatttctgtgacatatgataaattgaacgtagatggataaaatacttgaggatggtccaaaatgccacaaaggtaaaagcgcctggttcaaaagtgaaaatattggttaaagggtaattcaaagcgaaacatcgataataaaaaggtgatccaaagtaaaatctactcttcacaaaatcatataaattgacaacttctacttaaacctgacatgtgggatgatagttttatatgatttgacatgtcgtagatgaaaactcttacatgctgcaataagtatgatagatgaaaaaactggtaaactccacatgtcaaatttgggttaaattgttttgtgaaacaatacacagaattatgtgttgcatgctaaaactcgtatggttttataaattttggacctaatatttttcactttcattgtataaaagtttcgtggcaagggtcttcactagtttttcatagccataattttataagaaatatatagtgtaaaccataaaagtttactcatcctaacgtgcataaatctcatacgtctattttggatttttcaagtttcaatatggaatatgatttgcactattcttttcgcaatttaatcattcacccaaatcgtttggttcg

SEQ ID NO: 81649 - DNA, 29909 bp, Oryza sativa
cctgaggaaactgatgtgcaaaaacaagcgtcatcagagcatgaaccataaaatggccataattcgaagtaataggacagtaaaccgttcacaggtttgtggggggtacatactacataattcaaactttaaaaaacagattctatctccagaaagattatcattgcctatttcagtagctgtatttgtgaacaaaagtaaaggacagacaatctacaagacatggtaggcttcagcaggctagcatacaacataagcacataaattattgtatgaatttatgatctcgactggctataacatatattctaattcaaaaaatataatcattatcctcaaacctaaaagattgtatacataaaacaaataaaataaactggacacacactgtacatatgatttttaacaaaaacagattcatgcttataggaacataaatagaccaattcctaaagaaatatcaaccacagattggtcaataggtcaagactattaaccttcttggtaagtctttgcttggtcagaatggatatggatgaatggttacgttgaggatagcgacgtagtgcactgttcattttacaaatgtaattccaaatgcccttggcaaatgccagttttgccatctctatgttcatgccgttgtcttcatgatgcagcactgtaattcggcatgcatcccttccagggactgtaaagtaacataaagcatataagcaacatcaaatttaaaagtagttgaacatatatgagatacatccccagaaaataacaatttatagatgccttttgatcataattataacaaagaaaattgagagtcgagataagctagcaaaaatggcatgtcataatggctcaactttcagttgcatattcaaggtcataaagaaaattgatggcaaggagaagaaatgtgtgacaatggtatttattcttcaaaaataaacacttaaaagaatatttgttttattttcagttgatacacagcctgcttatagcttcagtagaactcttcccattctgtttggttaacaagtacaacagaactattagtgtattaactcatggatgcagaaacaaaaattacaagcctttcattcttatcagctaacaaattcatccaactgcatttcaatctaaatattaaagtataaaatatatactgtagatactagaggctggtaaagcattaccaaacaattagatcatttgaagttattctatgcgtattttttagaaattacatcgacgcaatacataccactgaaacaagataggtcattctaaactcaataaggaccgcaaaaagaaggccttctatgaatattagagttgacttacttttcctaatgcaccatcctgatctcaaaagttgcactcgaacaaatttccgctgtcttggtgcaacaggatgctcacattcctgtccaggttaacaaattggcaacaacagaacaaattgtaaaaaatgactgagtggtcaaagaaaataagataatggggataaggttaatgtcatcaaaattgcatatgaaatactcgtgtgaaattggtgagttcattctaaggttgtatattcaattagatttcaactgattttgtattttctcaaattgggcgtgtacagtgcattatccctagaatttgtgtattctcggctatatcagtggtgttttaggctgtttgtttacaatgcagaatgcaggaattctacagggagcagtttacttcccacaataggtgaaattcccacatcctaaacaggtccttagttcatttaaaaatgtcaagcataggatcaaaaccaattcaacttgaatttcatattagaattgaagatgtagttaggacacaatcaacaattgtggcatcattggtttcttctgcaactgactccatgagcattaccgaaagcttagaccttatataagtacattactgaacgaataatctacaatgtttacattactgcataagtacaaaagccaaaacaatgacaccaaagtatatcacacttttacctcgcaaaaaaaatatcgcttttaaacagttgagaatttaatgacgagaaaggatggagagagagatgtgactaaccttcaccaaacagtagaaagacttgtcatttccttcccaaactcgccatgccaatatgtactcccttggtgttaagagcggaaacttcttgattgtacgccctatctctattccactattttcatcaaactgtagctgctcatgctttatcacagtgttatcccactccattctatactcattatccatgtaaaagtccctcaatagctctgttgagcatctctcatatgttgtcacactaagatatctaggagggccttcctgcataggggaatataactgttacataaagaaactgaattgttaaacttgagcaagcaaatagaatcttgggaattgtgatgttcccaaaaatgtaatgggtcaaaggacatcatggaaatagcatcacaaaatgaaaccaggcatcaaaatccaatcatggcagaacccagcgaaaattcctaaaccctaggtaacttcacgtagactgcatcagctgatcagtaattaatcccccaactattttgaattctaaagtattaaggctttgtttgcaaaagctggttcccaactccatacttacgttttccacgcgcacgcttttcaaactgataaacagtgtgttttttacaaaaaaattctatacgaaagttgcttcaaaaatcatattgatccatttttgaacaaaaaaattaacaaatacttaattaatcacgtgctaatggaccgctccgtgttccgtttttactgtttgggttgggaacatgttcttgcaaacagagcctaaatagctttagtttcttttgtcaattcttaaccaaaaaaatcatgatcaagtacctagagcacacataaaccaatatcaataattctagtgtggttctaagatctcacccacagagttggcatgctcccaccgtcccataaaaatttaagcccattaggggaatagaccaagggatattgagaaggtgataccaaaattagctccaaacagtgatatcaaatgacaccctacaactacgcatccacttttaaagcattaaggcagggtggatggggttgaattattctaatacctacaatcttaattttctcgatcgacttgtactcttgcactatgaagtatgaactacccatacagtaagcattagttgtggcctttcgcagctagtaaatcgcatggacacaagtaggcagagtaaattcacaatccgccttacgataagaagcagatcattagaacatttccattggccagcaacaatataaaacaataaaacatttccagtgacccgcaacaatataaaacaagatcaatggattcaacaagaacaggaggagatagagctaccatgggcttgtcgcaccacaccctgtaggagacgtcatcgttccctttggcgaccacctgctgccacccctccctctccggctcacgcgcggccaccccgaggttgcccaccagctcccgcagatcgccctccgtcacaaggccatccatcctgcgaaatccacacccccacggagcaaaccctgatcaaatcacattctcgctcaaaaaaaaaaaaccccgcgcgagagggccaaggagcggaggggaccaaaccctgcggcggagcctggggcggagtccgcggtgacgacggcggcggcggcggcggaggaggaggagacggcgtcagcaggtcggaggcggcggcggaggcggaggcggcggaggaggaggacggagaggtgggaggcgaggagcaggaggagcgccgcggcggtggcccacccgccgccgcgggcgacgggccgccagagctcggcgccgccgccgaggaggaggagccgcggggcggcggcctccggcggcggcggcacggcgcgccccgcggccatcggcgtggaatccgtctcccccgccatgttagccctgcgtgcgtgtgaaccgcgttgatccgcgagcgaccgccgcgggcgctttgttgggctgcggaggagggttggttcctttcgtggcgggggagaaagcgaggaaaaaggagacgatggatgggcgagagaaaaaaaaaagaaaaagaaaaagaggaggaggcgaagcgatggaaccgaagaaaatgggggcatttggaatttctgggagtgtgggcagcgacgtaattataggataatgctcactatttctgtgagcagtgtttttctcgcgtctgggatgtttctctaaaaagaggtaatggtgtagattgatttagtggaagttttcaaaagatatacatgggccgggaatttttagttgtcaattatacgtatattcattcgtgatcattatcctttgcttatgaaattatggcgtgctacaagctcttgggatcatccatcgtagtcaagcttttaaaatagtttctgaatttctggatttttcactttttggtcctttgaaaaaacttatttcgcaaatagatccctggaaaaacttatcccagaaatgatcctttttggggcgccagagtggctggcgccgtcgtccaattagaaggcgccagccgtccccctgccgacgtggcggggcgatgctgaggtggctagggggagcacgccatagtggctggcgcccctcccccccgaattttttttatttttcttttatttttttttcacgcttagggacacataagaaccaaccatagaaaaaatgaactcaaatggacataatatgtgacttgtagaattttttttctcctctcatctctctccgaactagtacagaggagagagatgtgcaaatttttttattattatttttttgatatttttttcacacttagaaactcacaagaaccaaccatataaaaaataaacttaaacggacgaaatatgtggcctgtggaattttcgaaagctttaccgaaaaacttctctcctcaaaaacacaatcttgcaagcggaattcagaggttttaatatcgccaaacccggcgaagccatggagaatcggatgtaactttttctgtagatgtccgtgaatatattatttgcctgattccgagtccatatgagaaagttacgcctattttaataaatgacatattttgtctgttccggtagagttttggaaaattctacaagtcacatattttgtccatttgagtttattttttatatggttggttcctatgttctcctaagtgtgaaaaaatatcaaataaatgaaataaaaataaaaaaaattgtatctttttgtactgtttaacttatggctatcatttcatttggctatattttgaattagattaagtaatttcatatagtgatagagtgcattatgtgtaacatgctgatcaaaggatattactaaaggagttatgcaaagggttttactaaaggagttatagtctaattttagtgaaggtgcaaagtagactaagtggtatgctagctattttcagacttagctaagtggtagttcgagtttatattttttttatggttggttgtatcatgatcctaagtgtgaaaaaatatccgaaaaaataaaacaaaaatgacactgttgcaactacatacagagaaacagggatggaggcgaggggttggggggggggcggcgccagcatggctggcgccctcttcctgccacgtcggttcgcgagtgccacggtggcaggaggacggcgccagccactctggcgtcccaaaaaggaccatttgtggaataagttttttcagaggtctatttgtgaaataagtttttcaaaagggggacggcgccaaccactctggcgtcccaaaaaggaccatttctagaataagttttttcagaggtctatttgtgaaataagtttttcaaaagagggacggcgccaaccactctggcgtcccaaaaaggaccatttctggaataagttttttcagaggtctatttgcgaaataagtttttcaaaaggaccaaaatgtgaaaaatccagttctaaagttacttgctggtgatattttgttatgtacttaaaaaatggttttatttgttagatgtgatgggactaactatttatggaagagttatgataacgcttgtatgtaagaggacgttagagttatgataacgcttgtatgtaagaggatgttttctaaatggttggatcaactttatgcttacatgtgttgaggagccatatcattgtagaatgtaatagcatgatttttcatgcaccttgtttcaagtaaacaaaccaatcaatgaaatctaaaccccaaatccttaatagcgggagaataatgtcgttctctgtagtaccgtgtctataatagctattgctgatatttaagacctacccgcaggtgtagttgatgtttgatttactgttatcgagatttggcattagaaattttgataagtttttatagtcacccctaaaatattatatctattttttctatgaaaaacgtacaagcgctaggaacccataacatagtagtaaaggcatgtcacaaagttgtaaaaacctattcgtactaatgaagataaagattaaataaggccatacatgataagaaagttattagtgtatgattaattaagttttaattattataaacttaaaaattaaatttatttaatattttagagtaacttcaatatagaaaatttttgcacggaacatatcgctcagcaattagaaaagcttggtaatagaaagcatgcatctctgttagaaaagaacacggcctaaatccagtccaatttttcatcccactatcataggatagtggcccaataggtccactttggcagtaaaaacgtcccaggctcccagcccatcacggcctagtatcatgcccgaagggagaaggaaaaaagttcacctcaggttcctcagtttactgccgagttacaaaatcatccctaaaagaaaaaaaaaagaaagatataacgccttccttgccttacaaaatcagatcattttgagttctaagacagtattgcttccatttttaggtgacatggtggctgaatcagtatggtacccatatgtcatactcacaaaaaaaaatcctcttcatgagtccccaatctctcccgctccacccaccatccacagcatgagtccgcacaagcgggcatgctcggcactggccctgtcggtgttgcgggagacgaggcgccatggagaagataacgccaacagcgggtggaggcggcgaagcccgtcttctgagaagctatgtcgagctccattagtatatgttgtgtctagctcatggtgtcgttctattgcgcactcagcctggtgccgcccgacagcgatgccggcaccaggtgacagctcgccgatgcgtcaacctcacagccagcgatcttgaggtctctatagcacgagacgaacatatggtagcagtagtcggacttgaagcgctcgccgtcagtggcccaatcagaggcatctcacatctagcggtcggggaagatctggccaccttgggtgacgagtgggtagtgatggacggcaatacaaattgacttatgaaatgaatacgaagacgacgagtacttacgtagaaggtggtgttgacgccggtggtgtagctggaggggaccttgattggagaagctcccttcttgttcgccttgccgatgccgttgttgggttcgtgggggcaaggaggggccctcgctgctcctcctcaagatgggtgccactctgcactggagctcgacagagcttctccgaagacgggcttcgccgcctccgtggctccgcctgcccctggccttctcctctcgatggcgccttgtatctcatgacaccaatggggctggcgccaagcacacccgtcctctcgcttcaccttgccaccctgagcctcgcctaccatcttgtctgccttgttgacgttgtcgttagggtccgtgggggtagggagggcactcgtcgacggttgtggcccgctcgtccaagtctagtgccccaacaacaagcacgattgcgactgctatgtcacctactgtgacatcactacccaacagagcgccctatttgtgcctggagcctggtacagcttcctcaccgcgccgccagcgctcctcggccacctcattggcaaccactcccggccctctcaggagattacctactgcgccatccactcgctcatcatgtttgcgtcggagccgacgtggcgacacctgttgctggttgtgcgtggggacggcgatggctacgacaagcgccatgtgttcctcctcgccatggcacctaatctcccgcaacatcgactgggccggcgccaaggacacccgttgagtgagggagagagtgaggagaaaaggcaatgattttttgtgagtatgataggtgggtttcacattgactcagccaccacgtcacctaaaatcgggaacagtactaatttaggacccaaagtgatccggttttataagataagggatatgttatagagtattttttgggttcaaggatgattttgtagctcgtccacagaatgaggggccttaagtgcaccttttccaagggaaaaccccttccagcgcgaagaaaccaaccaattcaatccaggcccatcaaagcccaaatccatcaaccctaactccttcaagcacaacctccaccgtcacagaccgccggcgccgttcgactcttcgacctccacgccgacgtcgcgctgcgcctgccacctttatcttgaaccgcgacgtcgttgtccgcccctcccgcgccggcgaggcgaccgagccccctcccctccttccctgcctcgtgccactagcgccgcccttcgccgccgccgccgccgccgcccgcgagggagacgcgagaaggatgagggtgaagaggcggtccaagaaccgcaaggtggtcaggttctacgccacctgcttcggcttccgcgagccctacagggtgctcgtcgacggcaccttcgtccaccacctcctcagtcacagcctcctccccgccgacgacgccctccagtccctcctctccgcctccaggccccctcccctcttcacctccaagtgcgtcctcgccgagctcaggcgcctcggcaagtcccacgccgacgccttcgacgccgccgccctgctcgccacggccaagtaagtagtagcacacttctacttctaacgatggtttttttttttctcttatgaggcaatgagggttttgttccattggaaatttttgtttgtgggttcaggtgtgagcatgacaaagtagtcagtgcagtggattgtgttctgtcactgataggtgaaaagaatcccgaacacttctttgttgccacccaggattctgatctccgtgcaaagctacgggaggtatggaaattcactaccctttcgtgctcgtgccaacacgctgtttcagagtaatttaagaattatcaccttaattatgttatgcaaaagcatctggacagggagtcagtggcgggcccaggatttagaacttgtgtattcgaaataggagtagggtaaaaaaatttcctacacccaagagcctaataaatgatgtatataatataacacaccagtaattatataatatatagcatatataacacaaaatacacataagttcgtatattgatataattttataatatatagcacatatgtaagtactaattggatgaagtacacacaaaagaatagaaaatggtaaaatgataagaaatctttcaatttagagatgaacttttcaattcttgatattttgaaaatggtaaaatgatatgtaatcttacaaatcctacttactattcccctacatgcgcctaactagttacttaaatcaagtctgcaagttagcaattatgatgaatcaacttccaagtactcagtgaacaattagtagaatactagaaaagtagaagtgcagaacaaaaaatgaaatcagtgaagtactaacatcccaggctcccaaatcccagcgtccctgcctcttggtccatgcgagctgcgatgctgcctgcctggtgcctacgtcgtcagctcgccaatgcggcaccgacaccacgagcctgttcggttgccccgcgctgccgtcgccgtcttgccgccacgccatgcctacgcttgcgcccgagcatcgccgctgcgtgtttggccacttgcgcgcccgcgccaccgccgtccagccaccggccacccaacgtccgcgaggctgtgcgcctgcgccgaccgcccgtcggctagggttaggggagactgagggaatgggatgtgtgagattgatgggtgaggctggaagtgggtaggggagaggagagctggagagagggagggaagtggggaatttgggcccaatacatttgggctaatgggtgaatgaggagggaggatgaagcaagcccaagaaaactagtttgcttgcttattgggtatttgaggctcttttttatttgtttgaattcatatacgaaatatatagtatatatacctattttttgtgtaaaattcttgggcatacatctgaatacccttgaatcatagctgcgcccgcccctgacagggacagtcagtggcccggtttagttggcaaaaatttttgttttggggtgtcacatcggatatacggacacacatttgaagtattaaacattgtctaatgacaaaacaaattacagattctgccaggaaactgcgagacgaatttattaagcctaattaatctgtcattagcaaatgtttactgtagcaccacattgtcaaatcatggcgcaattaggcttaaaagattcgtctcgcaatttacacgcaaactgtgtaattggttttttttcccacatttaatactccatgcatgtgtccaaacattcgatgtgataggtgaaaattttttgttttgggaactaaacagggccaaacttcatcacgtttgaccaagtttttaaaaaatacatagcaatgtcttcaataccaaattagtttcattaaatccacatttgaatatatattttttgtagtatatctgttttatgttggaagtactgcaacttttttctataaagttgatcaaacataaagaagtttgacttaggacaaacccaaaacgccttacactatggaacggagggtgcacaataatgtacatgttgccattacatattctcttgaatcagtttatgtgttcatgtgtgttttgactggatgcaggttcctggtgttcctgtgatatatggtctgaagagctccttgttcattgaacaaccctctgtgcagcaacgtaaatttgctcagttggacgaggagaagcgtctgcatatgggtaaatcagaatatcagaagctactgaaggttccatcggatggaaaggcggctgccagtgaaaacgcaagtgatgatgaaaagaacagaaggcctatcagttctcttgtagaaaatgcacttggggtggccgacaaaagcaaatttaagaagaaaagaccaaaggttaatattttctgttattttcttctggcttctgatgtattagatgtatacgcaagcgcaacaatacgtatgatctagttggcatcatcagccttactccatagtcaatcctattttcgataggaccgcttgacaattgaatccaatttttcccattatttaactatccataatagtgtggaaagaaagtttgctacaacagttccgcttccgtaagtaatttttattgcttgtcatttctgcagggaccaaacccactctcctgtaagaaaaagaaaccaaagccccaattgtcagctgctcaaaatcaggtaattttcattttatatcactgttgtttttctctcagtagttgtacgtaataatacctaaaactgttactttcagattaacatgcccattattagtatctattatgttgttggaaaagcatgtctagaagagctgtttgctgtcgatgcaacacgaggactgatgagaacatgtgtcctacaggggcccaaagctgatggggaggcaaagcgaaagagagttaggaagcggaagagaagccacaaagatagcaagcaaacggaaacaatgagctaagaaagatgagctgcaaagttaagaaactctcgctgcatatccagaggcagagctaggtggcacaatgttttgaagatagaaatcatactgatctcatggtgtgccactcattgagtcggctgcgttctttgaattgtaatgcttgattgttcacagatatttatgatagatccgtataggatgtatctggatgtcttcttgtagcagttgatgcaacactgtctatcaaatggaattcatggtgctactgctaatctgatagaatttcctattgggttcaaatcctgtgaacttcctccatttttcctttaaaaaattttccaaatgttttcccctgtcacaattctcggctatgcatattacaggccacaggatgagctggcgggctgctctgctcccaggaatagtctaccaaggatgctgctccagcgagtgccatcagttcatcaactcgtcaaattgatgctgatgtctgaacagttgcgaactcctcaagatctgattcgtcagagcgcccttgtccatcggccatcgctcacttcattaagttaattgtcctttctgtggtacagttttgcttgtgaatcgtttaccttgattctttcctctcattttctgtaccgcttgaagagttctttgagctagtagaaaagttgctttggtttgacatccgataatctagatgttccaaaagattagatttctgaatctgatggatgttttgctttcttttctttttttacatctccactgctattttatcaccagaagtcaatctgactctgctgcatcctagccacttcatggaagaactacccacggtccacaagctcaagattcatccaatccaaatgtacatttgagcatagagctgggaagaaaaggtcgtactccctccgtcctaaatataaggaattttgggtggatatgacacatcgaaaatcccttgtattttaggacggagggagtatagcataagctcattagaacgtcttgccagcgatgtattaaccatatcatgatatgaacattggaaaaaaaaaatctttctgtttcaagtcttttctccgcctctgcaatacagttggatggaacttgtttgatcctcaagaagttgaggccaacacaggattcgttgaacttcaaaatgatggcatgtcacatgtgtacttcacctcacattcgtctctgttaaggttaacattgaactccaaacatctgtcttgtgtgatcttggatctataatgcagacattcttctacagaagttaacaactcctcttcgagctatctttttattattatggaattattataccagtagattgggtagaacattagcggtaaattttactccctccgtcccctaatataagggattttgacattctgtttgcactatttaactactcgtcttattttaaaaaattgtgtaaatataaaaaaagaaaagttgtgctgaaagtactttgaataataaagtaagtcacaattaaaataaataataattctaaatttttttaataagacgaatggttaaacaatgcaaaataaaatatcaaaatcctttatattaggggacggagggagtatctttagttagttgccctctaaaattctatggacttctcattggtatgtgttgcttgaaactctattctaaaatataacaacttctgactaatttattcagatagatagctagaaattactatattttgaaaccgatgtatatactactaatgcatacttgcatatagtatccgcgtcccattttacaattagttgcattgaatttgaagaaaaaaatgtacacgatgggacatattagaattagttttcccctgtccagcttccgccaaggccgaggccttttgcaaaccctgcaatctccgcgaggtacaggtcgtccatcccgccgccgtagatcgccgggaagaacagccagaacgccgtgccggcgacgaaacccagtacgagcggcgcggccaccgcgcgaggcagctgcggcctcgcctcgcgcttgtgctggcgcgcgcaccaccaccgctcggcgcagacgcacacgccgtggagcgcgaagaacgccgtgacgcgccccgtgggagcccgggaggtcaggtagagtatcaccacctcgtgcatcagccccgacacgaggaacgcggcgagcacgccggccgccgggtcgccggagcgcgccctgacggggtcgtagacggcggcgcggagcaccgccgacgccacgaggttccaccgccggccccagaagtcccgcagcgaggccgacaggtacggccggtcgaactgcggctccatctccatgcccagcgccacgcccgccgcgccgagggccggcaggacgacgtcgaggaagcagtacatgaagacggcgttgagggagaacgccgcgtagcggtgcatctcctccttggcgtggaggacgcggacgatggccgccatggcgccgaccttgatggcggacgagacgacgaacttgaacgtagctgcaggtgcagctggcggtggcctcgacgccgacgcgcctgctgctgccgcggcggcgtcgacgagcttgacggggagcgcggcagtgaagacgaacgggagagggcggagcgccgggtggagcgggccgtggccgaaggcgaggaggaggagcttgaactcgccgagccagacgaagacgaaggcggagaagccgcggtagctgtagtacgggagggcgagagggaggacggggaggagtgccatcgccgggaggagcgcggcgaggcggcgggggccagggccggtcagggaggcggcgaggcgggcgtacagcatggcgacggtggtcgccagcggcacggcggcggcggcggcgtggcgcatgacggcgtgtcgtgtactcgtgtcgggggcctctgtgcttggatagtcgggtgcgaggttttctgcaggacaaactcgaaataagaacagagcatgcacgcacatgtgtactgttcctagtgcactggagtagtgccattaatttgtcagtacgagggtagagttttcacaattgaagtcttctccaaaatactccatccgcaccgataatacttgtcgttttaaacaaggtgagatcaaactttagaatttttattataaatcatttttaaaatatttatctttcaaatatgataactacatgtatagattagtcttaaaaaatattttaataaaattatatagctgttaacacttttatatatattataataaaaaataatggtcaatgttagttttcaagaccgtctctagtccaaaacgataagtattatcaacccggaagaagtagttttgaagaaattactggcactaattcttccgaacagtgctagtgctacaacatctgtcgttatgtgcatattcattagttcgatccatgccattgcaaatgtggttattaaaaaaaaagtcattacaattcttcaatttctaagcgtgcaacttaaattttacgaaattggaaccatgccatcaccgtcatattttctatcttcttcccgtttacatgtggggtgctgatatttcttaacgacattactataaatatgaatttccagcaatagcgctagaaatggtcctgctatatatacagttacagaaggaatccgcaagcgcacagatatatcattgtagtattttatccgggagtattccaaggtatcgtatttattaggcaaaatttgctacgtgatatccaaattttgtataattggctgagggacaccgtaagatcgtgccattgccaaaagacaccataaaaatgatgtaattgtctgtagaacactagatacattattttataatttttaagaaaaagcggagagagaaatttaaaaaagacaagtttgctcctggcttggcctgagcttaagttgggactttctgcttctgctcaaagaaacaaagctttggtttagtgactcgcatgtattcgatcaacaaaagatgaacaaatacaaatcaatagagtctaacaagaacgtgtcgacatatgtgatgtaccaggaagaccgtgctttgcggatgaacaaatacaaatcaataccggagcttcttgcggatgttgccctacgtagttgttgttgtcttgctcgtccgaccacccgccgacgacaacaactccagcaacatccgctcaccgtagatctcctccacacactccctctttagcaccacgcccacggacaacaatgtgtacacgctatgcgtagggccacggtcgccgtcgcagctgcgtccctcgttttgtcgagcgtgcaacgatggctgcagcgacagcaatacggccaccggtagccaccatggtgtgccgtcgcgttggtcgttcctcctccttggccgctgccaagggacaggcccagcgccaggctagcattgctcaggtggccgacgtccccaaagcgggccgcccatagcagcgggccgctgcctgcttgcacagctactcgccgccgccacctcctcttagctaggggagaaagagcttgtcattttaaaattctctctccactttgtcatggaaattattaaataatgtgtttggtgtcctacagacaattacactattttttatgtcctttagcagtgacacaattttgtggtgtcccacagccaattacacaaattttcaatgtcctgaaacaatttagccttatttatttaatcccaagggaagattgtaaaaaagaactatgctaataatgtatatatgccacttgtatgatcagagtctaaacaggggttaatataatcataagggtagagtggcacaaagcaaagaactcatatctctcattaatcaatcctacgctatgtggaagaagaaataaaaaagcaattaattcctatgcttctagtatacgttccatcaattagtttatatccgctagtatacagttgtatggccaataccctctaacaatgccctcctggtgttttgagagaccatcctgggttgccgagttccttacgacaacttatcatggctgtccaaccgggactaaatacggaggagtaccctccccaggaatttatcttaggaatatatactaacatggaggaatacccgtactaaactttcaccatcagcggcccacctctactgtcccgcagcatatatgcctagataatgatacttaataatctaaacaccacgtctacattattaaatactactctatatcccctaggatgacatagagcaaccgaataatggaacattaaacccacaccattgcacctctctggtaggctagctacacaactataccgatacagatataaagtaaagtcgatacttacataaactaaagcaccaagaatatataaatatatatagaataatattccattaattccaaaagtcttacaaaagaataaagaaaagctactaccgccatactcgaattcccccctaaagactccgaggacttcaagagctattccactctactccacttagcactagaatactaaactaaagtatagatagaaatgttgagctttcttaagtgtgttttgaagtgtgaatgagctcctccttaaataggcaggtatgatggttgtagcctatgcgaaatgtccaatatgccctgaaaccgtcaatccgtcattggggagcgatcaggagcgtccatgtgtaaggccagtcgaagctagcgtcaccagggttcggccatacttgggccggcccaacaggcctccaaactactctagggcactgacaagtgggtccctatgatggttgtggcagttatgacggtttcgaggacagttacacctgacatgtggccccatcttatccttaagcttgcttaaggatgagttctcctccattttatttgcttaatcactgcaaacaaataattattctaaaataaatatgcattgcaagtatagctagctcccctttattttagttatattgatggtcaaaatttatctataacgaccatcaacatgaggcccaccagtcatattcatcttcttcctccattcttccctcctcttttttcccatctctctccagtacttcttcacctcctccccaccaatccatcctctccccgccaccaccggtgccggcaccgcgccagagcgcgcggcccacgttggccgcgcagctgctgcagcagcacagcagtgcagtagcggcagtagcaactacagcagcatagaggagtagcggcagcggagcagcagtgccagcaacagcggagtagcagcagcagccgcgcgcgcggagcgggagcggcgacagcagcggaaccctgcggcagcatccgacgggggcgacggcacgagaacacatttggccaccgacctcgccacctcctagccaccggagcactggcgccccgctcctctcttccctctgctctacctagcaagaaagaaggaaaaaagagaataggggaggatggaggaaaatgaatctgaccggtgggcccacgtatagatggggaggaagatgaaaaatgtgacggcgatggtatggttctaattttgtaaaatttaagtgacacgtttacgaatagacgaattataatggcttttttttaatagccacatttacaatggtatgaatcgaattaactctagatttaaatgggatgtttcacggtgttgctagtccgtacggagtattgtttctcttaaaggatggggatgtttcacggtgttgctagtctgtacggagtattgtttctcttaaaggatgaatggataaatgtttacgttattttatatttctactattataaaaattaaagatttttttgccggtatttcggtacatcatccgtgttttagtcagtttttaagttcgttcgcttttgaaaatgcatatccatgtttgagttggatttaaaactcgtttgcctttgaaaatacaaaagaagtcgtataagaaatctctttaaaaaaatcattctagcttgagatgaaatacggactcctaattgcagtttatgattttctaaaagaaatattcaagcacagtgaattttaccctagctaaaccgtataaaaataataaaattaaaataacatttatcgttgcaacgcacgggcattttcttatatataaatttaatagactattcttttattttttttgaactttataataattaattaattcatttatacccttgattacttgtatcacctcattcaattaaatatttagtcattcagaaaaaaaacacatgcactgggcgaggtagaaagaaatagagggtgccacttacttaatttattctacactttagatcaagtttaaactgatgcgggtatctaagtttgtattagagagtgcacacatggtgaaaatgtatgagatatagctcaattttattttgatcgggttcctgggcactcccctcccatactctacctccgctagtgcatatgaatgcattaaaaccaccctggagttgccgcgctgaaagtgttttggaccgacgtgttcgcacgcggtgctatccacgtcactccagcgcgctgggaggcgggcggatttcgcgtccgcacgcgccgtccgattagcttgagtggacgggcaggatgatgagggtggaagttttgcaaaaaaaaaaaaaaaaaaaacccttcacttctttgtaacttttgttaggttaaatacatacggtcttacgttttaatttttaacgtttagaccctctataaccaggaaaactttatgcaaagaaaagaaaaacatgaaaataggtccgcactctgaaaaacaaaaggaggctcttttgaaaaatataacatccccgatcggccaatcccctccccaccgaaaccctagccagccactgctcccaccaggggcggattcaccattggggcttgttggggcgcaagcccgagcttcagcttccagcctcaagtgttctcccaacaagctcaaagctagtataaatcactgggacagtcagagtatatatattggagcctgcagcgactagagaagaagaaaactcgcctgtagctatgtggtgtgattagtgctttgtctgtcatctagtgtttaataattgctaaatgctataccaagcccaatacaattaccgaaccggtgaggaaaagacaagacagatattaccatctaccaggagctcttggtttgcattgttcagggcacatggatggtctaattcaactgggcatacatgttttttccaaattaatgaaacatggatttctaagttcataattttgaaatatgatttccattactgagctatatatttttagccctatgcattagcaccatcttctatttcaatcttggggcactgctcccacgctgtccccccctctccctgccgccacctcctccacctccttcccccgctgtgatggctcgcggctcgcgcctcgccccgccgcaactccccgccaagcgacgcctctcactgatccgtcccctgccaccttcctcctcgatcccctccctaccacatgcttggtagcttcctcatcagccgccgccatccatctgttgccgctggtggactggcgctcaattcggcgggatttggtggtggctgcctgcattgagtggatttggggaacgacggctcctgtggcggcataagcggcggaaagcaggtgcggtggcatgagctagggctggagtcgatgggccactaatctggtggcagcttaacaccaccccattcacgagatcaaagcggtggttggtctgagggaaatgggcggtccgggcagatgtgcagacatgctctgtgtcgaaacatgaattcggcaataataaaagggggtagcgcacgagacctaaaagtggatggatgtagagacaaggatttagacaggttcaggccctctcaatgagaggtaataccctactcctgtttggggatttgaatccgccgggtgtagtatagatctgacgatctagttgtgtctcatgcccctagagggcctcctgcccaccttatatagggtggggggcaggattacaagatagaaaccttaaccaatacggtatcggtttcctaaatctactttacaatattatcaaaccaggactttaggccgttccataatatacaaggaaacgtaatacctaagtcatgattcgttacatattccatagatataaattatcccttataacccgtcggacaaccatgccgtgtgggtatggggtacccataatctccacagtagcccctgagaccttcacagtcgaaaagataatcttctctcgaaccagattactccaaagccaagtgcttcaatcatctttgccatggtcacccgagtactttaacaaatatgaagactgtggagggctgaaaaataaagtcagatgcattgactagatgcacctaatagatgtagcccccgactacgtggttagctgaacaaactaagcatatagtcaaggaataaataatccaaccaaccgagtggttttgataattgtaatcaaccaagtgacttgatatcaatatatagcatatgcggtgtgaatcccccaaataacatgatccaagtgatataccgactgctttgtaaaaattgatgcgagcaacctaaagttgactacatcattgaaaattcacatagcaaaacagctataaacaagcttgaatgatgtgaataaagaaattttcaaagtattaggcatacgccatgcacacactgctttaataaatgtgcttaagtccctaaaagacacatggtttcaccacacccggaaatatacggcatatgtggtgtaaaatccgagtaaataaactcataaaggatttaccaaccgcctgaaaaatgactaagatatataatcagcctaagccataatattggtcaataaaaatgcacacttacgtggcaaaaagcagtggtattgtatccaatcaattgctttataaacccaaatagcacattgactatataaaaaagtcagtaggacagctatgaaaaacttcactgctgggcaccttttaaaatgcattgtaccaactcctaaaaagttgagtaactgcggtataaaaggattttaaggtattgggcacttgatcacacgcactttggcctaagcaaaaaatgcctaagtccttaaaagaacgtgataggctacacctgaaaatatgggctgcagacatattaggcctaggccaaaaaatatgccttcgacaccctttaaaggatgacgcatgtaacatgctcccgagtaataaatcttccgggtgatatagaccaagtgtagctcatacgaatagcttctgatctgagtgattatcccttatgggatactcccaaatagatataataattgaatcccgactggcgcaagtattcggttgataacccttacggggaataataaatagtccagtctttgagcatagaaaatagacccatgatcatgaattcatgttgcatgtattcggaacaagtccaaattgaaggtatgatacttgtgtttgagctagtaagtccctaagcatatagcttgtccttctgtcgtagtcacaattgtccattgatggtagctgacgtagtgggcatagagacaagatgaccaatatagagataatattgcccaccagaggtggcaaaaatattggtagtagtgaagatagtgataccaatcaaaagtgatgaagttgcacagccgtagaggcgaagaaaccagtcggcagcagtcaggtcagccagcattgaagatgaaagcgcccaacgacagagttgtgcagccatggcagtgaaataatcagtcgataacaaacgaggtgcccggtgaagaagacaaagacgcccattagtagaggcataataagccatccgtgaaagcgaagacatcatgggcggaggcaagccggtggtgaagacgtagacgctcatcaatggcaatggcgaaatccatcaatcatgaagatgaagaaaatagtcagcgacagaaaacgcaaccgatgataatgatgattagcagcaacagagatgatcgaatatgatgacgaagttgcccatcaatagcagtagaataagctatgttgaagaggcttgacatgatgttgatgaagatgacgatgtcggtgatccagtcaatagctgtgtagcagccgatgataatgacgaaagacactcatcaacgtttacgtagtaggtcagccgtgaaggtgaaataataagtcggcaaagacataatcatccattagcaacaatggagatgacagagccgatgaagcagaggtgctggtgatgatgtcagtgacaataatccatcaaactgttgagaagatatcaaaactcgagtagtttccttgatgcgagcgtgtgcataacaaagatgatgcaatgccccttgatttacgaagatgactacagaacttagtgttatatctgttgcagatgcttcacttggaagagagtagatgttgttgtccaacttgttgaatatgagttaattggttgataactccaacctcccgaatatgtagattaaatctcaaacttgatacttgagaaatttgaagtagattgtggcagtatggagcatccaaaattgtcagtgaaataattgaagtagaacgtctgctccgaagcaaaaacgaagataatgactcctggagttgtaaatcctttatgagtttatttactcggattttacaccacatatgccatataatgacccggcaattttgagagtcttgtgtagcccccaactctttgattagttgggaaacaactgaacatagagtcgagaactatagcttcttgtcatcgagtagtcattgcttgagtgaagatatgtgttgaggatgtccgagtagaaatcttgaatattgaaacaccagttgttgtagtaaaataacacggcatcaaatctagtggtgcatgccgagatgtcgaggctcttgtagtcgtcgtggtttgtgaagtagcaaagcttgcgaagtagaggcaatagagtttgctggtgccgaagataataaaaatgaagtcgctccaccatgacgacaaagttgcatagccgtgatgaagtgaacacgagtcggcggcaacagaagcaaaccggtagcgaagatgcgtaattgtgaagataaaaacattagtcggcggcggcataaccagtcggcgatggaagaagtagaatgatgacgaaaacgaagacgtccttgaatggcagcaaaataggccaaccatgaaagtgaagacaccatgggcggtggcaaaggcaaaccggcgatgacgatgacaccagtcaatgttgatgaagacacgcagccgtggaggcgaacaagccagtcagcgtcagacaaggtggccagcaatgaagacgatgacgtccatcagtagtggtagcagcataaaccagtcgtagaggcgaggacaccagtcaacagcagacgacatgaccggcggtgaagatgataaggccaatcaacagtatcagaatcatgcagccatggaagtgaagaatccagtcggtagcagatgtagacagcttgtgttgaagatgatgacgcctattagcggtggcggcgacgcggccagccgtgaaggcgatagcaccagttggcgtcatacaaggcggccggtcagtgatgatgtggacgtccaacaacggcggcataatagaccagccttgcaggcggagacaccagtcggcggcggtgaaggcgagccggtcagtgaagacgtagacgcccaacaacggtggcataataggccagccgtgcaggcgaagacagcagtcggcagcggtaaaggcaagccggtcggtgaaggcatagatgcccaacaacggcggcataataggccagccgtgcaggcggtgacaccagtcggcggcggcgaagacaagccggtcggtgaagacgtagatgcccaacaacggcggcataataggccaaccgtgcaggcgaagacaccagtcggcggcggtgaaggcaagccggtcggtgaagacgtagatgcccaatacggcggcataataggctagtcgtgtaggcgaagacactagtcggtggcggcgaaggcaagccggcggtgaagatgtagatgcccaacaacggcggcataataggccagccgtgtaggcggtgacaacagtcgacggcggtgaagacaagccggcggtgaagatgtagacgcctaacaacggtggtgtgaccaaccaaccatataggcgaagacaccagtcggcggcgacgacggcaagccggtggtgatgttctgactgatccattcctagagcgtaagagataagcttaaagccatgaatcccttttatgcatatttggatctggatcctgcagaacaaacatataggatgagtagtatctgatataaatataatactcgaggaaaattcaagtattttaaaatgtttataaatatgtatttctcctcttgttaattttgatttccccgagcgaatgactccttacgtttaaacactctgcccgactagtcatagcccccaagcaccgggagtcggcctaagcacttccaaaacatgcatatgagtgacatgagttcgtcattaatggaacaaagtttcacgaatcagaatttactactcgggtacttttgcaattgttaagagcagaaaataaatttatcttatctctatgcttttgatttattccgaataatacttagcaccttgcgttactcggtccatccaacgagcccccgggtgataggaatcggcccaaaggcaactatccatcggcaaaccaaatggaaagcataggaagatagaactccataactcgataggcacttttgtactcagattatattgcaagcaatcaagataaatattataaaaattgtttaaaaaatatggtataacatatgtagccccgactcactagtcaacggcgaaccagttgacatagtgaggcagaggaaaaggaaaatatcatgtaaagaatgaaataaatgatgacttatctttgtaatattcccgttggtgatggcagaggtgaccaatgtgggaacaaagtcgtccatcaataacaatgaagacaccagtcggcggcgacgaaggcaagccggtgtagatgacgaggcccatcaacggcggcggagtccaccaaccgtataggcgaaaacactagtcagcgacggaagcaagccggcggtgaagacatagacgcccatcaatagcggcataacaggccaactatgaaggcgaaagcaccagttagcggcagacgtggcggtcgatcggtgaagatgacgatgacgcccatcaacggaggcggagtccaccatccgtatacgtgagaacaccagtcggtggtggcgaaagtgggccaatggtgaagttgtagacgcccaacgacggtggtgtgaccaaccaaccgtgtaggcgagaacaccagtcggcggcgaacgaggcggccggtcggtgaagacatagacgccaatcaacggcggcataataggccagccttgcaggcggaaacaccagtcggtggcggcgaaggcagccgcggccatcggtgaagactgatcccggcgaggtgccctagctgacagccaacatgaataggcagccatgccgaatatatagatgaacatactgtacatggcttgatgtattgcattgttcctaaaaaaattgcatggcatcgggtttggcccaattgatctgaacaaagatgaaaccaccaaagagagcaaaaactccgcctgtgtgtgcgcgtcgtcgaggccatggtaggtgcagatcattatggcaaacaaaaacggcaaaagtccggcggccgtgaccgacgctcggagagttatgcatgtgtgattgttgatgcatgcacgtgagatggaggcgactggcggcgatctgatgcggtggaggtcccctggtcgactcaatgcatgtatgcatcttagatagataaatcatttgactaatcaaattcctttcctggttgctgatgacgtggcagctcctgattgattgaccaaattgccatgcacgtttgcttgcacatgtatcagatggaaacatacacttgcatgattaatgtcttcgagtattgctgatcaaggaaataactcggcgacgaccgctctgatcgattggctccaagttcaggctgactccgatttggattagtaattgagtatcgctaggaaatttcacatcttcttaaaaaaaagctggcggatgagaattgatctgttgcattgatatcgccgaacagattgaaccagatgatgaacacaacatgccaactttcttcaataaaaccggtaaacatggcggcgatccaacgagatgaaagaagtcttaagccttcccgactgattttgcatctgaattacagaagcataaaattccaaactcgtggacgaggaaattgaaactcccgaagtgagaggcttggggtgaataccagggggtcaatctgtaattgaaagttaatctaacaataacattggttagattgaaacggcaaacccgatatcgatttgatcagaagattgcatcaatgacggcataatccatgaaactcgagggaggatgatgccagcgactcaggttgattccatcacacttcttgacagataactcggcgtagccctacctggcgcgccaactgtcgaaacatgaattcggcaataataaaagggggtagcgcacgagacctaaaagtggatggatgcagagacaaggatttagacaggttcaggccctctcaatgagaggtaataacctactcctgtttagggatttgaatccgccgggtgtagtatagatctgacgatctagttgtgtctcatgccccctagagggcctcctgcccaccttatatatggtggggggcaggattacaagatagaaaccttaaccaatacggtatcggtttcctaatctactttacaatattatcaaaccaggactttaggccgttccataatatacaaggaaacgtaatacccaagtcatgattcgttacatattccatagatataagttatcccctataacctgtcggataaccatgccgtgtgggtatggggtacccataatctccacactctgcaatgcttcacccgtgttctagctgttgctgttgcttttcatgttgacatcgttcttgccatcgaagacaacggatctggccaccggttgctgtcccggggagcttgtaatggaattaatgtcaatcagggcaatctaccgttctggcttggccttgtgctgctgtagaagacatggccatatgactggagcaactagagattggctgcctaccactgctgtgctgtttgctgtaacatttaaacaccaaacaagtaataatctactgattttgatttatctctgcatacgatattatttagtagttattgtttcttggatatcaaataggtacattattagcagcgaatagattgttgtgaggtcaaacatattagcaggtgcttggcttactatgcagtgtggcagggggtaatattgcagaggtaatgcacagaagagtaaacaatgatttctatttcttttcatgaaagccacctttggatgagcatagtatagagtatagttgtgtgttggttaccttgcctttaaggtgtttgttattcttcctatgagcacagagtatgaaactatcttgaagttatcaactagatatgcatggcctactgatatgcattggttgggtatgagatatgtggtccctggctttgaactattttactttaataattgtgttctttggctccccatcctgatctattttgctctatgcttctgttgtgcaatgtagctaaaaaaacatccagagaagagctttgcttaagagattctagatttagatactttagttatttaagatgtaagagttacttttattgtgttcttggctcaatgtgcagctatccagctgatcaatttattgtgatttcaagttatatgcaaaaaaaaaaaagaggagacatctgctttacagattctattgtagaaggcacatatatctgtatgggtatttggtgttaaattttattgtagggtactccctccgtttcacaatgtaagactttctagcattgctcacatacatataaatgttaatgaatctaaacacatacatttgtctagattcattaacatcttaatgaatgtggacaatgctagaaagtcttacattgtgaaacggaggaaatagttctcacatagatctgccattgtagtggtattggtccgaccgcaagaaaacaaaactacagatgtgtcgtgtatatgtttgattaatcatccatattctgactaaatttgaatgtagttcagttcttggcaattttcatgattaaagtattaaactggctataaattgcatttctgtgcaaagcatcagctgagtaggctataagaatgctaaggtatgcccatagttgagatattaattaagtcccccccccccccgccttttcatatgtactaacttcccagtttatttcatgtttgtgtatctgatatgatctgtgccataaaaaaaatgtgcattacaatgtccttattcacaatgtatgaaaatacttaccaaatctttgtgtatttattgctgaagtggttttagcacaaaatgtccttattcatacaatgtgttaaagatgcttcattatctaacaaatgcttctttttttcagataatttggtggttaaaacttttggtggaaataggttattaagggcttgtttggtttgataccaacttattgccttaccaaattcttggtaacttgaatagtagcat

SEQ ID NO: 81650 - DNA, 69911 bp, Oryza sativa
  unsure (1)..(69911): unsure at all n locations
gcccagaaatcacaccccccttgctgcaagaaaaaaccccacttcaaaccctaaaaatgcaaactcaacaaatccaactcgtaataccaaaatccctcacttacccgagcgttttggcacttgtaataccggcgcccagggttgtccgtgctccacgagatccacctcgccgccttggctggtggacggcatcggcacatcactgcgggctgatattctagcggaccaacccgataaggcacgggatatgccttcgactcacgggtagacgacgagccgtcgctcatcgagctcgacatctccgcgccgccgctcgccaccgctctccaagtcactgccgccgccgccgccgccccgctcggttcctgcttcgctagggtttcggggaatggggataacctaaccgcgtgccaaacatttcgcccattatatcctaactaccgccctgctgactcagcgctgaagaccgtggtcaatgcgccacgtaggacaaaaccggacacaatactgtcctgggaccaacactgacctggttttgatagttaggggacccccgatgtctggttttgcggtttgaggacgttttggtaactcgatgacaagtttagggaccttcggtgtactttttccaaaagggggccatgaaaaggggcaggctagacctgaacccaataacaaaatgtgcatgggaggagtttggtgcagcgcttgcagctgccatgcagtggctgagccagtatagcacatgattcgagtgaggaagattaatacgtttttttatcaactaaggctctgtttagttcacaccaaatttctcccccaactcctaactttccatcacatcacatcgcatccaaaactttcctacacacacatactcctaattttttttctaaactatcaactttcctcaaacttctccccaatttcaaaaactaaacacagcctaatttttttgtaaatattaataggtgtcaatagagaagacggcagaggtgaagttcaggacacggtcacccaacctactcgcgagctggcttcgctgctgcctcgatgttctgacggctgacacgcgtacaactgaggcgctccccttcctttttttcttgcaaattcaaaatctccttaaaatgtgtctgccttcaggttgaacgtataattgactgaattcaaatcctcttcaaactaaacacgacgtgtaacggaaatgcagaatccggatgttaacgggaagcagagtccggttgttcatgggctaatacatgtgcatcttgacttctggagcaagaatatctgagcagccagaaacacaatttactgactattaacaaccagaatcacaagacgtcttcttgatagttactactaactacttcatctgtttcacaatataagtcattctaacatctctcatattcatattgatgttaagaaatctagatataaatatggaagatgttagaatgacttacattgtgaaatggaggtagtagctagcaagaacaaacaacaaaaattaaaaaggccgataaaaaataatctacatccggagaggctgcaccgttgtagcggcattacgtcgaacgccaccgccgccggccggtgcaagctagctagcctcaactcagtgagcgccggacggcttcgctatccacatccatcgccgccgcattgtccttcagatcacatccccggaggcccggagtcagggggaaaagaatgaggaactccggcgtagggaatcccggcgtaaccgcaagcggcggcggtgcctgtgccggtgcctgtgcctgcttctggtggtggaatcccggcgtcagagggaacagcgggaggcacaccggcgacggcgtaggttcctctttctccccgccgccgccaccgatgatcgggtcgtcctcctccttgctccacccggccaccttcgagttcttcgacgacgacgacgcctcctcctgctgccccggtgttggcggtggcggcgaacgattgccgccggcaccgcccgctgctcctccctctaacgccgccatcgcgttcgtttcgattgcttcctctccggcgatgaataaagtggaagatgaactaaccgaaagtacttacacattacattatctctacgacgtggaaggagttttatatagttatctttgcgacgtaggagtttgagtcgagttagagaaagtatagtgtttgagattaattcgagtcaggtttaagatagactttgactttgattttcacttggttaagtttattagcttctgcaaattaaattgaatttgatattgcaaattacaaactgttcgtagattttattttcaatttttgaatcttttagttttcaattttaaaaatcaactctctcaaattttatttgaaaattctaaactttttgatcactagcttggcgaacaacatttgttttgtcacgccaccattactggcatggcaaggatttttccatgtcggctaggttggtgtggtaaaataacactagcacagtcaccattggtggcaggggtgaagctaggataaatggtcaccggggtcagtattaaccagggtttatgtttttgatcaaaactaaccagaaatcatgtaattttgatgttttgccgtgggacgaaaagtatattctgagtgaaatttcgaatgttttttgagacttcacagtaaaactagatcaaaacttattaaaatttggtaagaaaaatgtcatatcgctacattggaatccaacactaaatcggaaatatgtcatctagtttgtaattaatgatataagaatatacataatacaggacaaaattaatgacaatacattatgataaaatgaaatgtctacaaatctattaaaaactatacattattaatttgtaaaagacatcaaatgcaccaaagatcatcaaaaccactaatttcttgccttccgttctgctagaaataagatgatactccctccgttttaggatataagatgttttgactttggtcaaaattaaactactataagtttgattaattttatagataaaagtagtaatatttttaacccaagataaatatattataaaaaattattcaattatagatttaatgaaactatggtgatgttgtaaatattactaattttttctacataattagtcaaacttacagtagtataagatatcaagatgcgcaatgccggtgcgggacaaagtgctcgaaggaatacgatgacgcaacaagagaaactcgtggagttgtgggcttccaatgttatttttggatccaaatcccaatcgtatatgtatattcggctaatgtataaattataagtgctagctaatttattgtttgttagtaccgttcctagtcgctatttgggttttgacggaagaatcaacaatattaccggggtctagtttttctcttcactcaacaatattaccggggtctagtttttctcttcactggggtcatggatggcaaaataaagaagggtaccagaggttcgcaaaagatcgtcagggtcaactgacccctatgaacgagtgtagcttcgcccctgattggtggtgtgacacagtaacaacgttgtttcgttatgtcaccaaaaccagcatgattaaaatgtttagaattgaaaataaattttagaaaagtctatttctaaaatttataaaaaatcagggtacaaataatatatattctggattgtattcacgtccttaattagaaacttaaaatccacgcccccacaaaattaagtctatcagcacatccacatacagagcagagctaacagcagcagaaccagagtggcgatgaggatcgttgcggcagatgacgggaagctcctcgtggccgccgttgctgtcgtcgtcgccgtcaccgccgccgtcttcttcttccgcttggtcgggcatgggaggggaggatgccggaggcggatgcgagctccggggtctctcatggccaccttgctcctgaccagcaccgagttggtcaccccctgcacgttgttgttcacgtagatgttgatgctgcagcagcagctgccgctcgccgccactgacatggtcgcccccgtgctccggttgctccgctcggaggagcaatcgtctgcaacacccatcgccggcgaggtaggccggtcggaacggacggaaggttgatttctgaagctggagaaaacaagatctgcaacctgcagggatgcagtgcagcagcagtttcagttatatttggcatagttagtacgttgctgcatcaccaagaaaagcatagcatatgctactacgagcacagctggggaatcacactttgcctctgcggttgggctactccccaggctccagcaatggatgtcaagaaagagcgggttaattacatgtcgctttgcgcttatctttgtatagcgtcctaacatgacataggcacatagcaaatcaacggtcatttttgtgttctattgttgaataagctgcgcgatagaaggcccatttcagttgtcaatgatattactgggctggactgtggatttggagaaggtcagaaggctataagaaaacgccagcccattctgctcttctagtcctttctttccccttcacgacgttaagaacattgtcgttttttattcaaactttgaagcatcgccagtaaaatctcgaagcatcacacgaataaaaataaaaaagaacactttgaagcaccaccagtaaaagtttggagcatcaccagtagattaagctcatgcgaagtgcaaactagggtcggcacaacattaatatactttggatccacatctgtaaataaaacacgaggctatcgactcaaatacttagtactcacatgctgcagtcatacgggccgaacggctagctgatactaccagtaaaccgtgttcaacggaaggtagtactaatgcgttaggatgagggcaagcaagttgaacttaattaatcacagtactctacattttctcaattcatccgtgcacacattttatacttgaattcaaacagaaccaaacacacagcagcaaacatttgaactaaaaccaaaccaaacggtacatacatatgattacgaacgtcgatacagagaacagaagtttacatacggagagtatatgaacagcgttgttcgtgcattgccattgcatctagcagcaatgcacgagcgggaaacacaaagtgaagaaattacgagaaaatcaaagctcgatcacaccgagatatataggcagtcgtgtgcatgatggatggcatcgatcgattggccggtgtgtcggggtcaaattcagttagaccctggccgcggcggcgggcttgtggtggtggtcggcggggtagtcgccgccgtagccgccggcgccggcggcgtggttgccggagaagaggccgccgtggagcatggcgacgtagagcagctgcgtgaaggcgaggatgatgacgaaggcctcgagcacgcggaggcgccacccgcggtagccgccgatgtggatctccttgcaggcgaggccgaaggcgagcgcggtgatggcccaggcgatgagcgccgacgcggcgccggcggcgaggctgtgcgcgccccaggagcggacgtggtggacgccggcgagcttggaggcggcgccgaccacccccgcgaggatggcgaagacgaggaagtagaaggtggcgccgttgccggcgacccccgggtggttggtctcgccgttgatgtagtggttgagattccagctcgcgaacccgatcacgatcaagtacatgatcagattcagcaccagcagcggcgcgatcatcgtcctccctactccggccatctcgtatcaaaatcacaaatcaacacaaattagcaacacaattagcactggtttagctagctagctgagagctactgtgattaagtgaggagaaaacgtgctggttggtggagggatatataggcggggagaggggtgacacgtgtgggtggatggggatggcacgtgtcggcgtgtggcaaggggtaggggggacacgtacgcgcggggccacgccacggacgcccggcttctggtgatttccggagaggcgcgacgcgagggagacgggggtaaagaaagcgtaaaaaagtgcagcgcgcgcggcgtcggcgtgtgcggaggtggcgacgcgcgggcgggagatcgaggggaggagaagcagatggttccggactttcgccgcaagcgcctcggctcggggtcccagaggcggcgtacgtggcgggcgtggttagagcacccgcaatgataaagtaaggtgctatctataaaacatgtacatctcagcaatagattcgattaatagtaaaccaccttaatagtatatctacattggtatctataaatctctcatgcattgtctcgtttttctctatagactatctctaagttagtagatagctttgctctctctcttcatttaataccttccaagtagaaaaatatgctgacatggatctcttgtagagagcttatagataaccattgtgggtgtccttagcggctaatttaggctaaagtgtgcgtggttttacttactctggcgggtgtggcagcaggaggcagggttagctgcttgctttaggtttgatgatgatggtgttgctgcctcttttttgttcctcctttctttgacgcctagtgcaaatgtgcttccctgttttgggtttacgctgatccggcctactccgtacttcttatcgtctgcctaagtaatgcagcaatctggagtctgtactccctgcatttcaaaatgtttaacaccattgactttttaagtacgtatttgaccattcattttattcaaaaattttgagtaattatttatttttttcatatcattttattcattattaaatatacttttatgtataatgtatacatatagttttacatatttcacaaatttttttaataagacgaacggttaaacatatgctaaaaagttaacggtgtcaaacattttgaaatagagggagtacatcgatcctcagaatctttcgagcgcacatacgtggatgcagatttaaccatggtcgatacgcgccactaggccagtcagtactcccccatttgtgcattgacgaatttaaattaagaccttcaaccataaaatgcctaatcccttgtttgctgggttttaaatcttactcctctgtcaaaacaaaccaattatagatatgtatctggacaatatttatgtccagatacatcctttaggattagaatttttagatggatggaatacactatactagtacgagccaagcataatgagatcttctatccccatggggctgtcctgtcaaactggctatgtgatgtgcctatccttctaatcggaggctgttgcctctttgatattaaaaaaaaaaaccggtcagaggttcgttgctcacaaccacacatgcgtgcaatttgggcagtagtgggctagtggcgtacgtaagctgccaatttgggcccggccttttcgcggtggctcctgccgccgtcctgcgtcttctgccagagtgctgtaccatctcgacatccttttttgagaaatgacaacaatctcgacatctcgtagtctcttaggcgtgggaactggcatgtgtacaacaaggagtacgttgtgattttggcctcgatcagttggctggtgattactgatggccgttatgcggtacggagttacaaagttacaacaccaaaattacgctgtcatattgtttgtaggggtagcaaacaaacaccttggctaaaatgttgtccaacaaacttcgctgtcacattgcccaagttcgatgaatcggtcacgtcctcctgcatatgaaattgatctacttaatctaggttgcgagataactactttccataacaatggataccagttgatacttttccccattccataatataagacttgtttcataatatagagcatgtatgtatgcatgccattaactaggaaatttttttcactaaaatattattatttaaatcttctaccttcgagatatctaattttaatgggtgcatgcattttatttattaggacaatccaaattataaggtgataataattatttcttgattttttggttaaggtggttgtgtcttatattttcgaatgaaaggagtatctaacatgtatcggctgatatacatataagttactactcccactgttcatattataagccgtttaacttttttagtcaaaattctttaggtttgatcaaatttataaaaaaatagtagcatcaacaacatcaaattagttttattaaatttaatattaaatatatattgattatatgtttattttgtatgaagatgttcctatattttttataaatttgattaaacttaaaaaagtttgacaaaaaaagtcaaatatataacttatgatgtgaaatggaggaagtagctctaataccgatagtactctctccgtcccattttaagtgcagccatgagtttttatatctaactttaatcgtcctttttatttgaaaaaaaataaaaacataagtcacgcataaagtaatacttatgttttatcatctcataacaacaaaaatactaattataaaaaaaatttaaataaaataaacagttaaaattaagcacggaaacttatggtttcactaaaattggaacggaggatgcagtagggtgataggtataccaacaaaaatcaaacgttttaccgttctgttttttttttactgaggaaaatatgagaagcggataacgaaagcctacggcctgttactactgccgtactgcgacggcccacctagcaaacccgcgcttcacgactggctccactcacccccggcctccccgttctccgcgccgaggaataacggataacaaacgcttggattgtcgcctaccgcgacgccgcgaaccaatggccgcctcctcgctcctcccctccaccaccacctccccgcgccgccgcctccccttcccccccacccgcaaaccccactccgccgccgccgccgcagccaagcccccgacgacgctgaccaccaagccactccgcctcgcgcgcccgctcgcctcctcatcctcctccccgcctccgccgccgccgcccgaggaggccgagccgaaggaccccatcgcgctcgccttcgcccgcgccgccgcctacaagaaggagagggacagccccccgccccctccgccgccgcctacccctgcgccgccgccgcagcccccggcggctacggaggaggactcgaggtccagcaaggagtccttcgcgcgggcggtggagtacaggaacggcaacgggggagggctgggcagcggcggcggctccccgctgctcggggcatcgcctagatttggtgagtagagaggtgacgtcggtttggttgtttttcactcccgttggtaaaaatcattccaatccactaagatgatgaatgaattgatgattactgcattcacggatagaaatgaggaatagatggagacagacagaaaaactttttcaattcggatgatagcattctgagtctgtgtgtatgcaatgtccccgggtgatatatatggttgtggtttgaaaccttttgctgattgatgcatatccccgttgtgtttttactagaagcatgtggagtaatgcagtaatggtcactgtatataggtttcaattcctggaagccttttttttttctcttttggaaagtaggcacaaactccgttgatcaaatgcctagaagcactttatttatctgtggaaacatgtttaggaggattgcgagatggttagtccaagagttggtggatccctttgtcattgtgatcttgtgagagtatgtatcttttttttctctcaatacattcttgttttgaagaatgttaccgtttgtacttgcaaacctacaacttgaaaactttcgcatgttcatttgaaccatgacactgtttacttagtttttatgtaagaatagcatagaatcctcactgcgaacagttaaaaaactttttacattgtgcgagtcttcattaacaccatcatttttattgagtgttgtccatgacacttgcttttcttttaggtcaaagtacattttctactgaagatggtgcatttggtaaattcacaaataagaaagaagagtatgagtacgatgagactgactttttgggcctagactttttcgagaaaaagagttataaggggcctccaccaggtttagctccagcagctgatccttttccagataaagattttcctgaagtggagataataataggggaccctagtaaatttgggaagactcatcgttcgacagaggttcaaccagcagatgatagtgagcctgaggaaacctcacgctcaacaacagaagaaaagaaggaagaaaacaagcctgatgaaacaccaccttcaactgttactgagccagaagaggatgaagacgagtacaaaccgacagttagatcatggggaatgtttccacggccacaaaatatttctaaggcggtgatataccatattttctgtatctcttaaagcgttccatgtatatctgctttcagttattagaatctttttcatgtttgcatggtcattttattgttatatgttgaactgtgttcggaggacaatgattttttaaaatgaaactctaatatcctttttgcatacttctgttaaaaaaacaaaagattattgtgcaatcctctctttatatttagtaacttctcctttttgaattcccgtatgattgtaatgctacatttaattctgcaaattatacaacctagtggcaccaggctacttatctatagggaatcaatcaccacaagcttgtctatttgtactgcagagatccagcacaatccttcagaaaaatgtttcagttaaaagtttgccttaacaagggacaatattgacatatccaacatggctgcagaagctacctgcatatgatttataggccattatccaagaatgactgcatgtagactgtagagcgtaggagtgagtacataatatgtatgtgtttttttttaggttaatatgtatgtggtttttatatggactagcacaacctttgggacatacatgaagataatctgtgaaacaatacatttctgacgataaaaaacaatgaagattattcaagaagatgatatttggaactgcatttctttcccttgtttgattgagacaatgtatgtcgaccattgctgatgctatcataatgtatttgatttgataaaattagattagaatgcaaatatgcttacggtagtgccatgtttacccagttctgaattttcctctatttcttcgttattagtatggtggcggaagaaatatacgccttggtggagagactcgaagtgctgaagagaaggcagccaaggataaacgtaccaaagagctaatagctgcatataggaatagtcagaacatgatagttgatgcaaagacaaaggcagagtgcactgaggtacatgaaacatcatgttttgttaattatccttcattgaaaggaattgtcatttttattttatactactgtactagtgtactttatgattgacctagttaattccaagatgatggtcatatctacagacaggtgacctgataggtatcttatggacttgaacgtgctgattttaaaatcctttctgttagaatacccaaggaaaatgctttccccagatcacattcaagttttgaagtttggtgttagtgtagtttagagttgtctctgaatatatgcactgcgttagtatgatctataacagcgaactttacatgctgaaggccttgaaggaaggtgatgagctgatgaatactggaagacttaaacaagcattgccttattatgaaaaagtgatgcaggctgtggacttcaaggtattccattacgtaattggtaatctatcacatgagaaacaccatgataggatattttgtcatattgtcctgttagatgcattaattcggatacattttatttctcaagtatatgcagttctaaattttttgcattgctgcttcactgttatgtcctttcttatttttataccatgtttttttactcatgttgcgcaaaataaattgcgcagactgaacttcatggaatggctgctttgcagtggtccatctgtctagattcactctgcaggtattttcctttgtttttctatgtccttcccctgcattgatgtttttcaccacatatacacctgttttgacttaaatgcacagcaacatactgaatttcataatccctatttttactaaaactaggatttttccactctataaaattaatggcttctatggtttgtaattgtacgtgtgtgcgtgcacatgttcacatgtagctatgcaatggaatgggttaatttgcatattttcacatgcatagttggacttaagttgcatattttgatggaaacatcggtgccatcagtctgcttcactgcattttttaaatttgtgaagcatcttgtgttcataaactctctattttctggacatgtattccatgaaatatcttgttttgataggtccaaggaagccatgagcatgtacagcaaactcaaaaatcatccaaattctgaaatcagtaagaaagcaaacatgttcatgttcagctttcaggtaagcatctcaaatgcttatgcattccctctattgactaaagcactcaactaggctgaggacaatgcagaagttagatatatcatcttgacccatccttgaaaggcactgactatgagctaatcgtttttgctgtcatctgaaggcgatggacttcatgaaggtgaacagctcccctttgccccgtaacacgggctacgagaagtacttcgacaagtttgggggccagaagaactactacgctgccctagacgaacctgagatgggcatcgatcagatcatcccgtacatgctcttccttgtttccccaatattcttggttgcttttgttgctttgagaaaatccttccagttataaaagtcaggaagcatatgcttgaatgcttcaatctttgctccactgacgaattgattagtatgttcctcgaaacaaaaggctgaagaattgatatttgactagtatgcagatatattgacttgattagtatgtagataaaaatcaaaacttatttaatagtattgtcttttgggccggcgtaagccagctgttaggcaggctagtctgagagcctgtcttcagctgggctaggcccatgtcaaagataaaaccgtttaccaaatttctaaagtatttggaggtacggatacatatggcattctcattaagtataaagggttgtctgaatttcattttttaaaaaatcgaaatatctgaaataatctcgaatttatgtttaattctttaacttctaaattgttgtttcctttttttttaatgtcgattttaccactgctttatatatatatatatatatatatatatatatatatatatatatatatatattactagctccacaaagcaataaaagggggaaaatgcaaacaaaaaccagcgtgatacagtttgtatagtactggttttgaaggtacttattaccatttacttttttacagaatgtcaacactctgtctgtaattttctatgccacaattggttgccaattcagaccacgagcatccatccccttgattctcccctcccagtacagtatctgtgtcttttttctgtgcgcgtactagggctaccaataaatttcatgcatgttttttcagaggctaatgaatacatcatgttagtactctatgtgtcctataccgtattaccgtgttaatagtgttgttagagcagcaggcatttgagaggtgcgcagcacatgtacgtgcaggccggccggttggttggatcaaatctggcgtgagcgcccaagtctttgacttgaagaagaggaataatgtgccaatacactgccatgtgtaggaaaggctgcatagctttcagtaggcataggtatgcattgacccaattgagtaagtatatataaataaatggatagaatgtattagcactctctttgattttctaatatactatgatgttgttaactttagacatacataaaatcacttggtttattaaaaaatacataaatattatttattttgttgtgatttgttttatcattaaaaatctatttttgcgtatatgcaaataattttctaaacaagacaaatggtcaagtgttcataaaaaaaatcaataacatcatatattaaaaatagaggaaatattagaatttcaaactgatttaattgaactactgtgaatgaaataaatacgcataatgctcaaataaatacgtataaatgctgagaacggaacagtgaagaaagttacgggagttgtaaagtcaagggacggtttcaggacggttgacaatgccgcaaaggtgaaccgtggctgcttcttcttctttctttccttgtgggcacagcatctgccgaaaggcgtctaaagccgtcgtcatcgcaatcatccgatttgacgccctgattttaatatggagttttgaggctaatgatcctcgtgggtgctgagcctaatctgaataaattagggaggatcgatagctgcttggttgctttgactctggtatagtggatggaattttttaggagtttttgtattgatcggagccgttagcttttgctgtgctagcctcagcttcgtgtcctttgtgagcccgcttggatttgttaattttggttttaaaaccttgagtgaaagaataacttatactccctccttactcgtagaagttgttttggacagcgacacggtctccaaaacacaatttgacttcttgtttctataaaaatatttattgaaaagtgatatatgtatacttttatgaaaatatttttcaagacaaatctatacatacaatttctacattttcaaactcaacaacttgagagttattcatgatttatattcccaaggtttgacttaaacattgtcttaaacggcttcctttatgagtacggagggagtactagtactagtccgcgggactaaaactgttaagtccctatcacatcggatatttggacactaattataaatattaaacgtagactattaataaaaaaacccatccataatgttggactaatttgcgagacgaatctattgaggctaattaatccatgattagtctatgtgatgctacagtaaacattctctaattatagattaattaggcttaaaaattttgtctcgcgaattagctttcatttatataattatttttgtaagtagtctatatttaatactttaaattagtgtctaaatatagagactaaagttaagtccctggatctaaacaccaattgatagtgttccacacagccgaggaagtagctagcttccgaacatcttatcagctattaggaaaaaaaatgcaggaaacgaaagggaatgaagaaaattcctaaaaccaatcatagaattatattctagaaattcaaaatcaataacttatactagtagagcatatactccttccatcctaaaatataagaaattttagatgaatgtgacatattctagtactacgatcatatcctaattcttaatctgtgatgaatagccaaatagacagttgatttgtgataattattcaatggtagaaacagatgaatctttcgtaatattattttaatctatttttcaatttttcaatatatttttttgattttaaaatattgttataagaaatccatatatagaacgttttttttaaaaaaaatcatactttttagagacagctgttagggtaaaaaaggaacaagctattttacctggattaatctgagacagctctcggctctcaccaacaaaagccacttgtttcagcggacctactccgtacacacacaaattctgtctagtcagactgagacacattattactcgtcactgacacgcagtagtagttccactggtggcgttaaaaagaaaaaagggagagaaaaacagctcccccccggagacatcagacaatagccgttggaggtcgactcggccagcagaagcggacagagcgcgcacgagcacgaggccaccaccccagtaccccaccccacactctccaaattccccgctgatgaaaaaaatggccgcctcgcgctcgcccccaccgtgccgatgctgctgctgctggtgtcagggctgaggggagcagcgacgacccgggcaggtagtggtagtaggagccaaactggagtacggagcacacaaagcgccaggtgggttttgaatgcaagctgcgtcggtgcgtgcgactagccgttgcgagttgccttgccccttgtccaatttctcccgtgcccgtgcgcgcgagcctccgccttgtctcggcgggcgggtggtggcgcacgggaaaaaccaagcgcgggtgtcgctcgcggcgcgcgcggcgcgggggttcccaccggatcggacgcgtgatcgaggtgtcgtgacggcgccaacgggctaggcggtcgggtggagttccgcgccgacgagacgacgcgttggcttgggttgggttgggtttgcgtgcgggagccaacgcccaacgggagtggacgactggtgggtggagtcggtgtgtgtgtggatcgctcgctccagggggtggtgcgaggcgagtgcgacggagacgcggttttctgcgcgtgcgcgaaagctccaaggaatcgaaaacgggcagaaacatgacgggaaaaaaacgtggaaattggtgtgccattttataatcgggattgctaaaattatggcatcatattttcacttaatttcagttacttttacgctcctatttctcctatctactctttaaaataaaaacaacaaattactttaatcatatataattctcttatatatcatgtatttataaaaagagaatccaagaaatgacattgacaagcgtccaaatctaagaaatgcaatcaactacaaatatgagttttaaaaaatgctatcgtacaaacgattttgtcccaaaaatatcatcgttgttagggttccgtccaccccatgccattaaatacattgttcatcatatagcacttaacgacgcgggatggatggaaccctacggtgatggcatttttgggacaaaatcgtttatacgatggcatttcttagaactcacacttattgataatatttttttagatttagacgtttgccaatagcatttcttgggttatctcttataaaaatcatgatgtaagtattgaaactaacaatgtaaattatagtgtaagtttcaaaatttgtagtgtaattacaattgtaagaacgatctaactatttttggtgaaaaatatatcatcataaatatagctatttccccatcaatttttttcttttaccaaactctcccaaccagttttggtagtagtatctgtcaggagttggtcatctataagaccattattccacatgagtttccaaaagtcatgatccttttttggaggagaagttttcaatgattcataacctattaaaaaaacgacctcaaaaaagaatactcgtcctagattggtctaaatgaggccgaaggtgcgatgctgcaggatcaggagcacgtcctttgcgtagctatttatctggttgttggttggcagcagttagttggtnnnnnnnnnnnnnnnnnnnnnnnnnnntgaacgaggctttactacggcggatgtgtttgttgattaggacgtgcagtgcaattgtacaagtgctccatcaattccataatataagagatttcgggtggatatgacacatcctactacgcctatccagattcatcattatattagtctatcaagattcatcattatactagcatttgtcacatccacccaaaatctcttatattatagaacggatggagtatataaatgatgtactctctccgtccaaaaaaaaagataatttctggaaatgaacctggacaagcatttgtccacattcattcttagaacttgattttttatgggacggagggtgtatgcactaacggtccaccatcacttgttattttcaggagtacagattaactgtacagagccatcattttcgctcgtatatcagcagttgggaaggcagggcactggaccctctccttgtcctgggtagggatggcaattgtacccgtttgcccatttacccgtgggtaaaaactctattagagttaggtttgttctctattttatacctacgggtatcttattggatcaaaagttatgcccgatgggtagatgggtatgggtatgggtaatcactacccatgcccgctttgaccgtttacccgcgaagtctaacttacatgtaggctaggaacaaaatccactagaatacataagccacgttcttctacggtttcccttttatttcccttattatttctcttccccttactctatcgccgtcagaggagagacaccacaccgaggcggagaatatttgatgttttaagttcaattcaaacttagaagcttgtagactttttgttccactgcttttgttgtggcgggtaaacaggcacgcccgcgggcacaaggcgcccgcgggcaatgggcatgagcaaccatccttacccgtcatgtagtaatgagtatacccacgggcacaaataatctcatgggcatgggtatgggtagacactacccgtgcccgtcgcgccctatttccatccctagtcctgggtgttactttggtccttgaattttactacagcattttttttttgtctaaatcagtccttttaagatagcttttggggttaaaatggttctaggacgcacctttacgttaagttacgttagtaacagtgtaagacgactcagggaaaaaaaagccttgctaataatctgataatctcaatgatgaaaagactgttttctcatcgtgtctccatttgagactcaaaatcagctagctatgaatagggtgcagggccgactacgagtaaaattttattattgttgttgttgctgctgcaatggaagatgtatatgtgtaaaataattttttcatcatagctagacatcaagagcccaggcttaggtggtgtttggatcaggtacttaactttagcctctgtatttagacactaatttagagtattaaatataaactgcttacaaaattaattacataaatgaaagctaatttgcgagataattttttaagcctaattaatctataattagagaatgtttattgtagcatcacataggctaatcatggattaattaggctcaatagattcgtctcgcaaattagtccaagattatggatgggttttattaatagtctacgtttaatatttataattagtgtccaaacatccgatgtgatagagacttaaaagtttcagtcccatctaaatagggtcttagctttttcaaattagttgctccacgtttcaaatatacattttatcaaaaaagtttcctctaccgtattgtagaccacttattttaaattatttattaagtttatttattaaaatacttggtttatacaagtggataatctgtaagaacaatccgttcactaatctgttttaatatgatcccagacctttgctaaattatctggcatgtatgaaaaatgaataggtgaaatagtataattaaagacagaacaaattattgccaatagcaattgacaaccagattgatccagaaggcaaaaattcaagatctagtaaagtaaataaagttggttattgtcacaaatatgtttcaatcgatcttaaggatcattttgccaactagcattttttctttaacattgatgatcgtttcccctcaagagacctaacaatcgatcgaccacctcgagcatatctgtcaatgttatacctaattaaaccatgttttttaattagctggtttcattaggtaccactgcttgaatatgcgggtagtgtttgtacttgcgcaggaggtatatatgcattggttccccaagcaactgatcacacactgaccactgatgatttagtgatcagtggtcgcacgcaacttgggaacaaatactagactactcacatcacacaagctgctcgatcgttacggctcgtgaaaacgacgtcacgccatataccaagcaacagctgattaatcaaaagcttgtgatgagtacctcctaatattctctaaatcatcttaatgccaggcttgatatatataagaagattgctgaagcgataaaatattggcagttgcggttttggcttgggataagttagctgcacgtgtgtgcatctcacacgtactccgtatgagatgcaacgaacgattgatcaatcattctacacgcccggcctgcagttgcagagatgaggatggcgatgggatttgttagtgttctgcttgtccggttctaatgatttgttttatcacccctgtttagattccacattaaaatttttcaccctatcacatcaaatatttgaacacctatataaagcattaaatataggctaaaaaataactagttacatatattacgactaatttacgagacgaatcttttaaacctaattgctccatgatctaacaatatggtactacagtaaacatttgctaaggacggattaattatacttaataaattcgtctcgcagtttataggcggaatctgcaatttgttttgttattagtctatatttaatacttcaaatgtgtgtccgtatatctgatgtcacgcaaaaacttttcacctctaatctaaacacagcctatgtcatcaaacaagcagattcaatcatggagaaaacagaccagagaatgcagtactatggtcttttggattagatttccagttctttatgggctatatgtatacgtacgtgtaatggataaatgtccttcttccttctaaaattaatactccctaagttccttttaaattgatacggttgactagtttgacttgtttactgataaaaacttttgaaattacgatgttttgatgaaagcaaatagtgtagttatatttgtcatgcaaagtacttgaacaataatatgatatcttcttaagcatttataaaccttttgaaagaaagatgagatatccaagtttatatatgaatagtatttggtgtcaaataaaaaggacaggagctatggagggagtaaaaaaattttagcctatgaaaatgtttttaacgtcggtgcatgagtgtgtcggtgttcatgggtccataaaaacaccgccggcaaagttagtgttattttcacatgcaggtatcctaagacaaccagtaaattaatttttacaagcgtgccttgactggaggagtcctatgcattctcacaaggatacattattttagtatgtttgttaaagtaaggatgatgtatctgtcaaaatggtattcttagtgaattagacatgttatactatcatgaccatatattgtatttagaataatcagtgttaaatcaaacatgttatatattgggaatacaatgaattcattttttagcatttctaaaatgtaataattataaattttagaattaataaataaatggagttgtacacatcttggacactcaatttaattctaaaactccaaattaataattaacaagttgttattgacatagaatcttccttttaatttaaaccatcacaaaaaaatatatacttttaacatgttattagaattttcaatattaatttgtaatatcagtaacaatggcccgggcaacacatctagatgacgacttgcaaacatcaatgatgttaaggctctgtttgaggagaaggagatagaaaagattggaaagatacgcaaaacgaggtgagccattagcacataattaattgagtattaactattttaaactttaaaaatggattaatatgattttttaaagtaactttcctatagaaaatttttataaaaaacacaccgtttcgtaatttggaaatcatgcgcgcggaaaacgatgtccctttttcacccaatcccccagaaacgaacgcacctagaacaaacacataatactaagataacttcaggacatcaacaaaagatatagcttattagcttgtgcttggttaaggaatcagcaacaacctttttgttttcagaatagctaacaatagacttgtggaagattagtgtaactagatcagatatatgagtatatgatatctgaaaatcattgcattacgacatttccacgatacacaacagattaattgccgcacagccgacaataaccataccctttctgtttagtgaaagatcgatgacaaaagttgaaagttccgaacaagttaacgacacgtttgatatcaaaagcaaaagcaaaccattcgccaaaagataaagagatacatgacattaatttcttaaagaatattttcaaaaataaattcatgttgattgcacacggaatttcgctgcggcacggctgcaataaattaacgtgaagcaaatttgtgagctgtgacgctacagcatcatcaagccatcaaatggaaaaaggaaaagaaaataaaattagaggttgcattgggcccctatgtgctacataatgaaagaccaataataatccccgagaaagctactactaaatagtaccccaaatctccatcggtaaagtggatttacgcgtcagcatcttgcattgacgccccaataaagctctggggatcccctgagacgaacgttcgagagagggcatttagacctgcttatctttttgttaactttgtatcagtatcagccactccgtaccacggtaccaacggctaaaccatgtgccattagcagtaagatttatgtgtagaacaggtgaagttcgaattctctttaattaagtaaaattgtttactctttgtaggttgtcttaattttacgattactaccattatactcgatttgtaaacatagatatagttaaaagaacaataccagtaaaacttcagtatcagtagttattatcaatagttaagatgttactttttatctaataatactgttcattaaattgtagcttcaaataaatttgcttctagacttttgtcaaaccaccacgacaccgaacgtacgaagtagatgaatacgacacagcactaccgttcgtacaggaacaaaaccttcatccctgcgtattctttttagccaacatcaccatacccaaaagtcttaacgtcttaactgtgctcgatagtacttatcatatatattcccaagctgttaaattacaacaaactttaggaatgagtttatgaccaactaaccaaccaattgccctcttaaaatccattcaattaccagctcacaaaaggataccctccaaggttcatccacacgcacaaagttgcacacagagtttgaatccactgaagatccacagattcaaaacaaacttttgtgttttgtcagtgtccaagccttcccctcaaagatgccacctttgagccgcccacccactctccctccctccctccccttgctttccttgtcaattttgtactcccatctctctttgttattatcccctccactaatccatcaacaccttcttcttctttcttcttactccatctccatccaaacctctcttcttcttcttcttttgctttgcttttctcgccgccgccgtccaacccaagagagaagccaagagcgacaagcaaacctgcaagtctaacaagccaagaaatccgagagaaatcgatccaaggaggagggcggtgagccatggtgcggagcaaggaggtgcacaagaagcccaaggacccgctgatgacgccgccgccgtcgtcggccaagaagaggggtttccgggacgacggcggcggcggcggtggggggagcaggccgaggaaccgcgagggcgcggcgacgtcgctgacgccggcgtccgtgcctaactacatgagggggacgagcagctccgacgccaaggtcgggcgcggggcggcgtcgtcggcgtcgccgcggcggaggccggtgcgggtggtggcgagggggaaggtgctgttcccgaaggtgtcggccgccgccgccgccgccgccagcgccgggctgggcagggcgacgtgctcgtcgacgatgaaggaggccaagttccccgacgcgctcgacctcgcccccggcgccaccgacgccgagggccccgccgcgacgcgggtctgcccctacacctactgctccctcaacggccacgcccactcgccggcggtgccgctccggagcttcctcgcgtcgcgccgccggctcatcaagacgcagcagagcatgaagctcaggggcgtctccgccttccgcaagggcgccgcccaccagaggccggaggacaccaacggcgctggcggcggcgcgagggtggcgccgccgccgccgctcatcgacgaggaggcgctcggcgacttcttcgtggaggtgtacgccggcccgcgtgtgagcacggacatgagctgcagcgacatgtccctggacgagatggacgccacggtgaggaagatggagttcgtcgtcttcgaccggtgcggcgccgacgagtccgacgagaaggggaagaacgacctcgatgtctgcggcgacggcggcgacgatgacggcgaggcgaggccggaggagaggtttggtgccttcagagacagcacgtcggagtgcagcgacgcgtcgacctccggcgaattcgtcgaggagttgccgtggatcaggtaccaggggtatgaggatgatagcttggatggtgaattttcagacgaacacgggatcagagacgaggagatcactagagcagttgtttctgaatttcaagaagatcaagaagaagagggcacatcaggtagattgggagatgggtgcgaagatgaggctgctcaacaacaggaagaaaatgatgagcaaaacatctcagattttgcctgtgaatcggagatcgcgtcggagcatgaaggtgttgatttcagagttgaggcttgtgaggagcaggagagagtcagtgaagacaacatcctggatgcggcacatcaaaccgaggtttgtagagaacaagagatgcaagaagagaaaaactttgctgctgtctgcaaattggggattcctgagcaggaactagcagagacggcggataatatccctgatgagtgctgcaaagaggagacttcaatggagcaggacgaaggcggcgatgggaccaacatggagtctgaaagcatttcagaggttgccgagcatccgaatgtggaagatgaagagaacacgcaggatgatggtggatctgaaatggagatatctgaggagatcatctctggttttgggtgcgaagaggatttctccgaggaagtcacttcaaaatatgtctccgaaggtgaaatttctgactccggtgcgattgtttccctacatgttgaaatgcaaaaacaaccagtggagaaccatgcctttgagcaagatgacagcagcactgcagacaatgcatttcatcaagatgacagcacagcagacagagcatttgatcaagatgacatccgtgcagatggctatgatgactctcagaaggaattggatattggaatgagagaattcagagttgcctccgaagaagttggtattcaagaagctaatagtgatgatcctgtggactgcacagaagatgctaacatggaactgggtgtattcttgtgcgacttgcaagatgcttctgaaggttctggtatcgctcaagaaagcagccaagaaggtaactcggcatgctttaatgatggagctcaaatggtaccagatattaccacacaaacaacagaagatgcttctgaagaatctgataccgctcaagaaaccactcttgatgataactctacaccactcgctgctggtgcccaaatggaattggggattggcacaagtgagttgattgaaggctcttctgatgtcactgaacagtctggtattgctgaagaaacctgtcaagatgataatgctggatatttcagtgatgatgattctcaaaaggcaaccgtgataaccacatgccaattgcaagttgattatgaagaaaatgttattgctcaagaagctgatgataactctacaggtgtcagagatgatgctcaaaatgaacctgagcaaacatgtgaattggcaacatctgaagaatgtcattttacccaaaaaactattcaaaatcatggtgctctagaggaatccgtggttatcgcaagtgcatcagaagatgctcatgaagaatcagatcctactcaagatggtcatgaagaagactattctgtaggtatcaattctggtgctcagaaggaaggagagcttgacacaagtgaatctggaggtgcttctgaaggaactactgtgcatcaagaggatgatggacacgttaacaccacagatctgaatggcagtgctcaaaaagagattactgtctctatattagatgactctgaagaactttgcagtagtgaggaaaataatcaatcatccaatatgctaataccagagttcagcgataacttcagtgctgaagagccccagaaccaagattctgttgcaaaagaatcgtcccttgatgacatatgcaacgcattcagcgggatgcacctcaaaggagatgcatatcttgatcctactgagtccatgacttgtccggggaatagattgatcattgctaggaggaggagaacaccggaagaggaggaatatttgagaggttttaacccaagggctccaaattttcttcctcttgaactggacccagaatcagaaaaggtggacctcaagcatcagatgatggatgagcgcaagaatgctgaagaatggatgattgactatgcacttcggcgagctgtgaataatttaggccctgctcgaaagaagaaggtggagcttcttgtccaggcttttgagaccgtcctaccgcacgacgaggaagagaagaaaggcatcacaccaacaaggcctgtccaagcttgcaattgataattgtagaggtaagaatttttgacgagctctaatagttgtaacaaattcctaaatacattggcttcttacatgcccttttttgtttgtctattgcagttagtggtcgaactaatcaagatcttgactcgcgagctactaactcagtggtcgctgcagtattatcgccggagacctgcttgaagttgaatgagagaactacttactagtttactggaaatctctagtttgggttgtttttactgaggatctctagttgagtttcttaggagctcaaaactgctccacagggaaagataaccactcactgaatcaaacagattcttatctagttactgagctgcaaggtaacagctcaccagctaagtactgtaacgtgtgtataaatgtctcttgtgctagtgtctgatatttactgatgagtgatgactgagactagcaaaatgtttagggtggttgatgccttagacagagatgaatagaattcttctggagtgcagattggttctggagtatgatcatacatgtatgctagtactactaatgtgcatttgtaacataagcagctcctgataatcctgggattgccatgagtgcacattcatccattatgtccctactccctactcgtatgtgcttatgaaccaaatttctgaaatttggttaccatcgtcagtctacttcattaaccaaatttctgaaaaaaaaactaattccaatgaaaatcttgtaaaaattctgtgtttcaaaggacacagaactcctgtaaaattccggtgttctaaaggatcttgcgactgtaaatgtaaatgtttctccctgaaggccatactgttgttcttttgtgctcttgaaaggatgcttcaaccaatctaacaattgcagtctaactgtacagaaaaaaaaaatccagaccaagtcatcggaatctgaatgagataaatccatttcaagcagtctcaatctgcgttgacacgacaacaacagatgggcctaaatcgtacaaggagaggcgcaaacggcagccgaccatggattttcctgacgtgacacgaaaccaaatatcggcattactctctactgtacgctgcttatccaaggtcaccaagggcgtgttatactctgcacaatttgttttagtttcaatttgcatctattttgctgtcagatagtttacttacatcttcagtaaaaaaaaaaaacttgtaggtagcaacatcatcatactacaatctagtttgagttatgacccgacttgagcatttttcatgcatttcggatgcattgttcccctaaagaaaaggcaaatactacttttgtattgtgttatttcacatcttggtatctatcgaattgaagatatttgacctacacctcaaatccgtagtgagaactgagcagcagactattacagcctcgtgatgctgaattttcgttggcgtattacagcagactattagcattgttatggccaaagaaagaaagaagattcacctttcaatcgaaaaaaaaagagtatgcttgtaatagtcacaggcaacagaaaaaaaaaatctccaactgtctcaggtagatttgctttctcagtaccatgaagaaagctcatcagatcttggcatcatacatggacttctgctatatatttttcaggccatctcaaatgtgcaccggcctaaaattgatgctatgcaggaacaaaattccttctgatttactgtcgtttgtgtctttcaagccaatcatctcatgaattcagcatcaataggagtacttgctaaacctgaatatacttggcattcacgcaacaacgatcttagttactactccctccgacctataatataagaaattttgaagggatgtgacatttttttaagtactacgaatctagagaaaaaatatgttcagatttgtaatactagctaggaagtgtcacatccctccaaaatcccttatattaatatattatgggacggagggagtacatatctttcaagaaagctttatatagccgaccataatccagtcatctacagctttacatgtcgactgtctttcctctcctgcctcctggatgatacacagtgcttatcctcaaacatctaaaatgcaccatccgcggaattttcttgcacagggctgtgcaaatttcagttttcctttacaaagatacaagccgacggttcgtgatccatggtcggtcaaaaaaggggaatttaactatttgccactttgcagttattttttttctcttcttaagagatgatttcttaactatttgtcacttttacccacgtgacataccaacatggtaacctagagtgaaaaatggtgtgagactcacagacccactcgtcagtttctccctcccccttcatctctcccctactcgtccacggcccccatcgacgccagcactgccccgccgctgaccaccgatggccccacctcgcggtcgagtagaggtgggagtggaggacgacgagggagatgagaaggaggagcaccgtcaccatgggcggacgcactggaacgggtcagggtacgtggcgaggacgcgagatacggcgtttgcgacgtcgcaccagagaatttggggcggccgccgccgtcgtcggggaggaggtcagcgccgttgaggatgagcggcgtggaggtcgccagcatggggacaacacggcggtgcgggcgccgtccttgacggggaggctgcttatgcggtcttccccctcctcctccttctcgtcatccccatcgccgtaggcccaagcagcggccggtgacgacctctcacacaagagttgccgaggggttccaatggtgggaggtgacgagaggcctcacagcgtcggctacgaggtgacgccatcggtggtcggcagcggggcgacactggcgtgtagagcagcggatcggtgttggcgtcgaaggcagcgcaacagggagtggaggcctgcgcctctgtagctcggggtgggtggatgaggcggcgccatcggtagtcagcggcgaggcggtgccggcgtcgatgggggtggtggacgcggggggtagggatgaaaggggagggagagactgacaagtgggtcccacaccattttttactctaggttgccatgttggtatgccacgtgggtaaaagtggcaaatagttaaagagaccactttttaagaagggcaaaaaaaattgcaaacctaaaaagagtatttggataatcgccaaactaaaagtggaaaatagttaaatttcccgtcaaaatatggagcgacgctttggaaaggggaaaaatacaaatacccctttatgaatcactggtcttttcgatctcccccctacaacttaatttggtacaaaacactccctacaagttttttttttcacttccaacttcccatctcaggccccataggtctctgttgtgatgaacgaagttgttccttgacaccaaatgggtgtactttgacctcctttcaccttttgctctttgcatgcttttattccaccagtggtatgacggtaaaaccacgacgacaaacacgtacatactactggtgtattaaatcctattcctaacaagagaaggcacatgggacatctttggtcaccacactagagatccaaaaatcacttaggctgagttcggatgggggagatggggaacctaactctcctgtgcacggaaaatggagcggtccattaacacgtgattaattaagtattagctatttttttttttaaaaatggattaatttgatttttttaagcaactttcatatagaaactttttgcaaaaaacataccgtttagtagtttgaaaagcgtgcgcgcggaaaacgaaggagaggggatgggaaaaggtgcatgcgaacacagccttagcgtgatgagaaaaatcacccaaaaaaactagatacaggtgggaagtttgaagggaaaatagacttatggggagtgtttcgcaccaaattaagttgtagggggagattgaaagaccattgacttgtaagggcttatttggattttcccccagtgaaaaccatcgttcgtattggcttgtatcttgggtccgttagcatgcaggtaaagaaacaatggtaattcgtactacctctgtcttaaaataagtgcagccatgagtttatgcacccaactttgatcgtccgttttatttgaaatttttttataattagcatttttgttctgataagatgataaaacatgaatagtactttactcgtgacttatgtttttaatttttttcaaaaatttttaaataagacgaacggtcgaagttgggcgcgaaaaactatggctgcacttattttaggacggaggacgtatttagttaagtccacaggctaaattaaggcatgtatatagttgagtttgggttgttgacttttttggggcccatgtcgttgacttttttctccctatcttagccgtgtttagttctttagccaaaatttttgtaagtatacgtacacatatttgaagtattaaatgtagactaataacaaaataaattacagattccgcctgtaaaccgcgagacgaatttattaagcctaattaatttataattagcaaatgtttattatagcaccacattgtcaaatcatggcgcaaataggctcaaaagattcgtctcgcaatttacatgcaaactgtgcaattggttttttttccacatttaatgctctatacatatgtccaaacatttgatgtgatatttttggccaaaattttttgggaacgaaacacacccctaatcgaacaaccagctttcttaatccaacagctacggttcaactaagggcctgtttagttgaagggactaatccattagtccctaaaatcccaaacaggtgactaaaatggactaaaagtacattagtccattagggcttgtttggatctatggactaaattttagccctgtcacgtcggatgtttggatattaattagaagtattaaatgtagactaatgataaaacctattccataaccttagactaattcgcgagacgaatctaattagtctaattaatccatgattagcctatgtgatgctacagtaaacatgtgcgaattatggattaattaggcttaaaaaatttgtgttgggaattagctctcatttatgcaattagttttattattagtctacgtttaatacttctaattagtgtccaaacatccgatatgacaggaactaaaatttagtccctggatccaaacaccaccttagtccctgtgggaggagcttataggaattaaaatcgtttctttcccccactgctcccgcgcacaacctatcctcccattcctcgtctctgtctttgctccactcgaccccacgccgccgccgccgccgccgcctccctgcgcaagctcccgccgctgcttcgcgcaagcccagcctctgccccacgcaagccctgccggtgtcgtggaagccgccgctgctcgtgtaagccaccgcgagtcgtgcggcagccatggcaggcaatgaggaagacacagtggatttcttctcccagtcgtacacacatcacctggcggccgccatcgacgccttcaagtatggcttctcgcaggggtcgtcaggccaagctggatctggcgccggtttccatttttgggggaggggatctgggggcctggatctgtactctcagaccgacgccttccccgagttcgcctcctactagcagatctttcaatcggctggccatgggttacctccgattcacctggcagcagatccaccgtcgccccgtcgcgctctccttgcccgggggtgagacgcgatagaagtacttatgttcatatttcgggaacttgtgatttgtatttctgttttctccacctgttcatgcgtgactgacctggtagagtgatgatccaaacctgttttgcgatgaggacagcagtgatgttctgcaacttgttttgcaacctgatagaatgatgctttgtaaagaagaaggcggcagccatgggcaggagatggtcttgcggtggcatagttttagaggtaacatagtctttgtatagtgtatttaatgacctttagtcacttttagtccttacatccaaacagatatagactaaagtttttagttctaggactaattttagtctagggattaaaagatccaaacaccctcaaaatacatggctcattctaattgcatttcaggattcacttttccctaggtaagatatgtaggctggtaaaataactcataatccagatttattatagtaggatcgatgtgtctcatccaatcaaattttcttatattttaggacgaatgcatatatatggtgatggagagtgggttaagtagatgtttgcgacacttcacgctttagggccccatatatcatgtcccaccatatttcactttcttttttaagtaaccaatcctctagacacggattagtcttaaccacactgcatagagaagccactacatctattttaaaatgcagctatttttatcaaatgaagttctatttcttcacatatcattccttacaaccaatcacaaccattctccatttatttttttcacatacttttccttttcaaccaatcacaattattttctaataagttttatttacttttattaatacccataccaacctagaaattatttatattttagaacagggatagtagtcatgggcacatctggcccttttctttcccgtgagtagataaaagaggcgcagtgccagtataactttgacattaggtaaggcatatgtgctacgacgagcagtgatgttcaagaagcacctagcatcttttgtctgcagctcgaacattgccaattacaagatcaattaatccaacaatgtatactaatgtcgtactccctctgtctcataatataaaacataatataaaagacacgatcaaactcgatacagatcaaaactattctttagcttatagtttctcatacactataaggtttatagcaataaaattatatatatgaaattaaattcaaatatcaatccaatgatattattttcatcaaataaaattcatattatatcaattgttggtcaaatattttaaaacttgaatttattagataggatggagggagtaagagtaagcgcatccgtaaatatgtgcacggagcaatgctactgctactactcctcatgcacccatgatgatccatgatcattaaagcattgacaagcgttgacaagaaaggaataaaggttaacttgccaatgcttgctgtcagctgccacatatattctcagagaggacatcataatctgcctatataataactactactccaaggagtaatacataggcgcagatccacgtatcaattaattccaaagtatgcggatcacttgaagagagctgacacttcaaggtgaattacgcaggtatgcctccatcgagttccatggatacttccacttccacgagctctcccaattttaatttcatatatatatatatatatatatatatatatatatagtagtattatttaacacacacttgtgtgtacatcttgcacatgtgtgcaccctgccatcccctctaccttaacccacgctcaaagtgacgtaattagtgatgaatactaaacttcactagatttctactccctccactcataaatataagcacccttatcgccttttagcaaagattaaagtggaaggaaagccaaacaatttaggttttattttgcaacaatgtcgatcattaaatgcggtcctagtaagaagaataatataaggaaggggtcgatgcaaagtatgaacagtaaaaatgtgccatgaagttttatatttatgccatgaatttcacatacttgtctttactagatacctctcaaacctttttacacgcggatcgtcttttagtctgtttgtaaaaaaaagcaagatgtaaaaaaaaattcattttggagtagcgtggacaaattctagtaggaatgcctatacttgttgatggggagcatattgtagcagcgaccagaatattttattgatattttacataataatattttagaatactacctctgtcctaaaatataggaagttttaagcttaaacgtgggtattaagaaagtatatggaattaaatgtcaggagtttgcgattggttgagaatataatgtagatagagaagttgttataatttggagcaaattttgaatgttagaagttatattttgaaatagagggagtaatttgtatttcaaatctttaaaaaagattttcaatacagaagtacatgatgatggctccttaaaaaaaagttctacttgtttcacatagagatatttcggacgtgtcgtgggttttattctatatcactgtgtaacccatgaataaccaacatacatgttcattggtgatttttggaagattgcgtgtcaacactaaataaaacattcaataagtgcagcaaagtaataggctaataattatttgatgttgaactaacttataggtgtagaattatggattttggtatatacttaatagttacgaattacagtaacttatgttattgattgtttgtggttttacactagctagtaattgtgatgttctatacctatgaatagatgtattacatgatgttgttgaaaaacccataggtatcagtaaatgcgtaaaaagaaaacccacctgtacccaatggataaccggtattcaacgagtgtaggcatgcatggttaaaattttaggcatggatgtgctataggtgttttgagtctcagattgggtatgctctcactccacccgaacttaatctgaccctatatattgctagttccaatatatagtaatttctaaaaaagcatcatttttcaagtatttcttggaatgaaatcttctactatattttcataattaatcttctccagcattagcctcaatatctaccgcatcatcaccatgaccatcatcaacactagcatctggtttgatattggttgctgcttctagtctatctcttctaacgcttttcagcaataggatcatacttcttatttctagcaggcatgatatatataataagaattgaggaaataagcatcttcctgttttataaataaaagaaaaataatttaatttgaatcaaacattcacattacttttgattcaatcgaccattcaagttatggcaatcgtaatttgattcaaattatgaatttacgatctactcacagtctcagctctcaacttacagtcaaacgagtcgagccgtcgaggaggcaggcgctcgacctagcttggcggtcgctgctcgccggccggttgggcggtcggggtcagggcgcgcgtcgtcattgactgcgtctcatcatcatctagtcgaacggaaagtcgagacacaaactgcagctagacggtttgatgaatgtgttgtaaccccttcagcgattttacatattttaattttaaaagtcaaactttgtaacatattttaatcaaaagttagtcaaatcccaaaaaaattatcgtatccacattataccaagggattcatcgtatatatttattgtgcgatactagaacaactaatattatactccctccgtccctaaatatttgatgccgttgacttttttaaatatgtttgaccgttcgtcttattaaaaaaaatttaagtaattattaattcatttcctatcctttgattcattgttaaatatatttttatatatactatatagtgttacatatttcacaaaagtttttaacgatcaaacatatttaaaaaaagtcaatggcgtcaaatatttagggacggagggagtatattttatagaaatcaatgtcaaattaagttttaattctgaagacctttgaaatcaaaatacactctatagaatcaaaagatggtcctattaataaaatagtaatatgtcatgaacgtatactttaatgtgcatacgatagaaaagtttgatacgccatgctagaggaattgtcccattttctcaaactatttagcttgagcacttaaaccatttaactattaatgggctcatgttatccccaaattactgaaaaggccaacttatagaagcatattttaagttgaatttgtgtacaactatagtgacaattaacatcctgtgtacaaaatggttttttaaaaaagattgcagtttgcacacatttttaaatcttgatttttaaactagaacctatgcaaatagtgattaaaaactccaaaaataagttgagatttaagatatgatactataatattgcaatttatgctacttgtaatgttgatcttagaatataacttgtatagagagaaagaaaaaagatatttttttagggaataaagtgagcaatttattattgtattattgagagagggctaaaatatggcacacaattttcactttgagggtgaaattactacattaattaatcgggaaaaaaagagagtaaaatacatggatgccatgttgatcatttgggtccatattacagtaattcatattagtacatattgtagcgttgcaacaacagcataagagatacaactgtgcagaagtgtataagaaagacataaaagttgttgaacagctacaaccctagcttgaaaactattacctaaatctatgcatgtatgctggaaacgagctagttttattaattctggagagtaaactgatccggaaatatacgtacattatggggtcatgtacaggtctaagggagtgaagtggatttttttcctaatctgaatcattgctaggagaggtttttaatttgaacaaagtacatagacatgaattaagatttaattgacatgcgtgatttataggtgtatataccatcatatttacacgcttagctaggtaacatgtttagctagctcaaacacattcatatatggtgcactaattgaaattaaacctggttaatttacagattcaagtatacagagtgttttggaggcatggaacaagttgatactaagaccattgtgcaacagttcaaagattgggaaatccagatattggtgctcctgagcttttgccttgcaattgctcctcttcttttttggtggccttcgccgccgtaccagccgagtgtggcttagagttttcctatggttgacttacctgtcagcggatttcatagctgtatatgcactaggctacctctcacggcatctacccaccactacaaatgaccatatatgctaccaaacatgccttggaaaaaccttgttgccaagccaaagccatcatgatttcacactcttgtgggcaccattctttctcgtacacctaggtgggcaagacactgtgactgcatttgccattgaggataatgagttgtggtcaaggcacttgctaaatatgatagttcaggtatgcttagttgtgtatgtgatgtggtattccatggcacataacctacctgttgtcccggctgcatttttatctgtcgctggggtcatcaagtatggggagaggatatgggcgctcaagtgtggtagccaggaaagtctcaagagttctattagtagctcttatgtcgcagctttgaagaaattagcacatgacgaagaagacggaattcaggtaaccaaaccggcatcgactgtgcagcgtgctcttaagtgcatgccaggtcttcgggaggtattttctagaaggtaaccatctggaaacttttctttcaaaaagtctctcgatgcacaattaactttcaagacggcagaaatggagcttagcatgatgtatgatgagctctacacgaaagccaaagtgattcaaacagggaagggcaccatccttcgttgtgtctccctcacctccacagtggtggcttttgttctcttcatcctgatgagtggcagcaagcaaaggtattacaactcaattggagttgatgttgcaataacctatatgttatttgtaggagctttttgcttggaggcttgcgccatcatcattgccatggtttcaccgagagcgtgggcatccatggaagctcgaggtggaggatgcaacagcagtttgctcacccgagcaacctgtaggtcatcatgttcatctatgttgccgagtatccatccagagaaaaggctatggtggtcaaactcattagggcagtataactttatgagctcccgcctggctgatggcaagtcgaggataaccgaggagatgatggccattgttggagctaaggaggtgtggagtaactttcggcacactaggcatggtccagtcaccgatgaaatgaaggagcttatccaccaagaaattgataataacaagtagaagaaacctctaaacttgtctcctcaattgttttttgcgcaagctgcttcctcctttgaggaaaccttgttcatgatgcacctctacactgacatgtacttgtacaaggtaagcatataattagatacaattaggagcagcgggagggatgatgatattcaagagaaagaggtacattccctgatgcatacatgcgaggtgatatctgactacatgttcttcctgctggtcacgcagcctgccatgctgcctgttcaacgcaatgtgtatgatttgttagcattggttttgaacgatgccggctatgcacgtacctccagcaaggagcagtttcttgagacagtggctagcggtgagtactcgtgggaccaaccattcatggacttcagggcagcacctcctgatgacatgttgcagcagggttggaagggtttgcatgcagcgctgcaagtaatgttgcagatctgggtgcggctgctgatctacgcggcgggcaagtcccagcacgcacggcggctgagcatgggaggggagctgctcaccttcgtttggctcctcatggcgcatcgggagcttggagacatctataatatccagttccagcttgtggaaaaagagaaagacgggtcagtccgtactggtcctaattcaacaataaccaccgacatatatactcttttccgtttaggtcatccgatcgacatgatcaaatagtactggtggccggtgatcgatggtctctttggactctgattatcttaagccatcaagggcatgtatgcccgcaccatctcgatcgtttccttcatgtggatcataatataatcgatcaccctcggttattttttttctttcttttctttttggttgtgtgctatctgctattatctaataatgtcatttgtattagttgctggttaattttgctgtaattaaatatattgtttttaattattcaatatgcatgtaacggactatatatgtatgtataattaatccatgcacatatttttgtaagctatatatacatttgtaagatttgcttctatactcctcgaaaaaataaatgcacggatgtactagacatgatccacggcgtatattggggtggcccaatatactcaacggcgtattactatttcaaaggggtaattttatcttaggaaggagttagtccatactccgctctgtcccaaattatttttatctttaaaattcaaattttgtcctaaaatagttgtcacaataaactactacttgtcccggtccatcaatcacttctaattcaaatttctcttttctctgcccctaaccaccctcttatatccaaccatataatatttaatagagggtacaatagtttttttctcaaatcttaacctatgctaaattatctagaacgacaactaatatgggatggaggaaatatctatctattttctctcaccgcactagctaatctctcgacaagagtaccgtctcttaatcgcgtcacctgcctccctttcttgctctggaaatacgttcctcccggctggcaaccatgcatcaagaggagcaattaatcaccttagtttcactaattaattagcctccagcgagttgtttgcctttgccatgggcgagtcagatatgatcgcagtcgaagcccagaaggccagaacgaagtggccgaaagcccgaaatccgtccggtttattagcctcatcaccgatttcagctgcaagcaacataacatatatacatatatacatgacccttcccccacccccaccatgactaggacacgtggcgtgcgtagagcggacggcgcgccttttcctttttttttcttttctgtttcttttcataatttatttcttgtttttttttttagtttttttaatacgtatatatacaaactttgtacatgtgtatatatttttttatacattataactgtatacatataaaaaaattatatatatatatatgtatgtttgtttatatacatacgtataaactttgaaactcttattctaatgtcctagtaaagttgttggatatacaaagcttcgcattgggacacaaaaatcatagatggagccaaaactgagagaaacgaataacaatatatatgacaagatacggagattaattagaacattttccttagctgcatcaaagtatttgcagagtacaaccatgtcactcttctctaattccacgaactaaatcctggacaaaagagaaaaaaaataattctgaaaccttgattttcttcctaaagcatgtctcacattttaccttctcctttggtctatatgtacccatcatgtatctatccaaatcgaatttcacatcaactttgtcttgatcagtagtgcttcatcccgctgacgccatgtaagagttcccttgaggccttgaccttgtcacaacgactgtattctacaatatgtttacaaattttgtgttggatttcacgatttagatgaaatttttttacggtttgaatgtaaagaaaatatgccttttttaatggtaaactctattttttagcccttatatgttatttttaatacattttccaccctaacctacaaaaattagtagttttttagacaacacagcgcacccaccaccccccaccccccgcgtgcgcaaaaaaaaaaacacccacccacccaaaaaaagagacaaaaacctttaaaccgaataaataacaccctattgtaataaaggtttaatttagatttttattatgcatagtttgttatttattgggtccacaaccataaaactaatataatcaaaaccatcatgaaatttggtttagggaattatttatccagttttaaaagttgagggtgcaaaacaaaaggcactgatattataatgtagggtgaaaaatgaaatcgggcaaagtgtagggagactttacaagtcataaattactcatagcaaatctgttggatttttctacggtctgaacacccatgtcatcaaattggttgccccaaatttgtcacttgatccaatgcatggctgaaaaattcacaggtgcctccgcacacgccatggcccagcaaggcagacgatgtgaatcacatcatcctcccaaaagcttcacagcctattcttggccagttgcttcgccctcaaccgaaacaaagaaaaaaaaagggagaaagaagagggaaaaagaaaaaggaaaaaaagggaagaaggcacgcacagggaagcaatagcaacgaattcaaccaaccaaccaaccaacccttctgctgcttcaatcgatcggcaacaaatctttctgggtggtctggtgctcaactcccccatcgccattttatgcccgaacctgtttctccagccaatttgatgaggattaatttccaaacgggctccgatcgatctccatgattaaccatccggcgtggtgatgagccgccgccgccgcatcgtcgtcgtctcccgatgcatcgccaggacgtgaggacgaaggaggccgaggaggagaggatggaggagaacaatctcctgcattttctagatagcccaaacgcgcattacagaaggtgccgcattttatcagtatatctgtcgggtttccttgcgaatttctctccgttttttgttcatgcaagattcagtaagaactttttttttctctcttcctctttttttttttataaaggaaatgtgaagaatacgtatccgcgcatgatgatgaagcccattgcgatgcatcaggtttttccccttgctccttcctttcctcttcacgttcatcgtggttaaactcattggggatctttgaaacgaatagattatagatctacgaaaagcttcacatgtatactgaatatcgcacaatgtcgaattttgttggaggagatttccatgatttttaactcttgttattaacattgtgcgaaactagctcaaacgggttaaatggctctcaaattggcattgcatggatggttcttccttggagctgcaatggctcacatttgcatggttaccaaatgccaagtgccaatccaccgaaaaatggggcttgcagagcccaaattgtgatctgcaaattcaattccccatgccatcttattctttatttgtgttcatgaccatcgtttctccaagaaatttgtctaatggtgttcaatgtcgatcatcgttgaaaattaggcggatctatatatgagcataatcttctgtgtttgtttgtctttaatgattcgcgtgtttccgacaatagctgcaacctgcatacaataacatgcaactcttaacagatgtagatctggccaatgcaagggaaagattggagcatctgttgaaacaacctgccaacaagttctgtgcagactgtggtacccctgatccaaaatgggcgtaagtatcagccgtttcccagacatacaacattatccctatatttttgtttttttttataaaattaatgctccttttgttatcctaatagctgatgtggttcttgcagggccttgccttttggtgcgttgatttgcataaagtgctctggaactcatagaagtcttggagtacacatatcaaaggtgcacacgattgactctttgtagttcactttgttctcccatctgctcatctcaaatttggtttcaactcgacttattctgattcaatggttgagatgttctaagagaccaaaggttgtcacgatatgaatctatttgtctctacagtaccaataaatttacactgcaggcaaacatttcgttactcaaaagcatggacatatatgatctagtttgtaaggcataagcatatggtaactgcaaactaatagacctcatactgaagtaataattattcaacaattcactgttcaattgagcacaggtaatttccgtgaatctagacgaatggacagatgaagaggtcaattgtttagctggttcaggtggaaatgctacggtgaacacaagatatgaggcctttttgccagagaactttaaaaagcccagacatgattgcacaacagaggagcgttgcaatttcattaggtataaattacgagtaagctagtatttttgtcgttactacttctgtagattctgctacggaaagtaggattctgatcgttactccttctgtaaattctgtttgacaaaactatgctttctctccatctacgtatatgcaggaaaaagtacgagtttcaacagtttgtgactgatccacagttttcatgccctttacgattgaataccaaacacgcaccagacaagaatcagcagcagcaaaactgcagtgcgcgacatggttttggccatgcttttaggaatagctggaagagaaaggacacagataacaaaggactaaagaaaatggtggggaaaacttacatattctacgtattttaagcgggtattgcactctatgaactgtttttactgcaacatggtctaattttttttttcagacggatgtgggtatggtggaatttgttggattaattaaggttgatattagacggggcacaaatcttgctgttcgtgatgtgatgtcaagtgatccatatgttatgcttaacctaggacaccaagtaagctcatcttgttaacagatgccagttatctctgaaaaaatatgcaatatatatttttcttactgccaaataacatttttcagaccatgaaaacgaaggtgataaagaacaccctgaatcctgtatggaatgaaagactaatgctatcgatccctcacccggtgccgcctcttaaattggtacatgctctttagtcataacaaatcatctaattttaatttttgccttgcccatcaatggagagtattgatcagtatctctatccagtgttgtagaatagctatgttgtgcaactttgtgtggcaagcaaattcttgatctttagtattcaagagttcaagactctaggttgcttttgaagtatagaaatttgctggctaaattcaatctgatttattgagttacctacttatggatataatgatctgaactcattttgcgtcaaaaaaaaatgatctgaacttacgagagcagagtgccttatttccccttaagaacagcaaagagagagtagcaaaagccaaattcaagcttgtgcttacatatatatagcctatgacaaaccgcatttttgtttggttggttctgaagtgagaattcttcgatcagatccaaacacatttgttacagataggatggaaacatggattacccactgatattcaaatttatgtacaaaaaagaaatgttctacaaactcacacattgcatctctatctgctcttctacctcctaatttaacagcaagtgttcgacaaggacacgttcagctccgacgaccggatgggcgatgtggaggtggacatccagccgctgatcgccgcggcgcgagaacacgagagctcggccgccatcgccggctcggtggaggtcacgaagctgctggcgagcgacgacggcacgctggccagggacagcgtcatctccgtcgtcgacggcaaggtgaagcaggacatcgcgctgaggctccagaacgtggagcacggggagctggagatcgagctcgagtgcgtgccgctcagccagtagtatagctatagctgctgtacacattttattgctactatagctggccgggatgaaaaatgctcgatctgcattcgctgtgggttgtgtgatcatatgcatggagcttaatttgcttctgtgttttactccatgcctgtatactttgtcaagttgtgtcatgttgagggcttaatgttcatgtcatcgtgtattaattagatatggtttgtataggtaggaaattaagggggaaatggatcgtctaaaacaactctaattttaggcttcaatgttggttttggctgattctttgttatccttatactattactgctagtgtgtgtagctaattttggtagttctcaagcatttccagggtgttaaggggtaaactgccagacatacagtgttcacaaactattactccctccgtttcacaatgtaagtcattctagcatttctcacattcatattaatgttaatgaatctagacatatatatccaactagattcattaacatccatatgaatatgggtaatgctagaatgacttacattgtgaaacggaggaagtaccttataagactaccacgcaagaaaaaagttcaatagaaatttagtgaggctagagaattactcctagcctatgcctctttaagcatgtgaaaagggaggacttgggggtgtgtgatgtgagtgttgtgtgtttcttgcttgtaataaaaaaaatcaaaaggataaaaactggcattcaattgagaaaaagaaattgaaggaataatcaaatttgtaaacagatgaaaatcaaatggaacagacatctactccccaaatcaaaaaggtaattaagtaagccaagaagcaaagcatcagaatgaccaaattaactaggaataagtctactttgactctcttaactagtgaccgaatctgattcctattcttgaacagcaataccagatatcttgaccctcaactattaaaactagtccaaattaactccctcagcagttttggagggtggtttcactgacgtggtgcatccgtgacggtgttgacttagtctatgtctcacgtggtgtttacgtggtattagaactaaaaaatatatatggaacccatttgacatccacacaaaaaaatattgtggggcccacatgtaatcttctctctcctttccttcttcatcctccctttctctcccttctctctctttctctttctccccccttccacttccccttcggtcgtctgtagggggcgagagctggagcgacagcaacaatgggcaggcgaggtcctgggtggcggcgggcgctcgagggccaaagcggtagtgggcccttgagggccggagcagcagcgacagtcggaaggacgggagctggagcaacagcggcgggcgggcggacggctaggattgccgaagcaccgccgcctcctcctttgcctgcatcgtgccagcaccacccctaatccggtaccaccaccaagctccatccgccgcaagctagcttcttgccacccacctcgccgtctgaggccgtcactgggggaggagaagggagaggggagaggcgacaccgcctagcttgtgggtgcactggcgtggggcagagagagggaggagggagagagaggatgacatgtgggctctatgttagggtcccatatatatgtttttaattctaatcctacataagcgccatgtcaacgccatgtgggatgaggaccaggtcaacactgccacgtagacaccacgttaacgaaatcgtcctccaaaaccaccgagtgagtcaaattgtagtggttttaatagttaggggtcaagataaccggtactgcggttcaaggatacgaattagatttggccactagtgaaaaagtgagttaaagtgaagttattccgattaactatcactcgcaagcaaagtgccatccatcgagaatcgatgcggcccaagcaaacgcatcctcgggccatcacacgtttaggcttcatttcaaggaggaagcaattgcacgcatgcgggaggggggggtataagttcactttaggtctctcaatttgtcatcgagtccgaaattcgtccctggagcgcaaacctgttacaacgcatcccccaacttataaaaccattacaaacgaggtccttcacctactcgcgcggttggcctccgccatgcactacacaaccatccatcgtcgtgggggtcgtctccgcagccgtgcggaccaacgccaacaactgctcccgtgacaagggctcggggggctttggcgatgtcccccttatcgtgccgaagctccgaggagggcatctcctggtggtggttggtggtggtggcagtggcggtagcctccgacgcgttgaccgaagatcgagcgagcggcgcgaaggggaaatggatggagcgaaaaggagcggcggtgggcgaagcagaggggcggcggcgggcgagctcctcgctctctccacctcctactcctccctcttctgtctatccttctctctccccctacactgcaagaagaagagcggagcagcggcgggcttccgttgccttcctcggcaaaccccaactctgtcggcgacgccgaggtggccgaccactgcagcgccatcgtcatgacggccacggtctccccgtctcgctgaggttgctacctaccgccgacctcgctcgccttctctgccgttctcctcgacgcctagccgccctccatcgcccgcccttccagtccgtgcaaatccaggctggcgccctctctgctgccgtccctcttctcgctgcagcccccctgctccaccaacgtcggccacacacctcgcaaagctcaaagaggaccatgccgcacacctcttcgtccataccagggatgcacttgaggccaaggcggcggagacggttcagcgtgttgctgagtgaggatgaggaagaagaaagagaggagagagaggggatcaaagtttttatttcgtacgtgcaactgatatgtgtgtcccattgttttttttttaatttttggggatcgcattgccacgtcaatgccatgtgggacgtagacctagtcaaaggagccacgtaggcgccacgtcagctaaaaccaggcataatactgccgagggacctcgtttgcacggttttgtaagttgggggacaaatttcggactcggcgacacataagggatctaaagtgaacttattcaattgcggagcgtacattcttgggccaaatcattttgctggcttctttttgaaccgatccgataacaaggtattactgacctgtttcagcccaactactatgggccgcacgatcctgtttccggcctaaacataaccgtcatgacccaattacggccacgaagggcagcatgcaggggacgtgcggtccgtggaattttttttatttatacattttttattaaaatatttacaaaaataattttttgttttgaaaatttacaaatctaatctcctgcggccctcccaaaggacggcaagggacctaaatgtaaaatttttatttgtgttcaaaccctttccaccggttttaattgcttaaaaactaataatgcttattcgatacttcaaataattttaaatggaaaagtaataaactacaaagttatagatctcatcaagatctataatttttatataaagtttatctctatccaatgtcgtttgaaatgtagatctgagattttttaaaatgtgttttatattttgtaacgaatatttggatatctaaaacatcttaaatgaaaaagttgttaactacaaagttgtagatctccttgagctctacaattttgatataaagttttatttcatctaactttatataatataattttaaattataaaagcatagagctaacaagttgtgctggaaaatttgcatttaggtcccttgccgccctctggaagggcgatttttaaaaaatcgtcctcccaaagagcggcaggtgattagatttgtaaattttcaaaacaaaaaattatttttgtaaatattttaataaaaaaatgtataaataaaataaattctccatgcgtagcgggctggtttgcaaaaccgccggtaaccgcttaccgaggaatatggttaaaggaaaatttttgataaatttaaataaatttaaaaaataatttaaaattttgataaattttacatggtttcgtacggtttgccacggttaccgcagcaaccgtgcttaccgcctaggcgcggtaaccctggttccggcgatttgggaaacccttcgtggcatgggcttttgtttgcgtgattttacagcacattcccacattctaaactactattatttatctttcattaattccaaatatcaattgtcccctagttctccggttaccacaaccccacggtttggccgttatcgtgaggtatactgttgatttaaaatttgagaaggttatcgcacatgataaccgcgataaccatgtggttttgtaaacctacaattaaatccaaaagtaaaattttaacttaaagtgacttgaacaaatcttaaacatccatttttagatgttacccttcatctacttttgatagtcatatttcatcttgacacacagatcaaggataagtaattctacttatcatctatttaaacatgctattagtcatcgctcataaacaagcgatccattaatatttacatttcttgatgcctatgcaaccaatcttgcgtggaagaatggagagtcacgcattaaattcgagaaagtcattaagatgataggttattggattggaatatgcctatcaagaataaatttttcagatttaaaaatataactatcaaaagtagatgaagggatagtgcagtggtaacggggtgtgtagtttcaattctaagatcatgtgctcaatccctactataagcttacaattttttattaaaaaaattggagagacgactctaaatacaacatgttaatagagtagtctgagagtcgtaattctacggtagattgggcagattaatttacatgaacaacacaatacagttgtacaaacaacatttatcacaaggattgatacatgagtacatgaacagtggggtactattaatcagcagggattgccagccggaacacacaatagtgtaatgcgcacacaagcaaattcaccttagctagctaagccggacaagcgtcgccaccattgagctccacgtcatcgctctccggcgtggtcgccgtcggcgtgcgccggtagagcgccgtcatgaacggcgtcgcgagcaccgtcgtcgttagcgccatgatcacgaagatggcaaacgtcgtgtcgtccagcacctgcacacacatatatacacgcgtacatacgtatatttgtacgtatcgaagtacatggacacatgtgagacgtatacgtgtataaagaagacataccttcctctccttgccgatgttgagcacgatgagctcgacgagccccttggcgctcatggccacgccgagggcggcggcctcgcgcctgggcatgccggtgccggcggccaccgcgaacgtcccggcgaacttcccgccgatggccacggccacgacgagcgcgaccatgccccacgcggccgcgccacggacgttgtcgatgtccgtgtgcaggccgctcgtggcgaagtagagcggcagcatcagcccggacaccagcggtgccaccttctcgcccgcgcgctccgcgaggccgccctcccgcggcatggccagcccgaacacgaacgcgccgaacaccgggtgcacgccgatggcgtcggtggcggcgccggcgaggagcacgcacgccacggcgccggtgcacgccaggtcgcccgcgcggtcggggccaaggcggcgcgccaggcgcgccatgagcgggcggagcgcgccgagcatgaacgccacgaaggcggcacccgacgcgaggatgtacaccggcgcgagagggggccccttcggctcgccgcctccgccgccggagacggcgagcgcgagggcgaggaggacccaagcgaagacgtcgtttacggcggcggccgccatggcggtgtcgccgaagggcacgccgaggaggctgagctccttgaggatgcaggcgagcacggggagcgcggtcaccgagagcgcggcgccgacgaacacgcagagcgggaggaaggacgcgcggcgcggcgccgggacggcgacgtcgaggagcggcacgaggcccgcggcggcgaggaacgggggcgcgatgcccgccgcggcgatggccacgctgcgcggcccgacgcggcgcacggagcggaagtcgagctcgaggccgaccaggaagaggaagagcagcaggccgaggccggagacggtgtccagcgcggcggcgctccacgccgggaagagggtgcggcggaaggggccccaccggccgagagccgacggccccagcaagatgccaccctggcgagcatgcatatatgtataagtaaacaatcagatcatgtactcccttcataccattctgtgtccaactttgatcgtcggtcttttaaaaatatcttatttaaaaaaaactatggttattatttttgttgttattagatgataaaacatgaaaaatactttatgcgtgacttatatttttaattattttttaaaaaattaaataagatgaacgattaaatttggtcatggaaactcatgccctgtgtttaaaatggagtggagagagtactgatcataagtatactagaacactttatatataggttatttgttatgaggcatgcatgattcaggaaaacaagagcaaatgcataaagcatggattatctatttatcttggacatgccgtacgaatgaatgttcattgttacagtatgtcattagttttctggaaattaatgtgttctagatagctaaacaggcatatttccctccggttttgcttaaaaatatgtagccacagtttttcttagtttaggttatttttaaaaaaatgtgattgctacctcttttttaatatttaagtatgtttttacctctcccatctcccttttcatatagataattaaattttttattataattttctgatatatggtaggaaaaattatacagtaagtattaaaatttataatatagctatcaacatttgcatgataattgaagtgcaaatatatgtaatttatcgtgtaacaaatgtgactgtttctaataaaaaaatatgatgtcataaatatagctacatcggtcatctccctttccatgtaggagagttaagtgttttgaccactgaacagatacacatgcgatatatactactctctccgtccccaaaaaatttaacgggaaggatgcgacatcacctaagacaacgaatccggataacctcatgttcagatttattgttttaggtgatgtcacattttcacttatgctggtttttttttggacagatggagtacctcctaaaattttctaggtaaaataagtactcgtactaaatacagctatgcgggacttagtttgtgaatattcatgtcaattctagggcttgatcattagaaaatatgaattgtcgatcagttatgccaactacatgatttgaatctgtggtaaatctaaaactcaaattctggtgggaataactgaactgttgaagttttgtcctcgtggcttatgcataaccccaatcaaaaagtggacttaactttttttgctgtgtacaagtacaccatccaacacgtcaacatctggctgaatatatagtcaattatattcaatgacaattgggagtactttcatgatctcaacaatgttgtgcctcttctagaaaatgcggctgcctagctatatactctagtttggtagtcccttgtgttgtgtgtacattaggagaatcctagattctcgggagatatatagagaacacgttcaagagaaataatgccaaacatgtgacgcgcattattaaagaattatagggccacttttgttttttttatttatgcgagacaaatctagctaagcatgtatgcactgacttaattagtcactactacttggggctgtttggatggaatgtaagttcccggtggagggactaaaattttttttgagggattaaaatttttgtaagagaaatcaaaattagtccctcccatctaaacatggccttcatatcgatatcgctcatgttggtagagaaaatgacctcattatatatgtagcaaaagttttcgtcctttcgctaacatatatgcatttcttaatccggtctccttatgatctcctaattattttttaagagatacatattgtcatagaaatgtgaacgtagcggttagcaaattgtcatagaaatgtgaagaatgatatatattaatctatcatatcattttttttagaaaaaaagttatatttatttggatgacatataagagacgaatggacatgtctcaatggaaaaaaaatatttttcccagaaatatgaggagtagaatactcctcatatttttataggtaagcacatgcatcagtttaattccaaatataagcacaccaaacccatatttcaatctgtaggcaagatgctcaaggtaggcgttgttccatcgaatataatatccaacaaaataataggccgttgaatttagttttgtaataatgtttgacatatttattaagtataatttgaatatagcatgatgctaatatacctaaacaattgctactagtttacaattaagtgagtttacatcaccgggtttaaatgatctatttattttgttaggtattagatatatcgagggattgacgtggtccagtacacgtacatgtttaggaatggaattacgaatatgatgtgctcatatacgtaatcaaagggttggatgcgttgcgactaaaacaaaatcgggaatactccatccaggagtatatatatttcagtacgtaccaggatctcggcgaccaccctaggctggcgcaggggcttaagcgcgagcgcgaggccctgcgtgatcaccaggatgacggccacctgcagcgccagcagcggcagcgcgaagtccagcgggttctccccctgccacatcccgtccgacgccatcttcacggtgaccgccgccgccgccatgctagctctacctatagctcgtacacttgatgagggcgtgcgtgctggcttgaggttgagggcgtacgctgtggtttgatacaaacgtaacgctgctgtactgcgaatttataggcgaggagaaatggatgcggtgatatgatatgatgcgacctggccggctagctatagctcgtgcaccggatgagccatcgatgagtataacgttagtggttgctactagtagctcgatcgatcgatcggtgcgtttctccatcattgtgggagggggctttgctagatttggacggacatgtgggtgttgttgggatcgatcgatcgaactctcgtatagtattgcgctgcctaccgcccctgtactacgtgtggctagagattaatccaattaatgggatgcacagcacggttaaagtcaacgaatgatcgagtgatcggacacatgtgtgaatatattggaaaggaataacaagtagccctgcatgcatgcatgtggcttcgatctcaccacagcccctagtaaatatcattacgatcgatcgtggtcataactgtataagagaaatgggccgggatttgttaagaaatagtaaatcaatgttgcttccttaatttgttctaaaatacaagcatttttatgtgttcctcaaaatgtatcgatcgatggacgacgatcgcctgcacggagatcagactccagttagcctctccttccttgagatcgtggcaccttccttagctgcctgaccaaactatggcgactcgggcatggtgtctcaaacgatggtgggggtgtatagcggctcatggtgtcgtggcggcgaggagctggtggcccggctgattcggagctcaagcatatatggaggcttgctagctgctgaatgtttgtgttgttttttaatttttgatttggcaggtaagtccgtgttcatcgctgtttgtgttcgtcttgttcatgttgtattgatgttttgtgatgagtttctagttcttatatgtgatgaggttatcttgtgttagagacttcgactcttcaagcaaagttgagtgtagatcattttattgatgcttgcattgcctcggttaattggatctgaatttctttcttttttttcagaaaaatgcatcgacatctgtaacggctcaagacaagcagccgttacagatgaaactcgtctataacagggcctccaaccgttacagatgattggtcacatctgtgactaattctttgtaacgactgaccaagcttacatgcagatggcaatcttgagtcgttacggatagacaaatctatactattttaaatgattaatgtctgcatacgatttgaataaatctttaaaattctgggcattaattctgtattagaataaattagtgatccaataaatttacaatattatgatagtatttttcaagaaattgtgtgcacaaaactgattatatatattgtgcagaaaatcaggataacttcagctattatatatgctgttgttcatgcagttttcaacatatgaacaaagtcagaaattagaatgccgcagaatccctgcacccccactaacccaggcagggttagtgagtgtccagtggccaccttagtaatgtatctatcaaaagctagctagcaagatcaccaaagcattgcatcacgcatgcaactatctcagaagcgtatatgtatgtactccgggcctcaaactttccagaaccctaatcctgatacgatctcgagtccatggctgatacacaagtcaatcacaagacgttactccctccgttttaaattacaagatgttttgatttttgtcaaagttaaactaatttaagtttgaccatgtttataaaaaaatagtaatatttttgatcgaaaataaatttattcaaaaaatatatttaattattaatttaataaaactaatattaatgtaaatattcctatatttatctataaacttagttaaacttaaagcttaaagcagtttgactttgaccaaagtcaaaatatcttgtaacctgaaatagagggagtaattattaataaccccctctcaaattgtatgtgtgcgtgcatgcatcaatcaaatccccttttcggccgtcggttaatcactatgccgaaaaaaggcatggcagcagagcactgaatttatcgtgccgtcgacaggagcaattgtgagagaaagatgatgcactggttggagcttcttgattggcccagccaccgtagtgcgcttagcctatatctctccctgatcacacaattagggttttagggtttagtttaattaatcagtgagtggttggccggagctctgattaaaattatttatcgcaagaatctgcatgcatcaaggtaataataaacagagaaaagatgaagaaagtttgtgctcctgatgctggggtttgatgttgggagtggcctctagtggtctgatatgtcattgcttgattggcgttagttcgccacatcagtccgacctgtcaatgaaccaatggagatcagcaagcaagtgtcagagacacagaatgccaattactacctccatattttaatgtatgacgccgttgactttttatctaacatttggccattcgtcttattcaaaaaatttatgtaattatcatttattttattatgacttgattcgtcatcaaatgttctttaagtatgacataaatattttcatatttgcacaaaaattttgaataaaacgaatggtcaaacgttggtcgaaaagtcaacggcgtcatacattaaaatacggagggagtaacatcatgtctctttaaactagaactactagctattaagaagcgtgattaagctgaacagagagtgaaagcgggacatatcgatcaatcgaaactactgatgatcaaataagaaagaagacaattatatcaaattttgatcttacacagttaattacacaccgttatcaaaattattacacacagttacgttacacagtgatgttgtgagagggctttggtggtctgacctgtcattgcttgattggctggttgcatcgtgttcggccaccacatcaacccgacttatcaacgaaccactggtcgaggtcagcaaatttgtgccagcagtgccagagatagaatagtagtttcgttctttcccttgaagaattatacttatctcttttttaattgacgacgcgttaaccatttattttagtaaagaaaatgcaattatcatttgcttggttatgacttggtttatcatttatgatattttaaacctgacttatatttctatatttgcacaaaattttatctctactacttaaaaataagagatgcttctatcgtccgtaaaaaaaaaccaggcgagcgagaaaaaaaccgggcgaaaaaaataatccgattcttccctgaaaaagaagggcgaataaaaaaccggtgaaaaaaccagacgagtgagaaaaaaaccgtaacggttcgataaaaaaaagggacgaaaaaaaaatccgattccgtgccaaaaaagggcaaaaaaaaatctccatgaaaaagaagggcgaaaaaaaaatccgattccatgcaaagaaaaaaaaggccaaaaaaaatctctacttctctatctctacttaatgtttccttcgtcaaaacaaaaaaatagcgaaaaaaataaaaaaaagtctgattccctcttagaaacaaaaaaaaaagttcgactatagatctgattcccccggaaaataaaaggcgccactccttccgagataatagccaccactcctctcggtttcaaatatatactgtgatatctctcacatcttggtgaaacaaaataatgtgccagattgaagatctgtttacaaaaacggaacctactggtcgagagcattccatttttatagtattttaatttttaggtttgtacttttgcatttgagtccctgtaatttttatatttacatttgagtccctataatcttacaataaggtacttgaggtcgtttttgttaaaataataataaaagagagagaaaaaaccgaaaggtgcataaaaataaaaacaacaacaacaaaagttctgtttctcctaagtcatgtattggaaaaaagcaaaaaaaagaacattcaaagaaaaaacaagcaaaaaacacgcgagaaaataattgtaaaagaaggcaaaaaacacacgagaaaagaaaagcaaaaaaagggagaaaaatatggttttcgttgtaaataaaaaagcaaaaaaaatgctaaaaaaacttttagaaagaaatgcgccatttctgaatggtttgagaaaatcgtgcaagaaaaaaagaccgtttataaaaaaaaacaagccgctcattaaaatacaaacattgtcattgacatgattattcatgaaaaacgtttattatcattagaattttttcacccgttgcaacgcacaggcatttttgctagttaagaaaagatataaccaaaaatcaaattgtgtcatctttttttttaaaaaaaaaggatggagtacaagctagtaggaaatgctctgattaagctgaacagagtgtgagatatgtcgataccgaaactactgatcaaacaaaacaaaagagtttgctccgttcggtagtggaagaaagaaagaaagtaagtttgtttcgttttccgcgggtacgtttcccgaactattaaatggtgtgtgttttgtaaaaaaaaattccgcgggtacgtttcccgaactattaaatggtgtgtgttttgtaaaaaaaaaactataggaaagttgctttaaaaaatcatatgaatccatttttaaaatttacaatagttaatactaaattaatcatacactaatgacctacctcatttgacgtatcttctcaatcttccaatcttctcttctcgcaaacagagctgccctggtgagtagtatttccctggcctgcagccatccggagcagcaagtagcagtgtttggttgcttccctgaagaaggttgtccatgctcaggcatggttgccggagtcacgccaccaaaaatgaacgcctgatccaggcgtgggcgtgtgcctgatcatcccccattgattcttaacggatgtgactactactacacttgtaaacatctcactcaaacaagcatgtttttttttatggccgtgtttagtttcccccctatttccaactttccatcacatcatatcacatcaaaaaaacttttatacacatataaatttttagttttttttccaaactcccaactttattcaaactttcaacttttttttaggactaaacacaacctatgttcaatatattcagccaggctcatgtcttcaaccaaacaacagaacatcatatatgcctgctaggcatgattcaacacgagcttttctaccacagtacaggcatagatttttctcaggcaagtcatccagatcaccaaccaaacatgcccttgctaattgtgagtgcgagcgttgcagacttgcagttcgatatatttatttatgtttcaatttgggacgtttcctgtatataggactgtaaacagtttttttttttcttttgcaatattgcatcgatttgcaccatgactaaaaaagaagtttgaacatttttttttttggcggggggtgggggggtgggtgtaatgtaaacttttgaaaagtcggcaaatataccagaacgcacaaaacttacaaaaatagagttggtataaaagcgtaggcaattaagattattatgaaatgcatgacttacaaaattccgactgaagttgttcactgtaaaatttgtgatacagaaaaaatgacggaagcatgtttgtgatcattacaaattcattttattcgcgaacgcgtaaaagaattgcattagtatattactctctccgtcccaaaatataaggagttttggttggatgtggcacatcctatctgtctgtttagattcacaaacagacataatactatgatatgtttcatacaaccaaaactcttatatattttaggacggatagagtagaagaaatagagtttttgttacacaacgcaatggactagattggtcgttgccagtgataggacactgctattgtgtggtttagttgtggaacactgcccaaactcactttgggggaaaacactccataaacatggtaatttgccaatggacaccgtgccgattaaaataatgatttccggttgaggaggagagatatcgcgtgaaatgtcaaaaatgcccttgggcccacatgtcagctctctatctctcttcctatctttcttttctttctctcttctcctggtcgcggcttgttcggtgacagcggcgacgcacagagcgcgcgcggcctactcggcaccggacctcctcctccacacctgatggcgtactttgccaccgccgtcgccggagttctcgacgacgctgacgttcttcctcttcctcgtcagcctcgagctcgacccggccttactctgctgcaccgccctcgcagtcgccgccgccggaatcttgctcccaacgtcgcatcccagatgccaagaatcgggcgccgacgccgttccgcctctgcaccgccccgcaccacgtcgcgcgttgccgccctttgccgttacaccacccccacggtaaaaccctcgtgccccgagcctcacctagtgacctagaagccggcggccccctcgatttggggcgggcgccgccgtagccatgccggcccggtcgcccttatgccaccaatgagcttcctgtgggcaaacgtagtcccaatgcaacataggttatattatcgtgaaattgacatccctatgaaacctagatcgtgtagaagtagccggttgtgcccaaatttatcgacattgcgccgccgccgtgcttgtgtgctcggtgccgccgcttgccgtcgcgtcgtgcgccgggtggccgctgcgcctcgtcgtcgttggcggtgggtcctcggcggtgagccatcgcttccccgtcagcgcgccatgccgtcctggcttgggctgtcgcgctgaccatgcattgcgctgttactcacccgcgacgagaggaggaagaagggagaaacaaaagaaagagaggaagagagatggagagctgacatgtgggcccaagggcatttttgacatatcacgtgatttctctctcctcctcaaccggaaattattattttaatcggcgcggtgtctattaacaattatcatgtttatagagtgttttctactaaaagtgagtttggacagtgtcccacgactaaaaccacataatagcagtgtcttgtagcaaaatttgtctagaaaaaggatttcgaataaaaaaaagataaaactaagaactaaaagttgtttctcttaagaaaatgatttcgaataaaataaaggttaaaactaagaactaaaagttgtttctcctatctagcaggaggggtggtggcagaggagcctcctaatgttccaataggtccccaaatgatacggcacgagcgagataatttggttgatgaaagagcccaagcgcagattagagcttgaaagtcgaaaaaactcatcatacctatacagatctgaagtagtagcccacatcgttttttttttccctgggacttttccatttgacttgaattattgatggtcgtcattgctatgcaaattttctctagtaattcatactttattttgtatcatcgttgaatacaagagcacgtgtagcctcaaatagtcacaagatgtcttcatcgaagaaaattgatggttccggttaaatgaatgcaacaaaacagtaggagtattcttgttggcaaattgcacggaatttggatggaattataaaaagcattaattcctcccgtatgaattcgccaatctgaatttccgggaaaattgagaaaccatggagaccgcgcatctagcctacgtgctcctcttcctcgtcaccgccgtcctcctcttccatctccggcgaggcggccggtcagctccggcgaagctcacgacggcgcaccgcccgcacccgaaccccgtcctgggcaacaccgtcgagttcatccgcaaccggcgccgcttcttcgactggtacaccgacctgctgcgcgcgtcgccgtcgggcgccatcgaggcgtggggcccgttcggcgccggccacgcggtgaccacggcgtgcccggccgccgtcgaacacctcctgcgcggcaacttcggcaactatgtcaggggggcgagcttccgcgccgcgatgtccgagctcatcggcgacggcctcttcgccgccgacgggcgcctctggagcgtccagaggaaagtggcgtcctacgccttctcctcccgcgcgctccgccgcttctccgacgacgtcctcgccgtgcacctccgcggagggctcctcccgttcctggacgccgccgcggcgtccggggaggccgtcgacctgcaggacgcgctccgccggttcgccttcgacagcatctgccacgtcgcgttcggcgtcgagagctcgacgctgctcgagacggcgagggaggactccggccgccacgaggccctcttcgcggcgttcgacgccgccgtcgagatctccttccggagggcgctggcgccgttcaccctcgtgcggaagctcacgggcctcgtcaacgtcggcagctcgcgccggctccgcgaagccatcggtgtcatcgacgactacgccatgtccgtcgtcgaatccaaggaggcggcgtgtcgcgatcgcgatagcgaggacgtggacccggacctgctgtcgcggttcatggcggccatggacgaggaggacggcggcgagctgggcgccatgttccccacgccggaggggaagcgccggctcctgcgcgacgtggtcgtgagcttcgtgctggccggcaaggacacgacgtcgtccgccctgacgtggctcttctggctcctcgccgcgaacccgcggtgcgagaggcgcgtccgcgacgaggtgtcgcggtcgcccgacggcgacggcggcggcgacgcgaaggggatgcacacgcactacctccacgctgcgatcacggaggcgatgcggctgtacccgccggtgccgttcaacgggagggtggcggtcggcgacgacgtgctcccgggcggcgcggcggtgcgcgccgggtggttcgccaactactccgcgtacgcgatggggcggatggagaggctgtggggcgagggctgcctcgagttctcgccggagcgatggctccgcgacggcggcgagttcgtggccgtggacgcggcgcggtacccggtgttccacgccgggccgagggcgtgcctcgggaaggagatggcgtacgtgcagatgaagacggtggcggcagccgtgctgcggaggttcagcgtcgaggtggcggcgccggctccggccatggaatcgccgccggcgtacgagatgacggcgacgatgaagatgaagggcgggctgtgggtgcggctaaggaagcgggaatagtcagtgtgagtgatttgatgccacttgttgttcttgtttgactaagtgaactcttgcatcaggtgttgacgggaaaccgttttaaacactcgttggacattcacccgtttcttacatgtcatctaaataattatggaaaatttttaaaaaaattgacatgataggttaatatgtaatatattacttcacaaatatacaagttcaaattcgtcttctatgaattgtaacaaaaataacaattttgactgtgaatatacgtatactaattagagtttaatttcttatttttgttacaacttgtagaagtcgaatttgaacttccatgtttgtgaagtgatatattacatattaacctatcttgtcaatttttttgaatttttttcataattatttaggtggcatgcaagaaacgggttgacgttcacccgagatattagaatccatcctaggtgttgaccacaattgccgtaggcccgttggagtagcacgccaagagagtggctataaaagtcaatattttctgtggaatttggggatctggttgacgatgatatgtagaaagatatcaatattgaacgtgctatttatttgtagaaaaaaaacatactggatgttatctttacctttatttattataaaaatttaaggtgtttttgcatttgaatttcatacgtcacatcaatcctagcgctcgatttttttgttgtccgtagtcacgtggcacgttttactggctgcccgcatccgattgcaattccctctttccacgccgcgcaccgcgtccaggccgtgcgccagccctggcgcatgcatgcatatgccctcccagatcacgtgaaacaaaactgtttctgatttctccattcacacacaactttaatttttatagcacctacctcattcttatgttcctatacaatttcaatttttaaggcacgtaccctaaacaccagaaaaaaattgaataagataaaaatctttatctttacctttatccatatatatatctatactatagccatctctactacttaaaaaattgaaaacgtttctgtcatccgtaataacgaaaaaaggacgaaaaaaacatgaaaacaaaaaaaaggaaagtcaaattcaatttataaaaaaacgtaaagaaggggaaaaaaaagaagtccgattcatcggcttggtccgttgccgcatcacacgcatcccctctccaaatcccaaaccatcaccatccaacccaaaaacaaaatcccaatccaaataggaatcatcacaaaatcatccaaaatagatcacaggacaggagataatcaaatcggatcacaaataaatcacacaggagaggaaagggcaagcgagaggccgtcgctgctcctcgccgcctcgttgccgggatccaccaacctgccactgcgccgggaatacgttgcgccgccaacccgcagccgcgcagccacgccgtcgttgcgccgagaagtcgctgacccatcgctgcgctgggcagatgttgagagggagagagaggagccagatcccaagccgctgcgccaccaacccgccggatatggcgacgagcgggacagcggcgacaccccgacgaggaggaaaggggccaccgcccaccggtggggaagggacagcgccggtagggggagagggatggggagctgcgatgctggtggggagaggggagagggaacagtgtcgccggtgagaataaaaggcagtggtgctgccatgggagaggaagtggcgccgccgtggggagagggaagggaactagggttagggatttcgggtacgatccgagccgtccatcaaaatgaacggttcagatcgatcccgacttgggccggcgacattcccaggccgccctgtggctgggccacctcatgggccgcaagttcgtgggccaggcaaaaattattttatttctctgtattttaagtattttctatttttaggaataatattagtaccattttaattgtttaaaattgctaaaaaatcatgaaatttcttttctttcttttttctagaactttgtttctttaggaatatattttcttaaagggctcatatcataaaaaataaaccctaatcagccaatatttttatatttttgtataattatagtttacctgttgcaacgtacgggtatttttctagtaatataaaaaataaaagaaaaataccggggtagatttcaagtgacggatctcttcaaatctaagtcacgagccagtgggagactaggagagacaagaagagaggagaaaaggagggaagtgtaagatatatcgactggggatatccgtaaaccgaatgataagggtattgtggtacgtttgtacggggatcaacacgattcaacatcaagcaaacaaggagacaaggataatactggttcaggtccatcgtaaggtaatagctctaatctaaggccttgtttagatccgaaaaatttttggccaaaaatgccacattaaatgtttggacacacatgcatggggcattaaatgtggaaaataaaaccaattgcacagtttgcatgtaaattgcgatatgaatcttttgagcctaattacgccatgatttgacaatgtgatgctacagtaaacatttgctaatgacagattagttaggcttattcaattcgtctcgtagtttacatgcgcaatctgtaatttgttttgttgttagtctacgtttaatacatcaaatgtgcgtccgcatacttcaaaaactttacacccaatgaactaaacacaccctaatttatataagactgatatagaaaaccatagagtacaatagagaacaactagaagagggtgatgggcaggattggcagagagaacaggggcgataggggtgtcagagggatgcaagtgggtcgatttgcgaacccacttatttggcctataagtaggtttgcggatcgatccacttacatccctagttgtctcagcgatgtgaaccacatgaaaagggggaaatagacatggcggaggctttctggtgctagtgagagaaaagtgagaccaggggcagcggtggtgctggtgaggatgtgagagtgaggagtggcgagaggatagaggggttttagcaagcaaggataggaggtgacggtgtggggatatggaatgttgcagtggtgagttgttcgatctagtttatacatcttggagtcacgggagagggagaagataaggtttcctctgatgcgtgaatctcaatgcaatttgagtcatctaaaagtgatagagatttgtaggtatttttcatattactaaaacgcgatgccgcgccacccccaccccctcccccctcctcccggcggagggggtcgcgcggtgagcgcatgcgtaggggtggggcctttatttttgtggttttccattcggttttttcctttccggtttttttctttttggttttttagcatatacatatacgtatacaaaatttgtatacgtgtatacaaactttgtatacgagtatgcaaactttatatacgtcgtacataaagttggtatacttgtatacgaatatatgtgatgtttttttttggttttttgattttttaatatgtacgtatacaaagtttgtacacgttgtatataaagtttgtatacatcatatataaagtttatacacgtcgtatatacaaagtttgtacacatcgtatacaaagtttgtatgtgtgtatttttttatacatcaaaaaaatatacatataaaaatatatatatttatagtagtaatactagtagtagtatagcagtagtagtaatattaatagtagtagtgtagtaatactagtagactagaactgtagtactagtcggcggtcgggcgtctgaggggccgcgcgactagtcgtgcattagcccccccccccctcccccccccccgcctcgttagttgcaatatgtaattaaactctcccttctaatatattgataatatattgatgtgtaattattttgtgcgctaaactgccaatcaactcaccagcgggcagtgctgcacttcggcccgatttggagttagcttacgggttacggcccactcgagggaagtacaaggcctctaagcggcccagccgttcggccacccgccttcccctccagcctaacgcgcgggagacagcgagcgttgaaggcaaccgcagtacggtcccgtccagtgtgccccaacgcgtggccgtgctgggtcggatcatcatgatcacgtggtcatggtgtgtgtgttggatttagatcaggtgtcgttatagctgttactaaaacttaagaattacatgcaatttgattcgtccatttcgcaacactacaataaccgtataaacaatagccgtataaacagtactctactctaaagtgcttttgctaccgtataatgaacagtgcgactcactagtctggaccgttccatctgtatctgtgaatgagaaccggtgctgcctaaattgcagtgacaaaagtgactacacctgatccagattcgtgtgtagtggtgcgtgtctgtatggtttggtcccatatgttgcaatccacctatcagagcaacagcgtggtcaaggaccatgacaccatgtaccgatcaatagatcaccatctccaaaatcaaattcggtagccacaccatttagatcgccaaatctaaggacgaaacggtcgaaaaaaccttgtaccatttccatttttatattttttttcttgaaaacgaaatcggaacgataaaaccgaaaacgataacaatatcggtatattagaaacgggatcatcggaacggaatatatcgatattggttggaagtcaaaaattcatgtcggaattagcggagtgtggcatagcacacatttaactatgcacaaagatgacttttaagtttattcttgcatcatcacactccacataataccattatataataataagtttgacatataatataaacaaagttcaacaataatttaacattgataagttgaggagaccaaagtttagcaaaattcacttgtcacgtcatagggttaacaatattttctctaatcacttcttttttttatgggctaaaagcctaccaggcttcctttattcatgagcttctggtgggttgggtaggctgagccgctaggaactttcggaatttttttagaattttaatggaaattatcatacaaatacggttactgacaaaacggttggaaaaacatccatcctatttctgctaccatttccgaaagacattaccgtttccatttccaccatcgtcggttaccgatacgactgaaacggttggtggaaactgaaaacggcgctcggaaatctcgaaaatttccgtatcgttttct

SEQ ID NO: 81651 - DNA, 15571 bp, Oryza sativa
aaataacgtatataccctattcaatggagtgatgttcggtgacgtgaatcgatgaattatgatgcatttctgatatgtatttagctccatgataccttcttaggtttcgctcagtaatgttagaccaatcttaagactcatcactgtttttttgagtccatctcctcatttcttatcatgtcagatgcacggcattggcattttaatttgttgcaataattaggttgtagcccgtgcgtttactgtcatcatgacttcttttttttgcccgtgcgtttactgtcatcatgacttttttttttctttttgttgtttgcctgatggtagggcgcgcgaagcacgccttattatctactcccccgttccaaaataagtgtagttttgtactattcatcttcaacgttcgaccgttcgtccatctcaaaataattactatttttattactattagatgataaaacatgaattatactttatgtatgactaatttttaaaaatattttataaattttttaaataaaacgaacggtcaaacgttggacacggattttcacggctgcacttattttgggacggaggtagtagtatgaatgcattcagacccaaaacacacacacacacgtatgaatagctttgtatcgtgcaaaatttcacatctccctgctttcggtctatttttcatataagcacagctagtgtgagtatttgataggttagattgcaaaagttcgtgctgtggtgcatccctagcagaatcaaggccttcctcaatgggtaacttcgactctatatggcatacctttgtacccttggcaaacacacccatcacaactcttcgaaaaaaatggtaattccaaaactttccactctcaaaactcaacaaaagctataaaggtcttaaaccgaacactacccaaacatcttctacggaaccaaagtttgctaagttttctctttttttaaaaaaaaaaccaaacaaacccataattcaaagcgattttgaatttttaaagtttgatttttaagaataatattagctagtctttgaattgttctcctagtgatcatgaaaaagagccagacaccaagacaaaaggagaaagacaatggaactaattctaaaacaaaagcttaaaaagaaaatcaaaactacctctaggagagtccctgttggcatcatactaaaatcaaagcctaaaataaaataaaaaatacctgaagattttagcctttcgatacagcttccatgtgtcaccagccgtctgattctaattgcttctaaactataccataaaggagaaagcaaaagagattgtcccggaataaacatcatactacttagtttcaaataaaaaaaaatcatactacttcgcacccaatggcttaacaatggagtttaagatgcatttcctccgttttcaaacaattcaaagagttctctcggattacacttggtgagttggaatcataccaaaatggttgggtataggcttgcatgtgacatgccactatgaaacttcacttttgtcagctacctcttccatatgtgacttcattttcttacaacagaaaaggcgggaataagaaaaaaaaaatcagtcatctgggaagccaaaaaacttgttaatcagcgatacaactggtttggcatcccctggcacataagggttgagagtctctatgtccatttcctggatcgtctctcctagtgtttgtgggcttgcacagaagaggtgtttccttgtagccagttcctctgctaactcactctgatgattgtccatcaaatcctcatttacaacaacaattagaggtttgccatgtcgcaacgtctcgaatatgcttcctgaacctgctagagctcaatctggttaattgcaatcagcattgacaactactccctcagtttcataatgtaagactttctagcattgcccacatttttatggatgttaatgaatctagaaacatatgaatgtgggcaatgctagaaagtcttacattatgaaatggaggaagtaacaaagatgcaaaattgatgatatacttgctaaaattcacagtatttatccagagcacatatcaaggcagcacagaatttatgtaacatttaatgaaatttgaccataacggcaggtagaaatattacaactctacctaacaatagcaagtatggtcagcttacttaaatattatgcttctttgtacgcgtcagataaatattgtgaagcgaagtaaaaatggcatgtttattagttcaaatgaactcaaatagcagtatgatctagaggtgaaaaaacataaattggttaacaaaaaagtgcttataatatcagaagatgttttgtaaataaaaatcgagcagccaatatggcgttaaaacagtacaagtgtagctattctcttcaggcgtcagccatttaaagacaccaattatgctcaatttgttggcacaaactaccaagtttagaaaggatttcatgtaatgcaccaaagcgttccacacgatataatactccactgcagcacttaagaaaaaaatgagatagcatatgccttaatcaagttcaaactattggcatgaagatctttaaacccagttttgtatataagcttatacggtaagggtgtacactcctcatgtccaacagaatagaattggccatgaagacagactttacacaaggtatgacctataaacaatgagagcatattcatggtgcagtggagtaatccttcaattgagaaaaccattatattgggtaaaaatgttatttgaatgaaatacatttcacctggtatgtcctataaacatgtacaattacctgcatgactgatgaccagggaagcatcccttatataatcagcaatgcttggcgaaaaagtgaaataatcaacttgaagagttccatctcctgagacctgtattcaaatatatcaaagtttctggctggtttcacttcactttcacaaccatcaacatggtgcttacaaatgtttcaggtagaacagaggaatcactagcagagtaaagcaattattatctgctaatataacataaattcatgccacatgttaggaacatcccctaatcattcaatgattggatatagtccctacccattcaacttagaaacattcactcgaaactggttatataaaactgaaaataagaaatgtgcaatccaaacagaactcttcacaagaaatcaaaccgcgcaacttctgttcatctgacaactcatcaagaattaaccccaagaacagaacacgcacacagacaaaaaaaaagcaccaaaagaagaattaacatgcagaacaagctggaattccgtgctggtaaagtggcaatttaaaaggaatgaaagagaaattcattgaccttagatggaacatatgtacctcggcccatttgaattattagatcagtataacctttttccagtagagcttctttgacttgcggggaatctactgccttgacaagagcatcaaaacacgtggtccctactgtgacaaacacagttcgtctttccctatctcccatttattctgaaacgagcactgtctgtacaataatgttttccttaatccgtaaagagaaaacagtattcaagagaaaggtgaaaaaatgcattatgctggcatgctgctatgccaggtgaaatttagagagagacagagagagagtaaatggtgtgccagaaataattaatcccattattccacagatactattatccttgatagttaggggcatctattaaaacaacaatagagagtttgacaaacgaaagggtttctgttccgatgcgaaaattagcacaaaaaatggggtaagaactggtaattctgtactaaaaacaagatgaacaattcagacactagcaggagcggatctagcgtgggaccgacaagggggttcaattgaagccccaaactacttgggggaacaaacaaactgttactagttattcagattaaggcaaatttctagaacagaatctatagggttcaacgcaaattcgagaagaagtgcgtgggaagagaccagagagagatgaggaagagggtgcgcgtagggtaacggatggatgctcaccaggatgcgggcggaagcaacaggacgaacgacggcgccagcgccgggcgcccctgctcgctcgcgggatggagatcggcgcaggcggcgcaggggcgagctcacgaggaggagacgacggaagtctatgccgagctgggggggatacatgggccgcacctttttagatagaatactacatgggcctcacgaacactttggacacatagcagtcccaaaattggaataagttcactgaaggtcctctagttgtcaccgagtctaaaattcgtctctaaaccacaataccagatataacacgtccctcaactcacaaaaccagtgcaaacaaggtcccaaggaagtttggactatggtttcgactgacatggtgtctacgtggtgttcacatagcgcttaaagtaaaaaaaaaacataaacataggacccacatgtcagtgattgtccagttaaaaataaaaaagatacagtgggacccacgccatcacccctctctttaccctcttctctcccttgcggttcaagcacagcgccatttgctgaggagcgcagatgggtgggtcccctctcctcttcctaaatctccccgtctcctcctccgcagttgccactacatgaatcctgtcgctggcctaggaaggtgccgtgccgatgatcttgccgcacttcactcacctacctccccacctccccatagaaaactagcagtattcacccagataggcatagcagaatatacatcaaagattatataatataaatgtgtgcagttatatctagaaatttctaatattaaaactataatttttatagaaaaatattacagaagaaatatcaaatgcatgcgaagttgttgtcgctggtttgtatggagcctgacaccacacgaaacattccctaagagcatcaccaatagttctcataaacatatcctaacaattataggatttcagatgaaaatcatgctccaacaatccatctgatcaattgcctaaaatttgaaaatctcatatctgtttttttttggctatccacaagtcgagaacacgcaaccactcccaatcgatggatcgcgtggataggagggggagcgccgatcatgcacgggaaggggggccaatcatatgaagaagagttcgaggtgagctcactttttttttgttttcgggagttagttctgggcaatctgttggaggtatgttttttttaaaaaaaaatcctaaatccatattagagattcctaaaagaaaattttgaattagaatttgtgggaactgtgttggtgatactctaatgggttatctcccacacaacgttttttacgccaacacggttcccgcaaattctcctgaagatgaaaattaagtttttttttacgcaaaacgaggtagtattaacgtatgattgattgagttttaattattacaaacttgaaaaatagattaatatgatattttagagcaactttcatataaaaaatttttgcacgaaacacaccgtttagcagtttgaaaagcgtgccaaaaaatatttatcttcatccaactgttgttggagaaaagaacggaaccttagagcaagtacaataggaggctgtaagccgactaaatactgatgcggaggatagaagagaggagagagaggggagaagcgggctataaacttataaacttacagacggcttggacacaagagccaagaaactctgtaagatagacaagtgagccctgtattaattgtaaaaagctaactattatatgaatggactgagagaaggctaaaaaaaccttacagccaacaagttggttgtattattagccttgctcttaagactctataaccccatgcatttaaggcagcctcaagtaccacccaatacgttgatgagtaaacaatgagaacatataccgaaccagtcttagcagcttagagcaaggtcaatagtatagccaactactggctccaaaacatctatagccaatctaatagctcattcatacaatagttaactataaaaatatactacaccattaatacccggtcccacctctcatacacatataacatcttggagtccgtgttgcaaccagctacaaatttgtagcccgctttcttctctctcttttcttttcttctcgatatatggttatagccggcttatagcctgctattgtacctgctcttatacataagggtgattgatttttttttcctgaaaaaggtttatacataaggtgttatactctatcctatttatcatcacgcgaaaattgaacttagaataagagtgtatacacataaaatagaaaatattaataggaagtaaagttaaccaattagagaaaatctaataaaatttcaaaaaaaaattgtccgtacttttcactattactagtgcctctacagtactttgcttttacatatcaaagaggtgaaggctttatcaacgaaagtttctttcttttctaaacgaatattcatttagaaaaaacagagacaacgaatattcatttagaaaagaaaatcacctcacttttaatttgagcttccattcttaaacctattctcgaaacaaactaatacgcatacctacacgaatgcgcgggttaccttcctatttagaaagaaattaattaaaatctagaaagtaccaaattggatattggtaatatcaatcatttggcttaaaaccaaaaccatcatgcctaccactttaagcaatcaaaatattggtagggcaacaaagaaaaaaaaaacagtcctttcattttcttatgggcatagttacgctgagaatatgaaggggcatatgaaacattgctaccgttggtaatcactgcgacactgcctataaaaaaactcgaaagatcaataggtaatctctaacaaaaactgactcaggaccatcaccgtcagtcatctgtattctccgatcttagagaaaggataataatggaagagagagaggtaaagaaaagcagaaagtattggctctaatacaagagctagtataaatttatggtgagagaaagagaggatgacaaaaataaaactaacattatagccaatcatattatctctaacattgatttatattagtaagtagtgagcttatattataggccgtctcataatgacctttccatcgattggatggccattctggcgcccagtaatccatccaagcctccaaggtcgcaaaaggaatacatgccgaactaatcagcgtcggctgtgccagcgatatgccggtgatgaagattgaagaagatgacctttgctcttcttcgcacgggcatccgcaagaccgcaacacaggaaaatggataatgttctgaacatacagtcagactacaaaggaagagataacagaacagagcagagcagagcacatttctttttacgcaaagcagagcactttctcacactagttggatgacaattccatttcacttttcaaattacactctttaggaaacaaaactgaaaacatgctgtaagctgtcatttataacctattcttctgcaattttataaacaaacaaaaattttaattggatttatcgactgatggcacgaacttgattcaaagggattcgatgagttcaggcagagatggggtggaaggcgacgacggagtgcttggcgatgtggaggctgaactgcccgcctttctcgctcacgtccagcttctccacgcccggcggcggcaccatctcgaagctcctcaccagcttcccgacgatgagcgccaggatgggcagcgccaggatgatccccgggcagctgcggcggcccacgccgaagggcaggaacctgaagtccaccttcccggcgacggtggcgtccacgccgctctccttctccaagaaccgctcaggccggaactcctcggggttctcccacagcgccgggttgttggccagccaccacgcgttcaccaccaccttggatcccttggggatggtgtacccgccgagcttggcctcctccaggttcatgtgcggcaccagcagcgggatcggggagtgcagccgcagcgtctccttgatcacggcctgcaggtaagtcagcttgtggatgctggactcggtgatgggctcgtcgtcgccgagcacgtcgttgatctcggcgcggaccttgctctgcaccgccgggtggttgacgacctcggccagcgcccactcgatggaccagagcgtcgtctcgatggcggccacgttgatgttctccacgatgtagatcacgttctccgccgtcagctcgccgttcttctccgcctcaaggatatggtcgatcgcgcaccggagcttgttcctgtctcccggagtgtccatcaccttcctgcatttcatatcaagatttttgttgattagacacgaacaaatttaccttgcaatcctcattttttccatgacaagaatggatagggaatgcagtaaagtaagaaaaatggaatgtaccttctcttctcgacgtagttgttgttgaagaaggcgagcctcctgctctggaggtcacggcacttgttgaggtagccccgcaagaagggacggaggatggggatgaagtcgccgtagttgtactcgaagctctgcgcgaggcggctgcgctcggagttgaacctggtggcctcgatgaacatggggtcgtccaccgactcgaaccgcgcgtcgaacatcatccggtacatgatgttgtacagcatgagctgcagcctgcgtcgcaccacgaagccggtgccctgcgccaccgcgtcgccgcgcacgtcgtccacgacggcgtccatctcggcctcccacatggccttgtactgctgcacgacgcgcgccgtgaagaacggcagcgtcatgacgcggcgcatgcgtcgccagtggtcgccgtactcggtgaacaccatgtcggcgccgttggcggtgaagatgtcgaagacgacgttgcgcgggcgggagccgaactccacgccctgcgtgtgcagcacctccgtcgccagcttcgggtccgacaccaccaccaggttgcgcacgcccagccgcagacggaacacgggaccgtaccgtgccgacatcgccgcgaggaaccggtggttcaggtcgttgcccacctgcagccagttgccgaacaccggcacggccgccggccccggcggcgccttcccgtcaccaccgctcccgcccttcgcgcccaccgcaatgccgacaaacacagccactggcagcagcaaggtgagagcaggatgctgcgcctgcacgaacgacttgacgaacaaatgcaccgccaacgacgccccggtggcgatggccaccctcatcgcggaggccgccatgctgctcgaactagacccgctcactggctgtgcgatacgtccctgtgttgtgttttggtggtttgattttagttggtggaattgcaaagcgagctgtggctgctgggtcgggtgccgttggccgtggcgtgcttatatagcgtcaatggattggttggtgtgggtggcagtagcaagtagtagtgagtcagtacgtgggaaacggctcagcacgaagagatgcggcgaatttcgccggtttcgcgcggaaacccgtgtgccacggaaggaaacagggttggcgggccgcgatccatcggctgctcggcctcggcggaatggaggagagacgtggatgcgccgcgcgctcgtgctctctgttgtgctggctggttggtgggcacggccgcatgggcaaattgacaagtcgtatcgtctcgttgggctagtccgccgctctgacctggtcacgggggcaaagcggtggtggggttggtgtggcgcgataggagcgtctggatggccgatggacggccaggatggaggcttagttccggggttgggtttggtggtggtgggaggccagcgacctgtgtgagcttcggtgttggattacaattccctcacattctcattgtgcgttcaaccgttggttgggtcttttttgttttctgagagagagcgtttgttgggattgttgaccactgtcttggagatgagatactgctttaccacgtgattagttcaaagtcatttgaataacctgacgcataagtacatcattgtaacatttaaattcgaacagtttctgtgaaagggttcctcgcggcgatgtctgtgctacagtgatcaaatgcatacaacggtgtgcgattttactgtagttaatatagtactttacttgatgcaaatggggcactttagattagtcctaatgcactgcatgcctaatcgggcactttggatccatttccaacccaggcggccggctagatttcaaggttcaagctattcctatatacgtacagctataatgtgatttgtacgcttattatacgtagaatgtgtaagcttgacttcttcccctctgaaatgatgttgaaatttgttgatctcaaaacaaactaagtagttttcttttaacatcgttctactaaatcatattattgaaatagcgtaaaaaggcatattcataattccatatttacggtttttaccgtccagcaccgtcgcgaggtaccgcgtggtaccaaggtggtaccaaatcgcagccgttggatgtaaacagatctaacggtcaggaatgcacggtaccgcgcggtaccaaatttctcctttgcgcggtaccgcctgaaatcgtagggtggaagggtagcgttgtcttttcacaatatccggatcgatgagtggtgtatcgttgccctaacgaattggtctccatccgcatcgcagagacttgtccgccgctaacccttgtactgcgccgccgcctgctgcactgacctccccgccgtcgtcgcgagccccgcggcttccggctgccgtcgccgcgagccccgtggcttccggctgccgcctcccccagcagtaacctccccgagcgccgaggcttgcggtgctcgcggcgccgccgtcgccccgagcgacagccccccgcgcgcctggtctgctcgcggtcacttagtcgtggaggagcgcgatgcgagggcaaacaggccgtggatactcgcgtcgccgccgtcgacgccgtggccggccccgcgcgcggcaaggagcggtgcatcgctgctgccgggcctatcggcggttggtagagcgctggtggtgggctatcggtgctgccaaatcgccgccgtcgacgccgtcgccggccccgcgcggcaaggagcggtgcatcactgctagcggatctatcggccgttggtagtgcgctcgtggtgggctatcggttttgccaaatcgtgtgtcctcgccgtctcagaccgtggtgggatgtttggaagaaaaaagttgtatcacactggtatgttgtttgaatggaaaatgatggtttatggtttgcaatgaaaaatgcatgattgaatgaagggtcaatatgtttgagtactgcatatatctgaaactgtttgaaagaacgtttacatcactgagttgaccaagataaaaatagagaatttgttatcatcaattataagtacttgacatgttttgctcctgtttgtggcaaatttcttcagattcttccttgtgtagatgcattatgtcttcttggacttgaatcacctcattcatggttgaattgatcaaggtggtggccactttagctctaaaagtagttgtcgtgtgctgaaataataaaacgaggaaaaattagacatgatatacttcttcagcacgtagatcgcatagcagatcttagcagagaatacttgccattgcatcgtactcgggggataggtcttttccattccagtgttcaatgcacttgagcgtaaacaatccacatgaccatctgaaattttcaattatgtttatagtgttacatttagacatcatagtaatttttatttacagatagtagaaatggttacccgtccttctgttgaggcacttgcatcgggcatattggccatttcgtgatgttcgtagaattccatttataagtcttgtgttcatcttgtttggcataacgaagatacttctctattcctttgatctgttatattgcaaagaaatataattagttgtagtgctttcagaagggaagtgtatgaaatgtgttttcattataccgtagtggtaagggttttttctgcatcatagcttgtcctatccatatgcagtgagtccagtatttggattttttcattgacaccatccaggacagctacataccagtgggccgagtttctatttaagggtaggaaaatctacatgcggaatcatgagtaagaaatgcattttcacttatggatataatgtatacgatgtatgtattaccatttcatgctctaaatagctggcagcaactttagatctttgatcacgatatctcttgttgcatgtacctttgtctgtaccattaattttccacagctggcattgtgttgcagtttcaaggagtgcaattccctgtcctcgtggagtgtcggattgcttgtctatgatgatttgtatgtatgcatctatgacctgtccaatagcagtgcatattgtgagtgtttaattattctgttgttggttaaattagaagcaggagatagcagtgcttacagtgccgttcaaccactttgctttggatggagcctgttttggtaggataagtggtttcagatgctgtcgaaaaatcttgattcctgcaattgttgatagcaattttttgtcttcactcttagagatgtaactcaaggttacttcatccagcaggcttagatcatgtggtttcggttccctactagatttaactggctttggaaatgtttttttgtagtagatgaaatcagtttgtgacttgtgtgttggcttgataatccttccctccggtcgtctaagccttccgccaattgttgataactgctgcaatgtacaagcaattagcataatggtcagtgtagcatttgtaatgtagatgtaggtctattatttgaaaaaccagtgttggattttgctggctattgtcatcgctttcgattatgtgtggagaagtagctgttccatttggttgactatcgtagttctgttaagatgcaacaagattagttagtcatttgtaatgctcattggaatatactattttgcttgcaaccttacctttgaatcatcaactaggtcttgtcggcaatctgccctggaatcaattactgtctcttcttgtttggctgctggtttaaatttacggaaagttcgtgaccttgaagttgtacccaacctgtactttattgcctatgcatgttcgaaatcataaatagtacaagtacaatatcattaacttagtacctgaatttgttatgagtacaataactgttaaaattggttctgtacctgaatatctcttctattttgaatgcaagtattctctattgagattagttttgtggatatcttgttgtccagaaactgacaaccttgttgaatctgcatgagttgtgtcataattgcatcgaaattggctgattgatgtgcctacaacagagagatttaataaatgtttgaggtgagtagtttaaacttcatacagtgggtattacctcaggatctttgtaattttcaggacttgatgccttcaacagagagatttaataaaggtttgagttgaactgtttaaacttcatacattggctattacctctggatatttgaaattttcaggacttgatggaacattaacatcgtcttctatgtaaacatggtgtggactctcatcatcatcgcctcttccatgtgagttgaatccgtttgcagccgttctttctttagttgctttgaacatataatccggttcttcattggtgggagtgtcgtctttgatgaaatcaccattattgttttcggcagtggcgccttgacagtcttctgacacattgtcccctttgatctcttcaggctcaggtacgatgtgtatgacatccacagtgttatcttccatgaaaccatcaatttttttttcgtcaatttggccttcacattgtactgggacaatgtcccctttgatctcttcaggatcatctatgacaaccacaacctgtaatgtaatatgaatagtatataatagtaggtaattaacatgttaaaactaatatttaatgttgcaaagagttgtaacttacagtccctgtttcaagaatacatttcttgtcgtactttagccatgtcattacattcatttcattccaataggccattagcggcggtggccttccaacgtatgtcagtgtgcacattggatcgttaatgtgtacatgttcccatgcccaaaactgaaaaaaaaagagagcaagaatcactgaatgtggattgcaaatggagacgtgtaatggatactttcatacctgaagcaatggtacattcccttctagatttctccttcctcccttcaattcattcagacaattgattaagtaatctcttgtgattctagcccagttgatgttcttaatgttgtcaatgtctttcaaaagggctaggtactgagaactaactattggcttggtggtggggcataggatgtacccaatggtgaatagtacaaatcttctaagaaagtgctcatctgggtgttttgcactattgatttgtcttgccaactcatgtagggaaatgttcttccccttatgttgcttgtacattgaataatatttgtagtcttctccattcatgtgaggctttggcttgataatcataccatccgcaggcaaccccatgatacacttcacatcatgggttgttattggtattgctgttccttggatgttaattgtttcagttttactgtcatatctctcagcaatttgcccaatcagtttgcggtgaagggtgatatctggcagggcaagcatccggccaaatccaatcctctcaatttgtgatatcttactcttgtcaaaattagcaactacagcgagaaatctttgtattgaacatgcaatagtcatgtctttcataatgacaggctatgaagttcatgaaaaatagaacagcttcagaagtatggaaacataaggccaataaacaaaaaatgaccgaagctaaccttatgctcagtgaccagtgcttcagttgtgatttcatcaaagcgcggctggaccgaaggttcaaactgtgcttcatttctgacttcgtcgtcttccatttctctggcgatgttgatgcgataagagatcagactgtactttctttgtaaataatctgtaatttatatggggattaggagtgaaagtatgccatcagtcagctatttgttacgcagtaattttcatctcttcgtttactgtgctgacagcaataaatatgtgcattcatatgatgttctgaccaaggactaaatgctattcccaatgcacaacagtacagtgacgcataggtactactgcacgcatggttagatgatggtcatctggttggtgtgtgaatgcaatcgacacgacaaacgatgagccctccatcca

SEQ ID NO: 81652 - DNA, 1025 bp, Oryza sativa
cgcccattaggattacccggtttaacgtgccacggcaacgaaagtcatatcggttttaatatagttagagcgattgatcgatatatacttcccgtttaggttgatggttacgaaatacgaaattcggctaatagttgagggggttacattggactttgtttcattccagcctaacaagaactgtagaatgaaaaccttggcccaacccaaacacaaatagtcttgcgcaagactgtgattattattagtttgttatctatctatctatctatctatctatctatctatctatctatctatctatctatctatctatctatctatctatctatctatctattattattattattattattattattattattattattattattattattattattattattattattattattattattattattattattattattattattatatactaaaagtccatgaaacttactacaaacgctctcaagccgccacatgatgctcctaaaaacactcgtaagtcgtaaaaacactcctaagtcgccacatggtactttaaaaatcatagaaaatctaagaaaaaaacaaaatatctagccattgattttcatttaatctggtgggaccattatttttaaccattagatctatcttctaaattaacaatctaatttatattatatctccaaagatctacatcgttccatatttgtacgtgagtacgtgcatttgtatcccgaaacccacacccgaccaaaaaaaattgtacgtgtacttctctttcctttttttttatttctcacttagtcgaaaaaccaatctaataatcagcacatcttaactataatttaagttgtaaaaataaaaatatatgttatttcaagttatgttcaaataaaaaatatatctcatgaaaacatccatgaaaaatataaataaattaaaattataaatatattacttaacaacatgtataattattatatactacaagtccattaatcttcctacaaacgctctcaagccat

SEQ ID NO: 81653 - DNA, 7608 bp, Oryza sativa
gcggaccagccgcagcgctcacccgctgctcgcccattgccgctggcctcactcactgaagaagagagagaagagataaaagagaagagaaggagaagaaaagaaaagaaaaagattatgtaactgatatgtgggccctaagtacttttttaattttttttttctgactagtatgccaccactactgcacaagttatctttacctccggttcgtaactgcctgttctcccggttatacaaccgggagtccaaatccgggactaaagatatatctttagtcccggataaaataaccgggataaaagttgatctttagtcccggttgataacaccaatcgagactaaaggggaggaaagcggcagcctggttgccatttttttattgtttctttgctagatgcgtttttcattctattttcccccaaatcggatgggatcgatgcatatccccccataatcaaatcccaaatccccaaatcaaaatataacatctcaaatcatatatacattcacatcacagatccaaaaaaaataccacaaataaaatacatcttagatacatacaacaaatcacaaattctaaaaaaaattacacatctcaatggaatcacaaattgcaaaaaaaaaaacaaaaaaaacgaatcgaccaccagccaccagctcgccgccgggcgggcccgcctactaccgctggttgcggccccgccggcccctgccgccgccgccgccctccgcagccaatgccgctcggccacaccggtgcccgccgccagccgccaccgctcgacccgccgccgctgccgccgcttgggcacgccggcgcccgccgccgccgctcgatttgcatgcaacgagagaaggcaggaagggagaggatgaggctagaaggaaggagaggataaggcaaagaaaagaataagagagtaaaaatagaagaggagtttgagaggataagtcataggggttatatacggtacattgaaatttagtcccggtttgtgttaccaaccgggactaaaggtcccggggatatttagtcccggttggtaatataaaccgggactaaatataagatctttagtcccggttggagtctccaaccgggaataaagatccggggggggggggctgacagcacctgacaacacatgaaccgggactaaagatgatgtttagtcccggttggtgttaccatccgggactaaaaaacatatagtcccattctgcttataaaccgggactaaaaaccatctttagtcccggtttttattggaaccgggactattgtgatttttggctgaccaggcaaagatggtttctccagtagtgcacgtcagcgaaaccacccacatatactaccatgggatcttttttgaatgttttgtgtgaggttaggggtatacattttttgttttgtggttaagggacctcaaaaaatctcgttgttaagttgagggacctccggtgaacttattccattctatgctgggagatgcgaatcacattgggcccaatatgatgcattcagcactaaaacatttttatttagggcaaaacgtacttgctttaattggtagtgttatcatctctgctgtcggatgatgaagcaccaggtcgagcaatcaatcatcattgcgtcaggatcttgagttcttgtcgattttgggtgcacgctctagctcctgattaagtcaatcttgtggactgattttagattaattttaggggttctctttgtcagtttctgtgctaagctctccttttatgattgcttggaagataaataaaacaggatgactaaaccaaacttttaaattttggattgttttgggatatagtactaaaaaagaacgcctaccacttgagtgataattgaactgagtaattaaaagcacgtgagctgtgtgctacaccctggtatacttggcctcaaaaaatccacatttcacatttcagcagtccaaaatggaaagccaggaaagggacagaaaacagcggtaaaaatggcggccgccacttggctgccctcgctagcggcgagaacgctccgctcttctggcttttatacccagccctttctaatgaactagacgacgaacttcgttcggtgaaaagtcagtacaacatatgcaactagttatccgaagatgcaagaagccatgaactatatatggacggccgggatggtccagaatgtgcgtggtcagagcttgtgtttaaccatgaatggctgagaaagttactccctccatctcattttaaacgcagccataagtttccgtgtattgcatgtcttatttaaaatttttataagattggtatttttattgttattaaatgataaaacatgaatagtattttatgtatgacttttgttttttaattaatttttaaaaagttttcagatcagataaatgattaaagttggacacgaaaattcatggttgcgtttaaaatgggacggagggagtatgtctactgatgaaccgaatttacttttttttaagcaccacaccatttttattctttttaactttatacacctaaattttatacaaccaaaatttatacactaaaattttatatgcctcatttgatttcggattcaaatatagagtacttatattaaaaagtttatatacatgtataaggtctataatacgttcacatggaaagaaatatatacacggacatttttttagtaaagtggataatttttatttagtttgtatttcttttcctattttagaactttttgtgaaatcaatacgtgagaaatgcgcgggttgtttcagcaagggggaggggcgtgccgtgaccccacacgtggttggtcacccattagatgtacctaggaatggttgaggtattgacgtctactatcatcgaaattctgattaatttcaccattaatttattttatcaaaataagtttatcagataaggcaaaacatttttaggaccaatgtatgcatacattattttgttttcaaacgaagaattttaaattttattgatggtcaaagatgcgaaagtttgactaaaaaaataaatgatatactatatttgtagcccgaggagttataaatttggttgaaacccgaaagctgtggggtttccaatatatcataaatataacaaaggcgtagctagcgaaaacactatgattttaattaatctacaggaattttttgctatattgtactcttagggagtgtttgaggagaaggggattgaggagattgggaagatacgcaaaacgaggtgagccattagctcatgattaattgagtattaactattttaaattttaaaaatggattaatatgattttttaaagcaacttttatatagaaattttttgcaaaaaacgcaccgtttagtagtttgaaaagcgtgcgcgcgaaaaacgagagccaatctcccctatcacccctaaacgaacgatgccttagcccttcctaaccagctagatgggttacacgcgagattcaacacaaaaaaattcacacatgagactcaaattgattcgagtctatatctgatatctctatctctacttgaattcgtttggttttatttttcatactacgtaccaaattagttgttgactatctagctaagttgaaaatccaatcaaataggagtatatcacttctcgatctaatagatgatggttttggttgacatgcagtacgtgtgttaagtgttaactggtaagctcatgttgtagcaagtgcacgaggctcgcagaatttccaatacaaagacaaaaacacattatgatacatatgctccctgtttttttggtcaaagaatatgttgcatatggtagcatatctccacaagggttgcaaggtggtaagccggccatccgcattacctcaatatatcagatttatccggttaaagcaccgtagtatttactagcagtcattttcttttgtacatatatatcgtgcttaagtgaaatgcttgcaaagagaatatacaaaggactacctagcaaatattcgacagtaaatagcactgatttttttaataaaataatacaatcataatataattacattgcaactagcatgttttattataaattaaaaatgaatccagcatacagtactacaaacgtgatgggtaacatatgcatgcttccgatcgatcgagagcgtcgaaagaacatggttcgttagagtgaactcgctagtttttagagccgaacattttaaaattcgagcaagctgcaaacatagagctacagagattacatgagatcttacaatctttcaccccgagagacgaaccagacaaacgaagaaatgagaaaggctcaacgttaagtttaacaactaaacagatatatgatgctaattaagctacctcccggagctgtctctccactatgggatgctatctggaaatgcagagccccactgaaagtgaagttgtttgcgtggctcctggtcgaagacagtctgtccacaaagaaaaatttacagaagaagaacattgttcccactggcacctgtgacatctataacgaaggaaccgaaacgaccagccacttttgttttctatgcccgtttgcaaaaagtttccgggacaaaattggagtgcaaccgatgattcaagatgtgcatctgtttcattagctgaagctagtacatggagtgcctatacttcattttcagattttctacctcctatgtttctgggcaatgtggaatcacagatatgatgttgtttttagaggtcaagccccctcgattgcttcctggctgcaacgttgcatgcgtgaggctgctctgtggacagaaaacataaagactgaagatcgacatgtaatttctgtttggaaagaaatcttatcttccccctacaaactctcaattcaatataatgaaccttgcatccttatattcaatgaaatgataaattcgggtggggaagctctccccccgtgatttagtaaaacaagaaagaatcgagcgcaattcgccgtgtccgtaaaagaattaatcatcaaagatttaatcaatcttacaatagctagtctttataaaaaaatcaaagaataaacagacaccgtggcctgtggggtggataattgatggatcgacgccgcgccatcggcagggtctcatctcacgagtcatgccgtctggccgccggcggcgcccctccgcagcgcgcactcgacgactcgccggaaatgcccggcgtcgcagggcacacgcagcacgcccggctggccgaacccgtactgctgcgccgccatgtccagcagctccgcgatgctcgggtccccgagcagcctcaccggcaccatcacgcgctccccgccgccgtcgccgcagtcgccgccgccgccggcgaccatcgggacatgccctctcgggacctcatcctcgccgttctcgcggcacggcgaggcgccgccgctgccgccgccgctcttcctcctccacaccatgatgatatgtgatagatagtatatatgtcaggtttagcaccctggatcggagctggaggacggtgcgggggtgcagtcgtttgattcgccggcgtgcgctgcggaggagacgagagcgagtaggtgggaaatttatagaggagcaagctagcaagcagcgcaggatcaaggaagctagggttcatgaccatgcatgacgatgactgacgtctgaagattgacgaaacgaacttgtgtgtagacgatcaagccgcgattccttgacatggatggtcttccatggcgactggagagatggagactagcgtggagcaccggaacccgcgcgccgcccaccgcgcgcgcgggaagcatcggggacgttcgatctgcgcgcgctggacggacggacgtactgttcgctccataactagctcaacacgtactattgattgaccgattctgctaggaatatgctttattaatacggatttctcttttttaaaccaaagacaaatggagacgctcgcaacatatgcacactcactcatataaacatacatggtcgacagaacaaatgcaaccggtggacaggtctgagtgcaagcactccaaacgtaggttatggatggatgggagtagaacgtcgaagaatcatgtcactcaatccagctgcttcatgaggcctcttgtatagaaaatagactaaaatttcaacatcggaaaaagaattggttaagttgcataaaccaccccacctatcactctagttttgagattacaccacataaattattttgtcataaaaacccaccaatccaagactgtttacgaccagattgtgtcctctatgtgcacagaagtagttgattcggtccatttcttccaatataggatcgctgccgatcactgcctctgatcgcttcccacttcgaactagcatttgaggtcaggtgggtacagccagctctttgtgatgttcttaatctcgttcttgatgtggaattgtgaaactgtgtagctgcatgttcttgtttttagaaaactatgtcatcttgatgtggattatatgtgtaaacttcattcttgtgacttgttggatgtcaaggatatattcttgatatgtggttgatgagtcacgttggacttgatttttttatgaacatgttcatgatctgtgttgattaggggatctccagatatttgaggtcaggtgaccgctcgttgaatcggctcgatgaatcaatggattcatcctgtcgactaatttatttgtctcatggaaaccatcagtgtcgaaaagcttaatgttggttcaatttccagcactaataaggggttacgaattggcatagaaattgtgctctgttacaaatccagcactcataaccatgctggatgagtgatatggtccactgtaaatccacatcaaaacaaatgaacagaattagcaccggtggagaactggtttttactcccggtttgtaacccctatataatcccggttttccaaccgggactacgaatccgggactaaagatcgctatctttagtcccgggtgaaatatccgggagtaaaaatccatttttagtcccggtaaaacatttttagtcacggttaatgttaccaaccgggactaaagaggctagattcggttgcttctttattcttttcttttcttcattgtttttaatatattgatttcaccccatcccgtccctaaaatcccaaatcaatcattctcaaattgcctccaaatccacaaatcgatcatctcaaatacatcacaaaatcttaaaaaaaaattacatcacaacttctacaaaattcatcacatattcacatcacacacaaatcaaatacatcacacaccaatcccagatccgaatcacaagtttcccaaaaaaaacaagaaagaaagaaaccgccggcgcaggccgccaccaaccgccgccatgccggtcggccggcccaccgcgccccaccaccgctcggccgccagttgccgccgcgccggctggccggcccttcgcgccccgccgatgcagtagaaaggagaagaagaggaatagataaggttgaggagaggagtagatacctcgatccgatcgcgcacgcctctccgatctccgtgtcgatctttttttccggttgg

SEQ ID NO: 81654 - DNA, 1425 bp, Oryza sativa
tgaatttaaattccaatattagtttatagacccaaagtttataggtccaaagtttacatacccgtttctaatttgaatttaaatttaaacttaaatattagtttatagacccaaagtttacatacccgtttcaaatttgaatttgaattcaaatatatatggtgtagtagcaagagaagatggagagataaaatagtaagggggaggggcgggtgatcgctaggaaggggagagagcgatcacccgcccattaggattacccggtttaacgtgccacggcaacgaaagtcatatcggttttaatatagttagagcgattgatcgatatatacttcccgtttaggttgatggttacgaaatacgaaattcggctaatagttgagggggttacattggactttgtttcattccagcctaacaagaactgtagaatgaaaaccttggcccaacccaaacacaaatagtcttgcgcaagactgtgattattattagtttgttatctatctatctatctatctatctatctatctatctatctatctatctatctatctatctatctatctatctatctatctatctattattattattattattattattattattattattattattattattattattattattattattattattattattattattattattattattattattattattattattatatactaaaagtccatgaaacttactacaaacgctctcaagccgccacatgatgctcctaaaaacactcctaagtcgtaaaaacactcctaagtcgccacatggtactttaaaaatcatagaaaatctaagaaaaaaacaaaatatctagccattgattttcatttaatctggtgggaccattatttttaaccattagatctatcttctaaattaacaatctaatttatattatatctccaaagatctacatcgttccatatttgtacgtgagtacgtgcatttgtatcccgaaacccacacccgaccaaaaaaaattgtacgtgtacttctctttcctttttttttatttctcacttagtcgaaaaaccaatctaataatcagcacatcttaactataatttaagttgtaaaaataaaaatatatgttatttcaagttatgttcaaataaaaaatatatctcatgaaaacatccatgaaaaatataaataaattaaaattataaatatattacttaacaacatgtataattattatatactaaaagtccattaatcttcctacaaacgctctcaagccatcatgtggcactttaaaaatcatagaaaatctaagaaaaaaacaaaacatctagccattgattttcatttaatctggtgggaccattatttttaaccattagatctatcttctaaattaacaatcaaatttatattactaggtgaaac

SEQ ID NO: 81655 - DNA, 24079 bp, Oryza sativa
taaactctacagctacagccttccaatagtattctgccttcttatcattaccatttataggatccactgaattattcagccaagagctaaggagtcttatgttttcctcttcagtccagttgactcgtgttcctctcctccctgcctcttgactgttgtcacttgactcttcgatatcaaccacattgttctcttcatatcttgcagggcactgagaggctgattctgatccgtgggaagaagcagacccagtaatttgattaggtgagtacacccaattttccggaggacgaaaaccttgaaaactcactggtgtagagtgtaaccaatgtgcttgctgctgaaaaccgtggaagcttggagtagaattgccatatggttgatagttgtttggagccccaaaaggatggaagttctgaaaagtgggtgttgaggattgagaaaactgggattgggagaatattgaggggaactgtggagaagtggagttttggctaccatttccagaagtttggctttgggagccctagctaagcatgtgcataaaacctctgttgggaggatccatcttatttgatgaaatacagaaaatgactgagttgtgtttgtatttgtagagggatgaggttgtagcgttgttgcaacaagttacaattgctacaaatgtaacggctaactgctactctattattttagtgcaactctctaaaatcactgtacacatgctatattttatttgtctcttgccggcagtaacactactgcctgattcttgctgttatctgcccccacaatggctattacctggttggacgagtgcatttattgtttattacctgctttttaagcacattgtggttgcccttatcgagcggcgcctcccccactcctttttctccgcgtctgccgcccactccgcccacactccgtcgcgcatcgccctgccgccgacgaccgtcgccatcgcgccctgccaccggcgaccgccctgccccgcctgcagcggaatccatgcctcctccgtccgtcgccccacaccccccaacccacggcgccactttcctcgacgccaccgcctccgtccaacactccaactgccacgcgacgccgccgccttctccctctccttcgtggtccatcccatcacggcgattccccgcctcctcgccgccgtcgccgctcccactccccatacccccaccccagtttcctcgacgccaccgcagcgcatagccaacggggccgttctgtccctgctccccagggacgacggtggcgccgccgccgaccgcaaggcgccggatgtcaaggacgcagcctcaaggtcagcctgctcggcgattgctagatcggcaagacctgtttcatggtaaattctcccatctcctcctcctcctcttcttcttcttccaatccattccaatctcttgccatgtcgctttactgcctcgttaactccatcttgataagctttcccactgttatgttggtttcttgtacatgctatttcaagttttcaaccaagaagcaatccgaccctgaaacatgagtcagcaatccaacaaaaaaaaatcattttgaggttcagatttcggaaaactgctacttaatcatttttcattaaagattttgagcttctttccataggccatgcacacgaattttttttagcttgatgacatctacaactaattaagaatacctatgtgaaaacgacaagagagcccaaatcaaacctgaatcgagcacagcatgctaccgataagtttgtgcagaccgtgctgacctgatatcacccctacatcacagctaacagaaaaacaactcctcatgctattgggagagcctcatgcttgaaaatgtagttgcgtttcttttcagccacaatgaatagcaggttactgaaaagttcagatgagttcttcagtactcgaaatttaatgggaagtcaagtttaacccggtttaattctgacgaagaacttgacaacaaaaaaaaaacagatgcctgcatttggtgattcatacagataggctgtcatattgctgatttcacctggaaggagatctccttgccacctcaattaattgcacgttcatttggaggcttaattgtgcagcgatatatatcttgtttgcaaggtgtgtcttctcaatggtcaaacaaattcctgtcacttgttggttaaatatggttattctttatgttcttaacatttttcagtttctccataactgaatttgcatcatcaagaacaagtttcaatcattatatatgtgctgaaattccaaaggtttcttgtttacttaaattagacagaaaaagttgtgaattattcttcgaattcctgacaatgattccaaaggttgggattttttttcttttgttttgttttatgtaagcttagtagaaattgttcgatctgatcggggtatttcggtgctcttaagtttgtttgaatttaccctgtattactgtactgtgcttacattttagatcttatcaatcctgtatttctcctgttggatattctgaattacctaacctgagctcttattaaagccaagccaagtttctggaatgactgccagtctgtcagtcaccaagatatatcttcagatttaccaatacccaaatagaggaaaagttcttttgccactgaaaacagggaaaagtatttcaagtagtatggattaagcctcttgcagggcatttgttcggcagaactcactgcaatatataaagctgtaatcttgaggtgttatagccctaacgaaatattcagggcactgctattatttcaccaagtagaataaagtaaaaaaatattttattatgctattgtgctgcaaattgcaggaagataagctcttttggtgcaaccaattatttttcagcaaacaatgatccttctctaaagttttggttataagctagaactgaatgagttgagaggttcttgtctgttcttgctttcaattgcatctttcggtagataggaatgcatgatttgtaaccctttcagcatatgcttttcgccatgtgtttctcttgacttctgtactccaacatatattgaaaaaacaatatattttgatgactagagtctgtcatctgtatgaaattggaatgcactagaagtgtggtcctcgatttcgccttatggtttgtactggactgcactgaaaattttgaacttgtgcattacagggttccaatggatagcaattttggggcctctagaccaacatcgctgacaagatcaggttagttattcatataatataatataatataggtttatatcttaagctgtaccatatttggtttatttgatctgataaaggatgaaatagagatgggtgcctcaaaaataactttaatggcctcaatagttcaagacatttagacatgtttttcttaattatgattaattatttcacatgcagagcaaccgatgttgttgatagtaatcttaaatgagatggagtagggtgcaatcctaccagctgcacttagactgccctggtgaatgcattttgcaagggaaagtcagtatgagaagactgaagaagtgtttgaagaatgcaacaggctagccacgagaccgaagtgtatgcttatgatgtcctcatggaagataaatggtggtcatcataaatccatggctacacgagcctacgttcctaccgacatctggatggaattttttacttttctttaagtttggagtaatatacattgtatatatcaatgcaccacagccatacaggattgctgcaaggcgcttgagggatctctccttgatgcagcatttggtgaggggtgattgtgacagagcttcatataacatcttggtggatgcatatgaaggtacagatggtggtagataatttgccaattttgtgataaaggaaccaagaacttgagtgccatggtgccactttctaaaactgaaagcttttgaatttgctgctaattttcagattcagaagcaacattcaagcaactgaagcagcaggtgatgacattctcgatgaagacattcttacttctgttgttggcgcgtgcaggtctggcaacgtggtgaggatcaagtggaggtgatggcatggctgcacaaatccggcatgtcataactattgataatgctatgcatatggccacctttatgaaagcttttgattatcttgattatggattatatgcagttgtccaaatatgtacctgctatatttgaatatacggcatgagtgcataatgactagacccccccccccccaaaaaaaaaaaaagtgatgacttgtttggttggccagatatttatgaataattttgttgtttggggataatcagatattagagtaatcataagctgtccgttgctataattggtcccaaagaggacctatgagtctacatccatggcatatttgttcttttggaatttatatcttgtaattgttgatcgacatcctgggagacgtcggagtaacttttttctattcaaatataatattgccttctagcttacttacagtaatgcagacacgtttatatattttcaagttacaccatatcatattacttattcaagatccgtagcaacgcacgggcacccgactagttaaacacaaatttccgtagattgtttacttgaggcaatagtatgacaaggaagaacacttagtgactaatggttgataaggaattccagtgcagatgaatgtactcaaggagccaaattcgacaatattggtatggttcaacaccaataccaagaaaaaagaatgtgtaaatttctgacttatctacatcatgtaatacaatgacttctgaagcagccaacttgcatataattctagatttttcttatcacaacttgtcacagctataactttttagcagctaacttgtcacaactaattttttttggcaactatcgaattaatcaaatactcatggaatttatttggaaacttaatttttgaattttatatgtttgtgtgcaaaagtaatgaaatactatctcaatccacttataaaccattttgctgctagtttgaaacccatttgttgtcatatgcattttgaaatgagtataacatgatatatgaaattcaattgtgcatgtacttcctccgtttcacaattttacaatgtaagtcattctaacatttttcacattcgtattgacggaggggtaattgtttatcattaatgaatttgagccatcaacacatttttctgttgtacaactataatatttattgcttaaaatctttctatgtttgtaggacatgttctttttacagtgaccttaaatgaaatctgcatactaaaaaaattgcaaatacataagtggctttaaacaccccgttttagaacttgttgatcttttttagtccaaacttactatttcagatttagatcttcaagttttttagacataattacatcattaaaaaaataataaataggcgtgtactgattccactttagcagctaggacatgcatgtgctcaacttctcagagttagctgaagacctggtatctgcacatcatacaatgaacactgtcaggagcgagaagttatactcaccattgtagtcaatgttgacttccccaatcgtgcagtttttgggacctttaatctttcccctggcaatcttcaccacagggggacaagaagaactggatcgagccatgctaccgaattagatccctgctattgatggagcgagcccagatcaatgggaagaggcggtgctgttggggatgaggggaaagaagagggggcgtggctagggccgaattttttttatctgaacacatgcaaaccactaattgtaggatcgaatcataagaactaagccaaccagagagggggtgaatggttgatatacctcaaaaccaaaacttttagcggaaataaaagttaccctcaaatcgatggatcgcggtctgaccgaagtagatgcaccggtctgaccgcctgaagaacgtcggtctgaccgatgtagatcgatcggtcgaaccgccgaagtcgctcgtcgcgcctgtcgccgccgtcggtcggaccgcccttacgccgccggtctgaccgccgccttgccgccggtctgaccgccggtgagtcatcggttagaccgttgaaacctggtgaaacacaaatcgaagaactctcaaagttgatgacaactttattgcttctctttgtgtttacaaagtgcaacaatagcactccttacaaaaatctcgactaaactcaaaaccctagctaaactagcaactcaatcgctctccaaagcgatacaaaagcgataccggtaagcctcacgctccccctctatttatacatgaggtaggcagcctaaagccacgaaccaaactcatactaagagttctaaacaccttagaaaaccctctagtacaagacacaaacttaacataaccaatcgtaccaaatttggactccttccaaatttgactccgcatcccatatacacacaatacctccatcgtatgccatatggaatctccatcaaccacgtgcatcaactctagccttagtatcccgcatgatatctgaccaccacggacatcgtcttaccaccaaaccgactcccagtccatcaccgcaaatactctcccgaggcattgagtcacctacacatgaagcaaataaagaaaccatattccgagaccaagctatccccaacttgactcattgttagcaaacaacggtattacatacgtatagtatccatctagaagccataaccatgaaacaagcacggatatccaaagaaacaacccgaaaccgaaaccgacacagcgtcggccggtcagaccgcgggccgggccggtctgaccgcacacatagcgccggtctgaccggcaacctccgcccagtctgaccggtcccgacaaaacaacaaaccttgttcatcacctgtccaaaaccacttcgacgataatctccaaatatcaaaaccaataatcacatatgccaattgttcatcacataataagaatcaaaacacacgttgatcttacactaattacaaatgtgagcacgtaaaagttggaattctaggtctaaacaacctgcccacgtcaccaccgtaaatccagttgacctagtgctgtactgtccatgatatgggctcctcatttcttatcctgttagctttggctcagtgccatgacggtagcctcgacacgatgatggtgtgtgtatgtataaaccatctaatataacctttgacagtgacagtgttagcgtggccatagtgcaactaaaattcttctattctgagcacattgtgatcgactaatcaaacttgctagcatggagcaaacaattgatccactaatatgaatcgctagtattgaaaatttagtagtataataccctaattaaaccctatgattttcatactaccggatgaattagatttgaacaatggagaaaactccccgtaatgatgcaactaaccaattttagaggtgggttgttaggctaacatgattagttcaacggccagtttgttgggctactgattagagggaaacatatcgctgtatatgagcatcttgcctaaataattaaatgtaattgttgtgtgctcacatttgtaattagtggtttgcatgtgtttagataaaaaaaattcggtggctagggggaggcagaggtggaagcggagaagggatggtgagaaggagcgacgggaatgggaggaggcgtcgccgcgacggttgcggcgaggaggagaggaggggaggcggtaaatgcggcaccacaacgcacgggagggaggggaaaaataaaaatgtgcataggcgggaggaccggaagttgagagaagtatctggaagagcattttttttgaaagatttcctgatctgatctaacgctccttgtttaccccatggttgtatcggacggtcgtatgttttcggatgacatggcccaatcacagttcgagaccagcgacaactttataatctccctaacatctcatattacaatcgtacccttatttgtaatattttgttcatacatccacgattccatcatcgtgccacatgctactccgattcaattttattatgacaaactattaaaacattttttttaagacaaggaatggaaatgtgcacactattgctgcaacaaagcaaaaatttgcttccacccttgtggataaagtctcttaccgactcctgccttggaagggacgacttaccactctagctggctattctatgttagtccagtcggttctctcttccatcccggtccatgtatctatgacgattagccttccagtctgggttattaaggccgttgacaagaaacatgacgtcttcttgtggatgggtatggactcggctcattgggggagggggggcagtgtcgggtgtcctggacgaacgtctgtcgtcccgaaacctacgatgggttggggattcctgacctcaggttggcaggatttgccatgcgtgttcgctggctctggcttcagtgctcagggcacccctactggcagggacgaagctagcatcaaaacaaggggggtgcactaccattgagaatctagaaaatttcactacaacactgtacattctagtgttttttagtgagaaattaggaatttggggggagggggggtccctctccaccccccaacataatatagcttcgccacttcctactaggatggcctgaaggccccagttgagcaatccgtctctgacatgttcgcggcatctactttcatcatgctgggaaatggtgagtttatgctcttctgatctaaccaatggatcgacgaccgctcgatggcatccttggttccagatctcttcttcgccgttccctagcatctccgaggtttgagcacggttgcttctggcctggtgaacaacttgtgggtctctgacatccacggtgacctcactgtcctggtcatctcctagtttctccttatttgggatgcggtgcttcacgtacagcactcgccgggtgtcgaggattgtctcgtttggcgttggatgtctgaccagcggtaagcgcgttgggtgtactaggctttcttctatggccagcattactttgcctgtgctaatcatttttggtacgcaaagggtcttgctaaatgtaggttcttcctttggtttacattccagcaatgccgctggacggctgatctcctccagaagcatggcatcgtagtcactcggcctaccccttttgtgctcaggatcttgagacgacaaaccacatcctcctcgactgcgtgtttgctcggcaggtctagctccgtgtgcagctggttctaggaccggtggctgtcctccagggcctgcttacgtgagcatctccgcgccggctttgactctctggtgctcctggtttcttggcagctgtggaaggaatggaattatagggttttcgactctgctttctctacagtctcagtggttctggagtccatccactcggaatgccatctgtggtctttagctggcgttgttgccgcttttgggatctgttgggagtgtagcatggctcggccccttctcgctgcttggagtttgtgtttagccaccgtagttttctaagcttcagctttttattttgccttttctcccttcgcttggcataagccggtctagctgattgcgttatgtaactataactcttttcttctaatatattgacgtgcaatccttctacgcgttaaaaaaaaaagtttgcttccaacactcttagcaacggggaacatcttaatatgggcactagatttgatttcactcgtgttctggatatctcaaactaattgtacttaaattattgctaattaagtaattgactggtataaagctcacataatctcgatatgaaccgaatccagagccagaagttatgatcgtttcagcagcagatgagggctactctacacccttaatttcgtttggtcagacaaaattaagtactctatgttactagtaatatttgcaaaattctgttccgaaatgatttcttagcttaagagatggtgtttttcttttctctgagataatactgttctctccagatatgaatgaattctggacttcagtttatccaatgtctgaaatagcgctgctctgttctgttgcgtgttcaatgtgattccattattgcagcaagatttgaagaaccatgaaagccaagtatgctggatgtttacagtagccactccactacccaagggacagaaatatgaaaaccgttgcataaaaaaaaaaggtttgcattcatcacaaaattatataaactcacaggtttgcaacggggaaacaattacaatactcacgagcaaatgagtatcacagattaatgatactttgagtggtgttagttaaagctcacctgacagcacatagcaaagtcgagtaacaacaagttgatgttaaaaaactactagctggatatgaaatttcgcacatgtatatcgactggcacattgatatagacgcactttgcactagagaatcgagctgtgctagtgcataaaagcatgcaaaaagaatgataagttcaattaaaaaaaaagcaaaagaggatgataggttacttctcagttgtatcccttcaaagttcttttttacagagaatatttaagttaaaagtttgatgcacgcgttgatgactcggatcttcacatgaacatttaacgaatacaatctgttaaatttctcaccatttaaggtaaagggctggatgttgccactaaccttgattacttggatcactagattagactgaacatgtactaataatcttctaaacacacaccgtcctttgaggtttagcttgcacttgtagcatttgcttggcttcattgattattgtttacaaagtataaaatgcacacatgttcaaacgctgggtcgggccgggccgagctgacgggccaacaccgagcctcggagtgctagctaggcctgagctcggccagactccaattctcttagaccgatacccagcccaggctcgagcttgcgggcctccatgtccaggcccgagcccgggcccagctgctcaggaacaggtcttgtgccacggagcatctcaaggaagaaatccgtgagggccgcctcgtagcccggcatcttggcgtagcccgggaagtagttgatgtcgatgatgaagtacctgtcgccgtgctcctcgctcctctcccggatcatgtcgaagttgaacaggtgcaggcccagccctcgccggagcccgcgcgccacctcgtccacgaagccggcggccggcgtgtcgtcgtcggcggcgccgccgtcgtcatcaggtggggggagcggctggttggagatgttggcgaaggggacggagggctcggcgtccaggtcgaggaggcggcgggccggcacgtcggggaggctgctccggcgcacgcaggtggcgcggtcgccgacgacgtagaccttgaagagcaccccgccgtggttgacgaactcctggaggacgagcggcgcgcggaggagggggaggacgccgtcgcggcggtagacgaggcgcatgtcgtgcgactcggcgctgccgtcgacggcgagcggcttggcgatgagcgggaagcggagcgcggcgcgggcgaggagctcgtccgcgtcggcggcggcgtcgctgacgacgacctggggcgggacggagacgggggtgcggaggccggagacgacgtcgagcatggtggcgcggtcgaggaggcggtcgatggcgccgggggagtcgacgacgacggtcaccccggggtggcgcgcggcgagctcctccagctgggcgcgccacccgcggtcgtacatcttgtgcacgaggaggtcgaacgggccctgctcggcgagcggccgcgacacgtcgacggcgacgaggcgcaccccgcggtcggcggccagcgccaccagcgacggccgcacgacgctgctcaccttctccggcagcagcgcgtagccaacggtgtagcgaggtgacgacgacggggaggacagctcgggcgccatggccgcgcgaatcgatggaatcgatgcgatgcgaggtatatatatgtgatgacttgtgtgttgtacttgttggtagtgaccagctgtaacggctgtgatgtgcacctggtggatggatgcgtgcgaggccttatataggcggcgcgaggaggagaacggtgtgtggttgatagtggtggcagtggtgcatgcatggcgcgtggcgaaagcggcacgtacgtacgtatacaggaggagaaagggagaaacgtgcgagtttgggacgtggtggtggtggttgcagggaggaaaagggtcaatattttggtcgtcgtttgccttttcgttggctttcttttcttcgttttctctctcgtgtgtgtgtgtcaagctaggtctcatcgatctcctctcccgtccgggctctactttcctactactatcagacaattggtgtgttttggcagttggtaaccttacatgcaccttgcgtgtcgactttgtggagatcaagtggtgtgttcaggactgaggataagataacccaatcaggccggccgggattttgatctctccgctatggccttccacgaaattaagacagatatgcgacacggaatcaattgtaccttggtcggttgtgggaggagaaaaactatcgggatttcggcacaaaattcgatttttcttttaaaatatattttttagaaggtatgacataaatatactcattttaaactattagcaacattataccgttgtcacatccgcgagatatagaactggtgacacagtgatgatgtgtgcgagttcacactgccaacgcgtgaactcgttaagtcatcggcatggagtcgtgcaagttcgcgagttcaccatgtgaacttgtgcgagtttgccatttcaccgcacaaactaatgacgtcactcgtgcgagttgatagcgcgaactcaggacgtcatcaacacaaactcatgcaagtttacgcatgggtggagatacactggatagtgcagcggtgagtcatgtgtgttcggttttcaacatgctcatattttttttccaattatccgataacaggttatcctcatttttatctttagtttgcaaatggttggtatgaactcgcgcatcccaccgtcatatccagcgtttttgcgtcccccagatacgatgacagtataatgttactaattattttgaaaagagtatatctatgtcatatcgataaaaaatattttctttttattttttaaaattgaccttcttggtcacatggaaaatggaaaatccagctaattatccttgtacgtacgtgcgagggaatgtcccgttacaaccatcacaggtacttgtaaccatggttgggtcgtaataccttggatcgaaatttctaaaattcaggtaaattgtttggccaaagaaattattatttggctaaccaaattaattcaaatttcaatagtggatcgccgggacctttttagccaaggacttactgggcctgttcggctgcgctacagctgcacatataaagtactgtccgtataagctgcaacacagtgcaaataagggcagccgaataggtccactaatgatccttactctagttagcaatattgctaactaataggtgtgtgtgcatgtagtggcatcactactagaattaggatacatgatatatcctatgtcctgtctgggtgaacccacaagaaaatacgacttcacatcagaagttatttttcttgatggttgaccattaatttagcacatggaaaaatatcagaaaaacaatactacgacaatatatcgacataattataatttatagtgctaattcaccctaagtaagaatcttgagaatgttaggttgtacggttagttttccgtgtcgaatgtcttctacataatagtaaaagaaattgaaaaaaaaagacgtcatggaatatgtttgcaccgcgggcttcctttactttttgtcgacatatttaactagtggatacctcgcacggtgcggtaggaagtttagaaatactgggtgaaactccgcgcgttgctgcaggagttcaatacgatatcaataagtaaaaataatgtgtaaaatagctagacaacatgagctcacataagttgatatggtttatgataatttaaatagtatgtagaatgatgatccaaatgtaagagtaaagcgatgtagctttatgagagaaaaaaaggagggaggtaatttggaccatagattaatcatctaaggactaaaaagaattaaggtgatatgacttaatgagagaagaaaataaggtatttgagcaattgtgctcattttgagagaagaaaatgtgctcttttcactttgataggtgttggagtatttgtgctcttttagttttatgtagggtatttgagcatttgtgctcattttggttgtaaacttatgtgtaatgactaagctattacacttggaatttctgtagttgtatgcaccacgttggtgtagaagccgggttttataaactcctattacttaaaaaaaaatctatatctccgacagaagcagcgcgaggctctccaacaacatatcaatcaatgtacgttgtctcccttagtttcatgggcagatggttaggggggttgagctcccttaccccactagatgatcattgagaaaagaagagaggagagggaaaatagggagaggaggaagaaggagatcaacctctccaatctattattggatccgcccctgcttagtttggacttggacttatatgtaggtttacatatgatgtaggagcggccgtgcggcagatgtatcagtggttcgccgtgcttatgtgtaggggtgttttaatgttttctcgatcctcagcaaccacgattcacacacggatgaatgtattggggtaagtacatgttgtgagatcttttaatgtgcttgagaggtacctcaagtacctccacctccaataaaacacacaccgttgatttattaaggataactgggcataaaaatattttaaaaatctctttcttttttcttttctctgggaacactatatgaatctgagcatatagattaactaaaggaaaatatatagttattgattacttacttagttttatcattaattatacattcagtgtattaaatattgctacgttgttgcgaaagggcctgtagcctagtagttacaagagcctcagtagcacctgaggtcctaggttcgactctccatgggagcgaattttccaggatttaacggcgttgtgctttcagtggtaggcgacgtacccgtcgacagcgaggcgcctgtggtgactttgtcaatctctccagaatttgccggcccagtcttcgaagatgctcataggggtagggtttgcgtgcgtgtgtccatagggtattgctacgttgttttgtgcgttacaataataaactacacatcaatcaacttgtccttcccataaaaagttaattaatattatttaaatattgtacattatcaacaggtatttatcgcctgttatataatctatatgttcagctatatatggtttatttgcatagcataagttgtgatcgccctctctttaccatatctaatctgataaaagggacacacactacggagaatcgctttttaatcctggttgagaacccctatagtcctggttttccaaccgagactatgtatccgggactaagatatttttagtcccggttgaaataaccaagactaaaaatagattttctatttaccatatctaatctgataaaagggactcacactactggagaatcgctttttaatcacggttgagaacccctatagtcccagttttacaaccgggactatgtatccgggacttaaaaatatctatttttagtcccgattgaaataaccaagactaagttcgtaacaccagccgggactaaatcttttctggcgccaaatatctccaaatcattaaaaaataataaatcacagattgtgttcacacatcacagatcgttcacacatctcaacatcccaaatcatccacagcaacaacccaatatctcaatatcccaactcatccacaacaataaatcacaaatcattcacacatcattctcaaatcacagatcaaatcaacaaacaattattcacacaacgagaaggaaaaagagaaaaaaaagaaaaaaatccatggagcctgccgccgccgccaccttccgcggcgggccgccgtcgctccgccaccgcctggtcgctgtcactccgccaccgcctccctagcccggcacggcccaaccgccgccttcctcgcccggcacggcccggccgcggctgctgccatccccgcccagcacgggcccggccgccgccgcccccgccctacacgggcctgaccgccgccgccactccctggcacgggcccgaccgctgccggccgcttgtcccgcagatctgaggaagagaagagaggaaaacttaacagaaggtgagatgagaggaaaactcagatgtggaagaagaagggggagaggaagagatgagagtgaaaaaggaaggtgaggaaaagaacggagagataaagagtggaggggaggaagagataagggtgatgaggactcagatcgatgcgcgcggagagaatgatggaagagagagagcgagacgtgggaaactgatttgtagtcccggttggtataaacaaccgggactaaaaatctgatctttagtcccagttattcataccaaccgggattaaaaatattaggagacctgtcacgtcgtgccaataaataaactgggacaaaagatgatctttagtcccggttggtaacactaactgggactaaagattattgcacttttaaacccccggttttttaagcaaccgggagtattgttgtttttggtaaccgaccaaagatgatttctcaagtagtgacaattacatatttaacctttcacctaatctacaaattaactgcctggcccatttttttactaccttttgtaagacatctttgttttattgtttgaaccgttagatttttattgatagacggaccagatatataacatccaagcacgatagaacgcctcacatgttggagctatgaagtgcatggggctctgggaatggaatgtcgtcccttccttctgtttatttgcctgcttttggtgagttcctacaaggaagctaccgacgaaccgttacaatcgcacatgcataacggggtgaattaagttaattaaacccgtttatgctcggcgcacgaacaaaaaagttgcagcaatttcataagaccagaatatatgctgctagctactgcacatatgacattgcttttctgtttattattttgtgcgtacaaagtgctcaatcatatatgcttgggaaatttttttttgtcaaagcatatgtaaccttgtaactttcctattgggaatgaggatgtgctttagttggtagctttgggtgctctttactttttgcatacgtatgggcatatcgtttaatttgtacatgtatatgcatgcgccatgaacattttattttaccgaaagcaagatagcaccggatccgcccgcggcaaaggccctctctgagtttcctcctcgtgttctttcgtttcacaccgaccgagcgggtgagcttagggacgggcaaaataaaacgaaatcaaatgattcggtcactagttcagacaacagtttcaacgactgaatttattccgattaatttggtcatcttcattaataaaccgatataacgaagtgcaggctgggataatggtcgcatgtaaaaattgtatatttttggaggccttaaagtgcggacggggttaatgaccgcctgtaattttttttcccgtttgaaagaatcagttttctagttgtgtaggtgggtgtgccttttaatggatgcttacccgcaaaggagcgggcgacgtgtagtagggaacatttgaaaaacgactccgcttttaaagtagtagagaaatcaaccaacttttatgttgcaaatctcaacgaatgaaaagtgaaacctaagatataaatgtgccacattatccgatgaacattggccatcagattcacaaaatgacaaaagagttggaatcgattttaacaataggatcaaacttaagtagcaataaaaaacatggcaaattttgctacaggacactatgattttgtggttttagtcgtgggacactgcccaaactcacttttgggggaaaacacttcataaacgtggtaatttgccaatagacaccgcttcgattaaaataatgatttctggttggggaggagagagaaatcacgtgaaatatcaaaaatacccttggacccacgtgtcagctctccatctctcttcctctctttctccctccttttctctcttctccccgtcacggcttgctcggtggcggcggcgacgctcggagcgccgacgcctcaacgcatctgagaaactgttccaatctcgccgccgacgacccgcccggcccctcccacgccgctgccattgcgtctgcgatctcctccgccttcctcctcatcgcctcgcccttctccttctcccgcattaccgtctcctcctccccactctccaccaccgagctctccaggctcccacgcgccacctccacgcagacccccccccccccactccaccaccaccatcgcgttgaagaactgctcggcccccaccggccacccgagcagcggcacgccatggcggatgctctcaagaacgcgcccgtggacgagtgcgccaggatccgcgcccacccacccaccactagtcccctgcttgcctacgccatctagtcctcaaatccgacggggagccagccgggatcgaatccgtccttgtggtcgaaccccaccagcggctggacggcccagaggaacggccgtccgctcgtctccagccccagcgccagctccgccatctgatggatgctgatgctgttctgcgacccaaatgagatgtacagcaccgagcgccgcggatgtgcgtctagccactggatgatgctggtgtcgtcatcctgcgattttaacggagccggcgccgcgaggattggcccaatcgcccatgcttggacgtcgattcgtgcttgggtgcttcgtgatcggtgcagtgcgaatggtcgccggagtcccgccgcatctcccttgaccaccgccgagccgcccttgcttcgccccggcatgcccagccgtcatgctccaggcgtcgccgccgctgccgagcaagccgtgacggggagaagagagaaaggagggagaaagaaaggaagagagagggagagttgacatgtggcccaaggacatttttgatatttcacgcgatttctctctcctccttaaccaaaaatcattattttaattggcgcggtatccattggcaaattaccatgtttatggagtgttttctctaaaagtgagtttgggcagtgtcccatggctaaaaccacgaaatcatagtgtcctgtagcaaaatttgcctaaaaaatatatagagttctagatccttctagcatgctacacaagaacctcttacttgagatggtagaaagatattgcataaccatagtacctagacttcattcaagtatgcaaaagaaaaaaaaagtaaatttgctaaaagcaacaatgaaaatggtgtttatgtaaaaagcattaaacaaaaaatggttcgtacatttcaaattaagcttatttaattgagaggaaagtatagttacgtaaacaccatcgtaaaattatttcatagaataattatatgttttatatgttttggacaacaaactatgtaatttcatattatcattaatatatttttcttacatgtacaccattcataaaattatcaagtttagcataattattgtaaattatttattgtcatggtaatatttatttattacagatcaagataaaacaattcgtgttatacatagacttactgctaaatacgttatcttaacatatattcatgtatgcaaaagaatttaaatttgctaaaagcatcaacgaaaatggtgtttatggttggactcactattttgttcagactaaagatgggacacacaattcaaattacaagtctatttacactattactagaaatgaaacatttaaaagttcaacaagagggaggcaatggacacaataatgtatgttaaattatttgttgttatgataatattcttataaagtatgtttgaaaaaaaatgtattgttaattataaaaaattaagctaatcactgtaaataatgtgtaaaatatatttaataaagagggaggttatagtcacgtaaacaccataataaaattatcataaaataactatatgttttatacttttgaacaacaaattataatttttgattaacgttaatatgttttcttacacaccattcataacgtgatggctgtagtcgcgcgaatgcacgacttaatacactagtacatatatattatacaactcacactataaattttaaaacttacattaatttttttaagtacaaaccatattaggataaaataagttattacaacaagggaaaaacaagaaaaacgtatgaataaccaagagcaaggaacatgtgtgcgcgatggaaccggatcctctgatgtgaactgtccctgacgtggtcactgacaggtggccccgcgagcggtgaggcccacatgtcagtcactatgttcctctgacttcacgtcagaggatcccaatccgtgcacaccatgtgaggatgccccaaaatttggctgaaatcaatcgagaaattaatataacgatagttttctagcaaaaccgttaggccattcgttagctgactcaaaaatcctgggccatacatagtttagctagggagcaattcttgcctgggacaagcttaattattggaatatgaagcatgaaataatcaagtccaaaatggttaggctgcattcagttttctcatatcacaatcggacattacgatggaggttctgaactctgaatcacaatcggacattacgatggaagttctgaactcgatctgaagtggccagcccacaacgttcgcacatattgggccgcccaaaagtccaagagaactgttcatcggggaaaagtgtcatctgtgctgtgtagtaccaaaacacacacaagatgagataataaagaatattttttacaaaactatgtatacttcgtccaattattagaaaactacttatattgatttaaaaatatgtaccataaaactatatttagtgtcaattatatatataaaactacatattgacgatatcatatcataaaaaccacggatttaatatcaattatcacaaaactatatgtacgtataaataacttatagtgctatggatctaaactctaaaaatatgtagttatcactaaatttatagttttatgatatgatactttcaatatgtgattgtatgaaaggtttgatgctaaatttttagttttataatcgctaaaagtattttttaaaaagtttacttgaaataaatgataagaagagacatagaagagggggtttttatcaaggacaagtgtttgggaggtggagttggagttgggaacttcacctccctgtgcgcagaaaacggagtgcgcgtgattaattaagtattaactaatttcttttaaatcaatatgatttttaaagcaactttcatatagtaatttttgcatcattatttagcagcttgaaaagcgtgcacgtgtaaaatgaggggagtgagtttgaaactccaagaaaagaactcagcttaaagcagtgtgtacccttaatcaaattctaaggtgtatgtactcaatttcttaaaaaagaatgggacacccaaaagaataaatgaaagaaataagaatagaactgattgtatttttatcattttctttcgcctcattgtccatatgcttagtatatattacattttaatataaaataatgactagtatataaacaatcaagtacgtttagactgtttcctaatgaagccactactttgtgaattcttctactagcaaatatcatgtttttctaatacctagttgtaaacttcatcaattggcaaattctcttcatcccaaaataattaacttaaaatatgatgtgactttgagtacaacgaatctggatacgcttttattcagaatatacaggacgacagcaaaatttgacgtgaccttatggttattatgaggtgttgccatcgataaatatcaccgcagttcacaaaaagcaccgaataaaatttattcgtggtataggataggccgcaggaatatattcgaatatcatgcatgtttgcacgaatagcatattgaactgctctatatctccttaagaaatatcagaatgtgtcgctggatcgtagactagaaaatattgagtttgcaagactgaataaagtaacataaataaaataatacatgtagcaactatatgcgtatcatatttcttctctatatgtcatgccaattcagaatatataggacgacagcaaaatttgacgtgaccttatggtcattattaggtgttcccatcaataaatatcaccgcagttcaaaaaaagcaccacaatttaataacggattacataaggttaatattgatgtagtgaagaattaatccccctcatcagcctaaacatcaatgttattatcacgagtaccgcataaataattaagataaatttaacatgtactagtaggtaagatatatatatatatatatatatatatatatatatatatatatatgcatcacaactagagttttaaataaatcccttaagaaactatattaaataaacataaagatccgcaaagaaaatataaaaagaaatttgctcccacattacaagtgggcaagtacgtcatgatttcagttttaaaaaatacgccacgatttggtaaagaacttaaattttgtgcaatttgatacatttgacttagcaactgggtgcaatttttcccgaagtatatataggcgtattaaaaagcgaccatgtcttccaagctgacttggaacaaatttacaaagtgccctcttgccaacaatgataaccaacctctaaaccatgcgcattgtgtctatcatatatttgaatagattattgatttgcctatgtaagttgaccatattaatggtttgaccctttgaaaaggcctctctctctctctgtgttatgccttatttacccgttttactaatttactgttggattactgttaaatggaacacaaaatgacagatctctcttacttgagagatttcctctcgacctttctcctcatcattttattaaaaaaaaaatctcagaaacaatccccaatacatcgccaaacagataaatttaaagcattgaaccatcttcatctaaaagatggttagctaaactaagaaagcaaacttgctagtgaaaccaaatagcagcagaggaaccaatcgagagggatttgtggtgtggctacgacaactatacccttcttgagcctcttttgatatgaactccgcttgataaaccggtaaatcccgtttggctgtctctacgaaaatagcacaatttaaaggtttgttgactctagattttggtgtgagcttcaccaaactcagcaaagaatatccatgaagttcaccgtcgttgaatttgagaagcttgaactgcatgggcggctaatacttgcactgcacgcatgcttgggcttcatcaaccacgggcataggcacaaccacttggctatgcatctaaaagaagaaaggcaattactacttccttcgtttcacaatataagtcattctagcatttctcatatttatatatatttatattgatgacgaatgaatctagacatatatatctatatagattcattaacatcaatatgaatgtgggaaatgctagaatgacatacattgtgaaacggagggagtaatatataacattctttaaccgtagtttaggccccctttgattcaaaggaaattcataag

SEQ ID NO: 81656 - DNA, 17796 bp, Oryza sativa
aggtatttaaaactatctaaaattcggaataaatataataaaattaaaagtagagtttagagtccgtataaaaatataatttctaaataactaaaattcaaaattaagaaaaacatgggaagaagagtttaaagtcaatataggaatacaatttagaagtaactgaaatttaaaattaaaatttaaagaatattgaaatatgagtttatatagaaatacaatttacaaatagctgaaattcggaattaaaaaataagaaatattagaagaggagactagagtccatatagaaatacaattaggaaatagttgaaattcggaattaaaaaataaggaatattagaagaggagactagagtccatatagaaatacaattaggaaataactgaaattggaattaaaaataaggaatattagaagtagagtataaagcaaatacaattaggaaataatagaaattcggaattaaaaataaggaatattagaagtagagtatagagtccatatagaaatacaattaagaaaaaaatagaaatttagaattaaaaaataaggaatattagaagtagagtattgagtccatataggaatttaaaactaactaaaattcggaataaacataataaaatgaaaataatgtttagtgtccatataaaaatataatttacaaataactaaaatttgaaattaagaaaaacatgggaagaagagtttaaagtcaatatagaaatacaatttagaagtaactgaaatttgaaattaaaaattaaagaatattgaaagatgagtttagagtccacatagaaatacaattagaaataataaaaattcagaattaaaaaaaaagaaatattaaaatacgagtctagagtccatataggaatatatataatttacaaataactaaaatttgatattaaaaataattaataactaacacgtatataaaatacaatattaatattacacattagtagtttcgtagagttattacaaaatttaaaattatgttgtcattgtaatatattttaataatataatgagaaaacatatatgctattatataagagaaaacataatgatgctagccgcgcaatctgcgcgggccaccatgctagttaaccgaacaagacctaagacctaaggtgggggttgtggaagtggggatagactatgcccttttacggagaaacgcgaggcttgaagttgctgcggaataagcacaatccaatccgagttacggtataggcgtggacgacagaatggcgggatggttgggtcggttgggttgagttgagctgggaaggggtgtgtgatagttattttagattcacatcgatcaaatttgatacaagcgacttacaaccagctaaaaatcaaatcaaacacagactacgcaccaaaattttgataaaaatatctcaaatttttataatagtagagaagagataaacactctaagattgtgttctgcacggaaatgtggtggcttattaatgtatgattaattaagtattagcaaacacaacttaaaaaaaataaaataatacgattctgaaatcaactttcagatagaatttttttttaaaaaaaacatgcacgcgaaaaacaagaaatatgagttgggaatggaaagggaagagtacgggtggggatgctttggagttcactccaactccatccgaaggatttgatgaaatctctgtcatctctatataagaatggttgggatgaagtaactaattcctaatagttttttttctgcatcttaatatttgtaacaaatctaacgaatactatatatatatctagagaatatacaaactgattttacttgcataacctagaaatttcatggttcatccacagtataaaaatcgtattgggctttgtggctataatattttagcaacatttttgtgtgtatatggtttatgtatgtttgcacgtactaaatgtttaacatagttttttatacatgaccatagcttcttatttggagaagagagcgtgcatactttgttaatgttgttggcagaaacatactcactaggaacataaaaaggaagaaaaggtaagtaattttcattcaagcatatgtgattgagggagttaattaggacaagttaataagtggcttcatcttagccataggaaataattgatggtatggatttagtcaaatccacctggtggagttgtagctaactctagggggatctggacccggaagagcaacaccctaatactcgtaataaaatagcaatgtacgttgctaatgccaattcgagggtgcgatttgttttgggaatacgaaattgagccctataaattgtccaccctataggccgcagattcctcaatccttactgcaagcggcaaagccctcctcttcagctcttctgacggaaaagaccacagcgatggccaattacacatggataatacaatttaagtagtgcacgttggcaatgccaaatcaagagatgcaattgcactccacccaaccctacaaatatccacccgcagcttagctcgatccttgcccacttcaaagttcaaacaacaaagccgtcctcttctgaccaaaaagaccaaagccatggcgccttccctcgccacctcttccaccctcgctctcttcctcctcgtcgccgtctccatcgccgacgccgcgacattcgccatcaccaacaggtgccagtacacggtgtggccggcggcggtgccatcgggcggcggcacgaagctcgacccggggcagacgtggaccatcaacgtgccggccgggacgacgggcgggcgcgtgtgggcgcgcacgggctgcggtttcgacggcagcggcaacgggcagtgccagacgggcgactgcggcgggaagctgcggtgcacggcgtacggcgcggcgcccaacaccctggccgagttcgcgctgaaccagtggaacaacctcgacttcttcgacatctccctcatcgacggcttcaacgtgcccatggccttcctccccgccggcagcggcgccgggtgccccaaaggcgggccgcggtgcgccacggccatcacgccgcagtgccccagcgagctgagggcgcccggcgggtgcaacaacgcgtgcacggtgttcaggcaggacaggtactgctgcaccggatcggcggccaacagctgcggcccgaccaactactcggagttcttcaagcggctgtgcccggacgcctacagctaccccaaggacgacgcctccagcacctacacttgcccggccggcaccaactaccaggtcgtcttctgcccatgatcgaacgcgcgcgcgcgcgcgcggctgatcgatcgatctctgatgatcttgggatttgtatgatcgatgcatgtgtggatgtaaccgtgatatacgtacctaagaataagtttgcacgcgcaaacgaggataagtttatgttatcgatctttgaataagtaaaaacaactgggtttatgaattgatatatatgaacgatgactttcagtaagataaacacggttaattacgtgttcgatcagccatatgttattatgcgtgtaactatggaaactattctaactataaaaattaagaagatgtattaatatgtgatatatcaatcaataaatatgtaagtgtaaattcaacttctacaaatatcaaccaaaaaacaaattaaactatatctagacatctagttaatgtatattcacagttaaatttgttttttcattgtgacatgtagatgttaaattttaacttgcatatttttgagtaatatattacatgccaatatatttttttaaaaatctttcatgactatttaagtgacatgtaaataatgagaggatgtttcctcgagagtttaaaatacactatagtatatataactatgcttcggagttcaattctatgatttctccaacatttccaaattccagtcgaggacgtgtacggttgtaaattaattgagttatactagcatggcgcgcgattaatacatttggacgaacacgcccaacaaataaccatgaccactctatcacggcgcattaacaagaaattaactgtgaacagtagtcaggtcgaatccttaaaccttagcggtttggacaccacatgctataaccttagtgcttaagaacttttaagaataccatagctctgttaatagacctgatccagcactggatttatcctaaatccaatatccaggccaaaagcggtcagcttgagtggacccacccaatacttgcaacagcactcaatcgactacgcatgcatggaaagtcaaggattttgtaattagattccacgtgccaaatcggaatggaattaactaacccaagcagatatataccctatccatctcaaaataactcaaccgagaatgagatatgattcatcttaaaacaaagaatctgaacatcacatctcattttaaattaagttattttagaacggagggagtaaactacattattaaattgtgcgggagaaagtcatcatactttcatacattcaagcggtcaagagcctccactatcattatctagagtagtggaccgagcaagcatagatcctctagcaaattaatctgtcaaagaacttattattatatcacgaagaaaagacttccattctgcaaaaaaaaaaaaaattctagagacgtgcaacaactgagttagctggcacgtagtaccgatgaaacagcagagtggagaccgcacaaaacagaaaagagatgctcgcgtacgtacgcacgatgcacgcagaagctacccgtgcacgcgacctcctcctccttgttcctcgttccctcctgcccgggaaatgcatggccagcagcagcggcagatcgggtcatcgaggcctgcgttgcagccgatcttgaacggatgacggaaatcttaaatgaaattccattcaacgcgaataatgggcgcacgggagcacgcaaccgtccggctcgaccgattttggaattctaaattcttccttggttggttctggtcctcgccatccaagtctgaagaattcctcaccacgcagagtcgcagctcgcaggttcgaactggtatgtagagagagcactttgccttctgtttcgtttcgctccacctataaaaggaataagttcatctgagatctcttaacttgtcaacgaatccgattttcgtctctcaaccgaaaaaccaaacacaacggatttctcaactatcaaaactagtgcagatgaggtccctcggtgattttgagggcggttttggctgacatggcgcctacgtggctaatttgacctgatattcatctggcatggcactgacatggtgcctaagtggcaattcggtctagaaaaaataataaaacccgtgggacccacatgtcagttccacaaataaaataattaaaaaatggtgggacccacgtggaccccacatgtcatcctcactcctcactcctctctctctctctatccggggcggagcggctggccggcggagcagggcgggcagcggccggtgcagcggcgaggctggatgcggcggcgcgacctggcgaccgggccgaggcaacggcggtcgggcgctagtcagcccagcgcggcagaggcctgagggagagaaggccggcgcggtgaggagggagcttggcggcagggggaaggacagcagccgctggcggtgctcggagcgggcgcgtcgacgtggccgtgcccggctgacggcggctgggcggcagcttgccttgcctgaagaacaaattcaaagacacaactcactagaactgttgtattgatttgctataagaacctgcatgttttgagtttctgcaggaactctggagattcaattcctacaatgctaaaactcctcaagattcagttcaaatccaaagtggggaagaaaaaaagcgattcgagaagagcagcaatgtgggtcttagataagcacaacgatatgagaaaaaaaaattgaagaacagaagcagaaaccaaaattcaggccaaaaatcatcatcatcacagtgggaactctttccggcaagagaaagatttatgcgcattggctaatactagagattaacagggaagggggagacaatggtaggtacctaacctcagacgctgctgcttccatggtgatggagctccatctcctccaaaatttgcaaagcggagagcctctctctgttaatttggagtttggagggagcagagcagaggcaaggcaaaccaggtgcagaactgtggactcactctggtctcggcctctcgggtcaatccattcctaccactctcgtgttcccctctcgccaccggacacagtgaaccctagccggctagccgccatggacggcgtccagccacttcgtcttctgctcctccccatattgccgcatacaacttcgccggccggcgtggctggctctcgcgccggccttctctccccattcgcctgacactgcctgggctccctcaggccgctaccgcactgggccgactggcgcccgaccgccatcgccaaggctcgcgccgccgtcgcctcggcccagtcgccaggtcgcaccgccgcatccagcctcgccgctgcaccggccgctgcccgccccgatccgccggccagccgctccgccccgcccgtttcccgcttctaccagccgccgctggccccgctccatcggccggagagagagaagggagaggatagagagagagagagaggagggaggagtgaggatgacatatggggcccacgtgggtcccaccatttattattattattttgtgtgtgaaattgacatgtgggtcccatgggttttattatttttccggatcaaattgccacttaagcgccacgtcagtgccacgtcagatgaagaccaaatcaaatcagccacgtaggcgccatgtcagccaaaaccggcctcaaaaccgtcgagggacctcatctgcaccggtttgaatagttgagggactcgttgtgtctggatttccggttgaggaatgaaaattgggttcgttgacaagttaagggatctcagatgaacttattcccctataaaagggcagactgtacaacaaactcggcccgaataaggccgcatccagcgcaacctcggcccaaatctctactgtgtttttttttctttttcaggggaaatctctggtgtttcctgttttcacttttgggtgtgaaaaaatcggtgatgctgcccagcccttgccccaagcagtgacggagctaaaattttctcaaaagtagggctgaactagtataatttacattagtttatctttttatcttttaattgttttcaaattttaaatcacaatttcaatgggtatttaggctaaggagtagaggctctagccctaactaccctactcctatatccgttcctaggcctaagtgtggtcagacagtcttacagcttgttcgagtattagatataactattagtagagctcaagccagcagtgttttggaggcccaagagactgggggaattgatcgatgtgacatcctgacttaattaggatttggcatgtgtgaactataagagcagtgcacgcacatttaataccacgttgctagtttatcaaggctggaaccaatttataaggcatcctccctccaaccataccacaatcgggttaacccttttacacgaaacgaagatgaaaatgtaattgggatgatatgtgtaagtgggaccgtccatcggttaggctagggcatgtggggcacatggcatggcatatggcactagtattggatgtacgaacgtatacatgtgtggcaaccatactactcataggttaacccttttacacaaaccgaagatgaaagtgtaagtgggtctgcctgccggttgggcttggctacgtagttctggaggacccttttacacaaagcgaagatgaaagtgtaaatgggtccgctcgtcggttaggcttggctacgcagttctggaggacgagcgattacaatcgagaactatgaggatttaacaaaggaggcttcgccgagctcactagcatgacaacatccaacgtcttcccccatgcacaactgatcccttttatttgtgtgccacaaagcccccatagccacaagaatcttaatgaatgaaccctcatgtgtgacaaacaaaaacctataggtatgtgcgggagcaccgtcgtggctcagccgcagttggtaaacaacggtgtgcaaggtcattgcatgggaaagagcgtgaccagctaggacaatgggtagggaggttgctgtggtgagaagacggtggcgctattggccatagaaggtgggagggggtagaggaggagggaagatgagacaaatagctcacctagttgccatgactggctagccggaggagaggtcgtcatgagatttgttagcattgcatttgcgggaattgagtttgccaacttttcactgttgaagaagagaagatgacaagcactggagggtgagggtagagggaggagaggtgggagactaggagcggggaatgttttttatgtcagcaccatcgcaatcgccagtcatcttataatctcagctgcaacttacacgtgaagattgtcttgaactatggacaaaaagtataaggtggaggggctcgcgtgcaatttggtttactcacgcttgctcgtgtatttggagccccttataatcggtgattttttttctttgaacaattttaattttttattatagtaaaaaaatattttcttttggctatgccacttcgtctagcgtgacgaaacaacacaattatattgtcaatgtattttatatcaccacactaccacaccaatgagactggcgtgactaaaaggtttatattaatttttaaaattttaaaatgttaaaagaaattcataacctgccctgctctgctatatgggactctacacccacaccaatcagatcgtacgaagagaataattctccatgtgagctgataagtgaaaggattgatgggacaatatatttgttctaaaactaatcccaccaatagagtatagtactcttatacagctaatatgctgcagttaggccgagtttagggcctgtttagtacgcgaaaataaaatttttcaatgtcatattggatgtttgaccggatgtcggaaggggttttcggacacgaatgaaaaaactaatttcataatttgcctggaaaccgcgagacgaatcttttgagcataattaatccatcattagtatatttgggttactatagcatttatggctaatcatggactaattaggctcaaaagatttgtctcgcgatttcctccctaactgtgtaattagtttttttatttatctatatttaatgcttcatgtatgtgtccaaagattcgatgtgatgtttttggaaaaaaatttggggaactaaacggggctcttagttacaaactttttttcaaacctccaacttttccatcacatcaaaactttcctacacacaaacttccatcacatcaaaactttcctaacacacaaactttcaacttttccatcacatcgttttaatttcaaccaaacttcgaattttagcgttagctaaacacacccttagttttgttttaacttgacaagaccaaaagtccctgaatcacgcggagaaaacttcccaggccagcttctaatgtgactttttcttcgttgtggtacatttcttgctacactactagatgccaaggaaagagcacctaacaaatcgaaaacgtgaatcacagtaatcacaggatcatacttggattctttgctcctcttttgtccgcgccaaatcggtcaatcctacgaaattactgaaatctagcactaaatcatactcccttgatctttaaaacatatttcttttattatcaagattaaggagaaattaacttatccatcatataataaaaccaagaaactatatgcatgtatatttcttttatcttttattgactttgacagagactgaagatataaatcatcttcattatctaaacaatatatatagatgcaaccaatgagtattaaaataattttatggattctgatcaataatttaatttaacacataaagactaaaaatatatctaactcatttgaaaaaaccaaaaaatgaaatatgtttagacttttagatagagggactatgtgccgtagtgaatatacctttcttactgtagttaaaagaaaacctttctatataacttcatttctagacaccccgaatcaattagatatgcacaatagcataagccccgtaatgggctcgtggcaccaatgaattttacacatacctgtttagagcgaaacaatttgattcccgctgtggcatcaggaagaatttcctcgaacgtaccgtctgtttttttttttttgagaacactcaaccgtctggttcgtggtgaaaaaaagaatcaagagtagactttgaccagaagaagctgcgctaatgatagaaaattccgaataactccaaccaaatctgccgggatcaccaactctaccatatttcaacccacgtactacccaatcaccggccgtaactccatggagaagaaacgcgtagcccaagaaactccaagaagaagatgtcatgtttgtttggcgagagaagttataataaaccgctgacaaacatgagtgttgctgtgtggctaaactagaggtttccctccaggatcagtcaaatggcagatgctagtagctgatttcactttcttttttccgaacgaatattaactgattataaatttgcacaagaatgtcccctatcggcgtcagcgtctcagcggtgctgctaggttccctcgtcgatcttccaaatgtctgcaccagtacgtctctccgagccaagcagtccacagcaatcaacaaatgacgacggattcagaatttcagatcgcccaaggctgtgtgattagctgcaaccaaacggtgacacgcataaatcttctctttttatttttgattttttttctcatgcaattggggggacattcttgtgcatagacagttaacagtacggctggaaaaacgggcttcaccactgggaaaagtccatttgcgacttgcggcggcatgaatgccagtacaagacccagcacggagagtgacgagacacggacacacggtgccagcccggccgggtgcgcggctacgcgttctcacatgagccctctcctcgacggctgaggcctgaggcagaggcgagaagccgcgcgaggtggctttcaatttggtggtagcgaaaaactagtgcagccgaagcccgcgaaccggggcggctgctgcctgcctgcctgcctttgcttgccggctttggaatgatggcgctcccaggcttttcccctgcgcgcaggctgcagcattgtggtccacccggccgtcggatcagatggatcccatggagttctcagcttggatcatggggaccggccgggatgatgccgaactctgcagcttgtgcttgtctcactagccagcactattttactctacgaccgagtgaaacccataggccggcggccatagcagcagtagtagcccatcagtactcctgttcagtgggacggtgctgtgcaatccaatgcagcttctgatcatcgcaagtcgcaacagccatggtcgggatgggtgtgtttagttcacacttttagaagtttggttgaaattagaatgatgtgataaaaaagttggaagtttgtgtgtatagaaaaatttacatgtgatgaaaaagttaaaagtttgaagaaaaaatgacgaaaatgttcacgattgccacttgggtaatcgtcgattcgacggggaggggtgttccgttgaatggcagcgagaatattcttgcatcacataaaaaaaaaaagaaatagtgtatcatcaacaacactagtgcagccaccaacaacaccaaggtcacatttaaatcgcagaaatgagaaaaaaaacaaaaataaaagaaaaacacataattctaatagaaataaaagtgtaaaacagaatattacaaaacataggataaacacatgaatgactgtttaattggattgtaggaaaacacatgaatcaaatgagatagatagactcaaagaaaattttccaaaagtttgagctcttactaagttttcttcaaaatctttataggattaaccattccataggaaggattcaatcatttgctttaaaggcattcataggaatttttcctatagaattgaaatcctccaaaattcctatgtttttcctatgatcatgagaagtttcctcctcccgtcgctcccacctcagggctgacttggatggtgaaaacttgccacagtcgccccctcccccctcccattcgcctcgccaccgcccgagtggctcatcgacaaagccgaacggtcacaagaatggtaacagagaggtgcttccccctcccggagaaagcctgaacagctggggtccgtggttgcaccacccaaccccggttctccatcagagctagtgagaagtccagtggaggaggctttggaggagatgtggctgcggggtagagggcgtggaggcggtgtgtgcagagggacgggcaggaggtgggggagaggtatgcacggcggatcttgtgtcctctaccttagatccggtgcccaccccgcggttccggagatggcagcggaggagaggtttgtggcaggaggtggggaaggagcaggcgcagtgacaacggagcgtggatccggccccaatggctagatcgaggcccttccacaccagatttggccggaagagacggatgttgttgtggcagtgggcgagggggcgacggtggcgaggctaacccggtcggcgaggggcacaagtggcaacagcagaaggccacaggacatggctggtagcagtaggaggacttgcgacacgtagtcacagtcgacggcggtgcatggccaatggtaagagatcagtgcgcaacaggcagcgacgatggggcgccagcatgataaaggtgattgtcgagagtggtgtggtggcgggggctatgggagttcgcggcgggcgcacggcttgaggtgggggtgctgccatgggatatccagccgaggtagcggcgatggtggtgttgtgaggtgggtgctgtgggcctgcaacgggcttggatatagacgcttgtcctcttgcgacgacgctttgtcgtcataagattgccacgtcggtgggctagtgcaagggagggaggatccattcttctctctcaccctctccctctccagcccaactacctggatggattcggagtgcgtcagtggtcgagctccctcctgaaggctgactggcgacgaggcgctggcacggtggctgcgtgtcgaaggtggacgggtggtgggctgctgtttccggattgacctcgactcgggagagcagaaagatcacggacaaaagcccagccttggggccagtaatgaccacgtctgcgggcaccgcttttcccttgaggtgttgttgtatgatctcctatgctctccctgttggatttcttcgagtgaaaatcttgtcttggattctcacgacaggcggtggcgatacttttgggtggcatcgtctagaagattcttttcttaggggtgtcgtgttcatttacccttcagtagcgcgatttggttgtagaagcatgatgtggttgttttcttttcgaggctatgccttcgagggttatacaggcttgtaattttttctgctcaatcaatagaatcatcgcactatcggattgtttaaaaaaacaacacggtgcaaagaaagctgtaatcctaaggatgaactgcagacagatttcgggcgagactctaaggggatgtttggtttccagggacttattccaagtccctgtcacatcggatgtttggacactaatttggagtattaaacatacactaattacaaaacccattccataagcttggactaattgcgagacgaatcttttgagtctaattacgccataattttgacaatgtgatgctacagtaaacttttgataattatgaattaattaggcttaaaaaatcgtctcgcggattagctctcatttataaaattagttttttattaatctatgtttaatactctaaattagcgtacaaacatctgatgtgactggggctaaaaagttttagcccatctaaacactacataacgttgttaagttaacattgcacttcgagttccgattcagtaaggaatgaatgcaaagcacgaacgacacgagcaacaagaacaaatatttatgtatttgctgcttctttcttttgtcactcaactctcccctttcttctgccactaatttacatctttgggtttgatcctaaaccaccatgtaaagctccgatcgccgttgccgtcaccgcccgccggcaatctctgaaccgagctaatgaacacgccgcaaagcacggtgaacacgacggccgggagcttgccggcgacgaggcctacgagaacgacggcaacgacgaggagcgcgacggaggaccgggtccctcccacggcgtcgccgtctccggcgaggacatcggccggcgcgtcgatttctacccgcgtggcattgctgtaagcgtcggcgtccgtgtcgcctccgttcccgcggaaagacggcgaagaatccatcgatctggcgacgaaggcgtccgcggccttggtgcgcattccacggcgagagtccgaggaatccgtcgccgtggcgtcacctcggttgccttcgctgctgcggaaagaacccgacgaatcctccgcctccttgcccttcatgcccttctgtaacttgcggggaatcagcttcctccatgaccgtttcttggtcttgaccttggcgttgcttgagtcgtcgccgcctgccgcgattctctcctcaatggcgactatcgaatcgtcgcctacctcgcttctctcctcaatggtgaggatggataactcgcttcgcctggaggaatcggagaagcttgccctcgccggctccacctcccggatcggcgagacgtagccgcgcccgtccaaatccagcttgttgttcgccgccggccgccgcggccgccgggaaagcgcggaggacctgacggactcgagcaggaagagcgagaaggaggcgacggtgacggccgcgaccaccttcttgctccagatcacgaggagggcgagcgacaccacgccgacgagcgagacgaaccccagcccaaggccgaacacgcggcccttgggctggcggcggaggacggcctccaccggcggaagttccggtctcggtctcggctgggttggcggcgagaccgagacagcggccgcaggcggcggggatggtggtggtggtggtggcgaggaaggctgcggcggaggggaaggcgagggcgagggcgagggcgaggggggagcctccggcccgccgcgcttcttgcgcctggacgccgaggcggagggcttcttgaggcggccatggttcttgacgacgaggtcagcgagggaggtggggaagcctgtctggacggggagcgggccagcgcgcgccgggcggagcgcggcgaggaggcggccgagtcggccggcgggtcgctccttcagcgggctgggcatcgccggcggcgagcataggaggaggagttcgccggcgcgccggcccgtggcacactgctcgccgcggttgggcttctcggcgctctgggttggtggcggattggtgggttagttccgcctcagactttgtgcgcgtgcgtggcgtgggggccttggtagaggggagagcgagaatagtagtggacgacgcgatagccagtggtgcgtttcgacgaaaagaaaaataaaaaccatccaaatttcccccgtttcgcatgcgttttctcgtccaaaaaaagggacctgggagagtggaagagggtttcaattttagaacggctaaatttgaaagttttgttggataaggttgatgatgggtttagcaactccttgatgagaagggaagggattgtttcttcacatgacctgattaatccgtcacaagaactttgccaatttctacatactttctcgagattcatgtgacgtgaggagagagagagagagagagagagagagggagagggggaatgaattggtctcactgccggaaccaaccggcaaccgtaccgcttgactaatctgtctcgtgccggtctcacaacgttccagtggctgacagcgccctcgctaaccttccacgtagtcaattaatgcatcattgctttggattgattagtactaatcaagtgtatattaaatcgattggctaaggcgctaagcatttggggcctttattttggtgttttcttcattttttttggaggtttataggaccttttgggtctcaggaggttaaagtacgtactagtaaaaattaagcttcgatcatgactcttgatgtgaggtcaattctcttaacagggtcgtcacatgcttgcacgtgaaaataagcttagctatgcgaattacttagtttgttaaccttgtgtatgtctcgtaatctaattagttactagtttgttgatgctgtgtcttaacgagaagaacagactatattctcttgggacccgcggttgtactgtttgtctccctagttcccatcccatgtagctatgtaggcatgcaagcccattcggaaacccccaaatagtttctcaaaaaaaagaaaaaaagaaacccccaaatccttcttttaatactacaaaaatactatcttgttgctatctaaaacatatagtaattctaaggaaattcatcttgtgtgtttatttttttttcaatcacttctacatcccaaagttttgctctatttctttatagctgtactacctcacagttctcatccgtatgtacaaatcatgttagttgacctcattttagaaattttttgtagtttcacattttgttgatttggattcgtctaatttcacaaacaaattcacacaacttaaaaaataaccgcccttttaaggttttgacgtagggatcagggcataggtctaccactcaagttttataaagtaaatttcacataactacaattattttatcaaaactatcacttagctacaacttaagccaaacatttcataaaattacaaaaataacaaactattttattaaaaaactataacttttgttgcttacgtgtatttgatacgtgagactaacttacaagagtgcaagtaccacatatgtgctggacaagtgcacccaacctttttattagaaacaatacaaacagatgtgcacactcatccctataaaacgtacacacgcacaccatatcctcataagtacattcgaaagattacactggtggagaaaccatctttggacggtcgaccaaattccacaatagtcccggttgcaataaaaaccaggactaaagattatctttagtcccggttgaaaaggttagagctactttttgatctttagtcccggttggtagatcatctttagtcccggttaaaaaacggtaggtgatgtcaaacccctctaatatctttagtcccggttagtgttaccaaccgggattaaagatcaatctttagtctcggttggtaacaccaaccaggaaaaaagatcagcatgcgtggagagatcgaggcgcggagagatcaaggcgtgcgggatcgagatacatatctcctcctcccctcctccctcccggttctatctcttcttctcctccccttctcctcgctatcttacacgcggaggatcctctcctcctccccctcctctcc

SEQ ID NO: 81657 - DNA, 39985 bp, Oryza sativa
ttatgttttatggtgtggctactgctgcaaccagattgcaagaggatctggtgtgctacatgcaaaaatagatggtgattactatcaggtacgtactacttacaaaatttaggtgtaaaagtagcacatttgctgtgaaaattacttatggctctcaataacaggggtttctagagtaaatccatctaagctttgttgaactttcaattttaagatgcctgtatccgagcgctaattgcttttagtttctttctgtgctgctctaactatgaaggaccaagctaagttcactgtacaatggcatattaagggcccctttgaatcgcagggtagaaaaaacggaggaataggaaaaacataggattctgacaggaattgaagtgtaaaacagaggattgcaaaacacaggaaaaacacaggaatggtcgtttgattggagcgcaggaaaaacgcaggaatcggatgagagagatagactcaaaggaaattttccaagaggttggagctcttgctaaatttcctccaaaatctacatgcaatgtgtcattccataggaatttcataggatttggaaagcttcaatcctttgaatcaaagggccaaataggaaaatttcctataggatttgaatcctataaaattcctacataaatcctttgattcaaaggggccctaaggctgtgttcttttggaggggttggagaccccttccctccgcacgaaaaacggaacgatagattaacacgtaattaattaagtattagctataaaaaacttgaaaaaatagattaatatgatttttaaagtaacttttctatataactttttttgcaaaacgcgtaccatttactagtttaaaaaacatgtatgcagaaaacgagggagatgggttgggaactcatagaaaagaggtttgagttgatcttgatcttactgttctgtaccgtgtaaagtggaatattttggaactttgttttgttcgtagcatatttgctggaacggtgtagcgccctactcttacattccagtatgtcaactaaaattgtggtcttgttactcttgtacttatttgtttaaattttccttccagggagtgatctaagaggatcgttgagctgcaacaaaaggcaataattatggtggatttttttagctttaaggttagttctccatcgtgtgcttgaccaatagagtggaattctatgacttgaaacatgattttttgctatattgtcagaaaactttttgaaccagcttagttgaatttagctatgagattgttgcttcatttatttaactttatgctgcattatgatacttttaacagcattcctgaaacttttgatcacatcagccaaaaggatctgcatgaactatggtattgctacctttgacaagtgattagacaaatgcagatggctgaaccattgtttaaagacaccggccgtatggtctaagctgatcattttggccatattcatggctttgttgttgtcatcaggccttcgacatggaagattggcatgtttgctgggacggctatggattcttgggcaagttggccagagactacgtgacgttcatgatcctcagccactggaacacaatgttccttaacgcggatgatgccggtgcacgcacttctgctgagaggcagagaccaataagctcctcttccggtgagccggctagacagcctgcttgatgttgcccgtatctttgtagcctttgattgtctttttgtgctgtaaatatacatgtatcctgtaacataatgtatgcaatatgaaaaaaaaagggggggggggggggcaaaaccctactttttgtgcagcagcaatcacaaatgatcagcccccgcaaaaaaaaaaaagatcaaccccctatttgtttctagaatgatcactcaagcatttgaatgagaccaacgcttcggccatttttgtttctcttgattttctataatttttttagatgaaatccaggatttatttgagaagatatgggtgccacgtggcccaatcaaaagtcgggattaccgctggcttgagattactatatatatgtgttctaagtggcttgtttaagcaaagctgttggtctacatagtatcttttgaagaataaactgatatgagcctaactgctaatcacagtatatgagaaaaggtatcaatcaaggacttgagtgaaacctattcacatgaaattctgaattcaaggtatagttcattgttcagatgtggatagatgtagctcttgttataggtggatgttcattaatcggtctccaccgaaacactggtatatcaaagttgcattggaataaagagcattttcgtaagctttgaaatttggtggagattgttaaatttacttggacaattgatccatttaaatcaatgatatcaaataaattccaaggctcatatgctagtatttatgtgtattcattctctcatgagttatcaatggtaaagatgaagagttctgagaattaatccattcattgattacatctaattgatagttggttgatagtagtgcagtggaggaaggttgatggctagttgatgacaatcagttactctatttttcttcctattccatgagtctcttacccttcatttttcttttctcctataaaacgagaatggatttgatctcctacgcatgagagagaacatacattttccatccacttccacttctgttgcttctatggtgattccatcctggcgagtgtgtgtgcatatgcactaggagaacaaggctccgaaacctcacatccttgatcttgcaccgagaggaggcgaatcaggctttttgcaagcacattgcacgactgcccgcttgtgcttgagtgcgactacatcgactacttccttttaatcatggctggtggcgagaacaagaacagtaaaggcaacagcaatggcaatggcaagaatggcaatgacaacggtgggaacggcaacggttctccttctgctaccattgcaaccactattgtatcactgtatgctattgttctcttcttcccttctctgttggttcctttcatatgcgcaaatgagttagatatgcctattttcatggtttacactgatatcatgtttttttttcatattcctgttgttgagagtacatcgtttattgatttacgctatcataatttaaatttacatcgttatgatttactctcttattttctacatcaaatattaaggtgatttccttatattgtcaataattcaaaaaccttattatagccaaatatcatctacggttaagaggctcgtataaaaaattgattttcgcttatggttcttaaaccgttttcatagaaccatcttcttatagacaagagtagttatggtccaccactccacctacaatctaaggggcctcataaaaaaagatcgattaatctgcatagtggaccaagtcaattacgtagtcaatgcaggtttgtgtaccctgctatagctgagaacgatcgatcaccttttgagccagtcctcttaatcaattggcatccacagttgacaagatggcatgcaagaatctaaccatgcaagcggtactcgatcaacacgttaattcttattattaccgcgaatatggctgtgttcagttacacgttaaaattaaaagtttaaagaaattaaaacaatacgatgaaaaagttaaaagtttatatgtgtagaaaagttcgatgtgacgaaaaagttaaaaatttgaagaaaaagattggaatgtaaacatggcctatatctcccaaccaccactaggacgaaagacataagtgacattattttcagtgtcggcctgctcaattatacacaccctcttgacttcactcttccaattgcaagtctttccatgactgtatttatgtcagatttcagtctcgcctctatcggcatccccaattgaaatggaaattcccaggggcaataaaaaatttagcacgagatatatatgatacgttctaatactataaatctaaatatattctttttctagatttatgtggtaggatacgttacatctctgtattagcggcatcatcttttgacttgtgcttatgctttatcatctaaaatttgaatttttaaattaaatttggagttgattttggagttttttcatcgaagtttatttttcagcatttgcttttgcttttagatcgctaagaacatgtataaaaagctttattcataaattatttttcttaacgggctgtagatttattttctataaaacaaagggagcagaccgaaaactaccggaggtcaatgcatcctctacttttagttcggctgggtttagttccaaattatttcttcaaactttcaacttttctatcacatcaaagttttcctacacatataaactttcaacttttccgtcacgtcgttccaattttaaccaaactttcaattttgacgtgaactaaacacacgttaagaaaaattcattttctaagacatattactatgttttgggtaaattttgcatttgcctgcagataattgtcaaaattccattttgaattagatccaagccagtgccttttttatagaaataaaaactaagccataggattgaaacacggtaaaccaagcctaaaaaaggataaacagtagcgggtgcaaaacagcaaatcttatagaataaatattcaccgccaaaagaaaagacagcattattttcaacatgttaaataaattaaaccagaaaactaaaacaatatgatagagagcgaaattgcaacactttacaccaaatgttttccatagtgcatccgaggcagtcctctatattaatctcacaaactaaactctatgaaaaagaaagaagtctaaaaaccataatggtctctcgataaaggtgtcttacacaatctctctcctattctagagatgaataaatatcaacaagtcattcttctgatagaatagtaaatcggtcactaaacaagtttttttaggaaggtcagtaacaagtcggtgacctgtaggggtggcaacggggcggggcggggccgggttggcttggaatgcccccacctccaccctcatgcaggtatccccgtccccggcctcgcaaaggaagtcgggtgaaaaacttcacccgtccctacccccataggggacctggtgggtgaccgggtccccgcatcagctggatggagttaatactccatccaaatattgcaatacactaaataatagtatgataaaatttcaataaccctcgacagtgtgggtggattgaaggaaggaaagggattacgattgaggggactagggtattgagcttttatatgtcaactttgaatgggattgttgggtctatattattgtaatgggctacttttagagaagtaactcacatccgggacccctccgggtcacttgcgggttaattccgatccccatccccgttcctagaattttgtggggccccgtccccactcacccgcgggtgagaactctcccgcccctgtaggggcgggtcccctaccctaacggggaaattgtcacccctagccatacggcatgcgtctagacagatgcagactctagggtttaattgtcccttttgattcctatcatgttggggatgatgagattgagatgggctatgtcgcagtatgtaactcccacatcggggaagcaagaccccctttcgaagatttggacaaggggcgagtctaagcctgagtcaccctcaggatcaaatggacgtgatgaagtatacaggtttgagccatacggatgcgtaacatcttactcttgtgtgtatgtagactatcagtgatgaacttgtattacgatgagatataggacttatgtgagctctaattgctaaaagattcaaccttctattcattgggatagatcctccttttatatgccaagggaagtgcatagtgctaaaacttgcatctaagagcgggccctattccaaagagttgggtgtgtcttgtttcgtcgatgtcccctatagcaagatggcaggaagtgacatctttgctctccgattgacacacgatgcagaggcaaggtgatcttctcaccattgggcccaccagtcaactcttacaaggtggcaagattgaatatgctggagtgatatgggaggggcatgtccaccccacctattccttcggcagacatgggttctcgggaggctacatgcggcgtcatgtccctaagatgtgggtggatgagctgttctccaaacggctccctcctacaacggaaataataatattgagttggagttaagcccgttggcccaccaagcgaggtgaaaaaaaccccatagtgagcccggggcaatgaggtgtgctcgggcccctgcctagggccccaagtccattggtattgcgcattgagggtgcctccactccatggggcttgtttccatgcctggcgcactgagtttcccaggtctccagggatatttcctcttgcttctttacaggtttcttgttactttggacgagcttctcgaagatgtcgttaatgaacgggttcaaagtggttaccttcgtcaaagaagcaccatacaccttggagatattcttgtaggtctccaccctcttctcggtaccttggatacgtagatcttgtaggtttctacacttttcttaagatctgaatgtagatcttatacgtctcttgaagatatagattttgtacgtctcttaaatatgtaaatcttatatgtctatctcttgttgtgatacacatcatttggagccctgactattccagggaaccggggaccccattcccgttctccaaacaggccatattatagatcgactttttaagtcctatactgctgtatgcatataataatcaatacattttatgaacttggtcaaactaaaaaaattttaactgagaaaaagtcaaacaacttataatataaaatgggtaagtacctcttaagttcggccccactcatatcaagatgcgccactggttgacctgttctttgtcgaacatgttgccgtctgttagacttcttagagaaggactcagcaacttgtttatagcaattaccaattaacgtgggggcattttagcaaagctgcggagcatttaattattatgaagtggagtagataagttttcatttgttcaggctataaattgagaacagactctgccctctggtcacgcattctacacagaatctctggttttcccaactgtcagagaagtagagaacattccagcttagttgaacttctcacaaaaaaaaaaggtactccaggctgcctccaatggcggaccgaatccctgctgttgccgctgccattgccattgcctccctaatcctcgtcgttacgccggaaatggtctcctccggcttcattccacggttcaagctaagcccaaaggcaaataagcagatccgggacatattcaaggaccatgccgcggacttggccggcctcgccgcggacgccatccccagcaagggcgagggcgaaggcagcagcagtgacccaagtcaggccccggccaccaccggcggaacctacctcatcaccgtcggtgtcggcacgcctccgcagtatgtctacggcgcgttcgacatctccagtcagttcgtgtgggtgccatgcgaggagtgcgtgagcccctactcctgccccagcgacaaaaccggcgtttacaagacgctgccccgggagctttactcatgcggagaacagcgctgccggacaatcgtcgggcagccggactgcggcgcaccgtataatggcccatgcaaatacacctgcaggtacggtggtgcgggcggaacggaaacggaaggacacctcggcctccaaccgttcacgttaggtgacaacacgatgccagtcaatatgattttcgggtgtggcctcgaacccgaaacaaacttcggcgtgatcggcctaaacagggggagactctccctcatttcgcagctacaactcgggcggttctcctactacttcgcccctgaatacgacgacaccgccgccggcaacgcaagcttcatcctcttcggcgaatacgccgtcccgcagaccagcaatccccggtacactcagttttggtcctacgaaaacggtgcctacagctacctttacctcgttgggctctccggtatgcgagtcggcagcaacaacctcaacatgttgggtgcggggtcgggcggccgagacccactcgttgcgtacctcagcacctccgtgcccatcacctttctcgagaagaacgcctacgaccttctaaggcgggagctggtcagcacggtggggtccgacaccgtggacggctctgcgctcggccttgacctgtgctacacgagccagtacctggccaaggccaagttccccgccatggcgctcgtgttctgggacggcgcggtcatggagctgcagccgcggaactacctctaccaggacacggctaccgggctggagtgcctgacgatactgccgacggcggtggccggcgggctgtcgctcctcggcagcctgatccagacgggcacgcacatgatgtactacgacatccagatccagggccgcgggtcgctgtggttcgagtcgttcgaccagccgtccaagtcgtccaaccgggcgtcctcggcttcggctgccgcgttgccgcggatcatctcgacggctgcggcgatcgcctgttccgtgtggtctgtcgtggcgtgcatgttcgtgtgaactgcttgtgttgtgctacggatggactgagatatgtgttattagaactatcttaaaaaaaacttcgcaatttttttttataaaactttcaaatgtaagtatagtgtaactatattataataacttatatataactagaaagtaactacattgtaactcgtatataatttatacgtaactaaaataaaaatatccaaaaaattatatggcacggtggtagcatagatcctcaatgagctcaacggtgtgagatcaaattttagcagctacacttgctaatttattttttctcctatttgctagcacgaatcttaaagcaaatctaatggtctaaaattgaaagttttccccctaatctagcaattccgataagggttctcgaatgttggtgtgttctcgtatgagtttagatcggggcggtagccgcggtacgtctcacaggttgtgcagctcttgggacggcgctactacgagcgatgtggcttatgagtttgtctcgatctaacattccaagtctcgagttgcatccaaccccaatacgctgcaatctatactcatcgatttaagtaatagtaagagagagtgacatatggagcgtattgtgttattgactggttaattttcctttgtgatcagaacaaatcagatttttgactttcttttgtgatcagaataactcacatttttgccatccaaaacaaagtagtggacatacgcatgaatgaaccgataacaacatcaaattcaaaccgatgttattgaacatcctaagggtaagagcaatgtgtcactatatatatttagcctggggtgccaaatagactaaagaacttcaaaagccactacaaaatgcaatgtggcctaaaaccgagtcatttatgtttgaagacacacatgtggcatggcctagcccacggagccaagatttgtcccagcacataaaattacctatgtaccctcgaaatcaactagtacactgccctttgacgaggccggtacaaccatgtctcatcgcctcctcctaacagcatctccttcctctcctcctcccgcgccaccgtacgccagtctgacctcgccgacgatgaagctccggagtggcttcgtggctccggagcggctatccccaaacgcggcacagtctccactccctccggttccagccatgcacaggcttctctgaaactatctgctgctgctgctgaaagcctgaaatgtgagtggggctttgtttctttctttgctactcccgtgcatgtcttggatcctttcggtatggtctcttgctgcgccgtgtgagattcttgcatctgctacacatgggttctttggtaaagttggtttttgcctctttcagttcttggtctgcttcatctgtcttgttatcttccatttgctaatcctttgcattttatttgttgataaatggagacttgtgacctttcatctcttgctcaagtttcacctctcttcctgcatctcactacctgatttggtgcttaatctaatccaattcctttttggttcttgtgattgcggtgggtgattaggtgcttaacataatcccaatcctagaaaaacaggagagccggccatggctgtgattgccatggctgctgtacggcgagccactggggcaggggaagccggtcatgtcgccggagggcgtcgtgccgagagcacagactcctctggatcctcctccgattccaaccatggaccacgcggaaaggggaaaaagaaagcggcccgtgcgcgggagaaagagggggacgcgggaaagagggcgatggcgagggcaaaaccgggatgcggcgcgcgcctgggcacgagcacgaagccactcgccccacagcgcgccggccacgctttctcccagccgcgcgcagcttcgttttcacccaagaccgagttgcttcgttttcacttgcgaacgtggcgccgatttctccggatttgtcgacgtgtacgcctcaagccgaacgacaccgtgttgcattgtaaaggcctaatagaacgggggatcccaatgggcgatcgatcgtgggttagcgatcgatcccctctccctccctccctccaccggaagaaaattctctgcggcggactaccccaaaatcgaattcatcgcatcaccggagaggcagagaccaatatcacttccttcaaggctccaaccgaggagaagatatcaggtttcttgaagcgatattgaatattgatcctggcttctctttacaatggggtgctcattgggattggaattagtgtgctcacaagccctccgccgtttgagaaggggaatgcggtggatgatgccgaggaggaagcgaccgtcaaggatatcacgaatgagaagctgaagttggcggcacagaacatgccacgggagatggcggcggcggcggatgggtggggctccttggcagggggaacccgacgccccgacgggtgaggcgtagtcgtagaagccgaggagcgtcggcgggtggagcgcacgcacacggcggaggaaagcaggatcgttgacgatgcagcggaaccgaggaaggaggcgcagaccgcgcatgcgcggccgacatcagtgacggacgggaggcatatcaggacctccacgatgaggtcgtaggtgagaaccagctcctgggcgttgagtcgactatagagattggacatcggctcggctcgaaagaactcgggctacagtaaaaacttagacatgcgtcgctagactacgcggtgttgtacatgaagtgtcatgcggcatcgccgcagagaattttcttccccctccatctggtttcctttcttgggtaccacattactttcctattttagtaaatttgtacactaaagtttatacacctcaagtttacacatttaaggtttagagaccaaaagtttataagtcaaaagtttatatatccgattcaaatttgaatttgaattcaaatattttttttatatatagtatttctatatatcaaaagtttatagacctaaagtttataagtcaaaagtttatatacccgtttcaaatttgaatttaaattatatctaattaaaaattgaatttgaattcaaatattttttatatatagtatttatatacatctaaaatttatacacctaaagtttatagatccaaagtttataagtcaaaagtttacatacccgattcaaatttgaatttgaattcaaatattttctatatatagtatttctatatatataaagtttatacacctaaagcttatagactcaaagtttataagtcaaaagtttacctacccgattcaaatttgaatttgaattcaaattttttatgtataagtatttccatacataaatttgagtaaattgtatattggtcctggttttcttacctgtgttgcacaatggactggatgctaccccatattttcactttaatacatatgaagttaccaaaactttcatcttggactagtggcccacatatcatgtagaaagtgttttcttccatctctcccgtcttcaccgacgaatgcatcaatctcatcttgggcccgtggttagtgaccagcagtccagaatgagtgcagctttgttggtgtgatttgcttggggttccaattgaagtccgatcttgagcaacgcaggttggccaatggatggaccgagatcgatggagcgccaggctgtacgttgtacgtgccttcacctgtcaagctcgaggggcgcccgcactcgtctcccagtggcagcgccaacgacagagcccattccatctcgcgcattgcgtcagccggtggagcggtcgtcgacgggcacaacctatggagccgacgagcggtcatcttcaagagggagggatgcagggcagagctgcagaggacatgccagcggccactcgatgttcgtgcagcctgctaggctgctactgctgcattactggggaagagatgagctctgcccgatcaggatagggactaataaaagaggaagatgaatggctgaggctaacatgtgagtcaactagtccaaattgcatagtttggtaacaaaacctggttcaaagtgaaaatggttgtacgttcctagtccagtatgcaacttatgtaattaaaactagtccaaagtgtaattcactccataattttttctaactttttgttttttttaaaaaaattttatggtgtactgtagtaggaagataagaaggggaggagggaggagtgtatcgagtagtataggggagagggcaggcaggtgatcgctgggcggacaggggagcgatcacccgcccattagcatttccgtaatagaataatgttttatgaaaaaactaatgaactttttttgaacgaaaaattaatgaacttcaagtagcgaaggaaggtaaaatagagagtagctttcacgaaaccatgttcaccaccagcacgagtgcacaacccaccccacgaaacaggcgatcgtcaccgccgccgggaattaaattaaaggccaaaacaaacactgtacaacaaaagcgggaaaagcaaaacaagaaaaaccaaaattacaggagataagggggaagagaaaaaagaaagccacacagggaggatagctctattcgattgcttgaaccgatgaacccagagcttggcatcttggcagcaacatctgaggaggcggcttatggatgggagttcattttggaacacgacttcgtttctatggttccagaggcaccagcagcagagaagaaacaatgtgttgttcaacggtaccggggcaccagcaaggttgttggtgtgcagcatgaagagggttgtcactgacggagtgagcttgatcaaattccagaaagctgatgaaaaagggcaatcgaggaaaaagtgatccgtatcttcaggagagctctggtagagctcacatgttggggatgggagaatcttctttttgtgtagatttactctggtcggaagatggttgaaagctagaagccaggcaaagaatttgatcctggggggggggggctttgcttttccagatgtaagcccattgaggccattcctgaaactttgccatttgtagctggtagagagctgaagatgagatgacaccatttttgcatttggttttacatattagctcatcctgggtagccgagaggggggattgctacaataaaacctgagggtattgagctgattatgcgcttccattgaaagacgtgggacaagggtggcagccaggccattttggataatggcttgcactgtgcagtttgacttagtagagtgtgtgtagagagcttggaatcttgaggcaagaggctgatcatccagccaaatgtcgtgccagaaattgttgcgcctgccatctcggacaaccaaattagtttgagatctgagaagtggaaacagggcaatcaaggatcgccagtgggggcccagggctgaatcagcatgctccctccatatccaatttgtccagggtgaattctaggtgtacagtctgtaaagcatcttgatgagaaggcagatgttttgtgtgtgaaggcgtttgattccaaggccaccttgctttttgtctatgcagattaagtcccatgcaatgaagcatttcgagccgtgacatgattcctccccagtccataggaaagcccgacggccattgcataggtcggtagaaagtctagcactgagttcaccaagaccgccctgcctgcatagtttaagagagaggcctgccaccccgctaggtatttgttaacttttgctatgagtggttgaaaggcagtgaggggtagcttagtagctgatagtggcaaccccagataagtttgaggaaaagattctagcttgcactggaggatgtctgctaattctttgctggcttctggtggagtgtgaagggtgactagggtacttttgctgaagtttattcagagacccgtggcctgtgcaaaggagttgagaattgtttttagagcacttagctgggaggcttctgctgggcagataataagtgtatcatctgcatattgtagggtggctcctagcaggttgtgaattattgggtgcttgatagcactgcaattcttgatcatctactgcaagatatcagcaaccagaatgaacaggtagggtgagagtgggtcgccttgacggagaccttgagtgcagtttatccatcttccagggatgccatttagcaagacagctgacttgcttgaaattagcagagcttggatccacttctgccatcaattagggaaatttctagctctcagaatagcttggaggcttgaccattgcactgagtcaaaagcttttgcaaaatccaatttcaagacagccgtaggcagcttacatttgtgacaacactggagaatttctgttgcatatagaaaagtttctgagatgcttctccttttcataaagcctgtttgctcccagtctatgagactgccaagaacggattgtaggcagttagcaaggactttcgacagtagtttgagatggcagttttgcagtgagatgggtctataacaatatggggagtttagtttaccgggtttgtgaatgaggactatgtatgctctgttaagtctttcaagctgggcagagtggttgtgaaattcagtcaacaagttctgtatgtagggcttgatttgctgccatgctgccttatagaagcttggaccaaaaccatctggacctggggcattgtaattatccatgcagtccaatgcagactttgcttcttgaagagtgaaaggttccgagatctgctgctagctcgcattgtggactgtattctcagggtagagatcttggagatgaaaatcccaggtggtgtttgctgagccgcccagagtttcgtagaagaactcgtaaagcgcatctgccttggtgtcgtggtcgaaaacctgcgaaccttgtagcaggagggagtggatgccattgtttctgaacctgtgtgacgcgtgtgcatggaaaaatttggtgttctcgtcagaggctttgattctcttgatcttgctgcgttgcttccagtagattgctttgcatcgatggagatcagctaacttgtcttgaacgaggtcccgtagggtgaattccgcagtcgagaggggcctagcttcttcaatagagtccaggaagtcgatgagcaaagaacagtcagaaatgttgtcgttggtcaacttgtgagctttgatccaattcttggtggcgaaacgtgatttcttcaggttagcaacaaggttgccagccgcgtctgtggggtggtgagtgggtagttggcccacccaggcccaaaggatagtggggaggaaatttggggagcagagaaggtgattgtcgaaacggaaaacttgagttttgggtattgaagtggaaatggatatttttagggggacgtggtcagaggtagtgcgaggtagggaggagagggaggtgtttgggtgagataggttccaagcttggtttatgaaggcacgatcgattctagaaagggtggggatttctcttttactggaccaagtaaagagccaatcgaagagcgggatttctaagagcgcaagatcgtcatttttttcgttgaagaggtttgctaagtggaggtcgaagtttgagttgtttttatcataggggtagcgagtaagattgaaatcaccaaaaagtaaccacgggccagagatattggtggagagctcggagaggtcttctacaaagatggcttttgtttgtgggtctgttgaggcatacacattggtaatggcaaacgaaatgtttgagatattgtgggtgaagccgattgttagggtatgtttgcgggagatgaggaaggatttggttagggtgttggattccaaaccgtaaggagaccaccgctcgtggacattgcaggggtaaaatcaaaagcactgaggaaggacggcaggaaagaagaggtaatcgggtggtgaatagagtatagcttagtttattgaaataagacaacggagaaagcagcggagctaactgaattaaagataatggggcgcttagttaagtctccaagcccgcgaacattccaggacataatagatagagttctaacgttacttgacatatgataggaaagacaccaaaagcaaaggaagggggggggggggggggacgcatctcaacagggaagaactgcagggcacagcaccagcaccagagcgaagacccaagacagcaacagagcagcctcccttgaacaaaagattgtgtgattgactgattcatatgccttccgtgagcaccagttccagctctttggtggcagcctcgtcgaggttacagactttagccaggtctttgatggcagacggtgaaacatgcatcgccagatcattcaacaggttgtgtgtacggaaggtgtgttggagattgatcgaacatgaggctagctaatattgctaagttttggtatgatttcttatttatttcctagagtttagtaagaaactaaatagatgtatatatttagcaactttgctaaaaaatggtatggtttgaaatgacgtcaatctaaacaagccctattacagattctctgtgtagaattgacgactgatcgagactgcacggctatttatagcctcggtcatgagctaattacagttagtaaaacacgcagtatagccttttaccttaaactggaaattaagtaaagatgctcatacacatcgagggaagatgaaaggctgatgcgttgacctagctcgagttgcttccgccttccggtgatccagttcatcactggctcatagaaggacgaccgggtccaggcctccagggcgatgaacttacctagtagtagaacctaagatacaatcccaagacaaacacttccgaagagtgaagctaaggaggggatacttgagtagctacagctagtgataagtaaggctgaaacattcaaagcaaaagaaatgcttaattttatatgccacttgtctttcgttttacctcagaattcttcggtatattctccgcaagtcggcaacaataggaagatggacgtgctggccattgcatgcaagaagagccaaggttaggttcatgcatcgtgtcgattggggatgaaaattaataggtgaggacgcgttcaaaaaatgatcaattgctcaattgttctcggcaacataaactgtaactcgttgaccacgttgatcgtagcttaatttgatccaagttaatagggaagatttacctacatttgtcgacaaattttctctaaaaaattgacaaatgtaactataacataatcgttgtgaaattacactctaacttacatgtaatttgtatggaactttcaaaaatctctttgtaactgtcagggttacgggttcggcataccctttacccttcgatatacgttgcatatcgatatggcatacccacgcgcatgcggatatttcctgtatattctaaggaaacctttcgcgtaatttacagtagggaagaatcctacccggacagaactgggtcgttgacgtattgtatagggtctgatacctccaagttctacttggagaccaccagatctgcgatataaaaaggaccccccggggagggcttaagacatcgaatctcgaaaccaacacaacccacacagtctacgaagccggagcctacaaggagcaaagccattgagatccagtcgaacctactcgactaagatctcgctggatccgacaagttccatcgttctctttgtaacctgtgttttccaccatataatcccacatcaactagattagggctattacctatcaaggggcctgaaccagtataattcttgtcttttgtttgctcgatgtcatactacgtagatccttgtaccaacataccccaataccctctatatccggtctacgggtatcacccgtcgacagtaacatgctatttcgataaaaaccggaggttttgggaacgaatcctcccacatatgtacgcgcagtgacttttttctttctccactcatacaaatcttgaagaaatctaacggttcaaaattatgtgaaagttatatgcaaattatattatagttacatgcaagttaacagtgtaataacactacgattatacgattatactgtaattatatctattaaatttttaaaagaatttatcgataaatatataacaaaattgtttcggatataggtccactgtaataggttgtcaactgcgagccgatataaagcggcggccacaagacgacatccaaggcccgaggatgggattcgatcgagtcgtgggctgccgacctgccgtgctgccatgccatggatcttatttgcatgtttcgtgtggtgtgttcttggcgtgggaataagttcactttaggtccctcaatttgtccccgaaccacaataccagatatgtgcatctctcaatttacaaaaccagtgcaaagaagatcgcagggcggtttggatgacggtttcgactgatgtaacaccatacgcggcgttgacgtggcacgggacccacctgtcagtgagtatctaattaaaaaattaaaaaaaaacactgaggccacgacatctctttctcctctcttctccattcatctctctccatttccgattccgagtcgtggttggcgcaccgcgcacgccgccgctcttctggacgacaacgggcggacgggccccctctcctccttcttctcctctgaaacggcgagagcagtggtggtcgtcggatccgcgtccgtcgcgtcggcttccgccaccagcttgggcagaatgaggaagcagctccgtaccacatgtccttcaccgcaacatcgccggagttggacggccccaatgtaaggcagctggtgatgcgctcgccgtcggtccctgctactcggccacgaacgtcaccataccgtaggggaaggggaggagggtgccccgtgccgtccgccgtcctgcatccggccatccaccgaagtgtcaccatctcattcacggagtatcaaatacgacaacatgaagaagatgaacgcacatgtgatggaggagaacgccatggacgtcgtcgcgagctctgcgcaagaaagaacggcacagttgcttacagttgtaagaagcaacgagtccattgattaactgatgataaaattggcaagaaacgtaatgccaagatcattaattacgtcattctggagttcatgtgattcccagtcaattctgatttccctccaactgaaatctgcatgacgaacagagccaaaggtgagatttttacaggaaaatgctgtctttttctgaagaactaggtgttggtttgcaattactgcccatgtgaagagcagtgctactgctatatctacaggtgtgctcccagaattatgtaactgcagccaagcaacaaaagtttagcgaaaaaaatgaacagatcatttggtgtcattttcatctgcagcagtaacgagaaaaaaaaaaagaacggatgcaggatggcggacgggcatcctcctccccttcccgtccgggcgatgttcgtgaccaagtcgcagggaccgacggcgagcgcgtcaccagctaccttacgttggggccgtccaactccggcgatgttgcggtgaaggacatgtggtacggagccgcttcttcattctgcccaagctggtggcggaagccgacgcgacggacgctgatccgacgaccaccactgctctcgccgtttcagaggagaaggaggaggagagggggcccgtccgcccgtggtacaccttcgtctagttgctctctatttatccggtttgcatggccggaggtaattcgatcgcgaccgggacggtaaatccagctctcacaagaaatacgcacacgccttggcagcgcgcgcagccaacgactcgaacgtacttacgtaccccatcgtcggcccttggatcgatgccgacgatattacgccgtacacgtacgtagttgcacgtgccaactgccattctgccaaccgtggtatatatcctcgtacgctagactacagctgtatgtgacaccgtacgtggatatggtctcagttttaggtgttgtggccaccggccgcctgttatcggcgtcctcgcagactctcagttgacaatatagctaatacaatggacctgtatatcacggtcaacattaattaataggactagctatatttatggcgtcatattttttttaaaaaaatagttggtatgtatttaaattgtaagtctctaaattacatatgtaattttagtatatttacaatgtaagttctaaaattacatatgtaagtcttaaaattatatattgtcagggttacggataaggtataccctctacccttagatatacgctatacatcggtgtggtatatgtgtgcgtatacggatgttttttgtatgcgctaaggaaattcatcacggagtccacagatgaaaagattcctaaccggataggactgggtcgtcactgtatcatgtagaatccgatgtctccgagtcctacttggaaactacctgacctgcgatataaaagggaccccccgggaggacctaaggcatcgaatctcacatccgagacaaccaccatagcctacgaagccggagcctacaggagccaagtcgccgggtgatctagtcgactcgactacggtctcgtcggtatcatcgagttccactgttccctttgtaatatgtgatttccatcatataatcccatatcaactggattagggctattacctaccaaggggtcagaaccagtataattcctgttttctatttgcttaatgtcatattacgtagatcctcatactagcgtaccccaataccctctatatccagtctacgggtatcccccgtcgacaatggcgcgccaagtagggggacttggtgctcaagattctactactatgtcgtcaaatctcgtcaacaatagcgtcgaccccatcgtcaaccaaggagttccgacttcaacaatgctggtgtgtactcaagtcggtgaaatcgtcttcccgatttacaccatggtgccggtctcgactggtccatcaatgaccagaagtgagaatgccgtggccgtaaccccggacgaccccctgtcgaacgatcctcccgccgaagcggagaaggaatgtcgacgacatccaagcctgaggaagatcttagtgcggccaaatcttgtccttccgacaagaatcacgagccgacaaggacaacttttgaggcgacaaggtcctggtgtcctattcacaaaactaggaaatacaccctgcaagcttgctgggtttttctcaacgcacaagctgagatccgtgcctgcaaagagcatggaattcagcgtacttctccaactcgtgatatctattgtcctatccacaagacaaagaatcacgacttctcaaactgcaagattcttctcaaagccatgaagacgtcgcctcctaaggtccagtagtcacaaattcctcctagagatgtgaacaaggaacgaggagcgacggtcatcccagtcgattcgttggggtgatcgacatcgatccccacgagccatcagtcctacacttgctcgaagactatggctcattgttagcgagtacaccacatgacgtatttgctatcggtgggaccagcacgtctgcgcacgctaatgcagaagtggagaatcaagcggccacgccggcccaacaccttgggaccatcaacgcaatactgagagaaaccaccaatgatcccgtactcaacgatgatctcgcacggtggacagaacgactacgggaatcagtagccaatctcagtaacgcgttcgaggaggccactaccagagcacagacagaacaaccgacagctggcggcgccgacggcgagccaccggagtaacggacatcgcctcaatgagccacccctccgcctcacagcaccggcaatctccacgaccatctgaacgaccgccgagaagcgcgaggcgcgcgagacaacgagaatcgttcccgacatcgcgtctcttcgcgacgtcgcgagaacgaagagcgaggaggacgctcgggcgagaaccgagaccgtgatgaccgccacaaccgccaagagcgcgatgatcgcgaacagcggatgtcgggcgatgttggtcgaggacgccaccataatggtgacgatgacagagatcggcgcaggaacgacaatggtggacgatgacaggattcccgagaactcggacgtcatcctcggaatcgcacactagagccaagtgacccgtcgtcatcgtcatcatccacttcatcctcatcgtcagatagacatccacgaaggacatatgatcgccgacaacccactgcccccagcgtcgggtgtagagctttcaaccgttcgctacgtgatgtccgatggcctgagagattctgaccgggagcaatagagaagtacgacgggagtaccgacccagaagaattccttcaggtctactccacggtactctacgctgccggagcagatgacaacgcattggcaaattatctgcctacggcgttgaaaggttccgcgcgttcgtggctgatgcacctcccgccccactcgatttcttcatgggcagatctgtggcagcaattcgtcgctaacttccaaggaacatacaagcgtcacgcgatcgaagacgacctacatgcgttgacacagaatccgggcgaatctctgagggactatttcggcgctttaatgagtgcagaaatacaatccccgaaatcactgacgcctctgtgattcgcgctttcaaaaccggtgtcagagatcactatactacccaggagttggcgacaaggcgaatcacaactactcgaagattgttcgagatcgtcgatcgatgcgctcacatggacgacgcactgagacgtaagaacgacaagccaaagacgggaggggagaagaaaccagccaaagacgcacctgaatcaagcaagaagaaaagtaacaagagtgggaaaaggaaagctcaagtggaagtcctcgcgtcggaatatgagtgccctcctaaacacccaaaccggcagcgacacgaagagaatatggtaccccatacacaagtcggacagacattctctagaggattgcctcgtcttcaaaaagtcgctggaaaagcaactggcattggagaaaagcaagcgagtacgggtagtcgagaaagctgccgaggcaaccactcaggactcggattcggcatatccagattccggtctccatgtctcgcacatcttcggaggttccatggcatactcctcaaagcgagaatacaagaaagtggagcgtgaagtttgttcgacatggcagggggctgcacccaagataaagtggtccgaacagaagattgagttctcagatgaggaccaccccaaggctgctgttatcctaggacgatatccgatcgtggtcgaacccactattcggaatatcaaggtagcgcgagttctcatcgatggcggcagctccatcaaccttctctttgccagcaccttggatgcaatggggattccacgaagtgagttgacacccaccgatcaacccttccacggaatcactccttagtcatcgtccaagccattaggcaagatcacgcttcctatgactttcagccaagcgagcaacttccgaacagagcagattacgtttgatgttgctgagtttgacacagcatacaatgccatcatcgggagaactgcactcgcgaagttcatggccgcatctcactacgcatatcaagtactcaagatgcccgggccgaagagaacaatcactattcaagggaacgcaaagctggccgtccaatacgacaagcgaagcctcgacatggtcgagcacacgcccagcccacccaccgcaaccgagccacccaagaaagtgagcaaaacaaccaagacgccgaaaccagaaggcgtaatcaaaatcgttccactctccagcgccaaccccgacaagacagtcaagatcggggcatcactggacgagaaataggaactcgcgctcatcaccttcctccgcgacaatgttgacgtgttcgcttggcagccgtccgacatgtcgggggtccccagggaggtgattgagcacaaactcatggtgcgacccgatgccgagccaataaaacaaaaactgcggagatttgcaccagatcgaaaacaggccatacgagaagaagagctcgataaacttctcaaagctggtttcatcagagaggtactccatccagagtggctagccaacccagtcatggtgcggaaggccaacgggaagtggaggatgtgcgtcgacttcactgacctcaacaaggcgtgccccaaggatcacttccctcttcctcaaatagaccaactggtggactcaacagctgcttgcgagttgttaagcttcgtagatgtttattccggctaccaccaaatcagcatggcaaaagagatcgaggagaagacatcattcatcacgccgttcgctgtattctgctacgtttaagatgccgtttggactgataaccgcaggaaacactttccaatgcacggtccaaggggcacttaacgattagcttgggaacaacgtcgaggcctacgtcgatgacattgttgtcaagaccaagacaagcgactcattgattgacgatctacgggaaaccttcgacaacctccgacgatatcgcctcatgctcaatcctgagaagtgcacgttcggagtaccattgggcaagctgctcgggttcctcgtctcgggcagaggaatagaagcaaatcccgagaatatcaaggcaatcgaaaacatgaagtcgcccacaagactcaaggaagtacagaagctaactggatgcatggcggcactaagcaggttcgtcgctaggatgggagaacgaggacaacccttcttcgttctgctgaaaaaacaagacaaatttgtatggacacaggaagtcgaagaggcgttcatcgcactcaagtgctacctgtcaaatccccctgtacttgttgctctccaacctaatgaagaattattcctctatattgccgccacgccatattccgtgcgtactgtcatcgttgtcgagagagagaaggtgcaaagaccagtctactacgtcagcgaagctctccatgacgtgaagacaagatatccacagacccaaaaactgctctatgcagtaatcatgacgtcaagaaagctacgccactacttccaagcccatggggtcacagttgtctcctccttccctcttggtgaagtcgtgagaaacaaagacgttgtcggccgcattgcgaaatgggtagtcgagctaagccagtttgatgtctactttgtgccacgaacagccatcaagtcccaggttctcgccgactgcgtagccaattggactatgcctgaaaataggttagacagtcaaaccgacaatgaaacatggataatggcgttcgacggcgcactcaacagccaaggagcaggggcagggttcatcttgacatcaccttcgggagagcagttcaagcatgcaattcacctcaacttcagagcaaccaataacacagcggagtatgaaggactactcgctgggataagagctgcaaccgcacttggagtcaagcaattaatcgtgaaaggggattccgaactagtcgcaaaccaggtgcacaaagactacaagtgctctagcccagagttatccaagtacctcgcggaagtcaggaagctggaaaaaagatttgatggaatcgaggtccgacacgtataccgcaaggacaacatcgaaccagacgatctggcacggcgtgcatctacacaggagccactcgaacccggcaccttcctggacgtcctgacaaaaccatcggtgaaagaaacaaatgacgaaaatagcacagtcacacccgacatctgctcgggggctacagaggcagaatgcgtcgttgctgacatcgagacctcagatgactggcggatcccactaattaaattcataagtagcgacgagctacccgaggacgatgcaaaagccgagaaacgacgatgtgaaccttctcgaagaacatcgagaacgagttgccgtcagagcagctagctaccaacaggcccttcgccgataccatgagaagcgcatccgagcacgcacgctttcgatcggcaactacgtcctccgacgggttcaaagccaagcagcgcaaaacaagctctcacccaaatgggaaggaccgtacacgatcacgcaagtcctgcgaccaggcgcattcaagatttcagacggcgatggtcgcgagttggcaaattcttggaacattgatcaaccacgtaaattttatgtataaatcaatagcatccatacttgtaagacatattacctcttcaataaagtcttctttcaggaaaagattacaactaaagtgttccttcccgatgatccattaccccgatgacacctagcgttgaaacctatcctcatgtcctttacgccgtcttgacaaggcctccgaggaacctaagggaacttcggctggggacacccagagccgataaggccttgtcggatcctgtagagacgaaagaccatgtaagatctggtcgtgtaagagttctcgtcgtgcgtattaaccaagccgtgtaatcggaaattggattttccaacctcacggctaggggctaggattagtgtttgttcaaccaaggcaggtcaaaggtccaagagccttatcttccgagaagaattctccgatgacaaggctgggggttagggagagtgtatgactcaagtgactgatcgaagtcgctaagtgagaagacactcgcacacaccgcatacagagtaagaaagctcagttagatagatctcttttctatttcacaagtattttttacagctcgcaaaaattgaaaatatattacaatctaccctgagatgtttgtcacaggatacagaaactaccagcaagtccaacgccaatccatcgactgaaagattttctccgcaagcggtgccattgacttcgccaggtggtctatctctgcgggagtccaacgagaacgtgcaaacccttcgtggaggaactcgaggtgcagctgcggacgattatctcgtatacaggccaacacgtgccctccggcatatcggctcgatcgacggcactcctgcttcaaggcctcgtcgatacgcttgccgatgccttcaagttgggcacaggccccattcagccacgagatatacccggccaccgactcctcgggatccccgcgagatacttggagttcccggcagactccggccatggctgtgcaacaactcctgaggtacgagttgaaccacacctcacgacctcggagtgcttccacggcctggtcctttttcacttccaacatagtcctctcaagttctgccacctcaaacttcgtcctctagtattggatgcgatgatctcggtcggcaagcacactctcgaagtctgctcagtatggaagcgactaagtcaagctgccctcctctctcgagaacgcagcaaatcaagtcaatccagctgaaagagcaaagaagatgaaaacaaaaaaaaaccaacctaaggaagtcgtcgccacacccgtttccacggacaagttctgatctacgtcgtcctgcaacacatacgactcgaaggcaagtgccggaacgatcactggcaactcaggctgcccgcactgctggacatcctcgacatcgatatctctacaaacaacaacaaagtactcaggatcaaaatgctaaagaaaactaaggtgatgactgcacacacaaaggcagttggagccaacaaaagttttacgaagcataactgattaaggagtacagggaaactgaagtcctactcttcaaaaagggggagaacagactcccccaaatcaccgacttcttccatcacacccttacgcgcgtcgttagccgccccctgatccaggatcccctggaggtcgagttcagggtgcgccaaccttacgcacgcgaggacgtggcacgccccgatgtagatcccgttggacatatcctctctgatccttgccgcatgcttggaggggatcgcctccattgccgtcgcagttctgtaatcgaagtcgtcagcgagaactcatcgggattcgccgggatcgtggtcgtgacaccacactccccggcgaactggtgcaggccagtgtaggtaagccgcagcaagccacggaactctgacaggttgttctcgagctccgacatgcggtgctcgagcccctgctgttgccgctcgttgccggccaccagctccctcatcttctggaggtcctcgcgaacctccgccaggtaacgcgctagcttgtcgacgcgttcgttcgctgacgccgccgctgccgccctcgcctccgcaatctcgcggcctatgccgcgagcgctggcttggaggatgcgccttatctcgatttggagctcctcccaagtgaggacgtcagcgggagggcctcaagcaggcacaagaccgccggcagggccgctgggcgttgcctcacggctccgaggcacgaccacgacatctgtcgaggccgcagcaggagacacactggagttccctccagacccgtcttgcgctgccttcgcccgcgccaccctgtgaaagattgctctcaagacaggctacaagagttcgacgaattaacaaaacctcaaattcatcctcttacttctcgctaagcgttacaagcctatgccggcgcggaggcgggggagacgcgtcggaggcctagagtaaaaacgagcatgatgtgaggtcaagatcttcagtgatgaagggtcgggagagcttaccgatggggtgggcgtcttccgacgatttccgagcacggaggagaacttcctcccccttttcggaacattgccgccactcatcgtggcagcagcggcagcaacatcggacgcctccttggcgacgtccaccttcagcgaagccgccgcctggtggtccacgagcggtccgatgatatcagtaagagggagagcctgcactacataaagtcacaatgcgatcccggaggaaaaagacaacagggccgtcgagtacactcacattgatcgcggcttcgcgttcagctggctccttctcgcaaagagggacggggacgttgctcgccgttgtaggaccgctgatcatcacttgaccgacacggtgctccacggtttcgctgttcaattgtagatcgaaaaccagaaatgataagtcaggaggaatacacacttaaggaatggagtccaaaatacaagaaaaataccctgaggagaaacctgggtcacgtcctccggcccagaatagtgaaagggtgggtgggctcaagcctagaacagctggatctgcctacgaatgaagtcggcagcgacttcataccccgacaatccttgtactcggaggtcatcgatgatatcgatgaaggactgaagggaaggggttaaggcgggtttggcggtgcaagaagaaatcttgtctggttgctcctcagggacaacgaagactggatccgaattttctatctgaagatagaaccacctcgcccgccatttactacgagaagaggggcactagaaggggatgtagcgcgacttcaggccatcccaaagtcggaaaccaacgcatccagataccctgttggatttcatccaacgcaactcgtagtagaaacgaaagaggtcgagaaatggctctactccaatataggcctcacaaagatgcgaaaagatactaaggaaggcgatggaattggggttcaaatggagcaaagaaagaccgtagaaattcaagaccaaaagcagaaattcggaaggaggaggaagaaaaccacagagaatgtagtcctcaactgcaaccatgcggcccaggactggctcagggtcagtacctcctggttctctctccatggccccgcaaccggggagagcgccgtcctcctgtaacttcttcagcgacgcgccggtggaagtggatttgtcgagatccattgccgtcggagatcgtcggaggagggacggagatgaacaagctagggttttgcgggagcggagaagatgaggagcgcttagagactgaaaagttctttcgcaacaggcggacttcaaaatggatccccaaaactcttttaaaggcgcactaccggcggtgcgatttccaaggaaagaggagagatgcccgccgaaaatttctgggtccgttacgcgcggcagtttttggacttcaatttaaattcactcacgaccgttgaacttttcatagcgttgtcgattactctttgtctctacggtccttacgccgagatcgactagacgagaacgacaacaaacccaacatcagaagtcgcgatcggttacatgagttcatttaagtagaagtcgggggctactgtcagggttacggataaggtataccctctacccttggatatatgctatacatcggtgtggtatatctgcgcgtatacggacgttctttgtatgcgctaaggaaattcatcacggagtccatagatgaaaagattcctacccggataggactgggtcgtaactgtatcatgtagggtccgatgtctccgagtcctacttggaaaccacctgacctgcggtataaaagggaccccccccgggaggacctaaggcatcgaatctcacatccgagacaaccaccatagcctacgaagccggagcctacaggagccaagtcgccgggtgatctagtcgactcgactacggtctcgtcggtatcatcgagttccactgttccctttataatctctgatttccatcatataatcccatatcaactagattagggctattacctaccaaggggcctgaaccagtataattcatgttttctatttgcttgatgtcatattacgtagatcctcgtaccagtgtaccccaataccctctatatccggtctacgggtatccccagtcgacatatatgtaaatcctaaaattacatattaattacatatgtaagtaatgtgtaagtggggtgtaactagtatgtaaatttgtataaatatataattacaacaagaaagttgactactacaaacccatagcaattccggatcaacaaataaaataaaaaaaatgcaaagggataaacaggtggaggaacggatgtgcatcgtgcacacgatgtccagcgcagcgcatcccagccgttaaaatccgactgtactcagccacgtaatgtggcgacactttttcagcaaatccgttaattaattcttccctagctattaacttggattgtcaaagctacgatcgacatggtcagcgagcaatcgaattacagtttatgttgccgagaacaatttgatcatcttttgaacgcgtgcatcctcaccaattagttttcagacacgatgcatgaacctaattaaccaatgctcttcttcttttatgcatgcataaacgaaagatacaatcccaagacgaacacttgcaattgccgacttaccgagaacaatatactatcttctactgagttgatctgaggttaaacgagaaagacaagtttcatataaattaagcatttcctttgatttgaatgtttcagccttagtgccttacttaccactagctgactagctgtagctacttgatcaagtatcccctctctacttcatcactcttctaattgcaagtgttcgtcttgggatttactggagccggtcgaagagtgatgggcacacagtttagtactccctccgtttcaaaatgtttgacaccgttgactttttagcaaatgtttgactgttcgtcttattaaaaaaattatgaaatatgtaaaactatatgtgtacatgaaaatatatttaacaatgaatcaaatgatatgaaaagaataaataagttcttaaaatttttaataagatgaatggtcaaacacgtactaaaaaatcaacggtgtcaaatattttgaaacggagggagtattaagtagggaagacttaagtcgttgaccacacagtttagtagttcatcgcccttgatgggcatcagaaaatttactggacccggtcgtccttctgtgagccaactaatctggatcactggaagtcagaagcaactcgagatcaatatgtatcgatcgagcgaaaagagaactccatctggtaggaatcttcactgttattttagacaacagatcgaggagagttgtcatgataccatattttaccatgcaccttgcccgaagctgtgtggtcaacgacttaagtcttccctattaacgtagaccaaattaagctatatggtcaatgtgctgtgctgatagaaacgctcagggatcttacgactagcttcacaaggtagcggtgggctaaacgatctgggttcgaagcatcacccattctaattactccctacttccctaaacgtttgacgccgttaactttttaaaagatgtttaaccattcgtcttattcaaaaacttttgtgaaatgtataaaactatatgtatacataaaagtatatttaacgataaatcaaatgataaaaaaagaattaataattacttaaattttttaaataagacgaacggtaaaatattttttaaaaagtcatcggtgtcaaatattttaggatggagggaatattttatatgaccaatgcgctattcttagtacattttattactaagaaatattggtcataagtaaatctttgtgtgtgtgtgtatactgagtaaattaatgtactatatagataaggaaacatttctttccgttgataagcaaaacccatatctatatgtatatagtagtaaaatttatttatagatttcgtgttgttaacaaccaaaagtagtttggtagtgttgcgtagtataactgcgtacgtgccaattaattagaaaagagttaaatgcataatgttcaacacgtttagtttaggcatatagtctgacgatgacgggtttttagttagtatagggttacagttttaggagatgcatgtatgtgccttctttgtgtaatggaaaaaaaaaacaatcataactgaagcttcacggtctacatgttcatctttctttttcccgacagcaagctacaaagagcctaagacgacaaacaggtaacataagtgttgtaatagaaaagattgtcatgtatgtttgcggagtgatgtattatatattgatctatcttattaatttttttaatttttttataaccatatagttgacatacaataaacgggtggacgttaacccgagtgattagaatccatctcccatgctatggggaaaccgttttgatcactcgggtggacgtccacctatttgttgtatgttatctatatagttatgaaaaaaaattaaaaagatagatcaatatataatatatcactctataaacatgcaggttaaaatttaacttgtacagattgtaataaaaataacaaacaaaactccacatgctatgcaataggaataggatgagaaagatatccttggaatgcaggattttaaaaacatagagaaatagaagaaacgtaggagttgattgtcatatgtaagcctgctaatggcctaagacccgccccattcccaatccacaccacagcagttagctcaaatagttcaaaccaacccaacccgcaaatctcctttcagaatccaaaccaatccaatccatttctcacctcagtccacaccgcactaacccattcccttcctatggattcagtccaccctgtcaaaccatttcagaccatttagaatccacccccgaccacaaacccatttgattcaccatcaaccagaacatgcatttcgtcacgcacagcctgaacggcagcagcaagccggcgttcatagcgtcgacgacatgtttgtgtcgacctcgccgtctgtcaagccgagcacgcggtggccgcgatgcagcttgttctggcgccgccgccatggtccacccgtctggcgccaccttggcgtcgtcgtcgtcgtcccgtggaggctacatgttgagcgaccggctctacagcccatctcacgtccgccgccagcagatgctgctgctacaacagcagcagctgctgcaggggcaacggccgccttcgtcctccccctcgccggcgacggcgcccagggcggcgaggcagaagccgctgccatcgccgccgccgcctccctttccggcggaggcggcgaggcagaaggaggtagagaggcaggtggacgcggttgttcagtcaaagccgtggtgtcgccgttgccgtcctccgcggatgtgaagaggccgccggcagcggaatcggtgccggagccagcgcgagcggaggaggaggcggccgtgatgcagcttgttaatcgaccagggaacatgcatcgtctcatcgaccgctggagtgtgttgtccacgactgagacctgatctagccttcttagtggaaaccattcacaatccatgggttcaatccatggactgaatccacattatactcaaaaaatcataaccatcaccaaaccgccccaatcctcttttccggtggatccaaatcgatccaacccatttatagcgtgtgcccatttcaatccaaccaaagcaaacccaaatacaaaaccaatccatttaacccattccaatccagtccattagcaggcttagtcatatgctatacaatgctacaaaatttcaagcagagtaagggtgagtttgagggataggagattgagaagattgggaagatacacaaaatgagatgagtcattagcgcatgattaattgagcataaactattttaaatttcaaaaatagattaatatgattttttaaagtaaatttcaaaaacgcaccgtttagtagtttgggaagcgtgcgcacggactacgatgtgttttctcaccctaactcaccagaaccaacgctccctaacaatagaagtgatgtcttttgaaacacagaaattttaggggaagtgttatgtgaaagagagagtagagaaagcacgggagagtgtgcattggacttgaaaacgagtggaaaatgtgattgttttagtatatatgaaccaactccaagtaatgttttgactcggtcgatcaaatttgccagccagctccgatccatttaaaggctataaatagcagtacgtccagtgttgtaatcacgcacattccacacagaataattactcttgtttaccataagtaatctatcagagaacattgtagctctctcttcgatttgccacaagaggtcgatcgggttgccttcaatggccggccgagcccccgccgtcgccatcgccttcctcgtcctcgtcgtcatgccgggaatggcctccgccggaaagatcccacggttcttggtaagcccaaagacaggaaaagcgttgcgggacttcttcaagaaccacgcgaaagacgtggtcggcctcctccccaccggcagccccagcagcagccagggcgcgacggcgcagatcacggcagcagcaatgccccgagcccgccgacgccgaggcgtgcccgccacgccccggccaccaccgccgtgacctacagcgtcgccttcgccgtcggctcgcagcaggacttctccggcgcgctcgacgtcaccagtgagttcgtgtgggtgccgtgctgcgccaccggcaactcctcctgcggcacgaacaacaacatgcccggcgtgacggtctacgacgcgcggcccgaggagctgtacaaatgcgagagtgatacctgccagcgtatcatcaagccgacctgcaacacgacgggcgatctgtgcgagtacacctacacgtacgggtacgggggtgacgacggaagggagacgaccggcaacctcgccgtccaaaacttcacgttcggcgacgacagcgaagacaccgccgtaaagggcgtcgtcaccttcgggtgcagctcctcaacggagggggacttcggcgcgtccggcgtgctcggcctcaacaaggggaatctctccctcgtctcgcagctcaacctcgggcggttctcctactacttcgcacccgaggtgaacaccacggacaacaacgcagcagacgacttcatcgtcttcggcgacgacgacggcatcaccgtgccagggaacagcggcggcagtcgtccccgctacacgccgttcttcaccaccggcgcagtccgtagcgcgaacctcgacctgtacttcgtcgagctcaccggcatacgcgttggcggcaaggacctgcagctcgggggcggcggcggcggctcggcggggggatccctggaggcggtcctgagcacctccgtgccagtgacttacctcgagaagaacgcctacggcctcctgaagaaggagctggtgagcgcgctgggttccaacaacacggaggatggctccgcgcttgggcttgacctgtgctacagaagccagcacatggacagggcgaagatccccgacatagcgttcgtcttcgggggaaacgcggtgatgaagctgcagcagtggaactacctctaccaggacgaggataccgggctggagtgcctgacgataccgccgtcgccggacgacagcgatgggttgtcgctcatcggcagcatgatccagacgggcacgtacatgatctacgacctccacaagtcgaggctcgggttccagacgtccgatccgccgccgtcccagtcatccgatctgccgtccaatccgacgtcatcggctaccgcgcagccaaagccacggggggtcgcggtcgcggtggtgacgatggcatgtttcgtgtggtgccttgtggtgctgaacgcctgaacgtggtctcctgaaacaactactactactattattatgcttttaattacctttaatttttttccttgctgttaggatgcattatagtagttcaattccatttcttctcaacaaacgtggtttattatgatattatgtaaaatcggtttgagggtgttgttcagttatcatggtatgcctagtaggctactccctccgtcccagaatatagcaacctaggaccggattggacatatcctagtactacgaatctagatagggggatacgtcccattcgatcttaggttgctatattctgggacggaggaagtagtactttatttgaatcggagtaataacgtagcttattgacctagttctatcagctcactcagcagatggggtttacatgtcagcgtccccttctctccctctcttttatctaggggtgggcaaaataagaccgaaccgaagaaccgaaccgaaaagaccgagaccgaaaccgaaaagaccgagaccgagaaattcgggtagtaattcggtctcagcatgtcaaagaccgaaatttgttcaggtaattcggttcttgggctcagttaaccgaattaaccgagaaaaccgaattgtggcccaataggtccaggaggcccaataggcccaatacaccactaaaccctagagacaacccgcaggctgcatccctatccatccagccatcgcgtcgccctcccttccatccccatccctatcgcaccgccctcccttccatcccgcgtgagcacgcctcctctgcctccatcgtgccgcgctgccgttgccgcctccatcgcgccgcgccacgccgccgcctccacatcgtcggcgccgtctccgccctccgcctccacgccgcctcgccggtcgcggcgggccaccggattcatcacgccgcgccaccacctccgccctccgccctccacatcgccggcgccgtgtccgccttcacgctgccttgccggtcgcgcgggccgccggccgctagatctatcgcgccgcgccgcgccgccacctccgccctctgcctccacgccgcctcgccggtcgcgtgggccgccggctgccagatccatcgggctgcaccgccacctccaccctccgcctccacatcgccggtgtcgtctccgccctccgcctccatgccgcctcgccggtcgcgcaggccgccggccgccggatccatcacaccgcgccgccacctccgccctccgcctcgacatcgccagcgtcgtctccgccctccggctcggctcctctaaattcgatctgaccgagaccgagaccgaaaaaactgagaccggtcttgatttttttgggatgaaattcggtcctgactttttaaaaaccgaattgactgaaaaaccgaagaccgagaccgaaattttcgggtagaccgaacgcccacccctacttttatcccttgcatcttccttagcgacgaaggctgtctccgcaacaaccagggtttttaattttgaaattggactttatgctggcggtgaccgaaatttcagaaatttctggccgaaattagttgaaaatttgaatgaatttgaataaaatttgacaaattcacaaaaaattgcaaaaaaaacccaaaaatttcgggcgatatttgagcataccggtggggggcgaaattactgaaatttcgaaaatttcgaaccgaaatttcaaaaccctggcaacaaccccaagttgaacgacgacgaggcggaggcgcacgggttgagcgatgacaaggggcagcctgcgatgaagaggagtggtgagtgatggcttgggcagctcacttcctgccgatgacgacgaagcgcatatgcggaacctcgatgacgacagcgaggaaactatccatctcgatgtccccacctgctagggccatcctctaaaagcaggtacaatagtagactataagtcagctataagcacacgtggaggagataagagaggagagagaagagaagcgggctacagatttgtagccagctgcaatacagactccaagacaatgtgtgtatatgacaggtgggactaattattaatgatgtagtatatatttgtagttaactatcatatgaattggctattagattgactatagatgatttggagttgatagttggctatactattaaacttgctctaagaccaccatggcctgctcgacaagtcctcatgctattgtagtattgtactccctccgttccaaaataagtgcagccatgagtttccgtatccaatttttattgtccatcttatttgaatttttttttatgattatgttggtgatatgggcccagtgataccaagcttagagggaagagattgtccctagtatccacgtggcgctccctccaagggggtcgggcccgtgaataggtggtggccacctcctctaagcccgatggaaacgggctgtcccgacccctccccacgggccccacgtggctaccacgaggaccaggttaggtgg

SEQ ID NO: 81658 - DNA, 31952 bp, Oryza sativa
ttcctgcagccccaaccgggactacaaatagatcttttgtcccggttggtaacaccaaccggtattaaagattgaaaagtactctggagcttttacaccgggactaaagatgtttttagtcccggtttttactacaaccgagactattatgaaatctggtcgaccgacaaaagatgatttcttcaccagtgtaggtactcacgcgtattgggtgagtgggcttttgccacaaaataataagtttatgggttaaaatctctaaattagagtgacagttcaggtggtttatgcaattttttccaccacttttagcgagtcaagaggttaggccacgttttaatttacaactcaaattgcacgtggactatatacatgtataatatatactatcacatcgatcagccggcacggttgaactaaataaattttccgaaaaccaccaggccggaaaggcagccgtggtggcccatgcgaatatatatgtaccgtgtctgttactaggagtaggcggagctggggatcgcgtcaactgtagtacaaactactgtaattccatcgtcagggacgaactagctagcgtctgcgcggtcaaccaggacatgagcacgagggtcgtcaaaaaatccaaatgcaacgcgagctcgatcgatcgagtgatcctggatcccccggacatatgcctggctagcttagcttgatcatctcgatcgatcgagtccaaagcgcgtacgtacgagttgatcaaacagtactgcatatatgcagccaactagcttggcctgttggccaattggccaacttgcatggcgatgatcagtgagctagctgcgatttcttccaaggaagcctgtaggtacgtacgtatttcgtcgctgttcaaagggatgtacgtggtcatcagtccttggcttgggcgtcacagccaagtcgatagggccgaccttctaggctgggaaagagacggctgcagatgtaaccggctagccattttctcttactactttcctttttcttgttttcttctttgcgattattatgtggatcgaagactatacaatatatctaaccacttggcattttcttgtttccgagagtgaccacgaaagctgcagggcctgcgactataggcaacggaacgtgatatgggaattgctccatcttgcattgcgcgagcgtaatttgatcgaagcaagagtttcaaggacaggaagcaaacttttgaaagaaaattcaaattgggtccactcgatccaaagcttgaacattcagaaataaaaaaaaatgtgttatgaactttttttacaaaaaattaacaggtcaaattaatatgtaatatagcacttcataaacatgcaagatcaaattcgacttttacaagctataacgaaaataacaaattaaactataacaagtatatatgcatccataatccaatttattgtcatttttacaacttgacaaattggattaatttaaacttgtatttcttgactagtatattacatattaatttatgttattatttttaaaatgttatatagccataacatgtaataaatgagtggacatccactcagatgaattaaagagttcccgtcaaagctcatcagaacacaaggtcctcctcaagggtagtgggaagtctggtgcatattagggttttagccccaagcttagctctacaaacccctaacgatttcatcaaaatatcataaaaatttctacaagagataaaacaacagttagatcagcccctaggcgtgtatatcctttcaagaggactgaataattaatggcggggtgaaacattaatttaatatggatatgtatatcatgtgttttattgattttaattggtgggactgattcgggaaagaagatgtctctgcatatttgtcacatctattctgtcgagggaggattggaaagggaatagatcagacgattcgcgacacaggtcaataaattacgcgcaaatattgactatggctgctctttgattagccgtgacgcgagcaagcaaagctcgttgtgagatgtctctctcctatacctgttcaggaatttagatcgttctgctaatcgcgaaccatcacagtagcaacaacaacgaggtaacgagatgaagcaaattaattacctttattatttgccaatctatacatgcacgaaaatataatttttattatgacaaggattgccggaagtagctggacatactgatagaacattaattgttgtgatacatataatatatccatgccgacaaaaaaaatctcaattatgtatagtttctgaattttcctctatatattttggacaaataaaaattgtaaactagaaactaagggtacattcaactttaagatcatccaattttaccaagaaaaaaacatatcattgtcttaaaaggctaaatagtttccccagttgtaacgcatggacattttttctagtataatcatatagttataaaatatttatttagcatccctacatactctctccgtcttaaaaaaatgaatctagaactggatgtgacatattctactacaacgaatctgaacagatgtatgtccagtttcataatactataatatgttacatctagtactaaattggtttttctatgggacgaagaaagaatattgttcgtgcggtggcaatgggtaaatttagtgccatggagggagtataatttcgttattgaagcacagtatgggtaatttttgacttttgagctaaattcaccatctccataaaaaaaatcagtatcaaattactgcaagaatcggcggccacctgatttctttgggaagtttagtcattgtcttggcggttgaaactcaagtcgctgacaagcatacacatattttcttgacggctatttagaaactccaaggttacaataatttgatcaatcaaagaatacacggacaacgtgtatgtacaccgcacgacacatcaggcgtcatgctgaccggccaccgtccttccgcagcgcgcgctcgacgactcgccggaaatgtccggcgtcgcagggcacacgcagcacgcccggctggccgtacccgtactgctgcgccgccatgtccagcagctccgcgatgcacgggtcgccgagcagcctcaccggcaccatcacgcgctccccgccgtcgccgtcgccgccgccgcagccggcgaccatcgggacgtgccctctcgggacctgatcatcctcgccgccgttggcgcggctcggtgaggcgccaccgccgccgctcttgctcctccagtacaccatggtgattaattgttagattgattcctggaggccggagcttggggatggcggtggtttgattgtctggccggcgctgaggagagacgaggacacgagtttgtggcggcaaatttatagggaggaaatggtgattagcgcacgtgttcttgggttcttgacatggatggtcttccatggcgactggaaaggggatcgactatggtttgaaacgagacctgcgatgagagtccatgcaattaatacatcatccacttgatttttctcttgagatgcccgatacttcgcggtaggatgggccgttgcatcgcgcggtcgtttttgacgtcatgttactccacgtctcaggcctgtttagtcggtaaatgggaaattttttctgtcacatcggacgtttaatcgaacattgaaagaggttttcggacacgaataaaaaactaatttcataacttacttggaaaccgcgagacgaatctttcgagcctaattaagccgtcattagcacacgtgggttactgtaacacttatgactaatcatgtactaattaggctcaatatattcggttcgcgatttacatgtaaactgtacaattagttttttttatctatatttaatgctttatacatgtatccaaatattcgacgtgatgttttttgaaaagtttttagggaactaaacaggtcctcgggaaaatatgttaaatgatgcgtatgtagagattagtacttcctttggtcaaaaatatttaatgccatgatatagaattgtaccacattttttaacataaaattgaagagtttcttagtgctagaggtacatagtactacctgtcaaggacaacaaaatttcctattagtattatagtactcttcaagacaaatttcgatacattttcttaattagctaagcatttgagaaattatcgatcatcaaaatttaaaactttgagaaaaacctgtactcaacgtcaaatatttatgaccagcgaattgagcttacataactcagcaggtaaggttctctgtagtggaatctacataacctattttttcatgcggtcaaattgatttttctgtgcggatattttccctgtctggaatcaggcgtttggaaaaataaatattttcatgtgcgggtgaccgaaccgcacaggatactcgagtatcccgtgcggtcaaattataccgcccgcacggaaccaacaaaaccaaaaaaaaacgcgaaaatcaccgccgcctgctagaccgcacgcactcggccatcgctgagcccgccatcgtcatcgccttcaagccggcccgccgccgccgcagtcgcgccggccgccatcgccgccggatccaggcgggggacggccgccactgccagatccgggcgggggccgccaccgctgctagatccgggcgggggatggctgccgccgctagatccggccgcctcgccgccgccccgctcacctcctctgccttgacaacgcacgcgacgacggcgtcatcgtcgagggagctgagcgacgacgtgcatgacgaggacgacgaccaggaggaggttccgcccgctcgccgtcgcccgcttgccaccgctgccttgacgcctccgcctcgccacgcgcacggaaggggccgccgccgacgcccgctgttgtcggaggaggggaggaggaggaggaggtagagaatagagataaggtagagagaggggggaagtggttgagggagaataaaaggggaaaaaggaatagagaggatgtcaaaaatttgaagtgggtgagaggaaaaggagggaggtattttcctgtgtggtccacttaaaaagcccgcacacgaaaatcgatttttccatgcggtcctcttaagttgaccgcacgggataatgataattatccagtgcgtcggattaagacgccctcatggaaaaacgcattttcctgtacgggcgacaacccgccgccggtccccctgttttcccgtgcggtttcacttatgaaccgcatggaaacaaaatggggcggcgtccagaaaaatatatcatgtagtatatctgttttgtttcgggaaaatattatccgtgaccaatgagagtataatataggaaaaaaattccaatacattttgaggaaggccttagtttttttttgttaccgatggagttggtatttggaacgcataaatttcgtgtcacaccaagcagcaaattaaaggttcaactagacttgtctgttgtttcttaaataaataaaaactggacttgtctgttttcacaccctgagtcccaaaacaggactgagccatgcatcctcacttgatattttattgcaatttgcccgtagtaagtagatgtcgatatcttgttaagtttggaagttgggtttggaccgctggtcccattaacggctagctaggccaccacgtaccaactgtcaagtcgatggggagtattagagagcacccaaatggccacatatggacgcctgggttggtgaaggcgggacgcgcgtacgtgcgatcacatcgccggcggacgacgccggaagcattctgcgcatcgatccacctgcagcaagtgcatgcatgagcacgcgagggtcaaataaacgcaacaatatcgatcgatatcgagctgcatgccgttgatcatcagttgatcgagtccaatggcgtcggagagtcagctgtggcggcacagtactacgtacagaggcacgtgccgaattgaatctacttttcttaaaatatataacccatgtatttatttattgattaaaattcaagcataatatgagtacatgtacgtacagtgcttagagcacagatcactggaaaactatagttttgcaaaggagcccctcaaaactggacaaattacactttggcataacatgcatcttgcataaaaaaagttacttaaaaagaaaacgaattaataaagcaatcgagtccttcgttctcctttgactgccttcaacgcccacggtgaaatcctagagctcgactccactggaggatgcatccaaataagctgcataggattaagccaccacacattccccgtagggggcctcatatatacacatagaggttcaggtgatgataagtgtcaggaaaatgaaaaccaagagttcccatcatcgaccactcaggacatccttgtcaccaatccctgagcatgacccttataggctgtgctcggagcacatcggcccgaacacgactgctcgaggcatatccgccctcgcccgtccaccgcgggcggtactcggggcacagccgacctccctccccccctccccccctccctgggtgaggagtgcttggggaacctctctcctcgagtgttcagcccacgagaaacacaaacgggatgtcacgccccgaactagccccgagcggaactagcccgtgacgctccaaattaacatgttaatcgatactagtcccaggaaacagtgctggtatcacaggaagacagtatatcacagcaacagaggtctatttattatagagtaggagtacagtcatgttgggctgcggacagatctcgagctcacatctgcattacaaaaggggaaaacggaagccaagacttgggccaaacatcacaggcgcgacttgggaactaggccgaaaccctaaaactcatcgtagccgacttactcctggaagaactcctcgtcagcgggatccacttcatcttcttcagcaactgggcgggattatttatatagagcaagggtgagtacaggagtactcagcaagccacgggaattaagtgtttaatgcaggcttcaaaggaaaggctattgtttttgcaattgattttatttaaactcctttttgaaacgactaagtgagtgtttctcaaacgacccggatgaggcagtgcgtctcgtccggtaggagtatgtgcaatgtatcagtctttgaattgatcaaggttggcacccggccaacagctttcaaacggccacccgggcctggctgatcccatcagccgccgattttccaaacatcgaatccattccacagcagcaatttcacaagtagtagtcaaacaaaactacgctaggaatcacctcacatccgcccatgaccatgggcacggctgttcgaacagtttaataacctctgcagaggggggtacactttacccacatgacgttactagccttggtcacccagcccgtgcagaacagccacgtctggtgaccttgggactttcatgacaaggcatttcgaaagccgacacaggttcaccatatgccaacgagaggggtcccagaccaacaccagattaggtcccagaccatactgtgccaggaagcccgggggttctccccgacaccaccccgttgaattcacatgtctcttggcatcaaggctcccccgattagcaatttactcagccaggggtgtcccatttcacccatgtggtcgcacttgtcttatgttcggatgaaattccaaggaaacggtccttaagtgcaagagcaggaaaccgtacacccggtacgttccccggttcacgattttggaaattcatttagttcgcaagcaccgacccaggtgtcgggttttccaagtcttttgtaaaacccaagttttacccatcgttggatattttatattttgagggggggtgttctgatgcgcgtacccgaaggcccgtgcatcaaagcacaacagttgacaaaggaagtctaagtgttcaataattcaaggggggtaattgcagcaattaggattgggagggggggccagcaggctatctcgcaagccgcggccgaattacttgtataaaacctattcatgcaatatttgcagaaaagaaatacttagatttaaattataggtgcaagatgatcaaaggtgacttgccttgctcgagatcttgagcttgatcctcgaaatcctcgcactgcgggtcttcgggctccgaaactacacgtgaaatgggacaactcaacaaacggcaaaaataaagccctattattgacctctaggcgtgccattagatagatctcgagatttaaggaattttggaagttgaacggagtcaaacgggcttacggttgggaagatattgaatttctaatattattagatttttggtccaaaggaaaaggatttatttaaatcctttttgaaaaaaaaaagaaagagggagggaaattagacttcgcgggcggctcggccgaacttaacgggctggccggcccgagaaagcggcccaaagcgcgcgcgcgggcagggaggagagagggagccggtgggccgggtccaccttgcgtggtcccgggtgggacccgctcgtcggcggcatggttcaccgtgcggagggagcacgcgacgcggcgctagggtttgggcgcggcgctgcgcacgcgcgcggcttgcggaggacgctggtgcggcgggcccacgcgcagcctcacggctcaccgtagaccacgcgcacggcgagggcagaggggagcggcataccggggtcggcttgacccggtcttagccgagctggcgccgacgtggcgcctacgtggctgccacgcgggccggcgggaggttgaaaaaggcgccggccggaacggacggcggacggtggctgcgaacgacggggcgaaccatggcgatacaggcgaaagcgagcacaccgggtggttgcacgagatgaggggagacgagccaacggcttggattcggcggagggggctcgatggcggcggattgcggcggcggcaaccggcggcgagggaagggggaaacggcgacggcgcgacaggagatcgattcgggcgagctagagcatctacgcgactccgggaatccgtccgttgcgccggattaggaggaaacgcaacgagggaggccggcgacgagaggcgcttccgagctcgggcggcgacagcggcgagcctactgcgagcggcggcgcgggctggggcggcgccaactagctactggggtactactcgatcggctactcaaagctaaggggaagagatggagcgaggagggagaacggagggatgcactaccgagacgaggcggggcgctgtgacgagatgccgacggcacgggagtgatctctctggcctcgggccggggaagaggaagaagacgagctcccgaagtctccttccgcgtccacgaacgcgccggctcctccgtggcaacgaaaggcggcggcgaacagagcacgggaggcggcgacaatggagtggagacgatgggacaaacgagaggagaagggagggagggtgcctgggctttataggatggcgatgtcggtttgggaaccgacctagggctgtcaagggagagggctagcgctcggtggtcgcggccaaaacggcgacagggggggagtatggcgctggcgggagagaaaagggaaaaaggaggagggaaagggggcttgccccttgccactttgggaaaaggaggagggagagggggcgacgcggcaaagggaggaggagctctgtctccgtcccttggaggttagcgcgcagagtggcggggccgggttgtgacgacggcgatgacggcggggcggtgtggagcggagcggcgacacgggcggcaggcgcgggcaggcgtggaaggcgctgacggcggcggcgaccaggcggtcggccaccacgacgtgcgtgcgcgggacgcaacgggcggcgcgggcggagggtgctcggctcggcgcggctcacgcgcacgcgcgcgcggcgcacgggcagagcgggggagagagggagagagagagagagagggagggagggagagagagaggggaggagggatagagagatgggccgagagggattcggcccatcgaacctgagggaggcaaaatagacttttgcggaggaaatgaattgggaaggatttggattcgggatttgaatttgacgatagatcggggatttgagatccggaatggcacggagactgactgcaagcgaagaaacaattttcgcaattagggtttttagaatttagattttccagctaggcgccacgacgaaacgggcgctacacgagacatacaaaatctacatcttcatatctacattaattttcaaggtttcaagaggagagttgagaccaacaagatctatatcttcagtgtgttgaagatacagcatatccttcaagcaatgttcacgaggaaatcctttgtcatcgacttcttcaagaagcttgtccaaaccaataagtaaacctatgatcagcaatgggagcgatcatgggtgccttgggttgggcagccaaggcacgcggcgtgctccgggcgcacagctgccccgagtacggtgaccaccgaggaacaaggcacaagcatctgggggccccgggcccgggctaaggcccaaacatgccttttgtctcaggctcttctcggaaaacgtgaagccatattctttcactacaagggaacgcgaagctaccacgtgtcaaaaacactcggtaatacggcaaaaggtactcagaattcaaacatgcttccaaagcataaaagaacatggtcattggttagactttttttggataatggattttcataaatccggcctctatatccatgaaggatatacatagccaaagggatacaagagcacttagactcacatctcaataaggaggataacacacaaccaaaaaagaaaagaaaaacaaaacgacctcgacacaccactgcttctctgcatcctgacatactctcctgaaacggccagatttgatgagtggaattcgtctagacgccgccgcccctagtacgtcgtcgctgcgaacttccaatgatgccatcttcatccatttcaggtgagctgacgccacgcgccgccagttagcccactttcatccatcgtcaatcgtcggaactagccgacgggatcgacttccactttgccgaatcctaggcctccacacctaaaatgttgcaggcgtcgacatggatgctcttccaccttctagactctcagctcgccactgcccctagggctgccgccactgaaggggtcgacctccaattgctccttaccgagggccttgcaccgatgctcaggtcgccgtcatttcaggccgccgctgccctacggcagccaccgccaccggtgtcgacctccgtctgctcctcgccgagggccttgcgcccgctgctaccactagggccgccagcgccgacgggagtcgccgccataccgggccgacgcagaccctagggccgctgctgccaccctaggtcattggttagactggactatatatatgttcttcttggaaccaaacatcgtagacaaatttcagcgaaatctgctgtttccacaaaagaataatcaaagaattgctatatgtataattttgctaagaatctagaaaataaaatcaaagaataaacagactccagacgtacttgcacatctccctagctagctactccctggagctgtgacgttttctagtacaacaaataaatttagatatgactatgtctaaatttattatactagaaaatgccatatcctatcttagattggtttttatgggatggagggaatacaccacacagacatgtccgatctcatgctgactggccaccgcccttccgcagcgcgccctccacgactcgccgtagacgctcgccgtcgcagggcacccgcagcacgcccggctggccgtacccgtactgctgcaccgccatgtccagaagctccgcgatgcacgggtccccgagtagactaaccggcaccagcacgcgctccccgtcgccgctgccggcgactatcggtacgtaccctctcggaaagacattgcattcgtcgttgtcgtcgccgccgtggcgcggcgaggcgccggcgggtgacacgccgccactgctgctgctcttcctcctccacatcatgatgatctcgattttggccaagttaattggttagattgcctgcaggatcgatcggaggtgccggagtttggagccgggctgtcagcggtgcctggccggagcgcgttgaggagagacgagcgaggattgtggcggcaaatttatagggatcggcaaggacggttcttccgtggtgattagcgcacgtgcgtctgacatggattagcgcactgcgcacgtgcatattgacatttatggtggtcttccatggcgacgatggagagactagactttgaaccccgttgaatgtccatatgcatgcatcatccgccagggattaatttctgagatgcctaagagacgtccaacgacttggatatatatattccttagatgcctcaatatatacttcgccatcggatgggatctgtccgtttgtgtactatgtatggcacaaggttttcttcatcttgtttgaaacataaggcttgcatgtatactttattgggtcattttcttatttgcccttgtttattgcatagtctctgttgaaatacaccatacaatatgtttcactactgtatctgtttccaacgtgtttatatatactttctccatcccaagttgatcatcacctaagcttgttgaggttttcttaaaatgacatcatataacaaagtgtttctttgtttatttgtacaaagagtatatgcgcatttaaagtatgaattaatttctgttagacaagaagtgacggagtaccttgattgatgataattaatttatgttggacaccaagatgttttcatgtttttggtcttgatgccttttccttaaaggatgaccaaactaggatgaagggagtaggtagcaaactttgcttatctctcttgatttcatgccctccttaatatttacgacaactcaaaattaagttacaacataaaaatagagggagtatactatattgcatcaacaacttttaatcaacgaaaaacacctttgctttctatgagtcgggtgaaacttctctaaatttaagtcgacttatgaattttgttggatcaaaatccaatgacctgcccgttgtcctccacctttacaagagggaggcaggaggagaggagagtgatggagatggcagactgaccaacgatagtgatggcaagactcagtgacggtgaccccttaactctggctgaggacctacggattagggttctgggttagagagtggagacggtaagagggggtaggaacagacgagggtggttttagagggatcgccaggatggtgaagattggcgatagggtggttgatacggatgggttgtgagacgtctattgcaatgccgaagctgcgaggatggagaaggacgacaagcctgcgttgatgatgggggtatcttagcagtgtgatccaccgaaaatagagaaaaccaatgggacaggggtacctcaccaccacttggtatcgggacgataagaatccaggtgtcgaatgaggctaatatagtggggctagacggcattgttggtgatttccgctcttataaagtcataccatgttagttttgtctttagatgattaatctatattacaatctttttttccttctctaattgagccacatcatcttagttttgctttaaacgatcaatccatatatgacttacattgttgaaaaccgcatcactttaattgtttatggttttttttcaataatcgatcagacatgaaaattatacaaaatatagctatcttacatgctatttctactaatatcacataaaactcccgtagcaatacacgggtttcatttattatacagtagaaacaaatctcgcgcccctagtggcctgcttgaaatgcatataaatttcgtctcaccgcgcgcaagcacgcaccacagattcagctagacttttcagttgtttcacaccccggcttctcaagtagccgcatatatacagcatcgccacgttcatcgtttgcaatttgcttttcggttcgtagtacagtagcctgcagccgacaagatgtcagtatcttgttagttttgagctcccgtttgatgttttggaccggcccaacggttgggccaccaccaacttccaagttgctggagacttttagtaggaactaggaaggaaacgagcatacggttgccgagtcaaaccgcaacgcgatcctatatggagtacgtacagagtccgaggcgatgaagaaccagcccgtcgttttcgtacgatgattttgggctaggaaactactcctggagaacgtttgggccgtagcccactccactggccggttggcccgtctccatgtctgggcctgcctttgaactgttctaagcgcgactgcttgtgttgtgagtagtgtgatcgaaaagcaccggtgccgtgaaacccaaagtggatggaaaggaatgtattttctgtacctgccctttattttttaatagatgacgttgtcgactatttaacatatatttagtcacccatcttatttaaaaaatatatgtaaatatataagatataaaacatatttatagtattttaaatgataaaacatctcacaacaaaataaattataattatgtaaaaaaatgaataagacgagtgataaaaaacagtgtcatttattaaaaacgaaggtagtatttctcggtagctgactagtacgctaagatgcgttggcggccggaaccaggaaatcagagagcaggggctgaactagcttgttcatcatgcttcttttaaatttttacaataagtttttatagaatctattatactaaaagttcattaaatttcttacaaacgctatcaagctatcaagttgccatgaggcggtttagtgttatattaaatttatttaattagtatgtatgaaattttatctagatactcaacttttaaacaataataatgaattgcagtgacaataggaaagtttatatgtaatcggaacaaagtgatttcttttttaatctagaagacattatctatggtttattttagggtgtagaaatagtgagatgtgacctttttaattattatttttataaaacaataaataagatgcccgcgcatttgtgcgggctttctttctaatttatactttaatagtagtagtgttgaatgaaaccaagtatcattgtactagctactcctttaatttgacgtcaaaaataagctgatttctaatatttcacttttatttatcttacctatactctcgaagaaatagtatcctttcattactcattgactacatacgtatctcctaataatactactttcttattaataagataatttattttttttctcgctactatttttttcttaggatggctataaatggctattctgagatataggcagtggcagaatcagaattcttctaatcctagactcaactaatgtaatttagtacgtaacttggctattaattctctattttttgaagttttaaagtataattctaatggatatttagattcaggagtagcgttgtagctctagctgttctactcctgtcttcgccctgggacagagagagtgtatactccctccgtactcgtaaaggaagtcgtttaggacaatgtttaagtcaaactttgagaatataaatcatgaataactctcaagttgttgagcttaaaaatgtaaaaattatatgaatagatttgtcttgaaaaatacttttataaaaatatacatatatcacttttcaataaatatttttatagaaacaacaagtcaaagttgtattttgaagaccgtgtcgatgtcttaaacgatttcctttatgactacggagggaatatatattaggcgggcgtgagttaattatagattgattgggccccgcactgcctttttttggttgatccccgtgctatgaacacaacctaaagtagctgatagcactgtagaagttgctacacgatgtcatcccgttatgggtcgggtacaataatattacactgatatatatataggcaacgagagagcgagaagatcgatcactcgctagcttttaagctagccggctcaatctacacgcacgtacgcatgtgacccttccaggaacgagagactagggccatatatatatagtattattagtaccatgaaggcatgaatgatcgagcaaacttaaccatgggccggcagccggtgatcacgatttggttgcatgcatatgcgccagtgacgtcacgtccgtacgtacacaccaacaatcaacaatcatgtaggctaaaacgtaactgctcggtttagaagaatatatatatatatatatatatatatatatcgtgagggtctatttctagacttttgcatataaaataaaattaggtgtgttatatgcatggtcctcctgctaaacaaattgacctccgtgaatatgcatatgcatggacaaccaaaccaactactccgtatcttgcaattactaaaccaactgcaaaatgacacctgaaccgacgtatgtaatgcatagtctaaactaattaagctggaacaaaatatattttactacaatgtatttattgtacttcgtgtctcagttacgaagtgagggtataacttaactatttactgtttattaggtttgtggggaaaccagaacctatccaaatttaaatcgtagactcgatatgagtgttcacatttatggctaattatttattcattgtaaacggcgtatatattaacaacgatacatccgtgatgacttctgtattcttaatacgtacttcctccgggttaataatatttgtcgttttggacaaggacaatgtcttataaaactaaatttgaccactatttttattataatatgaataaaagtgttacaaatatatgattttgttgaagtattttctaaactaatctatacatattgtcaccatatttcaaagataaatattttagaaattatttataattaaagattttaaagtttgaactcacacttgtccaaaacaacaagtattatcagtccggcaggagtactcagtctttcagagttgctcacaggagtaagtatatgtacgttgtgagcgtttacatttatattgtgttctagagaaaaaaagtcaacttgattaataagttcacaaatatactcctttaattaaaacaaagggtcaatctcgttgacccttacagggtaataagcatgtagtatatgtcattttttatgcgtgtagcctcgagtctcaacgagatcaaaaggcagagacactcttatatggtcggccatcacaagcatatgcacacgtaccacacggcacacgcatttctttaggggccaataatggcaataaagcagcggcgtgccggccacattgcatgtatgcgccgagccactttgcgaagacctcaattgtttaacggagttgctagaaatatggcgccatatgttagagttgattttttttagccacttacatagtagttacacctcatttacatcccacttacatatataattagtatgtaattttcgaatttacatatgtaattttagtacttacatatgtaattttaagacttacattgtaaatacattaaaattacatatgtaatttagggacttacaatgtaaatacatgccgactattttttgataaaaaatatggcaccataaatatagctacacccttgtttaattgatacttcattattttctctttttttcttcataccgtaccacctgttagaggagctttagattctgagaaacagctgtttggtagccagcttctgagaatctggaaaagctctgaaacccagcttctccagcttctagctttttagttcatttttcagaatctgtaactacagattctcaaaagttgtagactgtttggggcagcttctagcagaagcagcttttgggaaaagctgcagctgggacaatctcccccaaacagggcctagtaccacatactactactgtacttcgctccctctgtatctgtttcatattatatatcgtttgacttttttcttagttaaattttttaaagtttgatcaaatttgtagcaaaatatagtaacatttgcaatacaaaataaaacatttgcaatacaaaataaactttgtaccaaaatatttttaatgttaaatttaatgaaactaatttggtgtcgtagttagtgttaatttttttctttaaacttgatcaaagctatagaactttgactaacaaaaatatcaaacgaattataatatgaaacggaggaagtacaatttatccatataaggtagtatgttcctaagtattctcaacttaataggtttcctaaactactaaacaatatatttttttaaaaaaatataagatttgcttttaaagattatattaatctattttcaagttgtttaagctaatatttaattaattttatattagtatattgctttgttttgcgtgccaaaaacctaagggactgttcagctgctatgtttatcagttgtgctactgtagctgtataaagaaaacactgtggttgttggctgcaacacagtagaaataagggcagcagaacagagcctaaatatactatattaatgtagtactcccttcattctaaaatatagcaacctgatgggacacattctagtacaacgaatctatgcatatcctgtctagattccgtgactagtatgtgtctcatccagaacaaagttgttatattttgaaacggaggggtagcgtatatcgtcgtggattgatatgcgcacctacgtgtacgtacactgatcgatggacgaactgaccggatcgtgcggtccacctgatcgatcaacgctcgatcgaccgatccacgtacgcgcgccatgagatttgccagcgtactcgcgcgacggagtagtcatcagtacgtagaagtactagcaaagtgatagcttgatccttaacacacgatccggccctgtcccccactcctcttctggcgtgcctgtgcgttaccacgctttgtatacgtaccaaagtgccaaatcaaaaggtagtagacgccactgcactgcacggccacggtatggcatatgcaggtgcatatatgcgttggacgacacagccacgtacactgctagaaatctcattttctgcgtaataggggataaattttcgcaggcgggcatgtaattcggagccaaaaccccaccggcaaaaatggtacccggggtggagggggcggtccgcctgcgaagattgatctttacaggcggttcatttcaccagccctgttcattctccccgacgtttctctctcctaaagtgacttaaatatagggggggaggttttgaacttcaaatcttcgggggatttttctacggtacttagatctactcatttccacactaggtatgcatttttttaagcttttagaccttaatttgtgatggatttatgcatccaaaattttgaaggaagagagctccatgttttttaattttatttcttgccatatgtttatgttagatgtatgtgtaatacttgatgcctcttgttgtagtggtttaatgtggtaacataaattctcgtttttttaattttttgctatcatatccaccacctagttctagatcagatctagctcttgtcatgtatagagagagaaaaaaattttaaatgtctatttattcagtgcaatcaaaaaatagttatagtattttgtaatatgccgatggattgattttgttagattttcctaatgtgctaatttggcatgtctgtgtaagaaaaatgaaataaactatgattttttattactttacacttaacctttagttaattagttttgaatagttataagttttttcaataaaccctacaaatttggtattaattgtgcaaatattttacgtgtaattttttagagatatggaaagttgggaatggatatatcattggccgaggtttttgtctccatatagaaacgaagtggctaaatttattggtattgccaaggttcacgctgagaagaacaatatgaggaagatgatttgtccgtgtgctgactgtaagaatgaaatagcctgggactttgacgatgcttttaaagtgaaggagcacttagtaactcgtggatttatggacaagtatgaaatatggacacataatggcgaagaacaagtggacgagcctgaaaatgtagttccgacacaagttgaagacatggtgcatgacgatggttctgttgaggacaaaatcgacctagaggaaatgttacgtcatgcagaacccgaggtgctgatggggtcggccagagggctaaataactttcaagctttacagaaggcagcaaaggaagttttgtacgatgagtcgaagggctgtgacagtgatttcacaacactccggtcagttcttgaacttatgaggttaaagacgagacatggatggtctgataccagtttcgacagtcttttagaactcctgcagaaaatgctaccgaggcctaactcactaccatccaacacatatcaagcaaagaaactcatatgccccctttcacttggtgtggaaaagattgatgcgtgcgtaaatcactgcatactgtacaagaaagagtacgtttctttggatgaatgtccaacatgcggtgcaagccggtacaagtcgaatagcaatactagcctagaaccctctgaagcaactgagggacgacagagaaaaatcccgcagcttgtgatgtggtaccttcctgtgaaagaccgcattacacgaatatactcaaacccgcgagatgcgaaactaatgcgctggcataaagaaggacgcaagaaggatgggatgattcgacacccggcagatgctcgtcaatggataaactttgatgcgcagtatagagaatttgctaaagacccacgaaacattagatttgccctgagtactgatggagttaatccttttggagacatgagcagttcacatagtacttggccagtgcttctcgccatgtataatcttcctacctggctttgtcaaaagcgaaaatatgtactactctgtatcctcatacagggaccccgtcaacctggtattgatatagacgtatttcttgaaccattgttggaagatatggccgatttatggaaagagggattgaaagtgtgggacgagtacttaagggaatacttcacagtgaaggcaatcatcttcgtgaccattaacgattatccagcaatgttttcagtttcaggtcaaattaaaggtaaaacaggatgtgtgatctgcttgaatggaacgtactataggtatctcccgggttccaacaagcttgtgtacatgcggcaccggcagttcctacgcacaaatcacaagtaccgtaagatgaaggcggagttcgatggtactgaagagactgatcctgcaccaaaacctacatcgggagaaaatgtgtgtgcaatgacagagaaaattgtttgcgagtttggaaaaatgactaagaaaccatcaaaggggacaaagcgcaagaaacccgagaagaatacaaagggaggggatagtaagaagcaagatgacagttcgaagccagatgataaactccctcccccattcaagaagcattccatattttttaagtacctcccgtactggaaagatctggaggttcggcatgccatagacgtcatgcatctagagaagaatgtgtttgacaacatagttggaacattattggacatgccgaagaagactaaagatggtctgcaatcaaggatggacctagtcgagatgggaatcagggaagagttacaccctcaagaaggagaaaagaatggcaaagtatatcttccaccagactgtttcacactgacacctgaggagaagaagtcattttgtaactcactccgtaatgtcagagtgcccataggtttctcatcaaacatcagtcgactagtttcaatgaaagatttgtcggtatctggttataattcacacgaatgccatgtcttgctcactttgtttcttgcaattgcaataagagccataaaaccggagcatttaaaggttgctatcacaaggttgtgctactttttcaacgcagtgtcacagaaggtcattagtctcgaagagttaggaaatctccgtacattcgcacatgagacccagtgccaacttgagatgtgtttccctccatcattttttgatatgatggagcacctcattgttcacattgtgccgcagatggttgcgtttggcccattgtacctccatcaaatgtggtcatacgagcgttacatggctgttctgaagggttacgtccgaaatcgtgcacatccagagggatcaatggttgagggttatagtactgaagaggttgtcgagtgctgtattgattatctcaaggatggatatgcaagtacctgtgccccgacatgagggcagattgagtggcaggggaacgataggaaagaagagattcgtcacccatgatcacaaatcattccaagaagctcacttcagcgtgcttcatcagtttgctatcgtcgagccatacatcgatcaacatatcgaactaatccgagctaacaataagggtcgctccaccgagtggataatgaaagaacacaagcgtctcttcatagattggttgcgagacctagacttacctgagggagaaactaccgattaaataactatgaagcggttggcttgtggtccatcaactacagtaaattcttggcagggatatgacattaatggattttcgtttagcacaagagcccgagataataagacctgtacgcaaaacagcggtgtccgtgtggaggcaattgatgaagccggggaaaaacaatcatacttcgggtttattgaagaaatatgggaaattgactatgggcacacaatgcaattccccatatttaagtgccagtgggtaaaatacccgaacggggtaaatgttgataagttcggtcttactgttgttgaccttgcgagagtgggtcacaaggatgatccttgggtactctccaatcgcgtggcacaagtgttttatgtgaaagacccttcaaatttgaagaaagatatagtgctaccagggaaacaaaagatattgggagtggatggggttgaagatgtcgaagattacaaccaatacgatagtatgccactttatagtcagtttgtacagaagattaagaatgtcaagacatctactcagaagaccgtgaagccttacatgcgcacggacggtgtgggcaaaaatgttaaagggtaatgattgtatgtaaggtgatgtgtgatcgtatcgcaaattgacgaacaattgtactcaacattttgcatattaatttctaagtactaatttttatgtgcaattaccatttgaattgtgaaaatttagttaaaaaaaatttaaagttagtaatatttgaaaagtgtaaatatttttatgtgcaattaccagtttgttgaaaagatcttcgcaggcggacggcccgcctgcgaagatctcttttactatcttcgcaggcggatggcccgcttgcgaagattatcttcgcaggcggaccgctcgcctgcgaagatctttgccctatataagggcaagcccgcggcgccaaaatttctaagtccaggcgggaaccctagaaaatttggcgccgtcaggctgccgaaatttttcaccgccgcacgcctccgccgtcctccgccgccgccccgcctacgaccttcgctctccgaccgtcgtcctccgccgcagccgaccgtcgtcgtccaccacgctccaccgaggcagccccgtcgatctctcctccgccgccggctcatccaccaccaccgccaccgtcgagctcatccaccaccgccggctcatccaccgccgccgtcgagcgcgctctcctccgccaccggctcctccaccgccgctggcccctccaccgcgcgcacggccaccgccggcacccctccaccgcgcgcacggccgccgccggcccctccaccgctgtcgccggcccttccatcggcgacggccgtcggcccctccaccaccgtcgcccacccctccgctcgcggccgaacggcttcatcggccgatcgtcgtccacgagcgaatacgtcctcggccgtgaacgacgtcttcggccagtcgtcgtccacggccgaacctcgtcgtaggccgttcgtcgtccacggccgaacctcgtcgccggcccttccttcgtcgtccacgactgaagctcgtcgtcggccgttcgtccaacacggacgtgcgtgcatgtgggtgtttccttttatatgtgtgtgcatgtgggtgtgagggggtatatatgtgtgtgcatgtgggtgtgaggggtgggtgatatgtgaatgaggggttatatgttgattgtgaatgtgaatttgggaatgtgggtgacatgttaatgaaattgggagggtatgttcaattttgcaggatatgtgaatttgtcaaattttttaaataacatgttggagggtatgttaacaatttttttaaaaaaatgtggaggatatgtttgccttttccatttttttagtcaacatgtcgatgaaataaggaagtgaattagtgcactacttgataataacatatcaaattttgtacaaatttgtttgtagtaattaatttagcataatagtaagtagtcattattttcgctatttaaatttgtttgtactaattaatttagcataatagtaagtgctagttaaatttggaaatctcttcgcatttatatttgttcatacgacatattgttaatacacagtttatttttgtactaattagtttgtactaatttgagtaatttaaaatgttgacgataacactttttttttatattagaggtttgaaacgatggccgatagtactaaagggactgaagagaagggtttaggggagcaggagcagtcccttgctgttgtggttgctccggaaccaacggtcccaccggatggtagttccgacagcgacgtaggtgacgaagacgaggagtactcgtcaccaagcgatccttgtccaagcccaagcccgaagagaaggaaaaagggcgacggtgaagaaggcgacaaggactacattccccctaaagaaggggtaagtaaacttaatatgtaaaatgttcacagtgatagctattagcccgagctaattcgaaactttcatgcataccttctcgtaggaaacggcgccacgacgatcaaaatggcagccgaagaaaaaagttacttcgaaagacgaggacgtaccggcaaacacaaccggcacacagaaaagcgaacggtcagcaaaggcgaagagaaggaagggtgagagaagcgtaaatagaaaggatgaagggttccatgttgttacccatgttttgcctaaaggagagccgctcgcccctaagacgacacgtgcgaaattcagttcacagtgtggcataatagtaagggagaagatctccatcacggtcaaggactaggatcatgtaacggatggggataaggaagtcctatggaaagagttgaagaaaatattccagttcccggaaggatcagaggcagcggtgagaaattgtgcactgcaaacaatggccaagtcttggcgtggttggaaaaccaccttgaacaagaaatttgtgaagacgggacgcacaccgttttcgacgtatgccaacataacccccaatcagtgggacgactttctgaccttgaagaactccccggaagaaattaaaaggagccaaaagtattcagagttggccaagaagaacaaattttctcatcgcttaggctccgcgggatacgcaccaaaggtggaacagtggacaaaagagaaggaggaaatgaggaagaaggggcaaccggtaccaatggaggagtggacatagagatcaaggaactgggtaagagctagaactccgaagatcacggatgagggaaaagtgtcgtttgaaaatccggagctgcagagcgttgccgataaaatagaaaatttatccagttcacaaaagaaagtatattttaagcctaaaagggagaaagatgtgctaagtacggcgctgggtactcctgagcatgggggaagggttcgaggtgtgtcgagcaagataagttggaaggaagggttcaaaaatgacccccacaagaaacgtgaagcgtacaaggataaacttagagacgaaggggctgcggagtttgaaaggcaaatgatggatttctgcatcaagcacatgattttgcctcgccccgaaaccaaagaaactgagccagattaccccttcgatgacctcaaggagaatacaccctgcagattgcacgttcccattggacgctccggtaaaattcttgaggccgctacagccattgctatccctggtagaacatacaatgaacaattcatacccgatgcgtatgccaaggtgcagccacaagtggtccacgaagggtttgagtcctacgacattgactacctgactgcagatggtatatccgtacttggggatgcggtcgatcttgtaattctctggcacaagaatgacatattctttggattgggcaccgacgccggggaaaaacctgtgttgcctaaactgggtttgggaaaacctccgaggcctcctaagaggaaggtgactgataaggcggatgatccagaacttggtaaggaaaatccagtgccggaagtgccaccggagattgcattgccggagacagccaaggagattgcaccgccggagacagccatggagattgcaccgccggagacagccatggagattcaagtgccggatgtgcccatagagattacagtggcagaaccagaggtggaatttgtggcatcagtcgggtcagacaaagatgaagtaccaggattggaatgggatggtacagagccagagatatttgaagacccttctcctgcgaaagaacccgaggtgccacgagtgattaggagccacgaatccaagtccaaagatgcgaacaaggagaagttcatgctaaccgtctttagagggggtaaggaacgtgccaagctcagagatgacgacccccagaaggcttctgtgctagccgggccaacatacttcgcaaccgatgattgcccggaaaagtacgaacatgggaaagcactcttgccggaatgggcactgaaagaggcaccatgggagatgagaaggttacataacttctacatggaggccagcaagaaaggcttgggcaatataacagctcgatcaccggcagattgtttcggcgaagaaggttacgtatggctagatttctcatatctccacgccatatatcgtcgggataagatgaacgtcaattatgtcggtgtttggtgcatgtgagtacgagttttaattaattagatgaaaaatatgtacaatacaactccatgtgattgttactaacaaacttcttctgtaggatgcaatacatggatgctaagaagaaaaaagaacccatcggcttcttggatccaactcggatatgccaaacacagcataccgttacgctagatccagggtcagaccagctgaagggcaagaatccgaaagagatagcagaatacaagaagggcttgcacaaggagaaattgattactgtcgcacagtacattggacgagccttcttgcactttcaaaataagagtcttcatggccgcttataattttaagtaagtccggtacatttatcttgtacacatatgtcttattttagctgttactaactaattataatgttgttaatatgtagcgatcattatatctgtttactcatccaccctaaagacggaaccatggtagtcttggatcctctcgattacaaacacaagcaatacaaagaatttctaacaatcttacagtagtaagttattatgactcttgcatttgtatatggatgtattacaaataaatatcctccttactctgaaacggtatgacatccatacagtacataccaatactacaagttcaagggtggagaacagacccgaacacgggagaagctgctagtacgtacctattggccggtaatactccactcactttatgtattccaatagtttcactaattgcaaattataactacttttttctatgatatgtccttcagtgtcacaagcaaccgcgaggaacggtcctttgcgggtattatgcgtgcgaattccttagggttaatggacggtacaggactaacgcggaggatgtaagtctctatactatgtactagacagctcttgatatttatgatactaatatattgattaatttcaatgtatgcagttgccaagattagaatgtcgaacaagctttgacgatacaggtatcacaaatgtgcagcgtgatctgtgccacttcatccaccatgagtgctgtcatgtcaaaggagatttcttcgacctagagggtgcccttgcggcaagtgacgaattcaaggatcttcgggagtggaacactgctatgccataatgtaactagatgacgttatttgaagtgacaatgtaaaacaatattgtaatatatatattttggcaacacttttgatttatgcaatataagtagatttctcagtaccaaatgcttgataatattccaatatatgtacctgcaagaatttctaataaataatttaaaagtaatttacggccaaattatatttagatttcaatattttctacctatcttcgcaggtgaaagttttcttttttgcaagcggacgattcctattttcgcaggcggaccggactagccaacgtccgcctgcgaagacccttttcggccgcttgcgataatgcttttcctagtagcggtacactaccgatgacgagctacagttatccagtacgcatgcattgcatcgccggcgccggtggccgatcgacacgtcgggtagggctcgcctgttcctgatcgggcaaactgtcatggtgactcgactggccgttgtactagccttccgcgtcagtcaggtgtcacagcaaacttagcttaccactacagtaacaacagtacagcgtacttcatgacctactttctccatccaaaaaaatcaaaaaatattatgacgtgatacattctattacaatggatttagatatagagagtatattcaaattcattgtattaggataaatcatatcttaataacaggttgttttttttgacgggggagtatttgttggtgtggacagtacgtcgtgagaacgacacaataaaggttcattcagttgtggctttttttaaggaaacaactaagtactcgtggttaattagacggtggtttattactaccacacctggtcttgacaaacttgggctcctagctagtagtggagcggcacgctgtcattattgctcattttgtggcatgcggtcgtgcacgaatcactaaaaaatatcgtaaagagaagaaggcacggaaatttctcgcgactgaggcgatacaaagaaaaggaaacgaaatcgaggagaaaaaaaaaagaaagaaaggaagagggaaaaaaaaaagcagtggcggatcgtaccggtccacgtaccaccagtccccacatgtacccttccacccacacgggcacacccactccttttggcaccgaccacccactgccaggtgggacccacctgccacctcatcaaaccaaccggcacaatataaataggcgacccaaccactcgatcgatctctcctggagaaattccacgcagcagctgagctctcgatctcgccacagagccaggtgtgcgtctccgggatcgatgaggcagctcatccggcggctctcccgcgtcggcgactcctccgccgccgccgcctcgtcgtcgtcgccggggaagcggcggggcgcagggacgaagaagaaggcggcggcggcgggggtgccgccggaggggcacgtgccggtggacgtcggggaggaaggggaggaggcgacggagcggttcctcgtgcgggccgagctgctggggcggccggcgctggccgagctgctgggccgcgccgcgcaggagtacggctacgaccaccgcggcccgctccgcatcccctgctcccccgccgccttccgccgcgcgctcgccggcgccggggatggagaccacgacgacgacggctagacattaagacaaagcaaaaaaacggtgttgggttgatttactactacgtgcgagagagaggcttctgagctcagcattagacaagctagcaaatgacactgcatgagccgctgccttctctgtgtgtgcataccgcttggaagttggaagagacgaagattattaatactagtactagtagttttctttttctctctgtaatgtagctgaatcagctggttgctaggccctagctagctatagatggctgtattataccaccatatagtatgttggaagagtattactgtgtatttctactttgtttagtatgctcttggctaggcaccggtagtttcagtttcccaacgacacatttttcaatcatcaattgatcatgagcagtccaattcacataaatctacggatttgctaaaaaacttctgtaggtttttttttctcctaaaactttcagatttgtgaatatcggaacacctcgagatttatgtatgttcgctagaaagaaattttcacatacatgttacatgtaagatcctagtattagctgaccaaactatagttgaatgtaagttttatataagttatattgtaattatagtgtagttacaatgcagacacaacataattataatacagttacaatattacacttcaattatactatagtcacatctaaaagttttttacttaaacaaacttgcggtggtttttttaaatataatgtcaaaaaaatatctctcaaaatgatctgaaaaacttgatctacacttgcgtgcttaattcgattggtacttggtttctttactttttcctggtggataatttgcattcaggcactagttacagtagcggcagtagtttccaaaagtgactcatcgagtggtgaaaggtaaacaaggcttgcatccaaacgaaggagagagccaattcgtcttcggcctggacgtcgtacgcgcgctgccgttcgttagcgtggctctcgccactttgctttcattcactgcttgtgaccgtcgttagtgcaagcagagatcaagtaatagccacgggttgttagctatagctagctagctaggctatatatatgagtgtaattgtggatttaattaatttgtgggtaacttttggtccgtagctttcaaccgaactattttttatcaggttttgccttttctgatcttgttggctaataatgtgtgttaaattattactccgcagtgtcggatcatggatccaatgtgtgctccattcttttctggagaaagatgacatagcaccatcgtcgagcattattgtctcatgggtacgtgcaaccgcttgtttgaccctaacctctaaatcctaaaagtctctgataaaaatagatgagtaaattgtacgtggacggtccttaaacttgtaggggtgtgtcatctaggtccataaactctcaaaatcatatcgaagtcacagaatttgtcataatgtgtcatataggtcccaaatcgccacaaccccttctggatcctacgtggcgttgatgtggcatgccacataaaatgacatggcatcattttgactgacaaatgggtcccatttaaaataaaatttctttttatttttttcttctctttttttccctttcttctcctttctctgtgacccgagcagcaaagaaaagacaaaaataagaatg

SEQ ID NO: 81659 - DNA, 9589 bp, Oryza sativa
agcatgaccagacgtcaagagtaagaaaattgctggatcaataaccacaccacaatggcaatatctaagtgatatttacctgaatcattccaggatggtctctggtattgttaccaggccaaggtgtgccatcttgcataatccatccttcctcaggactttctgtgccttggcgacgagagcattaacacgaactttaaattcttcatattccctctggattttggttttgcaacagacattaatgcgagattacaccaaaaaaaaaacaacaaaaaagtacacacatataaaccaaatttaccttcatggcacgacgatctttaacaaaagaagcctgaactttgtctttcaagtaatcaattttctgtgcaaagtaccactctggagctctgggttctatgctgtactttttacagaacggtacccattttctagcaaattctgaagtctcagcaagcgcatcaaatgttaacattgcagctccatcatcagacacatagcaagataccttatcaacagggtaatccacagcaaggatggagagcacagtattggcagtgacaagaggaggttctttcataggatccacagtactgacaaaaatgtcaacaggagccaattgagatggttcaccttcccggtcatacctgagagtgcaagtgatattttgttattgtcagtaatcagtactacagtgctaacgcaggaatggtgtatcagaggtaaatattgtacatcaccttaaagccagcctatccaggtaagtttcacggttgattggggaccacttggggaactgatccagaatccaggatagagcaaaccaaatctcacatatgacagagagcaaccatagcgggtatgcattacgcacaggatttgtgatacggtagtgcaagaatatacataggacaatcaatcggagcacaataaccatcctgtacggatttattctggatgacgaaattggcacttttctcgatagaggttggcgtgtttcatcattcctgtaatacagatagcacaacatttatagtggcaagctatatgataagtccgcattataaggttcagagatgtacaaccatttagaatctgatccattaaatgtgcatattgccttgcttaatagcaaggtatacttgtaaacacaaaataattatatttcgaattatgcaagaatttttcctatgttcttccaagtacaaactagtgcaagttagtacaccagatacaaggaatattaattactggtagaattcatagatgactaacggtggacaaaagcatatcagaactcacagtaaggcgtcctccatgttatagtcagtagatgcatcaatgtcaccaaccccacgaccttctgaaggagcaatgctagtaccattagccatgggaattgcacctttatccttcattttccagccatctactctctctttccatgcaacattgccaaggctaccagaaaactcccttgatgggtttgctgttgagcaacaaagaataattaaattttcccagtcgatgcaacgaaacatgagatcttgatgatagataaacttacgtgaatggttcacatagggaaatggatgcccacgtctgccaatgttcccaacgggagacatcatatgatcaggggacgctccaggaatttcacctgagatctatagaattaatcgagaggaagaaactaaatattagttcaatctttgcacataccctgaagggttaacgacttcacgctatcaacaaaaattctaacaaacctggctgtgagtgagcgatgggatatatatgcgagggatttcaccactgtcatacttgggatgaccaatctcaccactatcatacttagaatggacaatatcatcattcctcccagagttcatgcgccaggtgagcatcctctcggcaatcttgtgcttatggtcctggttgccggatgttggatagttcacatcactagcatcatccgcatcaacatcatcgctttcatccccaagtatcggcgggctccctgaagcaaagattaaatatcttgttaagctcaacaaattcactcacatttgcttctctcaatggaaataacccatacaggaaagaaattatgttgtcactggtcactaccaacttcgaatacagctcactaaagaacaggactctgtgctattaactcagcatattcactaagcatatatatatcttctctactattattgtctaaatgcaatatgcaacaacctgattgggttcacgagatgttcagtccaatgtagctgttcttaaccaaagatgaagtatttaggtgaaatccaagagaaggatgaatggataatgtgcaacttatacccttgtggcgcttgtacttggtcttgcactgcgggcacgcctggctgccgtccttgcgctcgtactcgtagcatggccggcacaccgggaacccgcagacgtcgcaggcggtgaagagctcgccgtccgccgccgtgcccacgccgtcgccgcagatctggcagacatggcattgcttccccgatttcttcgccgcgcatacaacaacaccaaacgaaacaaacaaacaaaggcaaaagcttcagagctcagaccaacccaaacatccacgcaacaaattaaccaatctttgaatctttccccccgaaaatgcgactcaccgcaccgtccatggcgcacgaaccaagaactcacggccaagaaagtgtctccacgaacggactcccgccaattcaccgcattccgcggccgccccgatgaaaccaagaaaccccaactcccccccaccccaagtgaggcaaatcaatcagtcagacaccaaatcgcctcggattcaaggcgccccccgccaccgccaaagccgacctcgtagctagcagcacaagctggatgaggaggcttgcaagaatcaaacgggacaagaaaaggacgtggcaccagcgaggatgaggaaaccgcaagcgtgagcgtgaagtgaatcgaatccgctcgcgtatcactctactctactccggggtttagcggttgattggtaattaaaacccccgtaaaatttcgagatttttggcgtgcatttgagatgagatggttgggttgttgctggggttttgattactccacggggttcggggagaggagtgaagtgaagtgacggatgaggtgagctgggggtggggcccacctggcagtgacgggcggagtgcgcgtcggctggaccgtggtcgcatgcagacagaaagtgtgaccgggatgggcgtgtggggaccgtggggcctactgtcagtgagaaagggtggacagcttgtgaggttgtgatagacacaaatgccaactgcacgcagcctgtatcgcagtactctgttcttaaaaaggaaaaaacagagcactcctcgcgcatagtaatcccttctaaaaaaacgtttgaacctgaatacaatatagaattgggttttttgacgggtgaagtatatgtatttgtgttttaaaagcaaaattgtgttaaatgtttaaaactttgaccgttagttttgcattaaaacaaatggtttgtaaaatataaggagtttataatgctatgatcgtatttttgaaataaaatttacggcacaccatttttctttcctttaaactataagtattttatatgaaactactccctccgttttaggttataagatatttttgactttgatcaaagtcaaaacgtcttgtaacctgaaacggatggagtatttgtgatcaaaatatcaaaagcttgactaattttatccaaaacataagatatttatgatggaaggaaaaaaatactgtggcaatctgagaagcctaggtgcgagcaatcgttacgctagtgatatgaactcaaccaagaaagtatctcgtaatcacatccatatgaacacatataaacactcgtacttataaacggatccgcgcacaccctatccatatgaacacatttaaaagatggggccccgcatattttaaaatcgataaatatattatctacctcttaaagaataattagccataaatgtaaatgcatgtgtcaaatctataagtttaaatcagataaactgattccaccacggtaatcctaatcagtttacactcagcgatagactgcaaatctgtaacaggagcatcaacaaagtagtgctgaaatgacaatctcatgatcatacaccacatacatatggtacgcaaacaacgatagttgtctcctcgacagtttaggatagtgtcccacgcatgcgtccacgagtcctcgacgcaacgttcccgccatccacgcgaccacgcatgcacggggggcgcgcgcggttgatgcactggacgtcgagcggaaaaacgccctgatcgatctggtgtcctgagcccccgaggattcactagctcttgccaattgtatccatggccgccgccacggcggacggacatggcgggaggcggcggctgagggtgttcttcctcccattcttcgcgcgtggccacctcatccccatgaccgacctcgcgtgcctcatggcggcggcgagcactgatgccgtggaggtggaggcgacgatggcggtgacgccggccaacgccgccgccatcgccgccacggtcgccgggaacgccgccgtgcgcgtcgtctgctacccgttccccgacgtcggcctggcccgcggggtcgagtgcctcggcgccgccgccgcgcacgacacctggagggtgtaccgcgccgtcgacctgtcgcggcccgcccatgagtcgctgctccggcaccaccgccccgacgccatcgtcgccgacgtgccgttctggtgggccaccggcgtcgccgccgagctcggcgtcccgcgcctcacgttcaaccccgtcggcgtgttcccgcagctcgccatgaacaacctcgtcgccgtccgccccgacatcgtccggggaggcgccgacggcccgccggtgaccgtgccggggatgcccggtggcagggagatcaccatcccggtgtccgagctcccggacttcctggtccaggacgaccacctctccatgtcgtgggaccgcatcaaggcgtcccagctcgccggcttcggcgtcgtggtcaacaccttcgccgcgctcgaggcgccctactgcgacgagttcagccgcgtcgacgcgcgccgcgcctacttcgtcggccccgtcagccagccatcgcgcgccgccgccgccgccgtgcgccgcggcggcgacggcgacgtggactgccttaggtggctgtccaccaagccgagccagtccgtggtgtacgtctgcttcgggagctgggcccatttctcagtgacacaaactcgcgaactcgcgctggggctcgaggcctcgaaccagccattcctgtgggtgatccgctccgactccggcgacggcggcggcgagcggtgggagccggagggatgggagcggcgcatggaggggcgcggcatggtggtccgcgggtgggccccgcagctggcggtgctggcccacccgtcggtgggcgcgttcgtgacccactgcgggtggaactcggtgctggaggcggcggcggccggcgtgccggcgctgacatggccgctggtgttcgagcaattcatcaacgagcggctggtcaccgaggtggccgcgttcggcgcgcgcgtctgggaggacggcggcgggaagcgcggcgtgagggcgcgcgaggcggagaccgtgcccgccggcgtgatcgcgcgggcggtggccggattcatggcgggcggcggcgggcggagggagagggcggcggccatggcgacggcgctggcggagagcgcgcgcgtggcggtcggcgagaacgggtcgtcgtggagagatatccgccgcctgatccaggatctgacggacgcgactgcatctcagccttgaccatgacttccattccggctcatttcattatcgtcgcaatcactttttgaaaaattttgtagaaaaaaatcgagtgaaaagctatgatgacctttgtatgcttcttccgttctgtatcatcaacatttgtttgtcccatcactcaactatcttaaacttatcgttacatcaaaatattttctcatttagttctaatatatgctaaattacctagaaaatttctattttagaacaaaggattagtgtgtgtatatataagaaactcttttaattcctcaaaagatattcccttatttcttacacgtcatgattattaaaaaataacacgataaaatgaatgtgaagaaatgtgaacaagtgtggtcatctaaatgcgagattagaaatacatatcggggacattcgagattagacatttcaaaccaagtaacacaagtgtgacaacttttgccgggtccggttggctaatctattttgggccacctcaccggcccatgaaaatattctcatttttatcgggccaagaaattctctgtcggacaacgaggcctagcccacggcccgttcctcaagaatctggataaggacatcaagaaatggcccgtttggtaaaatttcaacttcgaatggtcagtttagattggtgtcattttaaactatacaattgcttgttaaaattgataaatttatcactgtatttagtttgttatcaaatattggtaatacatagaaaattttggcacaacatatttattccgttctaccaaaattttggcgatactgccaacttaccaaaaatttggcaatgccaaattttagaaaatctgattttggtagtaatataaacagaccctaaaaatctgattttggtagtaatataaacagaccctaaatttaactataggagttggatatgaagtaaattataaaacagtctaaactcaactcaacttctctatttaattttgtgagagcgcttcagccagtttccgttctattttaagtgaagctaaaactgtttgattagtagcttcagaaatcaaaataaatggagctaaagctgaagccgtgtcaaactagcccctaaaagtggccgtcgccatcaaatcggtctggactccggcggatatgccagcgagaccgaccccgccgcgtggcacccccgccattgttgatgctgacggccgcggctcgcgaggaagaagaagaagatgccatattccctcgtctactcttgccgacgctaatctcccccggttccgttaattatccccggtcaaatcccaccaatctctttcatgcctcctcctcattccctgtatcgaattcatctttaaaaaaaattcaatggcgttatcatgaggaaaagggcgaaacctactgacgtgtagctcagggcgagtgctccctttctccgtctctctctcgaggttgccgtccaacgtccatcagtcatcgtgatgattgagattgacatccaatgtccacacgtagtactcacagtaatcgaattgatttggtaccattgctttgagaaattgagctagattgatccatggagagctgaagaaaaatgaagtgctagtactagtgtcgaactgaatgtttgcaagatttgagcaaacaaaccatttatgccgtatggataatacaagccaggggaaaaacaagggccactctgtgatcacaagcagcagagggcaacagcagcaacagcaaatatacaacttgttttaaaatcttttttacaattaggttctcggatgcgcacagctaagcaaacatcacacgaagaacggcagctagattaatccagcacacaaaaggcactgaaagaaacagagcagcagcagatcgatcaagatcgaaggtttgcagaggctggctgcaggaagctagaagaaggatcgcttggtaggcaccctcccaacagccttcatgaagttggcgagctcgagcaccttggcgagcttgaggcctctcttcgcctccgccgacgccctcttctcctccgccttgcgccgcgccttcgcgatgtcgttctgcgtcctctccagcgccttggcgcgctgctcgtccagctttctctgcgttagttgttcagtcatcaagaacacctacgtgagtaacattttggagtacatagcagttgctgctaagcactattcagtaatcagatatgctttctaaaagataaaactgcactatgcaaaagcatgatttgcagagcatgtaatggagagagaaaaaaaggcttttaaaagctggattctgacaaagaccgctctcctaacgttgcatgattgagtagtggttaactcatctgatgtcgcatgcctacatccaaaaaggatagatagtactagtgctactctgaacattttcttgcaagaacagataccctgctactctgctttgagttaatcaccaagaacaaagttggattccctttgctcggaatcaaaatctatcagctataatttcagatttttgcaaagcctaaacggacaacaagaattagatgaaaaatctgcaaacttgagagtcataaataaattcataatcagttattgagttacctcgatcttcttgagccatgcggatgctttctcgacctgctcggtctcccacccgttgatgacaacctcctccctcttgaaccggttgttgatcttggccacctccgccgtctgccacgccgacaccttcgtctccacctcctccttcttcacctgcctcgcctccaccggcggcgccggcgatggccctgccgcggggacaacctccagctgggacgccctgctcctggccggcgtggcgatcgggtggctgtccggcacaattgccagcgggttggtctcctccagctcgtcctcgccgatgctggtgagctggtcaccgccgttgttgccgtcgttggggccagtctgcatggtcgtcccggcggcgaccatggccgtgaactcccggctcatcgtcatgaactgctcctcggacgacacggaccggtggctgctggccgtgtcccacgagtacgcggcggacccgagccgcgtgggtggcgtcgtcgtcgtcgtcggcgacggcggcgtcagagggtggatgtcgcggtacgtggtgacgacggtgacctcctcgtcgtcgcctgcagcgacatcgtcggcggcggtggcgggcgccgacagctgtagcgaaacctccggctccggctgcggcggcggcgcgtgctgctcatgcaacatgtgctacccgcgcggcggcgatggcggtggtcgtcgtggaggctccgccgccgtgcatccgaagcgccgccgtggttgctgctggcgagctgaggtggtgcgtcgtgtcatggagtatgtgcgcgcgtattatatggcgggagatgggcatggagggggggaagcgatggggccgggtgtggttttgtccattggcgccaagggggtgacacgtacttgtctcgcggtgcggtgcgttcgccattggcgccaggttaaagctggtgcatgcactgcgcctgcgcgatgtgggctttggtcaaggcgagagcgagtgttttggtgcacctggagatcggcgaatttgcaagttggggcgcttgtttaatccaacaggatgggttggggaatgtttcttttggttgattaattgattggcaaatggcacagcgtggcct

SEQ ID NO: 81660 - DNA, 22222 bp, Oryza sativa
agatagaatgtttaaagcttgttttttttcttggaattttttatcatatgttctctcatttattttaaattttagtcatgccaagtgacccaatcatcttgcaacttccatgccagctttagaaggatagattctattggagcctttactggagggatggagtcctccgttttttagtctgacaagtgggccacaagggacctagatgcctttggttatgtatggtaagcacagtctttgtgtattatattgtacttgtggaataacaaagtcacatcgattggcctaataagttcaagtaaaagtcacccatattaaaaggaaaacttaatgtacaaatacatatatatgtttaaggtagttcacagcgtacgtgttttttttctaacaacacgcacaagaggtacatagttcacagcgtgcgtgttagtacatagtagattactatcgacaatagctcagaactagtttgcatcatcgagtaccaaattactagctgagtaatcgacaatagctcagaactagtttgcatcatctaccatctagagtaccaaattactagctgagtgcctctggtaagggatgcacatgcacaaaacattaaccatgcctgctatgtatccctgttatgtgtttccgcagttagaaataggcaaatagctgagagctcagaattaaagtgactgctctgccatctagctgagagtggagtggtgagagcctggtagtgaggatacagaaaacaacagaaaaaaaaaacttcataatgagtattcagaagaaattaataacgtcaaaaagctgaaaaaaaaagagaccatttgctcttgattaataggataaatgaactgaaaataaaggaaaacaatatataatgacataatattataactattattaccttagtgaaagacttcaataccatcggacaactctactgtcaaagtgacaagtcttctagaacatttacgtacatgaaatacaccaacctgttaaatcaaaaggaatgtttgttgtttatggtatgtaagataagtacaaatacatcgttttaagatacccaagtaggagaagaaatttacctcaacatcaactttagagcccgagtcattacccttctcaaggtgtctctcaccaacacccaacagtatatcttccaactaaaataaataaaatggtagtcgaattactgtataaactaaagtactccacacatgcacacgctatactttgtgcattttaggtcttgtttcgaagactaacttagattttgaaacatccaaataaaaagccttaaggatgacaattgtttgatacctgagttacatttgaaatgttctctccttggcatgagagaataacatcaccaactcgaatgccatgtttctcagcagcacactgagaaaaaacctagtatgaacccagaagagttataatataatatacctgcagaaatagttagacaccataaacaagaagtttacctctcttacaataagaccagaggcaatgttgtatttacgggacaatagctcaatatgcgccatttctagaaaatccactgttcttaacttcaagccaagctgaggtcgaacaagttgcctacataagattatcgttagattgttgcatttattctaggaatatccaaaatggatcaattatagaaaacataagcgtacaatcgctacattttcagcaacgatcaaccatggagtattaatttatatataagcaaggttcttcagaaatttaaacaaacatcttaccctcttaaatgttatgcatacgcaaattaagtttgtactcattcgttattaggcaaaatatggcattgtgtgggtctaaatatcactttaactaataaaatggagcgagtatggtctggtagcgtgagaaaataattaccacccacacacacctcaaaagaaaaaggaaacaggcaagggtatgtaaccaattaagattaacaaaatggcgctcacccaaaatttctccacaatctcatacacgtaaggattagagagcttggtatgaaagcaacaataggtaacgtgcagaataacatccccacaatgtttccactaaaatctgccaatgcacctccagtaccacactgcaaacaaaattggattgagattatatataagtacacctaaatattcagaatataaatatatcattaccttaggaatggaaccatctatgaacaaatagtgattgtgctgatactcataaggatccacgtatttcactctgactgtagtgcaaatcaaatctgttttattatctctagctagcacacacaaattctggccatactccaaatcaggtttcaacggtacaattggtagagtcaactctcccatagtttcaaagaaggcaatatcgaaatgcttgctgaagtacagcaagcgacaatctgaggctgtgtcatccggtatgcgaacaataacctacaataataagtacataaaagagtatatgaaacacttcatgtgaaagacaaaccggttatactattttgaacactatgttagaccttttgattttactaagtacagtttgaactaaagagagagatgaggggggacaaggtacaaatgtacttagcattgcaagcacggtgaccagaaactagatccttgattccaaggtgctacaaggagtaagggtgggcaaaaattagccgaccactagacaacgaaccaaatgcttgttcggcttacgttttttttccttgttttttttttaaattgtcattggtttgtatctttacgaaccgaatactagacatgcttttgggggggttgaaaacccttcccctctagcactcaaaactgagcgatagattatcaatgattaattaagtattagctaaaaaatttgaaaaatagattaattaatatgattttttgaagcaacttttctatagaaaattcttgtaaaaaatgcaccgtttatagcagtttggaaagtatgcgcatggaaaacaagctaatagaagttgggaatagggagtaaagaacacgcccttaacatgctaacaatcacaagcatgctaagcttctgaagtgttttaccttagcctcaggagcataatccttgtatgaccaatcatcgaagggtttctttgtgcaaataatccaagcagaagtgagaattatagcagttttttttacatcatcccactcaacaacaataccagtacattggttaatctccgtaccatctgggcatacacaaaaagttagcagaagcaaccaacattgccattagagatggaattatacacgagatgaagaatatacactaccgtgataagctgaaaggctcacaacagatttggaagcatttaggaatattttcttctgcttggggctataacattccgtagtacaagaggaagcacaagatgatgaccttagtgtcggtaattgttcctgacgagctacaacaatgatatggtgtataagaaataggtgagcttaaattgcgttaaattgaattaactttaattctttagttggttctacaagcatgttgtgggttatattaaattgaattggttagattcatagttgatttcataagtttccaataaataaattgtgaaaaactaaattggtttcacttcctagttgatttcatagatgtaataaaacggatgaaagaaagtaaacaaacctagtttctcctcgtacttgcgataggcccagtgataagcttgtgcagctactggatcatcagtaatgccatacaccacctcaccggaaggagttctcaagataggcacgagtggggcctgcggttcacgaagtggagagctatctgcagaggaatccgagtcttgctgatcttgtgctacctcccactgcttctcctctgaagctatggaggagtcgttgaattgcgattgaggtgttgaaagtggtagatccaattctgattgtttggactcagttgcctgtggatcatatgacattgtcatggaatcggctctacgagggcgagcgaaccagtatgtcggaggagcctccgtaacagcggggaggctttgcgacggcgacgcccgcgatgatggagcagggagttcctcccggcttggctcctccatgctagtgcctccacaagccggcgacccgcatggcgcagacgacgacggtggcatggtagacatacctggctccagcgaagggggcaacgaaggcctctcctggtcctcgtcgctcgccgctcttctagtcctggaatccggcaccttggatcctggtcccgatctcatcttcgccggttcggatctcccgcagatcgcagtcgagggccgacggccgaggaggagagattagacggaggcggcggttcggagcgcccgcaacccggcggctaagcggaagggagtgctgaaaagccaaagcaaaaggggcgctttttatttgtagcgtcaaaccttggacttcgattggaataggtattcccgaatacaagtaacatttttatttatacttaagaaaaaaaagtccgtgcgttgcaacaggtgaatgctattttaatcttattattgttatacagtattacggtttagttaaggtgaaacacattgttggaatttgcttggatattttttttaagaaaatcatgagctacaattagtccgacattcatctcaagttagcatgcgtggttttttaaagagatttcttatacgattccttttatatattttcaaaagcaaacaaatttaaaatccgactcaaacacggattgtatttttaaaagcgaacaaacttaaaatccatctcaaacatgtatcagtatttccaaatgcaaacaaacttaaaaacccactcaaacacggataacgtaccaaaataccggcaaaaacatcttctgatctctactattataaaaattgaaaatgttttcgtcagtattttggtacgtcatctgtgtatgagtcggtttttaagttcgtttgttttttgaaatatatatccatatttaagtcggtttttaagatcggttcttttttttaatacagaaggaatctctactattataaaaattgaagatgtttccgtggtccgtcatctgtgtttgagtcggttataaaaattaaagatgttcccgcggttcgtcatccatgtttgagtcggttttgattttatattttgattttaatctatatctcttctctatctctatctctactattataaaaattgaagatgtttttgccagtattttggtacgtcatccgtatatgaatcagtttttaagttcatttgcttttggaaatacatattcgtatttgagtcggtttttaagatcattcacttttggtaattgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggacgagagcctccaagcactcgtccctagccggagccggcgtgttagctcctggggatggcacgttggttccggtcagatatatgccaggcttcatcctaaccattataggcaagatattgtatgaagaagggcgaacatgcagattgttaaactgacacgtggtggacaagaatgaccgatttgtgaccggtctgacaatggtcatgtcgtcagcagacagccatgttccaacgtcgcgcctgcttccggcggaagtggaggtaggtatgggccgtcctatcagaaggtcattcggacggcagccatacaaatctccgtccattaatgaagagaagtgaagttggagggaagagaggatgagtccccacacaaaagaaagagagggagagatggtgcatgtggtatccccttgagatataaaaggaggaccttgcccacttagagagagggaaaaaaacgatcccagaacaatcgggggctggctcgcactttgtagcttcttcatacacagatccaccaaaacacaggagtagggtattacgcttctcagcggcccgaacctgtatacatcgcccgtgtcttgtgtgtttccactctcgcgaactttccacagaccaagagcttagaacctcacccagggcccccggccgaaccggcaaaggggggcctgcgcggtctcccggtgaggagccccaagctccgtcagtaatacagaaggaatcatataagaaatctgttttaaaaaaaactcgcatgctaacctgagacgatcggactcctaactacagcttatgattttctaaaaacatatatgtccaagcgaactcttacagtaaatttcatcttaaaaaaatcatattataacaataataagattaaaatagacttcacccgttgtaacgcatgagcatttttctagtagtatattgaaatgtaattatattataactatattgtacactataacttgtattaaatcgtacaaagtaatatataaaaagaaagagttcaccctttcaatcaaacatatgaaatttctactgctgatcccgtgacgttacctggtcacgctttccccgccgccgtgacctccgccccgccataacacccgttgcgacttagggccttcacagtgcggtgaggtggcattctctcttgccatcccacataggcaaagcttaagggcacatgccacctttgcatctgggcccaccgaaatgaggttcttgtgtccaaagaaggccaccggttcttgggagaaaaagtagggcgtgtgaggatggaaacagcactgtggagcaagtggcatcggagtgagcgtcgccgtcctctctttcctctcttccgctggcaccgcaggaaggcttggttgcgacgggcgccacccatcctctcatgcctccggcggctagctctgaactgggtaacacttcagctccggtcgaacacccatcgtcgggcgctcactgctccgtcacagccgccagcgaccatcgaccatggcacacggcctcgacgtcacgcatatatatctgcccgccgtcacctgtctgtgtctgctcagtgctcacgcttgccgtggacggagcaaccacttgctgcaccattctccctacccatccaccgttgcctatttctgttgtatgttctcatttgcacattgcatggtaggttattggtcaaatgcttactcagatgatccaatctatacgttctcacactaatcatctataaaaacttcagcagccaattcgtggtgttagaattgttgaactggcgtctactactcttcattaaagctgcaacaacaatttcagctaccccttttggcagtcttttgccgtctttcttgttaggccccgtttagttcccaaaaacatcacattaaatcttttacacatgcatagaacattaaatgtagattaaaacaaaaactaattgcacaattagaggggaaatcgcgagacgaatcttttgagtctaattagttcatgattagttataagtgctacataaacctacatgtgctaatggtaaattaattaggctcaaaagatttgtctcgcggtttccaggcgagttatgaaattagtttttcattcgtgtctgaaaaccccttccgacatccggtcaaacgtttgatgtgacacccaaaaattttcatttcgcaaactaaacaggcccttagtcacaatatattattatttgatcgtggatcccctcctatcattcctctctttcttctgttgataaaattactgaatggaagacttttaacaagctgaccatatatttagtaaaatgttgcctacacgttgctaatttgtttcattagttgcttcttattgttctagcaacttacgtgtgaaagcatcgacaaactagatcttttttcttcagattttcagaaacatcattgagctccatttagttgtgccaataattatgaatcatcagcgaaacatttgatgaatgtatagtactgaacttccaaggtaatatctccattctccacctcagcatagaaccgtatactatttgcttgccatgaatgcagccgtcgtcttcacttctttaaccaaaatgtttgtcattcagcatgcacaactaggggtggaaaaaaaaagggaagttgaaataaagtggcaatttttggtgagaaaaataaaacatgttcaccatttcaattcattaatccatggttctcttctccatttgtaaagaagatgcactgtagactcaacaactgcattgttccaaagttcttccggatataagcattgaaagtctttttcatggccatggtctcttacaagttaatttgtttctccaggtcgaacttactaaaagtagctgtgatcattattggaggataatttctaaacgtcaagacctgaattcttcattttttttctatatataatgtgtatcaaaattcccgctaataattgacatacataattgtttggttaaatatttattatgacctagatacccaagttatgctccccgatatgtactagattttttatttatgtaacttcaagttgcctgccgtactgctttgaaccaccatccaaactaggacaagctcttccaacagttttaatttaattcaggttggcaagtcactaaatcattttttatgaaataaaccgtccaaattaactaggacaagatcttccaacggttttaatttaattcaggttggtaagtctttaaatcatttttttatgaaataaacaatccaaactaggacaatttccgaaggatttacatggagttttggagccaagccccaggtcaagcctatgttgtcccaatcctagggccgcccccgataacaacccacgtatttatttgtaggcctaaatggtgaaatgttctgcttcctacaaagcattataatatatattgcattctatcttcattaggcctcgtttggttgtccgtgtatattatacatgtgtgaatagtcctacctgtgtattaagtgaatccacaccacccacccaatacacagcatgattcaatacacagtgtgggctggtggttcgactggtgatacccagggttgactccacagcaagtacgtagtgctagctaagctagtggcatgcatggagagtcatggagagttgggcacagagctaggtttaccttttaggcctcgtttgttaagaaaaaattaatataaaaaatacaagaaaaaccattataatatatattgcattctatcttcattaattggttgtagacgcaacaattttagagcatatatcactctattgatttttacattagcattacaaatggatgaggaagtaatatggaattttgtttatattttttaaccttctaaattttttattttaaaactaaaccatttcaaaacttattttcaaaatgaaccttttggccacaccagtccgcttgacgtaacaaaacaacactggcaagacccctgcagcgggcatgatagtattgttttgtcacgctagtttggttggcttgtcaaaaggctaagatcttgaaaataagttttggatagatttatttttaaaattaaaaatttaaaaggttcaaaaaaaattaaataatcttaatatggctggtgttcttccttgatcacacacctacaactttcccatgacacatcctatggcccacccacctccgttcaacaaaacaaataaccgtacatgcatgtactttgcaagcatattttgtgtgtttgaggctgcttattgtttagtttgtttggaacaagtttattggatcgtgtgcaaatcatcctggtagattaataactcatattgcgctttatttgctaatatgtttgaccacttatactattgcacaaatgttttgcttttaaaacacttgtatttgccagcttactctgattagatacaatttttttagctatgataagttacaccaatgcattaactcgaatattggtttaccaggtcggcaagtgtcagcaggtgaaagaaaaaatttattttgttggtgttaagttcactggaaatatttttaactgaacttttatttgcttatcaaatcctattcactgagcaacgagactgatagaaggcattcagtgggtacgaaatgtcgatctagctctaaagtttcagaaatcacatcttactatatggagggattgcttaatgtgtttttggtcactcactattcattaagttcttatcgtgttacagaagattggatgtacatatggcagaaatataatgttgtcatgtcttcctacttatccttggatgataattcacaaatctgcatcaaattcttaagcatgcagttcaagcgatgatggtggccacaactggagattccggtggtagttaataatgtaagaatcatagttgtttactgacaattcctataatgcaatacatcatcaaattatttagatagaaaagcatttttttgtctaaacaatgattattgccgtttatctctctaggttcaggccttgaggatcatgttcaggactctgctgccttcaatttgttccatcgataattgagcgctttaatttgtgcactgttgaactatatacgagagaattttcaaccgtccaattctaacattgcagagaagtctaaaatgtcagtagtatgcttgtaattttgttgttatacttggtttgctttattgacatttcaagtttaaatattattctctgtaattttgtagattctataaattgtaaattttatttcatgtatttttagtatgtttaaatatgttgttcaaccttttagaaaagaaaagacaatgaggattattggattgcaatcaaatggaatgtgcaaagtaaatatattattggaaggattagatgttttaatacgattatatatgaaaaacgtgcattgtacgtgcgtgagtactagcaatggaataggtaagggtagtaatatatacatgctgacactacggtattatttcgatgcaaatcaaattaccataagataatatatgttttattaaacgagattgatttaaaacatcaaaaaaaacagtaacagtgagaaaagttattttgttgttagtatctccggttataaatatttgacttttgctctcatataaaagaaaaccatacttacttgacctgcttgataacatgaaccatttgattgttttttcaagttccaatgaattcaagcaatattataatttttggatttctatccactgggatcccgtcgggagtcgggacgggacgggatccccgcattcccacatggtcagcaaatgacttttcacacggaagcacgaagaaggcgtcgtacgccttgttggcctcacgcgctcccagtccattgctgccaggagctagaccatcgtggtcgcgagcccgcaacccccatctaccgccagcagccgaatcgagaggagtgtctccattggtgcccagcgaactcctccatgacctccaccttccgacggttgcccctattcctccttgtgcttgctgctccttgtccttgttatctgcaattgcagggagggacaatgtaggggagcatcctgctgctccccctcttgtctaggattgcggtaagagaagatgggagattgtggagagggaagatggggagcgccgccatcgccctgggggaggacaaggagcagcgtcgtcttcgccacagcaatgctggtaaccatctccatcccttcttctcttccccctctcggctcagatttgatactcgattggtgccatgtctaatagcggtaggtataggcctaataccgatatgtatcaactggcaccgactggggtattagctagtaccgatgaggtattagttaatacctgacgagtatcgagtgatacatatgaggtataaaatctaataccaacatgtacaggaatctgatacctgcttggtatcatcctgtctggacgggatcacgctgtatagcagtctcctattatttttgataaaatttgaccattttctaccgtaagtcaatggtttcaaaatggttttagcgaaaaccagaaaaaactggtttttggatcgttaaggatttcccccaaatagtccgatttttcctccacgccgataaggagcgattcctgcttcattcaggcgagttgcagcctgcaatccgaactgaggacgggtttttggagttagctcaccctcgcgagatcgcgacagcagagtgctttcgccgttggtgttctttccgatctcaatgcatttcaccggtccaaaaattcttatctttagaccattctgagccatttacgaacattacggcaaatatgatcaagacatttatagctcccacataaataagaagttgtgccacagctataaagtaggaattcaataaaatatagaataaggatattattagaatttttttgttagaatccaaaagttctttactaactagaaagaaaaacgaatacctagtgcactaccaacccaaaaatcccaactctgccttacgtaaagttgccagagtacgattaacctctggatcgtaccattcgagccttttttttcatgcttttcccggcggtgacctcctccagaccagagaggagagcaatcaaaaaagaaatattactcaatcaaagatccaactgatccccatgtctgtattgcaaatacgcatggtttcgatgtgcaaaagcaaaccatttctattggaaacattcctataatgatcgtcgagaggaaaacagcccggatcaccagctaaggcccctaaatgaccgcttagtgataaaggaggtgggggaacaattttttctcagttgcaatatagaactaatttttttgttaatttaggataagataggtagaagttgtaagtcttattgcaggaatactgtacttttcataatagaatcccctttttttatttattatacggatatacgttccttttagtttcgactttagggataatatttttcgctatcttcttccgagaaccacctaaggttctgactaaaaaagtgaaataatttaattgaagtaagaagtctccccatctgagagacttcttacttcaattagtccccgtctgctttgcattttaaagaaaaagtacaaaaacatatttattccatttagctattgctattcttttcctgatcgcaggtcatatgtataggacccgccagcgttcatcctgagccaggattgaactccccaaaccaaagaaaaagagaatggaagaattcttcccttcaattcatagttttcgaaatctttttaaaagtggattaattggacgaggataaagagagagtcccattctacatgtcaatactgacaacaatgaaatttctagcaaaaggaaaataggaaatcgatcaaacgatcccaataccgtgaaagagaaactgcacgctctaccactgagctaatagcccgtcgtgcgggcctcccaaagggaggcctgctacgccaaaagcgagaaaaaccccacccctttccttttgacatcctcatgccgccggaaggttaaggaagttggtgaactgatgacagggaagccggtgaccgaagccctggtggggaggtcataagcgcctataccgtaaaatcgattttcgacggaatcaaaaagacatatctggtagaatcataaccatagaatccaaatagcctccgggttttttcagatttggcaagcatccggaataactattcactcatgggatccgggcggtccgggggggcaaaggaaccggacatgagaatttttcatcatccggctcgagcaagaatgaaagaaataaagttttgtaaaagcaacatgaagaattgctcagatgcccgtgagcgaggcttacttgggtcgtgtcggctccgaaaacttgcagttctccccgtcaatcctcgccatgagtggaactccgaccataacataattgacagatccaagatgtgctccggtggcgtatttttttaaaacgaggtcctcgataacgggacatgaagacgatctattacattctaattaattccaattatacaaaaggttcagatagactaagcaaaaaagggcttcatttcgttggaaaatcacatattcatttccttcgtatgaacagaaaaatatgatgacttaaagaagttcactaccacgaaccaatttgttcttaattttgtagcttgtgactagaaatccactgctatatccgattataagtatttcacatcatcctgcaatgcagcagattgaaaaaatatttaacttggaaacgttcgaggtggagtatttgtttacagttaggacaacattacgaagacatgtagcagtgataattaaaaaaacaggattgctatatggcattcgaataaaatttggggatgaaatcttacaaattttggaccattggatccatgccaagattcgtgcatcggcatctctcctccaactccggcgggctccccttcttctccggtaccggtgacaccccaactccggcgggttagggtttggggttggggtgagggtaggaggggggttgggggagggggaagagggagggggtttcctcggggcttagagggatggccgtggcgggggaaggactggcggtggccggtggactccggcgggcggcgaggcggcggcagcgccgccgaagctgcgggaatgtaggaggccggtgggccggcgttgccggtgggggcaaagcaagtgtgggattagaaggcgccggccggtggtgcggatccagcggcggggagccgccggatacggggaagacggcggggcgggggcacctcgtcgtcgccgccatgagaaagtgaaggggaaggggggagggggcttgccggcgccgttgaccttttccggccagccgcgaggcgagcggcggcacggtggggcggtggcggtggtagcggcgacggatcgtgcgtgggacaggaggaggagggtggcggcgtgatctggaaccgaggggaggaggagttagggttaaggggctgcacgaatcttaaagtacatccaatggtccaaaattcgaatgataggagttgggattttctgtcacataatatatagacagcctcttaaaaaaaaggacagaacagaaaataaagtatgattgtggcaaggaatgcaacacaatgcagttgttaacagatctagacatctcaaacaatatgtccttgctaaattgtgagggagaggtaactggaacctgaaaagatgtgaacttgagttacatgctatatagtgagggagtctactacgttgtgaacctcgtctattgctgttccctagattctgtccaagttattctctagtagactttcagcaataaagactgattagtacaagttaagtggttcatcttccctgcttgctccaaatcctcaatggtcaatcttcttccctactgtagcctgcctgttcatctgagaaataaaactgcagaaaagtcacgtaagaaatgaaactgcagaaaaggctatctgtgacttataaacaatacagatgatgaccaagcagtgatggccgtccaacatattgtcaggtaataagagaacaaaataaaaaaatgctactccatggaaatatgcaatccatcctactaactgctggctcattgcttttattttccgtctagtcaaaaactaattgcctgttagccttttgaactgcggttcaaccgccgggttcaaggttcaaccggtaaaccaaggagtcaaccaggtcatccactgatctggtttttcatactatggctgacgatgatgggggacgggtggggccaccttctactcgttgtgggacttcttcggggaggatacgacaacaatgggcattgcgtcccaggacaacatgcggtgcctgctaaagcagtcgaactaaccaacggtcataggaggtagtatttttattactagccccgtttcagtttataagacgttataattttagttaaacttagtcaaatttaaaatatattgactttaacttaaccaaagtcaaaacgtcttataaccttaaacggacggagtacaagttatagaatttaaatttaaattatatgtttgtgaaatgatatattaatttgaatctatcttgtttttttatttttttataactatttagttgatgtcaccagtggaagagatcagaccagccgctttgagctaccattttcagacggcaagaaatcgataatctgacttaaaatcccaaagagaattccaaacaaaggggatcagatattcagatgttcaagtatactagcctagttgcgtatagctaagcagaccagataagcttcgggaatccttgcgtcgggcacacatgcatgcccaatttaaaagaaaaaatagtttaaagtggtttgcacgcatgcgtcacgtcagcgcccgatttttccactcctccatcaggcgcccgatcctgagttgcgtccgataagcttcatctcactgaaaatttcaggtggcgcgtaaaaaggggttgatgaagggatgaagtttctttttctttactatgatatccttgccttgactacgccagcttgttacgatatgcatgtgcctgatggcttcctatcttctttcatatagagatatgaacagattactgaacatcaagcagtacagggcaacaaagctacagccagcaaacactcaagcaataagaataacataaataataaaaccaacacataaggagtaaacaattattaaagtttatttgtgaatctttattcgtagtagacaaaaatctgccagacattcatatataggaaagaaaggacaggtggccaagaccacatcatgctcagatctgcacgagccatggaatgttacctcatcactgcttctcagccatgaccttgaccagctcttcagcatcatcaatcgccttcgaacacctgtgtgctaacagggaggacttcccaacctggtaggccactcctgatgccttcacctgttcttctatcttgccaaaggaggccacctcttggtgtgcatacaccacactgggtacagttcataatctaagtgaccttttcctgcgatgaattcaacacaggcaatggatcttcttcagctttatgtgcaagcatgggtccgggtatagcatccccagttgtgtggacacgcttaacatttgtcatcaacaacgtccagaatactctgctctccaccagctgcaggctccacagttaacttgacacaactaccagaggcgtcaaccccaactaccattgtcttaagcatgaatttcattttctgcttctccagcatatgcttgaatggcttcctaatttgtccatccattgatgggacaatgtcagaggcaaattcgacaacactaacctcagacctggcccgttccagaaagaaccgtctctaaacctatgtatccagctccaacaatcaccaatttctttggtatttctgaaagaaaagagcaccagtaggcagtaggtgacaatctttttctcatctattgtaacttcagggagagattttacatctgaacaagtggcaatcattatattcttccctttgaagattgtgctacgttaccgtgcaagtccacaggtacttctgaagggtacaggaacttccaaaaacctctggcatactcaaccttgttcttttttagcaggcacattgtccttttgtgccatcatggcagccaaatctatttgataatttaatcccatggtgtgcaaaataagactttgcctcactatgaatgcagtaaagcctgaaatcatgaagaagaatcccaagtcaggtgcaatgcaatagcaagccaaacaatgcatttacaattagcaggtctcgaaatatacccatcttccaacagagaaatcaagtaataatttggtaactcagctgggtttccatcagcattttagcaagaacctcgtgatgtatttatctggctttaccaaggtttacagggaaattttgttacacctgggtaaaaatactataaatacaagaacaataccgaataaggtgacctcaaatctttatatgtttcaatcagcaggttgccagaaaaactaaacaattaaaatgaccttcaaaatggtaaccatggcacaatctaatggatgtgcacagtattatctacacttgaacactatttaaagaaaacacttaacataaagatactatttgagaaaagatcacacatcatttagaagaaagagcaagaaagtgtcaactctaaatgagagaaactgaaaccatgtaactattgtgtaattttgtgatgtgccttcttttcaaggataatacaattgatgttttttattccaatccatcccccacttagtgcaattaaggtattttcctgccttcacgctttgccacgtcaccccttcatttccatccattggattactttgattgacggcatcggattgcatgcccgagcatctatttcattcattactgtctcatacccagcaaattaaacccagcccaactttcctacttggcccagcccatctcactggctatcgtttcacttgcactatcagcgcaaaaggtgtcccccctgacctgaaacgatttgctgcgcccgcgctatcaaattctgtaacagctaggagttgaagcgacagcaatataatataggccatggccattcatttccctcaatatatatgccttttccttttcctatcaaatatgaggccatgaccaccaacgtgctctcaggcactcccagaccaatcaatcttcatcacagggagaaagaagagacaagatgatgagcttccacagctcaactagcctctcaggatacgccaccacaggttcaaatcaatatgttttagtcttattagttcaatcaggtttcttcatatatactggcccttccagttatgtgtatatcctatggtgctttcattgtcagatcctttttcttcttctcaagcaattgaagaatgcaggaaacaagatcatctgttggttcactcataggcgaagcataatggctatatgaggtggtaaaactcttaaatttgatggaaatttttagtttgtcaaacttctttgatatctgaattttaatagcgatctttatatgaatatgaattatcatctttatcagcttttttttctatctgtatttgaatgaccattttatctggtgaaagtgtctatcttacctttactgaacacctaaacactttatattcatgtgccactgatagagatgtattccatcatgcccatatttcagcttggtaatctttgaattttgaaagtagcctgctttgcctcctgagagagatgaagactgaacaagtaactgaaatattgcattcatgaggcacagatgtggggtaaatccttttttttccttttcagttccgatgacttacttgaacaggaccttctgctaacattcttataaagtagttagtgtttaagttatgaatcccctgctatgaattggttttgctaactctgttattcgacttggggagcaatgtactccctccatttcaacatgtagaataagacgaatggtcaaacattgtgcgaaaagtcaacaacgtcatacattttgaaaagaaggtagtatatgattttgaattattatcgttagcctagttctcacagcatcactaaacatttttctttcctataccaagactgatcaatgctagattttcatatttagatttttttttctattgcccacagcaatatctacactgtcagttaccaagatatatatatcatccgattccacaactgatttttttaaatgttgaacaaaaccataacattcacaccaaaaggttgtcctaaagcaatacaccgttttgctttccctacccactattgttccatgaattcccacagcaatgcgcaggataacttctagtatattataaacaagcgagcattgtattggataaatataatactgcattccccaccaacctttgaggccaattatctatcactagcttctaggtttattagaacaccaaaacaacgttccaacttttgtattgtattggataagttgaagccacgatatttctcctgccatacctgttccaagtgagatatgaaccttatcacctaaactgacacagatgagatccattagtaaacttcccagcaacatgctcaataataaacaattaaacatccctacgtctacaaagtctcaactattttagctaagaggaaggatgcatttatgcagactagcagtttaataacagaagaaatcacaagataaacagtcagtttactcaaagaggctcctatataatttttttaaaatttggtatgtttgtcaaacacctcatgtggctatcagcaacatatactagcagaccccaaggttaccacacactaattggatatgagagtttaaaaacaacttctaactggagtgtgagagctaaatggggaaaataaaagaacttcgaatttgttgtgcattgcaatcagaaatttgtctcccagaaataactccatcctatttctaacaaaatttatccctcattagcatccagttcaatcacatgatatgacaaagttaaacaattgggagtttggtacccaaggcatttgtcacctcccaggtgaatctattaactcagtaaaatctttctggtaaaagtgcgcattactacaactactatatatagtaaattgcagacaacactccatgcttatgagtagatcaagttatttaccagtcaatggactggctaaactctgtcttttctgggaatgcaattagccaattacacattgggtgtttgggacccaaggtttgtatcacctctcaggcttccacaaacagcagcagagaaaaagaaactgaaactacacccacagtcccacaattagtgctactccaaaccacccctagcgcaagttatcaccatgaagagttaagaaattgcataacctaatgatcacaataagtagaaaccataacagaattcacatctgcacactaataaatagcttggtgagaggagccaaacgtggcatttagatggtcgaacttttctttactagtatttcagatggacaattaaaatgtgcaaaccgtcccactcttctacccctgtaccgcatcaaacaacactacagcttacgcacctgtacaccgcaaaatcctaacccccaagattcgttgtaaagtgctcaacacggtcacggatcgacgtgctcgaatttttaccaatggacatatagatcgcgcacggagacggcgaatggagaacgcaataccttggaggggaataggggatgcatccaacgttgaggcaggtgcccccgagcttgcacctaatcttgatgcgcggtaacgtcggcagggagacacagttcgtggtccgcgttggacgaacgcatcgcctcgccaagcggggtccgtgtggtccgtggactgacagatctagaggatggaagggccgcgtttgaggggagggaggcgggggtgtggagggtggggaggcgggggtgtggagggtggagaggcggcagccggcagggccgggtcgccgggaaagacatgcccggaggatctcgtcgcctggccgccgaccaggaggacgatgacaatgacgtcccgccgcctcattaaaaaaaaacaaaaacaaaacttgggtttcatgtcgatcgtccgtattatttgaaaaaaaaaatataaaaaaaattaaaaagacaagccacgcataaagtattaatcatattttatcatctaataacaataaaaagtactaattataaaaaaaattcatataagacgaacagtcaaacgttggacatggaaactcaggatttgtcttttttttagacggagggagtacttctctactgctgctaaaatgggccaaagcctgagaattttgttccatcaatagagaattttggtcggtttaacgcgaaacggctaatgagcgattgctcgtctggcaatggg

SEQ ID NO: 81661 - DNA, 1363 bp, Oryza sativa
gatctccattggcatatatattccctatcttacagtctggaaaaccatcaattattcttggaacatcatagaacttttggttcctagtgcatctaccaatttgtccccgtcttgttgagccaaatccatagacagaattatctgcaagaacaaggactagcagtgtcatccgtttgtaacatatataacaattagtttgtcaatacatcaagtagaagaggtgtccatataattctcaggacgtccaataggaaagatatatgactgatgagctaaaacctgcaacatctcatgcatattcatcattagaacacaatgatggtgcagcatccctctgaaaagaatgctaaaggatggctcaaaggtacaccttcatagattccacatcatcagagaaagcagtggccttaaaattctcagatgactgataggaaatattatatggttgtggattgatgaccctcccacgtctcccgaatcactagtgcagaagggatggttctgcatccacatgaatgctttgtatgccatattgccatagttggaaaaaaatcaaagaatgctcactcagcccttcttcaaggaatcaacaaccctaagttgccggtatgtttggcttcaaagaagtgtataactgtgtataggtcatcttgttcttgattttcgctttcaataaaaattatcagtatggtcttgccctgctatagcgatgcctatcctcaattgaaaagaaaaaatattgattaattgtttctttcaaaggctgtttaactttagaaaatgcattacggaatatgattgggtcatttaaaagttgggtattgcccagacaatggaagatttctgagcaagtggtttcagaagaggtaacagagtaaatctgggtaggttcatgtactatgcaatttcttaaaaattaagctaacatcgcaacacatgatgttgcatacctttcaaaaggacaagagaatgacgcatcccaagtgcaagcctcacaacatgctttgtggtaaagtatgccacttcaaaaggtaagtttcttgggtggttatcaccagcaccgagctgtccaaatgaaccatctccacacatgaaaagctgtccagaatctgaaaataagaactagaaacatcacagctaagctcatcagtaatggttttatttttgaaacaaaataaacacctgaaatgcacagactatatgtgatatagagtataaagtagattttttgaacataaagcataaaggatcaaaagaaagtacaaggaaataaggtggtttcagaattggacacctgtagcaaatccagaatggttccatccagcagacacacaggttatcatgtagttctcaaagaacttta

SEQ ID NO: 81662 - DNA, 91111 bp, Oryza sativa
tgaatattttcttcttcatatattgctagaaaattaatgatgaaatatattcttttgataccgtgtcgatgccttttatctcctacataggccttcaatcgatctggctgactttatctagggcacacaaaatgatacatgtcataaaaaatattaatcaagtattaagtattacaaaattgaaaataggtttatttgattttttaaaaatacttttgtatagaaagtatttagaaaacacgcatcgtttagttcaggaaacttttgtagttcgggaaacatgctcatcttaaataacaaagtagccaatcagataagcactttagaagtcaaccttacgtactaaaacacttaatatgtagtatataatatactttgtcaatcaggaacaagccaaatatatcaattttatgtttccactaatcccatgtatataagttatatatagaaaccactatccattaatcgccaagtcataatggttatgaggcatccatgcattgtgcaactaataattagctgataaccaataagcacgtgtgttatgaggcatctacttctggtgaggttatcgaagaagccacgccgctgcagtgctgcttcacaccatcccaccaaatctcttcaaagtatttattttaataatggtataaaatggaattgtgagcactcatataaatgtatgcacatccaaattataaatacaattacacacctaacatatcagagaaaaatatttatcaaaaaaggaaaaagtacattcgtacatgagactactattcgctagaaaaaacatacatacttacgataaaaaatatcacatggaaccacattatatcacttttaattatgacattctcatctaaatagtgttgataattagcacaaataattttgataatatagattattccatcgtatattacccctgaatatgcatagatgaatcggatgtataatgaaagaaaaaacaaacacatattaactcatatttttgcaaagaatgatgataggcgagttcatatgtaaccgggatataaatatttctttaattattattaatcaattttcttataaaatatggtgagatatgacttattttagtattctttttataaacaataaataaatttcccgcgcatctgcgcgggtttttttttctagttactgtataaaagaggcagctgcccccacgatatatagttgtgcttaaccaaatcaaatctgacagtttgccagataacttttacctacttcgcagcatttaggggcataatgttcagcatcgacaaatttcaataagctgcagaagaacaaagtgcacactgcgcacaggacaatttgttctggatttgacatacaataagttcagaactcagaatatatcgcagttggacatacagttgtgttgtgaagagaattcaatgccaagtgaattgttcaaatattcatgtcgaaataagagtacaactctagagttgcaacacagtgaaaagtggagatccaatgcataagagagatatatcaagaggaaaatgtgggtaccattgtaccatctctctctggggtatcattgtacccatcagaattaacaaagatagtgaaaactgagcatctgattacaaaagaggaaaatatccagagttgaataaggatgtaccatctactatactgtggttttttgggatgtatcagcaggaaaaagagacctagtataaggaatacaactaacatgaagtttctgcagcatcagcattcgataaaaaaacattctgaactgcagctgtatcacattcatagggacaaaaaggaggcatatgccaaggcagacaacgctcccgttgatccaggcaaataggtatgcaccagctgaccggcctaacagtaatcacaggtacctccaggtagacactttcttgtccttgaaaatcaatagcttcagaaccaaagctgtaaatcagtactttgactgcattagaagaatcagagagctgttttgttgtcgatgcaactcacttatgaacactctcattaacgcaaattctgtgatagaattttgcgcgtgtataggaattcgtaaatgtcgtcatggcttatagcatatccctttccttcaatccggccatgataaactgcaaggatatcaccagcatgattgagtataggtgagccagatgctcccttttcaacattgatctttagctctataaattgcatattatagcctttatctctttctgttgtcagttggttgaataagcggcattgatttgaaacttgcccaatgacaacagtatcaggcctattaggtggccaggagatcatgaccacatcatttggtgctgaggatggattttctgcgagctttaatgactgatgaggtaagcgacatctttgagcatactgggtggcatagagtgtggacaaattgaactgaagcaacataagatccttacgctgatcaattttcaaaacagttgctacagtgtaattccgcttatcacgctcagattcatacaagtcaggatggatagtcttcatgtgatcttcattgtgcttgcagaggatgagaaacttgaaccacctgttggcctgctccttactcagtacaatattggctgaatagaaatcctcgaggatatgagcacaggtcaaaatgtatccaaaattctcatcctgataaatcatagatccagtagcaaagaagggctccttaattgtgccttctgcttcagatggtttcatatggaatttattctgcaggtgctccactatcttagcatggcagtgaggcactctaaccattttcacaaagaatattgattccctcttctctgcatgcaccagttgatgggcaatatgggagaaccggttgggcatgtctggagctgccatcctaaatgtggtagttcatgcatgttatacatcatataacacaaaacatatgtaattcttgagaaaaaaaaaacaaagtacataacaaacaagtacggaatatattaagaagatattctcaagattacaagttgtgtgtaagcaatatatacaattttaggaatcaaaatgtttctctgcgaacaagcaaaaggcttacgtgtcattatattagcaagagagcaaatgagtttacacccggcatcctactggcagcaggcgccaaaggagaggaaaagaaaagaggattacacttaggtagacttagaaaaaacaactaagactccggaatgatggaatcaagcatatgcctaagaaggccctgataccacaatattgaaggtaattcttaaaaccattaaccttggctacgcatgaccaccaaattcttatgaggaataaatatgttaagacaaataaccaaatatgcttaagattgatacaagtttgtaccactgacagatgcatgctttaataatataccaccattcaatgatccttgtaaacaaacataccatcagcccagagaaaaactagaataccaggcatcaacagattactctgttaaaaaatgtcactcctgcctacatatctggagactaattgccacaatgccactgtctggagacaagcagtctaggaatccgagggcccaacgaattgtgtttaaaagagtataaattaaagtccactctgcctacacatcaagaggcaagcactaaactattccacattccagaagtaactgcgtgttcctgcgatcaaagtggtaatctaactagaagcaaccagattctaacaaggactccatttaagaggcgaaccacacacagatgtatccctctttcaacaatccgaaccaaacaaactaattagcacgagccctagattcagggcgctagaagcaaccagattctaacaaggactccatttaagaggcgaaccacacagatgtatctctctttcaacaatccgaaccaaacaaactaattagcacgagccctagattcagggcgcggtcgcatcagcgcagaaccgatcccgcgacagcaaaatcgacccgcgcccccacgcaatgtgtgaactgaatccccgtcacgggtacacccccacaaccccgcaaccgcaagcaagcactcgtagggcacgtcggctaagcatgcagggttagagaagagagctcacccgcaggaaccacggcgccggcgatacctcgttcccctcgctaacaaccgccgcggagaaacccgagcggagagagcaggaggcggtggcggcggggagcagaagcgagaaaagaagcggacgccggagaggacttgcagaggaggacgaaccgacaagactcccagactttagagggtagttagagcagtggcggattaatctctgttgcactcgctgatatgtgggccatgttgccaatggtcgccgtttcgaaccggccatcggagcatggaaagttctacggggcctcccatctcatggtctccctatatatggccaaacgggccgcccaggccatgcctgggccgatgtcagtcgggccatgtcgtgctaacccacgggctgcatatatggcccagacacagtacaataagattcgggtcgtgcccggccagcctaaagacacgaccgcacatcgtgcttcttcctaaaataagtctattgtttgtccctcaactctttggaatgtgtcttatatggctagaaataagtctattttttattcctcttttttttttgctttgccttatatggtttattaagtatattttggatccctctagtatttttttatcgtgccatgcctcgggttaggcatgacctaactgtcgggccgtgccggcacaggcttgacactagttgggctatgccatgcttgggccggggccaaatggccgtgctttgggcggggctatcgggcctcgggtcatatggccatctattgtctacttcgttgcgcgcacgtgggaccatgttgccagtggtcgcccatatagtaatgcatactacatcagccaaaaaaagggaaaagtctggattacgtccctaaactattgagtgagtacgaattaacttctcagacccgaaaatcatatactacatccgtcccaaaataggtgcatccatagatatcagtgtccagtgttttgatcgtccgtcttatttgaaaaatttatgaaaaaaataaaaaaaatagtcacacatggagtactattcatattttatcatctaataacaataaaatactaatcatattttttttcaaataagacgaacggtcagacattggacttgaacagcacttattttaggacgaagggagtatctttcactctcaactattaatacatgataaattacctcccaactcaactcaattcaaagtggttttgatcctatgcggtagtccagttagcaattcttttttaaatccgtgaccctacttgtcaatctctcatcctttctatctctttccccaatcctatctatcttatctctccctcacctcctctctctctctctatatcacttaagcaatggggagggtagccgagtacggcgacggggcggaggcagcgacagaggggagctgaggacggtggcgggcatgggcggagacaaaggcagggtggcgggcgggagcggaggcagcgccgaaggagagctgagggcagcagtgggggcgttggcaggtaggcagtggtggaggggaaaacaaggacgacgacgggtgagagcggggacaaaagtggaagcatcggcggagagggaggcgaggacggcggcggggcgaagagggacgaggatggcggcgagcatgggtggagacaaaggcagggcgaccgaacacccgaggctgacgccaccgttgacgaccttggggagtttgacttcgaagacgaggacggcttcaacgcttaccctttccttgtcgtcgatgatggcgtaaccgaggacatcgataacatcattggcaaactcagcatggagaagaactcagtggctgcaacccacgtggacgccgttttgtacaaggccgccatacgcccatacctaataagcctcaatgcctcgtagtgcttaaaaaaagggtagacgcttgacggggagagccaccggcgagctcttccgacattggaacattggagggagaaggaagaagatccaagtgtatttctgtctaatatagtattttggcgaaggcgctcgggttgtggaggttatttcggcgaaacctatttaaataacgttattctagctaatccaaccttatataatgctatgatattaggtatgtaattttctcgtctttgcctagggggaaaaaaaaccccgaaaggcctcccctccgccgccgtaaagcttcggccgtcgggatctccgaatcgccgcctccaccctaatcccctccgcttctgtcggcgtgcaggctgcgcgaactcatcagaagcgccgcctccaccctaatcccacttctgtcggcctgcggcctgtgcgagctccgatccgccgcctccaccggaatcgcctccgctgccgtcggcctgcgggagcgcttcgaaccggcaaggatgaaatcgcgcagggcgctgtggatttccagggaacggaccagaagaacggcgaactacgaagaccgggagaaccccttctgggcccttgcaggtatgccgccgccgtcgtctgtgccatgccaactacagtcgactggtggcactgggatggagtcaagcccggagcacctcccttcgccgccgtgccaggcaaggacaccatcgccgcccccgagtgggagggcatcatcgccgtcgcagctgctcccctgggaacagagggagagggagaggatacaatcaccgcccatgagtgggagggcatcatcgccgtcgcagcaactcccctgggaagagggggcatgcccggagagggtacgatcgtcgccgatgagtgggagggcatcatcgtcattgcagcagctcccctgggaagagaggacatgcccggagaggataccatctctgccaaagaagaaaatgtattggtttgctcgctctcgggaagccaattccgtgcaagtatcacgtccaggggaagcatcatatcctgaggcaaccgagggcaaaccagagtataatctgcacgtcttgaagagcatgaagaagaagaagaaaaagaagaagaagcggggcaaaaggaataagagaggtcaaggcggctccgaggacaagagccaagagaagcaagaggtagcacaagagcatctgggctcggtgtcgtcctcatacagctctccgctgcgtgaaccgcaagctccacttgtgcctatgtggacgagtccttctggagaggtggtgtatggcatcaccgatgatcccacagctgcagaagcctatcattgggcttttcacgagtacaagaacaagagaggtacgctttttgtccgtctgtttttaccaaaattgtgataagcacaataattacaccaagtactattttaatgtaaggctgaactgcatcaatccacagtctgctctagtattaaaaaactttccaaggtttgccttatggtatccaagttgaaaggtataagttgtatgctgtcctttagtagtaggataaactagcaaaacaaaattggaattacctgcaaaaaattgtgtgtaaattgcacttgcactgggtaaagcataccttatttaactgtgcaccaggcttagtttatgctttcgctttacaccagggtatataagttctactatgcaccagattgcttcacaaaattggagtgatattgtaaaatatgattgaaacttatggaattcttaaatttagaccatatttcatgaagtttcgttcagaatttatgaaatttctataggtttgatgatttatcctggtgttatgtgacacattttaatacaaagtgataatactaccaagcgcaacgtgcaatttgttgaaaaattattcaagctcaccgaatttcacatgtctttgttatagcacgccaggaactattaccgacagtaaggtcgtcaatctctgctgctattgaacactataatcccgagcagaagaaaacacaaataaatgcttccaaatccatcgtgagcctttcagcttatcacggtattatatattcttcgactaatcttttttatttgatggtagtgtcggttgctttttagctaacttcttttgtgtatatgtagatggtagagagattaatcagggaactggtataattatcgagtgcgatgaagtgaagaattctgctatcattttaacttctgcttggctcatttgcataaagaaaccttttgatgattggtcgcataaagattatgctcctgaggctaaggtagaacacttcaatctcaacatgctcctagctataacatttttgtttgcttagttggaggtgttagcatgaataggatggtcacatccagttttttaatgatgttccatgcattttgttgcttaagttctaattttaggggatattctctctagatgcagaattgtctcaacctccccccctcccaaaaaaaacaatgacacagtgcatagatgctgttgctcctaaccccttgcgtgtttgtatccaccttgtgtgccatagctacctccccttctcaccttgtgtgccacccgccattgccctgtatatgttgctatctatttcttttgattgttcatctgtgcatttgcacacaggtttttggtcctaagttagaacttagaaataacctttagattacattttatacaggaaaaaaacaatcttttcttgcattgcgtgttggtcatataggtcgataagttgggaagcttaggaagaaaaggaggttactcgttaatgttgcttctcactatgtcacaactacctgcaaaagaaaatcgtacctcagtacctcacttatgagaaaaaaatgtactccctccttccacaaatgttagacttattctatattttgtttttttccaaataagttggtcatatttgtagttttcatgtatctaagacttaaatgaagagataaattaaatgtttaatcgaaacctaatgagccattttaatactcattggttgcatgcatgcatgcataggctccttgatctttgttacatgtaagatgagttctttgttacatgtaagatgagttaatttcttcttggttttggtgacaaaagtaatatgtctaactcttgtggatggagggagtatatgcatacaagaggcaacaaaatttagcggatattactgccaaagacaaaaatactctataaatttattttcatagaaattatacaaaatttgattacacgatacatattatacataattaaaaatttcacttgaccaaaaatttattgcaagtactttatcgtctatccagccaaacaaacaagctaattgtatcacccaatccatcttgatccccgccaatcaagcacatttttagtctctccaacatttatttgtgttgctgtgttttatgcattattaattctatccaaattacgcatcatatttgcagtctgtctagctgctctctttgttcacagagtttacttcgtgtttacttattgatatgttccttgatttttaattcaattctgctaaagggatgttctatcctggttgctgcttggatagttgcattaaagcttagacaacgacactacttgttgtttatgtttatgtaaagtacccgacacaaaaatcttttattgaatatgttagccagccaggtgtttgcatggcagattagtgcctcacacgaataacatccaaaagcttccatccagatcacagaatcggtcatgaaacttgagtcttgcatgcagaatcaatcatgaaactgaaggaaaatcatcttcaaaattagcctagccattaaactagagtatatttgagagatgacctgatcttaaactttgggatgttctaccctggtttgttggttgcataattgcacattaccttaaagcttagacattgactctacttgctgtacaaggttatataaagtacccagcataataaagatcttttatttcttatgttagctagccatgtgtttgtatggtagaatagtgcttcacatgaacaacgtccaaaatcttccatgcagattgcagaatcagtcgtgaatcttgatagtaaaatcttacatgcagaatcaacaattaaactagaggagaatcttttgtgcagaattagcatagacatgaaactagtgtcttttagagctgacctgacctttgggatcattagttattgagaactgtattagtgtaggagcattgtatatacaatacaaaggactccccctgttgattttaataatccacggaaacagccaggcacttagtattctccacatggttaacttacttcatgcttggtgttccttgattttaaactcagacatgcttcatatatacttggtgtttcttgattctcaaactcgaacatgctccatatatgcttggtgttacttgattcttaaactcagacatgctccatgtatatttggtgctcctttattattaaactcagacatgtcacatgctccatatatgctctatcctgcttggtgttgtttgctttactatatttgtaaaagaaatgaacatgcaaactgtatagctcataatagtataagtgatatatcttccacattaagtgtttttaacctactctttttatttatttattattttaggtcactgttcacatgttggatgacacgatctcagtgtgtcgattgctgtacttcagcaagcatttcgatattgccttatttgaaactgtaggagggctaactataccgattatgccattgaaatctgatttggaatatggccaggatttctgtgtgctcaccagagacataaatatagatttgatttgcacaacagtcaaagtgaagtacttagatccgtatgagcaccaacacaatcactatatgttcattggtggttccattcccaaggtaatgatggtatttaaaattttaaattctaaatagttagttgcacttgtctataatctcaatgtggtatttaaattttgcttgcagtgtggtactggaggtgcattggcagatttcagtggaaacactgttgggatgttattctgcaccttgcccatggttgcattcctaccgagctccctgatcctcacgtgcctaagattgtggaagaagtttgggtaggcatttttatttttgttcatcctagttggctatatacacttgcttaattcagaaacttaggacattagtttgagatatgcacttatgctgccagcacaaactatttcccttccattcaacaagtttacatttaaacctgtacagtatgttatattttatataatataaaaatgagtgccaacttaatatgcatatgcacaatacctctgtccatttgctctcaaaaccaaatgtacggtagaattcacagacagatacatacaagtgaggtgctgaattaagaatgataggtgtgagactgttagattcaggttaagaatgtggggataggtttgtaatggcctctattcaacatcaacaagtactgactgagatgcaaagtgaaatgtatttatatgttttaggcatgcacttctacaaccctaaacatgtgatacactataattcttgtatattggacttattatgtggtatgattatgccatctgtagcaaccaagtggcattcagcagctagtataaattagtaattattaccatctgaccatcatgtttacagaaaacacatcaactgctgtttttttttgtgtataatatttcactttagatataattatcttatataaaataaatttaatagtctaataatttcatataggcaaattgttcgacctcagcttggtttgaagtttaaaacagtggattttcaagagatgacgcttattgagttgctgtctcgtaaatacaatattacctctggtcttattgtaggagaggtaacttttttatttatgacatctatttatatttatgtgtatataatataatattttcatgtatatattgtattatttctggattgattttaggtttcagctgaatgtgctgctgagaaacttggcattcgagttggggatattattctctctctctccagggagaaagcatttcaagtataatccaggtagcaattgacatccttaagactttatttgaatatttcaaaatctaaattagctctttcaaacaaaaaggcataaagtataggtagcatgtgcattagtttatttaatacaaatttgactcaatccttttgtgttagttggagaatatattgctcagtattggtgagagatatcttgaggagggtaacgactccagctctaaggttgatatcaaggtaaatttccgtgtacttaatgaatacacttaaaaccatatactggtattaggattatttattactctataggctgtttatctcctagatagttaatctcctagacctttggtttttgtaactctctagcattcattgtaactcagcactagcattcattgtaactcagttatatatatgagagatcacctaccctcttttgtgtgtgaggcatccattccacttcttctacatggtatcagagcataggcccttaccttcttttcctctgctctagcacgtcgtcgtcgcaactgtgttctccaccatgtcaactgaatccactcagtcctctacctcatcatcctccagtggtggatcctcttccaacatcactagcgagtttcttcatccctacgccaccgtcgccgtcaaatcacacgtccccatcaccctggagaacaaccacccaaactacaacaaatggagggccttcttcacctccctgtgcggcaagttcgggttgatggctcacatcgacggctccgctcctccacgccctgacgacccggcctgggaacaggccgactgctgcatccgtagttggatcttcggatcagttacggacaacgtcgttgacctcgccatggagctagatcagaccgctcgggagctctgggtcgccatcgaggacatgtttcacgctaacaaagaaccccgagcgatcttcctcagccaccaatttcattccatgcttcaaggggactcctccattgccgactactgccagaagatgaagacagccgccgacgcccttcgcgatgtcggccacgccgtctccaagtcccaactcgtgctcaaccttctccgaggactaaacgaccgcttctccaacaccgccgatcagatcgcaagcgcggacgtcctcccgagcttcacatcggcgctcaacaccctcctgttgaaggagttgcgcatcgccaaccaggccaaggtggccgcggcgacggcgctggtcaccggcgccagctcgggctccggctcctcttgccctcccggcggctgcgcttcttccggaggtcaagcatgcactggcggcaacaacagccgccgcagcggcaagggcaatggcagctggatcggtggcgggaatggaggggccggaactggaggcggatggggtagcggcagtgggggtggtggcagcggctgcccgcttcctcctgctggtggcggtggctaccagggggtggccaaccctagctggaggccggccgggccctgggtctgttttaacccttggccggcccagcaaccagcgtggccaccccactcggcccactactctcaggccggccttcttgggccggctccggcagcccactactcaggcgaacaccactttcgctggcccatcgatgtcgcccacatctgttcctccaggctagccagacccagggcccggccttcttgggccggctccggcggcccactactcaggcgagcaccactttcgttggcccatcgatgtcgcccacatctgttcctccaggctagcccaattgggagcaagctggcctcattgaatccttgaaccagatggccttccaaagcccaaacaactaggttttggacactggcgcaacatctcatgtcctctactgacggtatcctcgttactcgattgcctaactcccacacttttattactgttggaaatggtcacaccatccccgttatttgtcgtggcacttcattccttcccataggcaccaccaaatttgcactaaaaacatccttgtcgccccctccttagttcgtaatttactttccgttcgtcagtttactcgtgacaataaatgttccattgagtttgatgaatttggtttctctgttaaggaccttctgacccggcgcgtgattcttcgccgcaatagccacggggaactctacacccttccagctgccactccctccagcgcccactgctccctcgccactttatccacactttggcaccgtcgactcggtcatcctagtgcagccaccatccagagtcttcggaatatgtcctccatttcctataataaaatagacacctctctttgtcatgcgtgtcagttaggcaaacatacctgattaccttttgataggtctttgtctcgcactttcattccctttgagcttgtccattgcgatgtgtggacatctccggtgttgagtacttcgggttttaaatattactttgtggtgcttgatgatttcagtcatttctgttggacgtttccactccgacacaaatctgatgttcatcgtcatattgttgagtttgccgagtatgtttccacccaatttggcttaccgctcaaatcccttcaggctgataatggcggagagtttgtcaataccgccaccacttcctttgtcactaatcgtggcacccagctacgactctcctgcccttacacctctccccaaaatggtaaagccgaacggatgctccgcaccatcaacaactccataagcacccttcttatccaggcttccatgtttccgtcctgctgggctgaggctctcgccaccgctacctaccttctcagccggagaccctcttcctccgttcaccactccttgcctttccagctcctacatctcaccactccagactactcccatcttcgggtttttggctgtctttgttacccaaacttgagtgccacgactccacataaacttgcccctcgttcaacagcttgcgtttttcttgggtacccggcctcccacaagggataccgatgtctggatctctccactcgccgcatcatcatttcgcaccacgtcgtcttcgacgaatcccgctttccctttgcggcgactcccactgctgcctcgtcttttgattttttgttacagggattccctccagcagtcgcttcctcctccgaggttgagcaaccgcgaccactcacggaggctccctcctcagaggtcgagcaaccgcaaccactcacagtggctcccgagcaaccgcgatcccttacggtggctccctccgtggaggttgagcaaccgtaccttccccctcttcggccgccgcttgccggacggcacggtcaccgcggtcaacgatgccattggtgccccctcggtcggtgcctccttggccggcactgcccctttggccggtgccacctgagccggcaccatcgtgtcacccttccaccatgtgtacacccgtcgccctgccccgatggtccagtcatcatcttcagccactgtgactgcgacggctgctgctccacagctgcattccatggtgacgcgctcccagactggctccctgcggccggtcgaccggctgacctacacagctacccacgccaccgtctctcctatcccggccaactatcgcagcgcgttggcttatcccaactggcgtactgctatggccgatgaatacaaggctttggtcgacaacggcacttggcgcctcgttcctcgcccccttggggccaacgttgttacgggcaagtggatcttcaagcacaaattccactctgatggctcccttgcccgccacaaggcccgttgggtggtccgtggttattcacagcagcacggcatcgactaagacgagacatttagtccggttgtcaagccggccacaatacgggttctcagcattgctgcatcccgtgcttggccgattcatcaactgggacgtgaagaatgcgtttcttcatggtcagctcaaggagaccgtctactgtcagcaaccctctgggtttgttgaccctgctgcccctgatgctgtatgtctgttacagaagtccctgtatggtctgaagcaggctccccgtgcgtggtactaacgattcgccatgtacattcgacagatgggatttatgccttcagcgtctgatacatttctctttgtttacaaagatggagatcacattgcctatcttctgttacgtcgacgacatcatcctcactgcttccaccacaccactacttcagcagcttacggcgcgccttcacaccgagtttgccatgacagaccttggtgccctccacttctttctcggcgtctccgtcacgccttcctttggcggcctcttcctctcgcaacgccagatgctgtggatcttctccagcgggccggcatggccgagtgccactctacctcgacaccagtggacactcgtgccaagctctccaccactgacggcttgcccgttgccgacccttcggagtacaggagcatcgctggcgtcctacagtacctcgcgctgactcgcccggatttggcatatgccgtttagcaggtctgcctcttcatgcatgatccgcgggagcatctcgccttgttcaggcgtatcctccgctacgtgaagggtagtctccaccagcctccacatcggctccggaccggttcagtccctgacagcatactccgatgcggattgggcgggttgtgccaattcttgttgttctacgtccagctactgtctcttccttggagacatttggtttcttggtcctccaagcgccaaactactgtctcctgttccagtgctgaggcggagtaccgtgttgttgcccatgccgtcgccaagtgctgccggttgcggcaattgctccaggaacttcatgtcccggttgctttggctattatcgtctattgtgacaatgtgagcgctgtttacatgacaacgaatcctgtgcatcatcgctggacgaagcatattgagattgacatccattttgtccgtgagaaggtggctttgggacaaattcgggtgcttcatgttccttcatcacaccagttcgcggacatcatgaccaaaggcttaccagttcagttatttactgaatttcagtccagtctttgcgttcgtcatcctcccgttgcgactgcgggcgggtattaggattatttattactctataggctgtttatctcctagatagttaatctcctagacctttgttttttttaactctctagcattcattgtaactcagttatatatatatatatatatatatatatatatatatatatatatatgagagatcacctgcccccttttttgtgaggcatccattccacttcttgtacatattgttttcgtacacttgttattgattacaactcttaacgataaatgtttttttttatttaataggttggtctatttcatgtgcgtaaatgtaccagaagatttatcactttatcagtacggttgtctggtgatattgaagtctttcgctgaggtaacaattatttctcatatcgtgtcattatcaattttcatgttttccttgttgaaccgttcatgaactgacaagatgtttgtgttagctcgatggcgacctcctgacgaacagaagagatggtgagacgacaagttagtactgcatgttggaaggaatgaagtcttttaagaggagtggtgttcaaagtttttggtctggctggttatactctgatgtctgcaagtctgttcgtggtcttgatacatgatttctattgttgggtttccaagtgtgtgcttgcagttgcacccattagtcccttgccacattcttgcggttttacacctatccttgtgtgaattttcggtcgggatctcgtcaggtgaaggaatcgcactgatttgcctgctgtggttcaaattgtttggtttgttgattttgttaatttattactcaatccgtcccagaatataagaagttttagagttggacatggttattaaaaaggtaggtagaagtaagtagtagagggctattattggatgagtagtggaggttggtgagaaaagtgaatagtggagggttgttattggttgggaagagaatacccatgtgttgtgatgggtgaagacggtacggacgaagctcaaagctgacaggtggtagaagcactcgatcaggatttgcactcgggcaaattcgtgctccgctatgtagagctggatcgtgctcagacacgacttcgagctagccgtgaggaataggtggcagcacatttggatgaagagcagtggtcgacgtggtacacgaccatgctaaggtatggttggaccatcggaggatctgaggtaatgcgtggagattgtcacgttgctcttgctgctcgacaacatggccatgtcgtgctccctttggacaacaattcaacgaaggaatgcagaaagatcaaacagagatgtttcttatctcgttttcattaaactttcataccaggttccttttctagcaatttagatttggaaaccctctatgaactgcgggagaggctctccctccccaggctactgtttttctctgattactattcaactatgtactcgtctctcttctggctccccaaaattttaaaaatgaagaatgtatttctgttagagagagagagaaagaaagaaacatcatcaccctgaaggaatttttaccatagcatgcacaatcaagagttgttcagcatttttaaagagcaaaagaccccttaccaagcaacagattgccagcatttgcaaccagcaccagcatctggggatggaagtgcatcattcacttgcggaaaccgttgcatcttgcctttggaaaaagaccacatattctatcatggaaaagtaaaaaaaaaagaaataattcagaaccacaaaattaccttggggcaaactatgaatatcgcatcaggataaggagttcaacgtctcacacactgacctcacgtggagtttgcacccttctttccttggattgggaccagccgcaccgcaccgcgacacatatctgagatcacagcggcgcggcgtatgcagcagcacggctacgatccgtctccggcatgcgcacgcgcgtgcggcccttgcccctatcaaactacgaggtggcgacggtggttatcttttccggttcagcacgcacgctcctccagcctgaccataatcctcgccatctgccgccaccctcgttgacatccccgagccgtgtcctgcgctcctgcaccagcgcaccctcttgagccggcggaaagccggaaaccgcttcgaggcgagatccgtagcttgctttatggcgctggcatatgtcctactacccgtttcgggttacaacacgttttgactttgatcaaagccaaactattttaaatttaactaagtttatagaaataataataataatattttcaacccatgacaaatttattataaaaatatattcaattattgatttaatgaaactaatttggtattataaatattactatatttgcttataaacttagtcaaacttgatatagtttgattttgatcaaagtcaaaacgtcttgtaacttgaaacagacgtagtagttttttttcaacggcggcaacctgctactggcctactgctatggcccgtgccctagcgtggacacccgaagatgaattggaatcaaagacaaaacaacgacggacgaaacctattcctgttgaggaagaaaacgaacactaccagcggcgaggattttgcaatgcacaatcaggaggtccatgcgtctccgcgctctgtgggattgtggcagagctcgtagatggcgccaccgctgaatatgctaccggagctgcacgcgcggcaggggtggcctgcacgccgcgctccaacgatgggtccagagcatctcaacatccctaataccttgtttggtttaaaggggattgaaaatgattagaggggattgatggagaatattttcacaccataataggtgtggaataaatcccttccaatctctctctcacaaggatctatctattatattataaaaaggatagaaaaaggagcctccacgttcgctctcatggcctagaaattctcacattaatcggagaaaaagaaaaaacagagtccatatagaaatacaatttagaaatagctgaaattcagaattaaaaaataaggaatattagaagaggagactagagtccatatagaaatacaattcagaaatagttgaaattcagaattaaaaaaataagaaatattagaagaggagactagagtccatataaaaatacaaataggaaataactgaaatttgtaattaaaaataaagaatattagaagtagagtatagagttcatatataaatacaattaggaaataatagaaattcagaattaaaaataaggaatattagaaatagagtatagagtccatatagaaatacaattaagaaaaaaaatagaaattcggaattaaaaaataagtaatattagaagaggagactagagtacatatagaaatacaaatagaaaataactgaaattcggaattaaaaaatataggtatttaaaactatctaaaattcggaataaatataataaaattaaaagtagagtttagagtccgtataaaaatataatttctaaataactaaaattcaaaattaagaaaaacatgggaagaagagtttaaagtcaatatagaaatacaatttagaagtaactgaaatttgaaattaaaaattaaagaatattgaaagatgagtttagagtccacatagaaatacaattagaaataataaaaattcagaattaaaaaaaaagaaatattaaaatacgagtctagagtccatataggaatatatataatttacaaataactaaaatttgatattaaaaataattaataactaacacgtatataaaatacaatattaatattacacattagtagtttcgtagagttattacaaaatttaaaattatgttgtcattgtaatatattttaataatataatgagaaaacatatatgctattatataagagaaaacataatgatgctagccgcgcaatctgcgcgggccaccatgctagttaaccgaacaagacctaagacctaaggtgggggttgtggaagtggggatagactatgcccttttacggagaaacgcgaggcttgaagttgctgcggaataagcacaatccaatccgagttacggtataggcgtggacgacagaatggcgggatggttgggtcggttgggttgagttgagctgggaaggggtgtgtgatagttattttagattcacatcgatcaaatttgatacaagcgacttacaaccagctaaaaatcaaatcaaacacagactacgcaccaaaattttgataaaaatatctcaaatttttataatagtagagaagagataaacactctaagattgtgttctgcacggaaatgtggtggcttattaatgtatgattaattaagtattagcaaacacaacttaaaaaaaataaaataatacgattctgaaatcaactttcagatagaatttttttttaaaaaaaacatgcacgcgaaaaacaagaaatatgagttgggaatggaaagggaagagtacgggtggggatgctttggagttcactccaactccatccgaaggatttgatgaaatctctgtcatctctatataagaatggttgggatgaagtaactaattcctaatagttttttttctgcatcttaatatttgtaacaaatctaacgaatactatatatatatctagagaatatacaaactgattttacttgcataacctagaaatttcatggttcatccacagtataaaaatcgtattgggctttgtggctataatattttagcaacatttttgtgtgtatatggtttatgtatgtttgcacgtactaaatgtttaacatagttttttatacatgaccatagcttcttatttggagaagagagcgtgcatactttgttaatgttgttggcagaaacatactcactaggaacataaaaaggaagaaaaggtaagtaattttcattcaagcatatgtgattgagggagttaattaggacaagttaataagtggcttcatcttagccataggaaataattgatggtatggatttagtcaaatccacctggtggagttgtagctaactctagggggatctggacccggaagagcaacaccctaatactcgtaataaaatagcaatgtacgttgctaatgccaattcgagggtgcgatttgttttgggaatacgaaattgagccctataaattgtccaccctataggccgcagattcctcaatccttactgcaagcggcaaagccctcctcttcagctcttctgacggaaaagaccacagcgatggccaattacacatggataatacaatttaagtagtgcacgttggcaatgccaaatcaagagatgcaattgcactccacccaaccctacaaatatccacccgcagcttagctcgatccttgcccacttcaaagttcaaacaacaaagccgtcctcttctgaccaaaaagaccaaagccatggcgccttccctcgccacctcttccaccctcgctctcttcctcctcgtcgccgtctccatcgccgacgccgcgacattcgccatcaccaacaggtgccagtacacggtgtggccggcggctgtgccatcgggcggcggcacgaagctcgacccggggcagacgtggaccatcaacgtgccggccgggacgacgggcgggcgcttgtgggcgcgcacgggctgcggtttctacggcagcggcaacgggcagtgccagacgggcgactgcggcgggaagctgcggtgcacggcgtacggcgcggcgcccaacaccctggccgagttcgcgctgaaccagtggaacaacctcgacttcttcgacatctccctcatcgacggcttcaacgtgcccatggccttcctccccgccggcagcggcgccgggtgccccaaaggcgggccgcggtgcgccacggccatcacgccgcagtgccccagcgagctgagggcgcccggcgggtgcaacaacgcgtgcacggtgttcaggcaggacaggtactgctgcaccggatcggcggccaacagctgcggcccgaccaactactcggagttcttcaagcggctgtgcccggacgcctacagctaccccaaggacgacgcctccagcacctacacttgcccggccggcaccaactaccaggtcgtcttctgcccatgatcgaacgcgcgcgcgcgcgcgcggctgatcgatcgatctctgatgatcttgggatttgtatgatcgatgcatgtgtggatgtaaccgtgatatacgtacctaagaataagtttgcacgcgcaaacgaggataagtttatgttatcgatctttgaataagtaaaaacaactgggtttatgaattgatatatatgaacgatgactttcagtaagataaacacggttaattacgtgttcgatcagccatatgttattatgcgtgtaactatggaaactattctaactataaaaattaagaagatgtattaatatgtgatatatcaatcaataaatatgtaagtgtaaattcaacttctacaaatatcaaccaaaaaacaaattaaactatatctagacatctagttaatgtatattcacagttaaatttgttttttcattgtgacatgtagatgttaaattttaacttgcatatttttgagtaatatattacatgccaatatatttttttaaaaatctttcatgactatttaagtgacatgtaaataatgagaggatgtttcctcgagagtttaaaatacactatagtatatataactatgcttcggagttcaattctatgatttctccaacatttccaaattccagtcgaggacgtgtacggttgtaaattaattgagttatactagcatggcgcgcgattaatacatttggacgaacacgcccaacaaataaccatgaccactctatcacggcgcattaacaagaaattaactgtgaacagtagtcaggtcgaatccttaaaccttagcggtttggacaccacatgctataaccttagtgcttaagaacttttaagaataccatagctctgttaatagacctgatccagcactggatttatcctaaatccaatatccaggccaaaagcggtcagcttgagtggacccacccaatacttgcaacagcactcaatcgactacgcatgcatggaaagtcaaggattttgtaattagattccacgtgccaaatcggaatggaattaactaacccaagcagatatataccctatccatctcaaaataactcaaccgagaatgagatatgattcatcttaaaacaaagaatctgaacatcacatctcattttaaattaagttattttagaacggagggagtaaactacattattaaattgtgcgggagaaagtcatcatactttcatacattcaagcggtcaagagcctccactatcattatctagagtagtggaccgagcaagcatagatcctctagcaaattaatctgtcaaagaacttattattatatcacgaagaaaagacttccattctgcaaaaaaaaaaaaaattctagagacgtgcaacaactgagttagctggcacgtagtaccgatgaaacagcagagtggagaccgcacaaaacagaaaagagatgctcgcgtacgtacgcacgatgcacgcagaagctacccgtgcacgcgacctcctcctccttgttcctcgttccctcctgcccgggaaatgcatggccagcagcagcggcagatcgggtcatcgaggcctgcgttgcagccgatcttgaacggatgacggaaatcttaaatgaaattccattcaacgcgaataatgggcgcacgggagcacgcaaccgtccggctcgaccgattttggaattctaaattcttccttggttggttctggtcctcgccatccaagtctgaagaattcctcaccacgcagagtcgcagctcgcaggttcgaactggtatgtagagagagcactttgccttctgtttcgtttcgctccacctataaaaggaataagttcatctgagatctcttaacttgtcaacgaatccgattttcgtctctcaaccgaaaaaccaaacacaacggatttctcaactatcaaaactagtgcagatgaggtccctcggtgattttgagggcggttttggctgacatggcgcctacgtggctaatttgacctgatattcatctggcatggcactgacatggtgcctaagtggcaattcggtctagaaaaaataataaaacccgtgggacccacatgtcagttccacaaataaaataattaaaaaatggtgggacccacgtggaccccacatgtcatcctcactcctcactcctctctctctctctatccggggcggagcggctggccggcggagcagggcgggcagcggccggtgcagcggcgaggctggatgcggcggcgcgacctggcgaccgggccgaggcaacggcggtcgggcgctagtcagcccagcgcggcagaggcctgagggagagaaggccggcgcggtgaggagggagcttggcggcagggggaaggacagcagccgctggcggtgctcggagcgggcgcgtcgacgtggccgtgcccggctgacggcggctgggcggcagcttgccttgcctgaagaacaaattcaaagacacaactcactagaactgttgtattgatttgctataagaacctgcatgttttgagtttctgcaggaactctggagattcaattcctacaatgctaaaactcctcaagattcagttcaaatccaaagtggggaagaaaaaaagcgattcgagaagagcagcaatgtgggtcttagataagcacaacgatatgagaaaaaaaaattgaagaacagaagcagaaaccaaaattcaggccaaaaatcatcatcatcacagtgggaactctttccggcaagagaaagatttatgcgcattggctaatactagagattaacagggaagggggagacaatggtaggtacctaacctcagacgctgctgcttccatggtgatggagctccatctcctccaaaatttgcaaagcggagagcctctctctgttaatttggagtttggagggagcagagcagaggcaaggcaaaccaggtgcagaactgtggactcactctggtctcggcctctcgggtcaatccattcctaccactctcgtgttcccctctcgccaccggacacagtgaaccctagccggctagccgccatggacggcgtccagccacttcgtcttctgctcctccccatattgccgcatacaacttcgccggccggcgtggctggctctcgcgccggccttctctccccattcgcctgacactgcctgggctccctcaggccgctaccgcactgggccgactggcgcccgaccgccatcgccaaggctcgcgccgccgtcgcctcggcccagtcgccaggtcgcaccgccgcatccagcctcgccgctgcaccggccgctgcccgccccgatccgccggccagccgctccgccccgcccgtttcccgcttctaccagccgccgctggccccgctccatcggccggagagagagaagggagaggatagagagagagagagaggagggaggagtgaggatgacatatggggcccacgtgggtcccaccatttattattattattttgtgtgtgaaattgacatgtgggtcccatgggttttattatttttccggatcaaattgccacttaagcgccacgtcagtgccacgtcagatgaagaccaaatcaaatcagccacgtaggcgccatgtcagccaaaaccggcctcaaaaccgtcgagggacctcatctgcaccggtttgaatagttgagggactcgttgtgtctggatttccggttgaggaatgaaaattgggttcgttgacaagttaagggatctcagatgaacttattcccctataaaagggcagactgtacaacaaactcggcccgaataaggccgcatccagcgcaacctcggcccaaatctctactgtgtttttttttctttttcaggggaaatctctggtgtttcctgttttcacttttgggtgtgaaaaaatcggtgatgctgcccagcccttgccccaagcagtgacggagctaaaattttctcaaaagtagggctgaactagtataatttacattagtttatctttttatcttttaattgttttcaaattttaaatcacaatttcaatgggtatttaggctaaggagtagaggctctagccctaactaccctactcctatatccgttcctaggcctaagtgtggtcagacagtcttacagcttgttcgagtattagatataactattagtagagctcaagccagcagtgttttggaggcccaagagactgggggaattgatcgatgtgacatcctgacttaattaggatttggcatgtgtgaactataagagcagtgcacgcacatttaataccacgttgctagtttatcaaggctggaaccaatttataaggcatcctccctccaaccataccacaatcgggttaacccttttacacgaaacgaagatgaaaatgtaattgggatgatatgtgtaagtgggaccgtccatcggttaggctagggcatgtggggcacatggcatggcatatggcactagtattggatgtacgaacgtatacatgtgtggcaaccatactactcataggttaacccttttacacaaaccgaagatgaaagtgtaagtgggtctgcctgccggttgggcttggctacgtagttctggaggacccttttacacaaagcgaagatgaaagtgtaaatgggtccgctcgtcggttaggcttggctacgcagttctggaggacgagcgattacaatcgagaactatgaggatttaacaaaggaggcttcgccgagctcactagcatgacaacatccaacgtcttcccccatgcacaactgatcccttttatttgtgtgccacaaagcccccatagccacaagaatcttaatgaatgaaccctcatgtgtgacaaacaaaaacctataggtatgtgcgggagcaccgtcgtggctcagccgcagttggtaaacaacggtgtgcaaggtcattgcatgggaaagagcgtgaccagctaggacaatgggtagggaggttgctgtggtgagaagacggtggcgctattggccatagaaggtgggagggggtagaggaggagggaagatgagacaaatagctcacctagttgccatgactggctagccggaggagaggtcgtcatgagatttgttagcattgcatttgcgggaattgagtttgccaacttttcactgttgaagaagagaagatgacaagcactggagggtgagggtagagggaggagaggtgggagactaggagcggggaatgttttttatgtcagcaccatcgcaatcgccagtcatcttataatctcagctgcaacttacacgtgaagattgtcttgaactatggacaaaaagtataaggtggaggggctcgcgtgcaatttggtttactcacgcttgctcgtgtatttggagccccttataatcggtgattttttttctttgaacaattttaattttttattatagtaaaaaaatattttcttttggctatgccacttcgtctagcgtgacgaaacaacacaattatattgtcaatgtattttatatcaccacactaccacaccaatgagactggcgtgactaaaaggtttatattaatttttaaaattttaaaatgttaaaagaaattcataacctgccctgctctgctatatgggactctacacccacaccaatcagatcgtacgaagagaataattctccatgtgagctgataagtgaaaggattgatgggacaatatatttgttctaaaactaatcccaccaatagagtatagtactcttatacagctaatatgctgcagttaggccgagtttagggcctgtttagtacgcgaaaataaaatttttcaatgtcatattggatgtttgaccggatgtcggaaggggttttcggacacgaatgaaaaaactaatttcataatttgcctggaaaccgcgagacgaatcttttgagcataattaatccatcattagtatatttgggttactatagcatttatggctaatcatggactaattaggctcaaaagatttgtctcgcgatttcctccctaactgtgtaattagtttttttatttatctatatttaatgcttcatgtatgtgtccaaagattcgatgtgatgtttttggaaaaaaatttggggaactaaacggggctcttagttacaaactttttttcaaacctccaacttttccatcacatcaaaactttcctacacacaaacttccatcacatcaaaactttcctaacacacaaactttcaacttttccatcacatcgttttaatttcaaccaaacttcgaattttagcgttagctaaacacacccttagttttgttttaacttgacaagaccaaaagtccctgaatcacgcggagaaaacttcccaggccagcttctaatgtgactttttcttcgttgtggtacatttcttgctacactactagatgccaaggaaagagcacctaacaaatcgaaaacgtgaatcacagtaatcacaggatcatacttggattctttgctcctcttttgtccgcgccaaatcggtcaatcctacgaaattactgaaatctagcactaaatcatactcccttgatctttaaaacatatttcttttattatcaagattaaggagaaattaacttatccatcatataataaaaccaagaaactatatgcatgtatatttcttttatcttttattgactttgacagagactgaagatataaatcatcttcattatctaaacaatatatatagatgcaaccaatgagtattaaaataattttatggattctgatcaataatttaatttaacacataaagactaaaaatatatctaactcatttgaaaaaaccaaaaaatgaaatatgtttagacttttagatagagggactatgtgccgtagtgaatatacctttcttactgtagttaaaagaaaacctttctatataacttcatttctagacaccccgaatcaattagatatgcacaatagcataagccccgtaatgggctcgtggcaccaatgaattttacacatacctgtttagagcgaaacaatttgattcccgctgtggcatcaggaagaatttcctcgaacgtaccgtctgtttttttttttttgagaacactcaaccgtctggttcgtggtgaaaaaaagaatcaagagtagactttgaccagaagaagctgcgctaatgatagaaaattccgaataactccaaccaaatctgccgggatcaccaactctaccatatttcaacccacgtactacccaatcaccggccgtaactccatggagaagaaacgcgtagcccaagaaactccaagaagaagatgtcatgtttgtttggcgagagaagttataataaaccgctgacaaacatgagtgttgctgtgtggctaaactagaggtttccctccaggatcagtcaaatggcagatgctagtagctgatttcactttcttttttccgaacgaatattaactgattataaatttgcacaagaatgtcccctatcggcgtcagcgtctcagcggtgctgctaggttccctcgtcgatcttccaaatgtctgcaccagtacgtctctccgagccaagcagtccacagcaatcaacaaatgacgacggattcagaatttcagatcgcccaaggctgtgtgattagctgcaaccaaacggtgacacgcataaatcttctctttttatttttgattttttttctcatgcaattggggggacattcttgtgcatagacagttaacagtacggctggaaaaacgggcttcaccactgggaaaagtccatttgcgacttgcggcggcatgaatgccagtacaagacccagcacggagagtgacgagacacggacacacggtgccagcccggccgggtgcgcggctacgcgttctcacatgagccctctcctcgacggctgaggcctgaggcagaggcgagaagccgcgcgaggtggctttcaatttggtggtagcgaaaaactagtgcagccgaagcccgcgaaccggggcggctgctgcctgcctgcctgcctttgcttgccggctttggaatgatggcgctcccaggcttttcccctgcgcgcaggctgcagcattgtggtccacccggccgtcggatcagatggatcccatggagttctcagcttggatcatggggaccggccgggatgatgccgaactctgcagcttgtgcttgtctcactagccagcactattttactctacgaccgagtgaaacccataggccggcggccatagcagcagtagtagcccatcagtactcctgttcagtgggacggtgctgtgcaatccaatgcagcttctgatcatcgcaagtcgcaacagccatggtcgggatgggtgtgtttagttcacacttttagaagtttggttgaaattagaatgatgtgataaaaaagttggaagtttgtgtgtatagaaaaatttacatgtgatgaaaaagttaaaagtttgaagaaaaaatgacgaaaatgttcacgattgccacttgggtaatcgtcgattcgacggggaggggtgttccgttgaatggcagcgagaatattcttgcatcacataaaaaaaaaaagaaatagtgtatcatcaacaacactagtgcagccaccaacaacaccaaggtcacatttaaatcgcagaaatgagaaaaaaaacaaaaataaaagaaaaacacataattctaatagaaataaaagtgtaaaacagaatattacaaaacataggataaacacatgaatgactgtttaattggattgtaggaaaacacatgaatcaaatgagatagatagactcaaagaaaattttccaaaagtttgagctcttactaagttttcttcaaaatctttataggattaaccattccataggaaggattcaatcatttgctttaaaggcattcataggaatttttcctatagaattgaaatcctccaaaattcctatgtttttcctatgatcatgagaagtttcctcctcccgtcgctcccacctcagggctgacttggatggtgaaaacttgccacagtcgccccctcccccctcccattcgcctcgccaccgcccgagtggctcatcgacaaagccgaacggtcacaagaatggtaacagagaggtgcttccccctcccggagaaagcctgaacagctggggtccgtggttgcaccacccaaccccggttctccatcagagctagtgagaagtccagtggaggaggctttggaggagatgtggctgcggggtagagggcgtggaggcggtgtgtgcagagggacgggcaggaggtgggggagaggtatgcacggcggatcttgtgtcctctaccttagatccggtgcccaccccgcggttccggagatggcagcggaggagaggtttgtggcaggaggtggggaaggagcaggcgcagtgacaacggagcgtggatccggccccaatggctagatcgaggcccttccacaccagatttggccggaagagacggatgttgttgtggcagtgggcgagggggcgacggtggcgaggctaacccggtcggcgaggggcacaagtggcaacagcagaaggccacaggacatggctggtagcagtaggaggacttgcgacacgtagtcacagtcgacggcggtgcatggccaatggtaagagatcagtgcgcaacaggcagcgacgatggggcgccagcatgataaaggtgattgtcgagagtggtgtggtggcgggggctatgggagttcgcggcgggcgcacggcttgaggtgggggtgctgccatgggatatccagccgaggtagcggcgatggtggtgttgtgaggtgggtgctgtgggcctgcaacgggcttggatatagacgcttgtcctcttgcgacgacgctttgtcgtcataagattgccacgtcggtgggctagtgcaagggagggaggatccattcttctctctcaccctctccctctccagcccaactacctggatggattcggagtgcgtcagtggtcgagctccctcctgaaggctgactggcgacgaggcgctggcacggtggctgcgtgtcgaaggtggacgggtggtgggctgctgtttccggattgacctcgactcgggagagcagaaagatcacggacaaaagcccagccttggggccagtaatgaccacgtctgcgggcaccgcttttcccttgaggtgttgttgtatgatctcctatgctctccctgttggatttcttcgagtgaaaatcttgtcttggattctcacgacaggcggtggcgatacttttgggtggcatcgtctagaagattcttttcttaggggtgtcgtgttcatttacccttcagtagcgcgatttggttgtagaagcatgatgtggttgttttcttttcgaggctatgccttcgagggttatacaggcttgtaattttttctgctcaatcaatagaatcatcgcactatcggattgtttaaaaaaacaacacggtgcaaagaaagctgtaatcctaaggatgaactgcagacagatttcgggcgagactctaaggggatgtttggtttccagggacttattccaagtccctgtcacatcggatgtttggacactaatttggagtattaaacatacactaattacaaaacccattccataagcttggactaattgcgagacgaatcttttgagtctaattacgccataattttgacaatgtgatgctacagtaaacttttgataattatgaattaattaggcttaaaaaatcgtctcgcggattagctctcatttataaaattagttttttattaatctatgtttaatactctaaattagcgtacaaacatctgatgtgactggggctaaaaagttttagcccatctaaacactacataacgttgttaagttaacattgcacttcgagttccgattcagtaaggaatgaatgcaaagcacgaacgacacgagcaacaagaacaaatatttatgtatttgctgcttctttcttttgtcactcaactctcccctttcttctgccactaatttacatctttgggtttgatcctaaaccaccatgtaaagctccgatcgccgttgccgtcaccgcccgccggcaatctctgaaccgagctaatgaacacgccgcaaagcacggtgaacacgacggccgggagcttgccggcgacgaggcctacgagaacgacggcaacgacgaggagcgcgacggaggaccgggtccctcccacggcgtcgccgtctccggcgaggacatcggccggcgcgtcgatttctacccgcgtggcattgctgtaagcgtcggcgtccgtgtcgcctccgttcccgcggaaagacggcgaagaatccatcgatctggcgacgaaggcgtccgcggccttggtgcgcattccacggcgagagtccgaggaatccgtcgccgtggcgtcacctcggttgccttcgctgctgcggaaagaacccgacgaatcctccgcctccttgcccttcatgcccttctgtaacttgcggggaatcagcttcctccatgaccgtttcttggtcttgaccttggcgttgcttgagtcgtcgccgcctgccgcgattctctcctcaatggcgactatcgaatcgtcgcctacctcgcttctctcctcaatggtgaggatggataactcgcttcgcctggaggaatcggagaagcttgccctcgccggctccacctcccggatcggcgagacgtagccgcgcccgtccaaatccagcttgttgttcgccgccggccgccgcggccgccgggaaagcgcggaggacctgacggactcgagcaggaagagcgagaaggaggcgacggtgacggccgcgaccaccttcttgctccagatcacgaggagggcgagcgacaccacgccgacgagcgagacgaaccccagcccaaggccgaacacgcggcccttgggctggcggcggaggacggcctccaccggcggaagttccggtctcggtctcggctgggttggcggcgagaccgagacagcggccgcaggcggcggggatggtggtggtggtggtggcgaggaaggctgcggcggaggggaaggcgagggcgagggcgagggcgaggggggagcctccggcccgccgcgcttcttgcgcctggacgccgaggcggagggcttcttgaggcggccatggttcttgacgacgaggtcagcgagggaggtggggaagcctgtctggacggggagcgggccagcgcgcgccgggcggagcgcggcgaggaggcggccgagtcggccggcgggtcgctccttcagcgggctgggcatcgccggcggcgagcataggaggaggagttcgccggcgcgccggcccgtggcacactgctcgccgcggttgggcttctcggcgctctgggttggtggcggattggtgggttagttccgcctcagactttgtgcgcgtgcgtggcgtgggggccttggtagaggggagagcgagaatagtagtggacgacgcgatagccagtggtgcgtttcgacgaaaagaaaaataaaaaccatccaaatttcccccgtttcgcatgcgttttctcgtccaaaaaaagggacctgggagagtggaagagggtttcaattttagaacggctaaatttgaaagttttgttggataaggttgatgatgggtttagcaactccttgatgagaagggaagggattgtttcttcacatgacctgattaatccgtcacaagaactttgccaatttctacatactttctcgagattcatgtgacgtgaggagagagagagagagagagagagagagggagagggggaatgaattggtctcactgccggaaccaaccggcaaccgtaccgcttgactaatctgtctcgtgccggtctcacaacgttccagtggctgacagcgccctcgctaaccttccacgtagtcaattaatgcatcattgctttggattgattagtactaatcaagtgtatattaaatcgattggctaaggcgctaagcatttggggcctttattttggtgttttcttcattttttttggaggtttataggaccttttgggtctcaggaggttaaagtacgtactagtaaaaattaagcttcgatcatgactcttgatgtgaggtcaattctcttaacagggtcgtcacatgcttgcacgtgaaaataagcttagctatgcgaattacttagtttgttaaccttgtgtatgtctcgtaatctaattagttactagtttgttgatgctgtgtcttaacgagaagaacagactatattctcttgggacccgcggttgtactgtttgtctccctagttcccatcccatgtagctatgtaggcatgcaagcccattcggaaacccccaaatagtttctcaaaaaaaagaaaaaaagaaacccccaaatccttcttttaatactacaaaaatactatcttgttgctatctaaaacatatagtaattctaaggaaattcatcttgtgtgtttatttttttttcaatcacttctacatcccaaagttttgctctatttctttatagctgtactacctcacagttctcatccgtatgtacaaatcatgttagttgacctcattttagaaattttttgtagtttcacattttgttgatttggattcgtctaatttcacaaacaaattcacacaacttaaaaaataaccgcccttttaaggttttgacgtagggatcagggcataggtctaccactcaagttttataaagtaaatttcacataactacaattattttatcaaaactatcacttagctacaacttaagccaaacatttcataaaattacaaaaataacaaactattttattaaaaaactataacttttgttgcttacgtgtatttgatacgtgagactaacttacaagagtgcaagtaccacatatgtgctggacaagtgcacccaacctttttattagaaacaatacaaacagatgtgcacactcatccctataaaacgtacacacgcacaccatatcctcataagtacattcgaaagattacactggtggagaaaccatctttggacggtcgaccaaattccacaatagtcccggttgcaataaaaaccaggactaaagattatctttagtcccggttgaaaaggttagagctactttttgatctttagtcccggttggtagatcatctttagtcccggttaaaaaacggtaggtgatgtcaaacccctctaatatctttagtcccggttagtgttaccaaccgggattaaagatcaatctttagtctcggttggtaacaccaaccaggaaaaaagatcagcatgcgtggagagatcgaggcgcggagagatcaaggcgtgcgggatcgagatacatatatcctcctcccctcctccctcccggttctatctcttcttctcctccccttctcctcgctatcttacacgcggaggatcctctcctcctccccctcctctccttctcctccccctcccccctcctccccgatctgcaggcggcggcgccacgcgaggctcctcctccccctccccccactcatccccgatctgcaggcgcggcaccggcctcgcgcggcggccggcgcgcggcgctggctggcggaaggcggaaggtggcggctgggcggcaggcggaagatggcggcttgttttatttttttttgagaatttgtgatccggatttgagatgtatttgatttgtgtgtgatatgaatatgtgatgtatttgtgatgaattttgtagaagttgtgatgtaatttttttaaaagattttgtgatgtatttggagatgatcgatttgaggatttggaggtgataattgatttgggattttggggatggggatggagtgaaatcaatatattaaaaacaatgaagaaaagaatataataaaggagcagccagggatcggcctggctctatctacaccaaccgggactaaagatagatttttactcccggttatttcacccgggactaaatatagcgatctttagtcccggattcgtagttccggttggaaaaccgagactaaaggggggttacgaaccaggagtaaaaactacttctccaccagtgttagcctgacatatatatcctgagaatgatgaagccaccttaggcatcttgttgttgacgagtacgtctcacataccgctgaaagagtaattaactgtaaatgcgagcactcgtgactaaattgttaatagctcaactggttaggtttcatgtggtaagtcttagacttaatacggacttgatagagtggtcaactagcagcactggtctagagagggtcatagataaaaactggaaggcgagcaaaactcatgtctgtgcaagggattgaacaaagaatcaagagaaggaattttcttagtaattctaaaaggacaagaaaaagcatataaattatcacattgataacaaatatagaaattcccaaaataacatgaaaaaaaataaagtatcaatttataacatttacatgagctaatataagatataatggaatgtatatacgaattagggaagggcgcaagtcggccacccgataatccttggaataatttttttaaaaaaaaacaacatgagaggctccaactgtgtcaatcctcataacacttttcaataaaatgaaggaaaaaaagttatgaattaccttcctgttctcgaaaaccaagcactttacatccttaactatgcaaactagataaactacccccgagcattgttttgggcggttttggcataaactggctgacgtggcactccggcgtggcaaaaaatatttttaaaaataatgggcccacatgtcggtctctatatctactctcactcttctacctccttccccctccatctctctctacccttgaactgagaggagatggagacaaaagaagcccaaggtggcggcgaagagtagtcccctgggatgttggcgacagagcgcagtcggccggagaagcctagtgtggtcagccgaagaagcctatggcggcggcggcggtgactagtcccccggggtgccggtggtggagtgcggtcgaccgtgtaagatcaaagtgtgttttgattcttattctgtgatgaataattggcatctatgattattggttttgatatttggagattatcgtcgaagtggttttggagataatcaattttcaggtgatgatcggattcactgttattttatgtgaccagtccgaccgggtggtgtataccggtgagaccggtggtgattaagcggtcagaccggccggcccacggtttgaccggccgacgctacgtcgatttcggtttcgggttgtttgtttggatatccgtgattgtttcatggttatggcttctagatggatattatacgtatgtaatactgttgtttgctaacaatgagtcaagttggggatagcttggtctcggaatatggtttctttgtttatttcatgtgtaggtgactcgatgcctcgggagagtatttgcggtgatggaccgggagtcggcttggtggtaagacgatgtccgtggtggttagatatcatgcgggatactaagactagagttgatgcacgtggttggtgaagattccatatggcatacgatggaggtattgtgtgcgtatgggatgcggagtcgaatttggaaggagtccaaatttggtacaattggttatgtaaagtttgtgtcttgtactatagggtttcctaagatgtttaggactcttagtatgagtttggttcgtggctttaggctgcctaccttatgtataaatagagggggagcgtgaggcttcccggtatcgcttttgagagcaattgagttgctagtttagttagggtttcgagtttagtcgagatttttgtaaggagtgctgttggtgtactttataaacacagacagaagtaataaagttgtcatctactttgagagttcttcgatttgtgtttcatcgggtttcagcggtctaaccggcgacataccggcggttagaccggcggcaggcggcggtcagaccgacggaggagaggcggtcagactggcagcgacttcacacgtggcaggcaatcttcaggcggttggaccggcggatcaacaccggtcagaccggcggcacgagctcggtcagactggcggatcaacctcagtcagaccgatctacatcgaatttgatggtaacttttatttccgctaaaagattgggtttttgggtatatcaaccattcacccccctctggttggcttagttcttgtgattcgatcctacagaccggacaagcctagggtggcagtggcggagactagtcccccgcggcgtcagcagtggagcatggttggccagagaatcttatggcagcaacgatgcgcggttgaccgaataagcccagtggcgatggtagactggtagacggcagtgggctcgtcgccgctttcatgcaagctccaactctgccaccgcagccatcacctttgtgcaagctccgctacctctaccgatgcctttagtgccctctccaaggcgagccatccacgagctctgtcgtgagtagagccccgccgctgtgtagctccaccccttggaggccactggctaccacggtcgccaggttatgggatccgccatctcctccctgctcagctcgattatagagagagaggatggggattgaggaagagagggatagagtagagagaaaaaggtgagaggggtgagtacgatatgtggggcccactgattttttaaaaaacaattgctgactggactgccatgtaggatcaaaaccatttcagattgagttaggggtattttatccggtttgtatagttgagggtgtaaaatatctggttttcgagttcaggggataactcggtcgatcacgatggttagggggtaatttatacttattttctaaaatgaactatgaatcactttttagacttcaaaaataaagtttagttaggccccgtttggtagggctctaaactctaactcccagctcccaactccaactgcagtgagagctagctcctataggagctgaagtgggtacgaaagtgtttggctagattagttagctccactctaccacgttccttgtaggcatttcgttgaacaccaggttggcatcggctgtcactgctgtcgcctgccgacgcccgcgcgcctgccgcgccaccactgcccgccgccgccaacgcagcccgtcgacgcccaccgctgacgccgacgtcaccgtccgtcgctgctgtagggagggaggaggatggggaggagagagaatgggaggagaggtgtgaaggggtagttcagtggcatttttatgtaaatacattaaaaatttaaagggtagtgggtcttttgaggtggagtggagttatggagcagtaaaacccagctccacccccgtagttcatttattaggagtagctatgccaactccactgccaaaaaagaaggatctggactgtttgacacagctccgacttcaagtaagttggagttaggagctggagttgtgccaaacgggaccttaattacagtagtatcaactaaagtgggccaagttttacctgcaagtcggttcttttgtaatgcatataagactattagccttattgctttcgttatgcttatcttatctgtatggtttattagtaatctatatacagtttgtgagtaaaagttttatatacttgttattagcgttttgaaaacaaatattgtaaaataatctataacgaaaaaaccacaaaatcaactctagaactaaaactaagctctaaaatttaacttttagcttaattataagcataattagaagtgaaataatgggcataagtgaattaattttttgcttaattataagcataagcttaatcactgttacatgttactccctccgtcccctaatataagtgttacatgttactccctccgtctcctaatataagggatttcgtcccctaatataagggattttgacattttgtttgcgctgtttgatcattcgtcttattaaattttttttgaattattatttttttgacttactttaacatccaaagtactttaagcataccttttcgttttttatatttgcacaatttttttaaataaaactagtggtcaaacaatgtaagcaaaatgttaaaataccttatatttgggtaagggggagtagttggtaaaaattgttaaatccttttgtaggaggcaaaggacacaatataaaatttaattcgaattgtacagtgcatcaacgcgtcgattttacctcgatttttgttaacacgctttttaaacgattaaacggtatgttccgtgaaaaactttatattttaaaatatcaaatatatctatttattaaatttgtaataattaaaccttaattaattatgtgctaatgattttctcattttaaatgtaccaacttaatctccattttcatccgtttcaaacacctcaacctggctagattcactctagcgaagatgaactatcatattcgtacatacgcatgggcagatcgactagctcgtcggtatttccactgttaattcttcacaatataggaatgcgattggacgagttgaataagactactgtcttccgtccaattgattaacactaattaagctcacgtattataacttcctacgaaacagattttcccttttattaactagagtcgacggatagatgtagcatatcattgcagcaactagcaagttctcccctgaccagccaaagcggccaatgtacgtgacgcgatttcgagggtactaccgtactactaccagtctactagtactactccaacttgcaaagtccccatcacgcgggtggttaggtagcttgtgaggggttcacgatctccgtgctcacgcagggctcgagtcgagcgcgctgtgcagcaagcaacgatgcatgctgtgcgcgcggcggcgccgcccaccgcccaccgatctcccggggcatagccaccttcagttttgtgcagtaccagccgtggcaacgcttttcacggtggaaatattgtttccaacttccaaaagtacatacgtgtactactctgtagtccgtatgctctcagtttttgggcggcacccaattaataatacttattcatacaaataaaaatataatgacgtttgtcataaaattctttacgtcccattacgttttttttcaatcccttatgtatttttgaattttgtcttgtccagtatatataccttgaatttttattttttggatggaacggttcaaatcctgttgcaaagttcgttagaccccgggctagggaccttcagcagtgagctagttggatttcgtagggcaggaacatggttcacatcttgttcaaaattcatcgcctaaaatttgaagctctccctcaatctgctctgttttttttgggtcaaatttcaaacaaaatttagtgaatttcaaaaattcgctcgaaattcatgaaattagttatctcgtgaaccctcggcaggaacgcgtggcgagagcaagtgctcgcttgatcattagtctttggagaaccttccaaatagcatgcgacagtgtgacacagtgatagcagtgtaaagtggcgtgcgatgctaaccagggttttccatagcatccgtggagaggttatcgtcccccttgctaagacggttattgcaataacatcatggtaactgtcaaaaaccatgtgaattccatcttaaaaagataaattcagaatattcaaatctcatcgaagataatggttatataatggttaccgcgaggcatggttcgtttgacttggaataaaaaagacgaggataaaagaaaaccacaacctcacactgacaataatgtaacaaactaacatggtggtccgcacagattgcgcggctagcatcattatattttctctcatataatagcatatatgttttctcattatattattcaaatatattaaaatgacatcataattttaaattttgcaataactttacgaaactacaaatgtgtaatattcatattgtattttatatacgtgttagttattaattatttttaatatcaaattttagttatttgtaaattatatatattcctatatggactctagactcgtcttttaatatatattttttaataccgaattttctgtaaattgtatttctatatagactctaggctcttcttccaatattatttatttttatttctgaatttttattatttctaattgtatttctatgtggactctaaactcatctatcaatattctttaatttttaatttttaattttagttacttataaattgtattcctatattgactttaaactctttttcccatgtttttcttaatttcgaattttagttatttgtaaattgtatttttatatggactcaaaactctaattttaattttattatgtttatttcaaattttagttagttttaaattcctatatggactgtatactctacttctaatattccttattttttaattccgaatttcttttttttttcttaattgtatttctatatggactctatactctacttctaatattccttatttttaattccgaatttctattatttcctaattgtatttctatatggactctatactctacttctaatattccttatttttaattccgaattttagttatttcctaattgtatttatatatggactctagtctcctcttctaatattccttattttttaattccaaatttcaactatttctaaattgtatttctatatggactctagtctcctcttctaatattccttattttttaattccgaatttaatctatttctaaattgtatttctatatggactttgttttttctttttctccgattaatatgagaatttctaggccatgagagcgaacgtggaagctcctttttctattcctttaataatataactagcatggtgacccgtgcagattacgcggctagcatcattatattttctgtcatataataacatatatgttttcttaatgtattattcaaatatattaaaatgacaacataattttaattttgtactacctttacgaaactactaatgtataatatttatattgtattttatatacgtgttagttattaattatttctaatattaaattttagttatttgtaaattatattcctatatggactctaggctcttcttcgactattatttatttttaattatgaatttttattatttctaattgtatttctatgtggactctaaactcatcatttaatattatttaatttttaatttcgaatttaagttacttctaaattgtatttttatattgactttagactcttcttcccatgttttttaatttcgaattttagttatttataaattgtatttttttataaactctaaactctacttttaattttattgtgtttattccgaattttagttagttttaaattcttatatggactctatactctacttctaatattccttatttttaattccgaatttctattatttcttaattgtatttctatatgtactatatactctacttttaatattccttatttttagttccgaatttctattatttcttaattgtatttctatatggactctataatctacttctaatattccttatttttaattccgaatttctattgtttctcaattgtatttctatatggactctagtctcctcttccaatattccttattttttaattctgaatttcaactatttctaaattatatttctatatgaactctgtttttctttttctctgattaatgtggaaatttttaggccgtgagagcgaacgtggaggctcctttttctattcctttaataagttaatagatagattacaaagattatgacatccacaatatatatgtctcaagcattaaatcttcatttcaccttatagtcatgccaaaatacagagttagcttagtgtttttcacaaattttatcaacaaatatcattataaatcatgtagaaccactttggaccttttttttttgctatttcccccgccccccctcctttttttcaaaatttgaattcaaacaatttttgtcaaacccaattgtaagtaaccctatcgtgcccccactgcaaatatggtcaatgcggtaaccgcgtggttaccgatggtttgggaaaccctaatgcttttttcgatagggttaattgacgttttacagcccatttaaaaagctactccatccgttctattttaagcgcatccatgagtttctgtgtcaaactttaatcgtccgtcttatttgaaaaaaattaaaaaaacataagtcacgcataaagtactattcagattttatgatctaatagcaatgaaaatattaatcataaaaaatttcaaataagatggataattaaagttggacacggaaactcatgactgcgctaaatgagagtgagggagtactccattatatgagatgcatgaagaaacgtaggagcactgcaatttttgtgttaccatcaaacagggcaacttctgaagcttttctccaacgtgagtaatgcgattgagacttgcgcgtccgttccattgcgtttctttcacactttctaactcaacattgatcctagctacttgttgcattccaatgagaatatcaaataatagagattacgtggtgtaggatgcccaaacaacaaacccagccattgccttttttgcatgatctgactgattaaacctacttttcatgcgtgatacatgtcttagcatacatatcgttgtcctgaatcctgaatatattgcgtgtcacctgcgtagcgccaagcatcactgtcaaatgaactgtacccagttactgagcagaatctcacctgtttattttcagcaacaaactcatcaggcgaatagaaattagaacctagaaggctagaatactctgcacagcatcatctttctttgctgcccttttccagagtcaaatttagcaaggaaaaaagaagctcagcctcatttgtttccttttgccttttcccctttttaacgtccttctaagaataaaggttatccactgcatatatttcgtccttatactgatgatcacgtgaatattcgcctcttcgtgatcttccatttgattcttcttcttttcaccgtgcatgtccccttcactgaaaacatcagctagctgttgttgttgttatcaaaaggcaaatctcatcagccaaaaaaaagttgcgtcttgtacccctaatataattggattggaacctgccctaacttgtgaaatacgggtttgcgtggccctgtgcttggaaagcaggtgcgaattcctcgccaacttgagcttcagaaaatagccgcactagctacctttgttgcttcatgtcgccctcgcgtcacagatgaacctcacaaaatattgctggtcgatcgatccacatatttccggggaatgatactttctgacagaatatatgtgtgtttcagatatgttatttgtgccttttggcttagctgaagaatagcatttcgtggctagctataatgtcattgagcttctaccgtcgatgcatttgcaatctgtaaaactctcctttcagtcttaacaatatttgattggtcgtctcttcggccaacccggcaaaaaaaaaaaaaaaagaaaaagaagagagagagatgtcattcagtttggctggtcatattttttatctgttctgtactgtaaacattttcacaagagaggatatatctcggtttgcggcttaggatttgtagttgtactatataccgcatcttgttgtaaataaggagtagggatgatggaagagtatgactgtatgaggtcagaattcagtgtgcgctaggacaagaattagcctgaaagtcaccactaaacaatgactttgctttcagaatgccaaaaggtcacacctagtatattagcagtaccatctcatcatagggggtttcatttgggtgagagataggcacaacacgtaagacagaaatattttgggcatatatacacttaaagcgtcatgatgtggcttttagatcttactagtagatggataggagagagatcaccacatttgcaggaacaactagacctttttagatgggactaaaacttttaaatccctatcacatcaaatattttgacactaattataaatattaaacatagactattaataaaaacccatccataatcttatactaattcgcgaaacaaatctattgagcctaattaatccatgattagcctatgtgatgctacagtaaacattctttaattatggattaattaggcttaaaaaatttgtctcgcaaattagcttttatttatataattagttttgtaagttgtctatatttaatactctaaattagtatctaaatatagagactaaagttaagtctctgcattcacctaaaacttactttaaataaaaaatagtgcttccaacacttctttttttcgaataagaagtgcttccaacactaggaccctgtcttttgtttgtgccactatgacagtgacagagcaacgggcatcatgctagagccccctttggcaaagctctccaaatgcaaagctatcacagttgtagagtaatttaaagcggcctatgctgatacattgcagcaatgtgtaaactaacttttgcttatgtcaattcatgtctcccttcaaaacagagaaaaaccaatgcaggatggtaaccgatcgagaaaattgcaaataaaaaaactgcacattgagatgcatgatgaacacagtagagtttagtcccatgaaaatgaagtagataacatttcctaacatatacagagatagaaaagagtaaaccacggttcatgtacatgaataaacaaatttagacagagaacaacgatgacaacgaacgaaggcatgcaacaagtagtagcgcacagtacacaagcagcagcagtagcagcagacacggcaacggcacattgtgtgtttgtaccgatcgaaatatatgtagcgtagcgtagcagagagccagagaggcaaagcgggagggatcgatcgatcgatcgatcaggcctcgtcggcggcggcggcgtcgtcgtcctcgtcgtagtcgtcctcggcggtggcgtcctggtactgctggtactcggcgacgaggtcgttcatgttgctctcggcctcggtgaactccatctcgtccattccctcgctggtgtaccagtggaggaaggccttgcggcggaacatggcggtgaactgctcgctgacgcggcggaacatctcctggatggaggtggagttgccgacgaaggtggacgccatggagaggccgacgggggggatgtcgcagacgctggacttgacgttgttggggatccactccacgaagtaggacgagttcttgttctgcacgttgatcatctgctcgtccacctccttggtgctcatcctgccccggaacatggcggacgccgtgaggtagcggccgtggcgcgggtcggcggcgcacatcatgttcttggcgtcccacatctgctgcgtcagctccggcaccgtcagcgccctgtactgctgcgacccgcgcgacgtcagcggcgcgaaccccaccatgaagaagtgcagccgcgggaacgggatcaggttcaccgccagcttcctcaggtccgagttcagctgccccgggaaccgcaggcagcacgtcaccccgctcatcgtcgccgatatcaggtggttcaggtcaccaactacaacaacagcaaattgatcattatttccatcatgttaatttcaagcaaattacacacacaaggtcaaggtgcatgatcgcttcgcttacatgatgggttggtgagcttgagggtgcggaagcagatgtcgtagagggcctcgttgtcgaggaccatgcactcgtcggcgttctcgacgagctggtgcacggacagcgtcgcgttgtagggctccaccacggtgtccgacaccttgggcgacgggaacacggagaaggtcagcatcatgcggtccgggtactcctccctgatcttggagatgagcagcgtgcccatgcccgaccccgtgcctcctcccagcgagtggcacacctggaatcctgcactcacaaaattgcatgtcactcacgttactacatactccctccgtatcaaaacaaaccaactatccatcagtagttataggacattactcagattaggataagtatatgagacatcttaactgaaaatgaaaatgatctgaactctactgtacattgaggtttagacatttaaccgagctaaagttcagatgcccctgttaagagtcatgaaagtgcaaacaattcaagaaactagcaccgcattatctgtcctatcagatctccggactaatcatattcctgtagtactaatttgtgtttctaataatatgtaagttgaatccgaaaatgtgtttatattctgtttctgatgattacgtgcactaaaatccatctcccaaatacgtccaaaggcaatcatgctaagtacatatgcaagtaatcagaacatcatcactaatataatccatccatcgatctatcatgtaacccaaccaccagagactggcaacagcctgtctgagtgtctcatccgctgtaaccaccaccgacggctctgttccattagctgatacatcctcctcctccttcactctttcttgtgttaggtcgtacaacattgtcactagtcacagtatgattgtttttctactactagtagtacattattattgtgatgatgataacctcatgaaccttcaccggcaaaagaagatggtgagatgcgatggtgatgtatttctgtaccgaaaactcgcatctgaccgacaataccagttgtttgccacctgaggaactgatgaaaactctctctcaacgacaattctattcgccagaaagtagcagttaggggatttttttttttagtttgttgctgggttcaattcgtttgggcatacgttgtacctcgcattttcaagaaaacaatgataattactgattactgggtaacatttttaacatgcatatcttacatcttggcaatgaatgaatgcataatagtcagattcaccttttatgcatagagggaaaaatagtattcagcgcacataagcagtactctgtacctcaagtattctgtgaattttttgtgcacttgaagtttttagaaccttcataacatgtatccatagtgttccaatttttaagcagttgattcaactcgatataagatttacagatctaacacagagaactactgaaatttaaaccaacaatatatggcgcctcaatttctagcctgtgttgatcccgatttcccatcatgccaatggatcaacttgacacaggatgaatgtctcattccgacaggtggaagtggtgtaatgtgatggggactgaaaataataatttcatcttattcgattttttttttgaagatattcccaatttcaaccacgagtaaagatgttgtgcttctgtctgattaacccgatccaaccagtactactatgtatcatgtatggtcttttccatgtatgtccaaatttgggttcaacaactggtgctgctggtattcctattcaaatccaacctaaaatggtatgataagtttgcacactgaaattcatccttgaaatttgcagcactactggtttgttttgctcctcaaattgaacaattcacactctcataactggaaccaccaattcatttttattttattttttttctgagacccacaagcaattcataccagattgctcattatcaatgctgccaagttggcgtattactctgttgtctaacaaaagaaaaaaaaaactccagattcttttcatgcggatcttaacacgctgcggtgataggctaataatgtgtagcataatactgtcttacctaaaaatacacacagaaagtacaaaccttgtccacttttaggatgccaccgtctaaaatgatcttgccaaaaaaaaagttaaagaatcatatgatcctattctaaattttcagcgacggtttacagaggcccgagaaacacgtatgcagagaaaatgcagaggaatgccatgaacgcaaggattcgttttttctttttttaacgaaacacagtgaatttaaagaacaagaggatatgtatatataaaatcgacgtgtacgttaccttggaggcagtcgcagttctcggcctccttgcggacgacgtcgaggacggagtcgatgagctcggcgccctcggtgtagtggcccttggcccagttgttgccggcgccggactggccgaagacgaagttgtcggggcggaagatgccgccgatggggccggagcggagcgagtccatggtgcccggctcgaggtccatgagcacggcgcgcgggacgtggcggccgccgctcgcctcgttgaagtagacgttgatccgctcgagctgctgcggcgacgtgccggtgtacgtccccgtggggtcgacgccgtgctcgccgcagatcacctcccagaacttggcgccgatctggttgccgcactgcccgccctggatgtgcaggatctccctcatcttcgatcgcttgcacctcgatcgatcgctcgccgcgcgccgatcggtgatccgatctctttcttggttgttcttgggaggtggtttgcgatcgatcgatggagagagggtggagaacgtgggaaggagaggaggagggatcgtgggcgcttatatcccgcgtttggagggaaccgcttctctttctgggtgttatggttgtgcgtggaccaggtgtatggacaaatgcttacacgtattgatatcgcttcaatttatttatttttttacggttgtcttcgaattttaaagagacggttttctttggaactttaaatttttataggtgacgcgttatttttggtctgagtgtgttttggttattgcaaaagaaaggttgatcaagcgaagtacttaatttgtgtggacatctgttttatattataaatcgttttaatttttttcctaatataaatgcaatagtatttttaacataaacaaacatattgtcaagatatactgaatgttacactaatatgatgttaaagatgttatttttttctataaacttgattaaatataaagttgaaatgacttataatataaaacggagagaatactaaaaattttgttgtggatttgttgcaggtcaggtataaatctagttgtactaaatgttcgttttaattagcgatatggaattatggatgtgagtattgaagtacctgtgtagaccatgactccatgagtatgtaaagatgtgccagggtagaccgcatgaggtactgtggtatcaaaggggtgtggggacgatcacgttgtgctgtctattttttctgccacattttatttttggctgggtgcagtggcgggtcaccaaataatgggatcaatgctaatttactacggatcaatttggtacctgcaagcacacttaggcctagttacagatcagaggaagaaaatagcaaaatcatggagcactacttttctactacagtattagtatggggtaagttttttttttggtacaactttttttgaaagatagttatatgttattagagggcacattatattggcatatttgccactagtagtatttctgaatgtcaaaattttttaaggcgtgtctcaagaggaatggatccatattaattttaaaggcctttgttacctggtagagactgtcataaaatctcttcatttacacgtccacatgtgtacatcctttgggaattttgatatgtactacttccttcgtcctaaatataacacatcctagttctacaaatttaagcagtcctcctatacaaatttacaacactataatgtgtcacgttttgtagtaggtttattttcttaacagaggaagtagttcactagttctctacttgcacatagccagaagttggctttttttgggatagagggagtagttcacatgtgagagtacatagtactggtacttatatgtgtcaagattcattaacatatatataaatatagacaatcgtagaaagttttataatctaaaacggaggtaatactattttagaggaagaagaaccttttaaaatgaatttctttcgtacgtgaatatatatatatatatatatatatatatataatatacatacatatgcacaatttactactccctttcttttaaaataatttatattttttaaaatttaataatcttttgtatgtaaatctggacaagtcgattgattttggaacggaagaataccctaagaaagtacactcccctgccaatgaagagaaaatgagaaaacaagtacactgattgttattagtatatttaaaccaagtttggtatgacttattgtgtgctcgaaaaagtacggagacagcttggccaacaagtgttctttttatgattaatataaatagatatcaagagaaaagttagctgtcaacttgtccatagtgttacattgctctagccttgtcacgttcaaatactgtttgccatggcatttgcaaggagaagatgctgttcttgatttctttcgcatcattatcatgatgatcatcaagtcattgtacatacatatatatactcgatgattgtaaacgttaccataccaaccaataattatattccgagataggatccggagactggaggggactgttttgagtccatcagtccacatgcaccagcacatgttgtgtctgtcttaaaccaaccgatatcatatcatctaattaactattaacttctcttcctaacaggtgacagccatttttttgctagattaataccattgtttttttaaaattactccctgtgtacaactccaaattttctctcgtccaaaaataatgtcagatttctaaatggtcttttccaaaattgtccctgttgaaagcgacgtatatatcttagattcttgaaactgcgatcaaataatagcttagctataggcctgaagcttagtttcgtaaacagtttctggcccagtataaccaagcggcgttcttaacttgcggctatggttgggctgcacggcctgcaggttacccagaccagacaggtgtatagctgcagagctagagaacgaatatgtccacattgactccctcaggtatagctttaatctaattcttatacttcaaccgtaatacctgatatcttaaccccaactattaaaacttatgtaataatatgattcccttaatagttttggaggacagcttcgctgaattggcactttgacctggtccaaaccggctgacttagtatgtgggacccagtgcaaccgctagagaacgactaattaaagtgggcttggcacgataattttgggctcgacgtagtaggtcgctgataaagatggcctaggagctgcatgtatggtccagaggtggtgaaatggactagagcctagaggagtgcggagagacacaaaaaaggcccatatagaatagccattaacataaggcaaaatttgctacaggacatgtaattagccgaagaacaccggaagaatgtgtatatgctggagagcatcgtaaaacactggtaattagctgatgtacactcacgacattattttattatttctggagaaaatagagagagaaacagttgtgaaattatggttttacccttgaaccccaataaaggctcactctcctgtgggacccacctattagggaatattattttttttctttttctctcctactgtactccttcgtcttcctttcttcgtcatgtcttcttccatgatggccagcccctccccacccatcgcggctccagggatagagttcacggcgccgccgccggggcgcgaccacacgcaggattgctcgctcacctacgcgcagtggaaggaggtggacgcctccacgcgccaccgcctctcgctcgacgcccgtgccgcgctcggctacaccgctcagaggatcttcgcgcggttcatggccatcaccaagctcacgctccgctacgcccagggctccgggacggacagcctctctgacgacggggcacgccatgtggtcgccgcgctgccgtccgaatggctcgccaggctcaagctccgcggcctccggcagctcttcgacgacgggattgcgtcgctcgctggggccacgccggtgatccgtaaactgtccgtcgcatccatcagttttgggccgaaggccttcgtcaccgtcctccggtcatgccccctcctcgaggacctctccgtcaagcgccttcgcggcctcctgtaatctcacggcgtccggctgggagcaagagccagagaccacgaggagcacccaggcgttggcggtggcgaggaagaggcccgtggggccgtggacgcagccggaaccggagacgacgaggagcagaccgggggagccggtgaggaagccataggggcaaacttgtctttaatggatatttctctctccattttctctggaaataataaaataatactgtgagtgtccaacagctaattaccaattttttatggtgctctccagcaaatacgggttcttacggtgtcccctagctaattaaaggttttttggatgtcttgtagcaaattttcactattccaaccaggatacgcatgaaaaacagagcgatccattagcgcgtgaataattaaatattacttttttaaaaaaatagattaatttaagttctttaagcaactttcatatagaaacttttttaaaaaaatgcaccgtttagcagcttaaaaaacatgcgcgcggaaaacgagggagaggggttagaaaaagggtgtgccgaacacaacatattcctctacaatagtcacaaacccgtgcgttacaacggaacgggatctggtgaacgtggttaacggagccatcgtttcgcttattgacatatttgcaaagcaaaaatactttgtgaataaaacttttatatacgtgttcttagcggtctaaaagcaaatattgaaaaataaacttcgatgaaaaaaccttaaaatcagctacaaatttaaagttgaaaattcaaattttggctgataaatataaacataaatgaaaagataaggccctaaaattttctgttcttctgtatttctctcttggctagtacaccagttttgttcatgggatcctataatcttataatactatacaagtgatccccacttagtgcagttattagggattttcctgagctgtggttaaggcacgtcaccctttttttcagccgttcgatcaaatcctcgccaaccgttcgattgcaatccatcacgcacatccctccgccactgatttgttgccgccgccgccgccgccccgggtctcccccatcgcgcactgcttcctcccaccaatccccacgcgcgctcgcttcctctcccccatcgcgcgcgcaccagcgcgggcccgccgccgaacgccctcgcttcctccatcgcacgtgcgccaggcgcgggcccgccaccgacgccctcgcttcctctcccgtgccgcgtcgcgtcatccctagcgcgagccagcctcttcggctccttggcatgtaggaatgaaacaacaatcgtcctatctcccccaatcgttgtgattccatgccgtaacgttaaattctttgctcgccctattgtgccacaaaatcgaagcaaaattaggatacgaatgtggtatattcatggttgccttcataagctgtctttaaatcccaactcgatctgtgcctatcatgctatggaggattgatcactgggttcatcattcgtgaaggctattgcaactggcatgcttctgatctctatcttggttggattattttgtgcaaatcatttcatcgtttcatctcggcttcttcacgtgagacaacagctgatttgtgtattccgtctaccctcaagtggataaggtagcattttctcatccctcatcctgtcatgtttagtttaattatgggctctccatactgaaacagggtggtttagcttttggatgagttcattgactgtactcatctttttctccctgtacaaaaaactgcaatgctgtaggtgttctttcggtgaggcccctgcatgatgcaattctttttcgttttgtattattatgttattttccctgtaatgttaaatcattcctatttgctgatcgatttggcagaacagctcttgcggtaattgctgggaagataaattctgatcattaatttttaccttcaattttttttaattccaaaagagaattcagttctcttctaaaatgcatgaaagtgatttccgaaaattcagcactatattaattgattttttaaatttattttcttacagcaatatcatttatttccattctataaccccatctctatcatatcgaccaaaagaacaatgcaactattggtctctgttttgtaccaaagcaaagcgcaatgaacatgtattctttctttcaggcctaaagtccatatgtgttaactacaaacattacctggcctcttcctgcttacagtttgcaagtttctgaccaaacttttaagagtagttgattttgccgatttacttcatccacatgatctatataaggacatagactatttatgatttataaaggtaaaattaatactccctccgtattttaatgtatgacgccgttgactttttaatcaacgtttgaccacttgtcttattcaaaatttttatgtaaatataaaaatacttatgtcatgcttaaagaacatttgatgagaaatcaagtcacaataaaataaattataattacataaattttttgaataagatgaatggtcaaacgtttgttaaaaaatcaacggtgtcatacattaaaatacggagggagtagaatatagctgtaatttagtacactaaaaccaatatgagaggttagatcgattaatgttagcatggactaggctaatatatttttatgttagccttaattactttgctaattactttgttaatcaagcaggggacgtactactacacgaggcggagccccggtacttgcccgttgtggtcggcccttggctacacccatgacggttatttcctacccgtataataaattacccatttaacacatactcagaatacgtacccacgagcatgttctcttttggcacatggacactaaggatgtgtttagttcacactagaattggaagtttgattgaaattaaaacaatgtgatgaaaaagttgaaagtttatgtgtgtagaaaagttttgatgtaatggaaaatttagaagtttaaagaaaaagttgggaaactaggcctaaaagataggagagaaacgataaaactttgaacatgagagtaagtttaatagtatagtcaactactaactccaattcatctatagccaatcttatagctcattcatacaataattacatactacactattaatatatagtcccacctgtcgtatacatactacgtcttggagtccgtgctacagctggctataaatctgtagaccgctgcttttctctctctttatttatcttactaaaatatgtttgcagctggcttatagcctgctattgtatctgctcttatgtgcatagtcatacgtcaattactaacttagagctagcatctcaatcaaagtggttacatacggaccatccgatttgatatcctacgtgtgaattcgctcactaaagttgcacattcgcctcaattgagcttccaaaaaccactctcgtctgttccatttggtgctcggtgtaggtgacagtgtcgtaggtgacgttcttgaggaagatcttgatcacgccacatgttcctcgtagatgagcctggagatgcgcttgggcatgccgcgggtctcctcgtaaatgaaactagatgataccccgcgcgttgctgtgggatatcgtgcctaaataactttggagaaatgggcacatatatataataaagatctatacaaaaattaacactgcaagctagttttcagtggcatgcataatttctaatgtcaacctgcttagtggagcatcactgcgtacggctgcaatcacgtggatgaaataaatcggcaaaatctaacgagatctctaattttattgggtgcatgcattatatttattagattaatccaaactataaggtgataataattatttcttagtttttagctaaggtggttgtgctttatattttggaatggagggagtatgtaataattggttatagtttatttgaaataaagaccagaacaaaaatagtatgtgtggatggtgtgtatacacgtgtacaatcttctatgtaaccataaaaaagagctcacaaggtcgtacttaggcattaagagcccattgtcgacgtttgatgtcgcgattccggtatttgcatattatgaggatcattggtactaggatatatgtgagattgtaataaaagagatggggccctgaattgtcaggtaataaccctactcctgttggccgaagccggtcgttgctcttatttatcataatcacaccagtacaatatttggggtagtctatctatctgtcgtcgacttggcggccataaaaccatctcgtagtcgacaagagagtaatcttcctcctcgaatccgtgtccggcgagatcaaagacagcgctatgtctctcctgacagtatccgtagacaccgtaggggactagccatgcttatctctgaagtcgatatccggcgtcttgtcttggcgtatgttggcttgtatgttgatcttgtgtttgatctattgttccgtgtcccctctccttctagggggtcttgtatttatacccgtaggtgtccccttgtccaagtagaactagggaaaccaatatggatacaatccgagtagttcttgtcgtttccatgtagaactctattcatccttccttatgcggaactcctcctatatccgaaggttgtttccgtataagacatggtatgtggtgggtcctgccgagatttagtcaactactattagatatgtggtatccataaccctaacacctatcttttgggttatattcatgcttacccataagtcgtattagcaacttaaaaaaataatttgtaggtaaaatttatacatatgtactcttaactatgcaacagcaaatgctataaaataaattatgattaaaaaggaaaaaataactctgaaataagttttaaaatttaaatttaaatttaagtaaaaacatgaggctgtaacactagtacgacctatatagcccgtatacgcttgcaatatggatcagtggatgcggccacgtagggggagtgggccgttcaatgtggtatggccgggccgtccttcacgtcttgcgcgtgacggcgcaagtacagggccaacacagccagcctgagaggaccaacacaactctcttaagactgtgcaggtaaaatgccttcccctttaggttgtgtttggattcaaagtttggatccaaacttcagacattttccatcacatcaatttatcatacatataacttttcagtcacatcattttcaatttcaaccaaaatttaaactttacgctgaactaaacacagccttaatggctttctcttcggcctcgcgagggagcgaatacatagctacagtagctcgcacgacccgtgcggccctgccacgagtaactgagaatcctgactactcaaggacgacgcatcaatgcatactccagtatgagggaaatgattaaatttgcacggttcacttcattgttctgttttccgttcacatcgcacatctagatgaggaaattgttttattttcctttctaaaaaaaagaaaaaaacatctgtttgtaggtgcgagtgtgatacgcgtgcgtcccacatgtactcgaaaagataggttctcttcatgaaacaatcatgtcaaattcataaattttagtatgacaaactttctttggtataacttggcaaaccattaccaattcagaaatttcggacaagacagggaggcgatctccctctcgaccctcaaagtatctccaacagtctctccaaattccactctccaaatgtctatttagccaactctccatttaatttggcaagtcaattcgttgtttctttcaacagcatctccattcatcctctctattctgagtctatgacagcaggacccacatgtcaccctatatactactttctttctcatcatcctgctcccactcttccccaagcccccttttgcttgcggtagtggtagttactcgcggcgatggcggggcggcggtggccgtgagcagcaacggcgagacattcctgagctcctccccacctctctccctctgctgcggtggcgacatgcacacgacggcggacagcaaggggaggcagcgagtgcagggggctaagtccacgcgacggtgagtgcagggagctaagtccacgcgacgtccgccctttcttattcctcatacttctttctttcctccacacccctcgtctccgtgctagtggcgctcctctgcgtggcggtggtgtcgccggcggaggtgggggggcacggtttgtgtgcctctgctccggcgatggaggctgacgatgggggcgacggtgagggatgacgaagactgcggcggcagcgaaatgggagaagccggccccactgctgcctcatctcctatctcactagcgccacccacctccttcccccgctcgctggcgtcacgagcccaccacccccttttcgcctgcccccaccgcctccaacgccgagacccacctctccttccgcggctggttcggtggcccccttcatcttctcctggggtgaggccagggagggcgacggttgaggcggtggcggcggaggaggcagtggtgggctcgggggcgtcttttgggcaggcgcagcgccgtcaccaccggcagtggcggctgcggccgcgggcggcatcggtggatggatggcgcgaggccgacagcgcggaggacgatggatgatgcgatggcgtgaggcagacgacgcgaaggacgatggatgatgcgagagtggagatagggagcaggaatgtgtggggcccatggttggctagtcacttttggctggccaaatttggctagtggagggaaggttttagccagctagatgacttagtcattcggttggagaggttgttggagggtgtttttttggctagaatggagagtggaatagtgaggctgttggagatgctcttagctagcaatccccactaccgcgccagctgcccttccctgctcccacttcacaaccccttccttttttttctcttctttctttgccttcatcgtcatcgtcatgcgaagcttcccaggtgatgggattttgttgctcacgccatcaccgaatcacggcgacttccatgccacgtggatggggctcggctgaatggagcgcctccccaactaggccagttggagcattgtcatggcaactcattgaggttgtggacgacggcgcgcgggctactcgtcggcagggttttaaatttcgatttcggctaaaatttcgaccatttcagtagaaccaaaatttctaaaatttcagtattttttgggccaaaattttatgaaattttgacacaatttaattgaatttgactaaattcacaaagaacatgagaaaaatcgaaaatttcggctgagatattgacttgccgggggaccggaatttcggaaatttcgaaataaaattttaatccctactcgtcggtgctagggcaagaggcgttgtaggcagcatggcgcctcggtggggccatggtgttgacgacacaacgatctaaggggggtagatcgccgctgtttatggcatgtctggcttgcccgcctccagtgcgttgttcgtggtgtttccatgacaatggtattctccaatactcactgtgtgtgatgagcaggttatgggatggtgaaaaccttgtaggattctaactgggatttgatgacactctcgagcaccatttcctcattggaggcgtcgccactgtcccccaagtgaaaacattgctttgtttttctggacgagcggtggtggtgtctcacgccccgtcctctatggaggcattgctttggaggatttgtgcgacggtgactatttttttatcggctttgatggctgtgtcggtggcaatatctagactaacgatttatctactactcagttactctcagcattatcttttgcctcgatttgacttcaatcgtcaatagtgatataagcaaaataagatcaacaaaatgattggtcactgatttcagagatgctatttcctaatttcataacttgcaagccgctatgaaacaacggttatacaattcctcgctaggctacgttcggatatgggagatgggaactcattctctctgcacgaaaaacggagcggtctattagcgcgcgattaattaagtagtattagttattttttttcaaaaatggattaatatgattttttaaaacaactttcgtatattaactttttttaaaaaacgcaccgtttagtagtttgaaaagcgtacgcgcggaacacgagggagtggggtcaggaaccctttgcaactagggctgtcaacgagccgagctcgagtgagtctggctatgtaggctcgagcttgacagtttaacttggtgaaactccaaagaactttctcttgtataagagatattaatgcaaattatcggtagtcaaaattaatgggtgctacttgtcttgaatgaagcctcttcagctttcttatgaattcatgactttgaaacgttgcaattaacaaaagctagctactacatctaataggaatagtagtactattactggcagccggataattgctttattgagaagcatttataaggtcttgagacattagtaggtcaagcacgctgataagtatacattgacccatcaagaatatcttcctacatgtaatgcatcttatactaatcaagccctaccgagctattcgagctcgagcttgctaggcttgtgagcctcagcctaggcttgagcttggcttgtctagtatttgagccgagctcgagtcaagcctataacgaatcaagctcgagcagcttgcgagctccgagctttttttacagccctatttgcaacaaacacagcctaaccatagatgggagttgttttctctgtcttcgggttggtgtttcatgtagttttcttgtcttgcatcaagttgtggttttggaagttgtaatcttaccttcaacctccgtaaaagttggttgtagctttttttttagcaaattaaagtcaataataaatttcattattagaaaattttcaaataacttagtagtggtgcctataattatgtaggaggggtatttttaattgggtttaaacgaggatactgattaatgattggcctttttttttgcttaaaaatatgttaaagtgggtaatactaaattatgggtatgtacgtatacatatggtatccggtacatagtagcgtgtatgctatgtacgttcctgtgtataataggaaaaaattgctgtcacagtacgtgtaacaggactacaggagtaagtagcagttgagttattgtactcgttcctgttcattgcacggaactgaaataaaggaacggtttttaattgcttcagaaccctggccattgattaacatatctagcaatgattcggctgactagtcagtagaagtccatttttatttttattttgcaaccatcaaatatatcggtgagtttactagtagtagtagcaaagaggagtattttaattataaatcgaagaaatttgagtgactaattaacatcaatggcccacttgaagtacacaaatgtatagcacggatttttggtcagtactacctccgtcccaaaataattaccgtcgtggatatccgtacccaacgtttgaccatctgtcttatttcaaaaatttgcgaaaaatttgaaaatatttagtcacacataaagtactatttatgttttatcatctaatagcaataaaaatattaataataaaaaattttcaaataagataaacggtcaaacgttgaacgtgaataatgtaaaactgcacttattttgagacggagggagtagtactctttcaagattgatttgtttcctggcaactgagcatgcaaggcaataatcaaattaaatacagtattaattagtcgtaaggtcgtgtgtcaaattgagagtatgtgtgtatgcatgattcttttctagcagtatcattttcgaattgaatttgccggttgcttgcatacgcgtacctggaggactaatactgttctatcatttatggctttgagaaattaaaacaagactgccaaaacccaaaccagttcaagcattcaattcaaagcgtgtatttaaaggacccgcaattaataggtacatttaatccctacattggccgcaggaattgattgactagctagctagagagacagttccatgctctctgaattccgaattaaaggaccgttgtacagtaaactgaattccgagtactttatagtagtatagcataaaaaaaatcattgttccagttcctctcgcatttttatgatagtaacagtagaattgataaatacatttgacaatattaaggttagagcaaggataataatagagcccacttcctactattagctcatcttaaagtcaacatatataatagattagctataagagcaggtacaattgcaggctataagctagctataaacatattttaaagagataaaggaagagagagaaaagcagcgggctacagatctgtagccagctgcagcacggactccaaaatacaatgtgtgtatgataggtgggaccaggtattaatagtatagtaagcaactattgtatgaattggctattacattgactatagatgatttggagctagcagtgggctatactattgaacttgctctaaggttggctacaattttcttctcctctctctatctctcacttatacatttaatgtatttgtcttggagcttgtgataagctagctcttgcattagagccaacatccttaatttttcactacctctctcctccacctaagtttatagtaggcttatagctcactattatacttgctcttagaccctgtttagatgggactaaaacttttaagtccctatcacatcggatgtttggacactaattataaatattaaacatagactattaataaaacttatccataatcttggactaattcgcgagacgaatctattgagcctaattaattcatgattagcctatgtgatgctacagtaaacattctctaattatagattaattaggcttaaaaaatttgtctcgcaaattagctttcatttatgtaattagttttgtaagtagtctatatttaatactctaaattagtatccaaatacagagataagtctctggatccaaacactaccttagatgtatgttgtcataactagggagtatattaaaaagaaaagaactgacagctttcagccacatgaaattctcatagattccaatcgaattcttctttttctccggcgaacacttcttttatgaatatataagcacagttgatttaatttattctataaataaatcatgacattgcacgtataaactagtatattcgtatcatatgatctacacatgtaactagacagtatattgaatattcaaaacatgtatcgaagattttggatgtatggctgcacaatacgaagaactcgcagtaccaggcgttaacgatagtgtgcaacacctgagtgcagaggaagacaagccgtgctggacgaaaagcaagtagtcacgtgaagtgattttcaaaaatcttattattgccttctccctatgcaagacatcgaagacgaaggttctggaggcgtgctctcccaataaccgcgcacgccagtgagtgggacagagttgactacgagtaacgagcgacgacgcaatacggaggaggaggcaaatcctagcttgattccgcgtgcgttgcgagaaggtggtggttcggttcatatagagatatcaggacacgtgataagagtgcctgcatgatctccataccgtgtaaccgaaccggataaatttcatataacttatccggactccatcccactctacgcactagattatttggtgtgtttccaaaaactacgtttccaaaaacaaaactgaactttgcagcaaaacaaaactgcaaaagaatggcacgtctgtgcaagggtgagtaaccaattttgacgggccattcacgcgccgtctcgcctagcctgacgagcgagcgcgcgtgtgttcctcttattttttccaccacacatgttttaagtggttaatagaacaccctcccttatagggagatctccctctcctagaataggcaaggtggtactaatcattctcatgtatgctagtggcgtttatgattttccaaagaattaatcttcaaatgtgctaaggcccatctattaatttcaacgatcttctcctcaagcaatggtctaaaggcagcgatgacacaacccagtgagagcagcgaagaatgaaaagaggagagagaggggagtgtggtacctatgacttaccaacggcgatgacagaatgtcccatacaactttccctacaatcggcgacaccaaaactctactccctccgtccctaaatataagggattttggtaggatgtaacacatcctagtccaacgaatctagactgtcgattcgttggactaagatatgtaacatcccaccaaagtttttatatataaggatggagggaatatctaccaaagaacctacagaatagggcttaagggttgggaagtggtggaggtggtaaggggcggtaatcaaggctactttcttaattgatactactcctatatgagtactagtactctataattctactcgaaagcggataaaaacatgctttgttagtgcagcaagtgtcaaaatacagtaatctgatcgacctgatagatacattttcaatgcctaagtataattgatactccctccgtttctaaatattagacaccgttaactttttagcacatatttaacaacttttgtgaaatatgtaaaactatatgtatacatataagtatatttaatattaaattaaatgatatgaaaataattaataattacttaaattttttaataaggtgaacggtcaaacatatttaaaaaagtcaacggcgtcgaatatttaggaatggagcgagtatttatttagctatgaatttcgctggaggtaattgaggtctgcatgctgaacctgacagactgtactatacaatatctgtagctgccaaaacggctgaaaatccatggggaacatgaacatgatcttcatttcagagcccaaaatcaggatgagcagatgatatatataaacacgatgcaacaggaatgcacattaacacagctagttacattcaggcactgaaattgttctgatcatgcatgcaggggagcgctacaggaagatgggtagtgataaaagagtacttaaaaaaaagacaagcattaggtttccttgtccaacgtttaactgttcgttttatttgaaaaaattataaaaaaaaatttaaaaagataagtcacgcataaagtattaatcatgttttatcatctaacaacaataaaaatactaattataaaaaattttcatataagacggacagtcaaactttggacacggaaaccagggtctgtctttttttttttttttttttttacggaggaagtacttcgcacaacttcaatgacaatagccatactagctaggtcagtaaaggctaattaagccgctgcactgtgggcttgtcaacatctggacaagtacccggtgagcaatcctgcagagtagcagtatgaatcatctgctaatgctagcactaattaacatctaaacgggtcccgccgaaattatctccattaacgtagggtaattaatcaaccatgcatcctggctcaccatttaattatacgcctccttttattgccctgctcttctttaacctggtgcgtaggggtacaaacggtacactagtggtatctaatcttctgtaccaacttgatatctgcccagttctgaactaccataaaattgtggatactgcattgatcatcgtagccctgctcagctcagtggtggcgacatgtaccccatgatccaattaaaaacttttaatacaaattgtacccgttctctatttaagctcaatatgcatggtagcttgatagtactaatgttttccaaatttatttcgtttacaatattccttgatagagtagatgtgctcattaacttaccatcaggttttgtctcatggtacgagtcctggaagctaattagaggtatagctaggacggcaaaaggagggcacggccgaccttgctatgaaccgtgtgatcgtatttggagtagacgtgggccgctctatgtatatcgttgatctactgtcgtttaaactagtagtgtagtacttgtgtacgtatttatacggttgatttagtttaagatctagtatttcatcaattgatttttatctatgtagtgttcacacttctcttttcttcttcaacctccaataggacttaatttagcttctctagaacactcctagataggccatcacgtgtcttaataaatcctgtaaattctgaaaaaaaaagaagataaaatttgtcccttaatttttatacttaaatgtatgggttcaatattctaaaccattagagattagattagtagatagattggtccaacctctcccctccctatttttaaggtattcatttaagataaaaggaaattaattaactagttacttgttgggtgctcatgagttgtaacggggaaaaatatacatcaatatcaaatcacagctgataaaatgatgtttaataatcattgagtgtaagcttgttgacattgttgtaacgagaaacattaacttccctttaaaatcttcttctgatataaagaccaatccataggaagttgataggattcttgcggtcctagtccttaatttcttccaaatgaacaaatagatcattttcttatatgatttaatcctaaaaaaatcatcaaaagaaacctttgttccattaatttaggtcctaattgagttaatgggcaccaaccaaatgacccattcctcgtgatcttttaagtacccggtccatccattctaaaatataacaatattatagagtagtccaaaatttatttcaattataacaatcttgttattttaaaagaacttttattgctaaactattcattctggctacctctactactatctaggagtattaatttattattgccaagtagtttgggcttacatacacctcaggtacctatcctgaaaagatagtaaagtatttacactcatcttcttaatagtcataaaacgtgcaatcgcgtatggttagaggaaagcaaggcacacaaacagtagatcgataattaaccgattaactttctctgtaaaaaaaaactaaaacaggtaaaacaggatatgtcatttctaattctaaatttgtttttttaccgagagacatgtaaaaaaaaaaacagcttcagctccttcatacctatttggtcctagagcgtactccctatagtcgtccctactgcaacttgtgccgctctctcgatcttgtactgtgctgctttgaaaagtccacatctaattaggcccgagccggccggagctcaactaataattgtacgagtctaattaggacctctcgcagtcttgggatcgatgacaacgatgcatgccggccgtcgtcctttcggccatgcacgaaattgatcgctccgacgacgtagtactgatctacgtacacggtgggcttgttcatgttttatctgtgccaataatgttaattaattggggtacaattctatgactgtgtttagatttaaactttcaacttttttcatcacatgtaactgttccggtcggactgcgtgctcatccgtgcacgttcacatggtacgtagtgtatacttttactgcagatttgtattgcgatataaaagtactttcattagtacgttaattaacaatgtagtagtacatgcattccccccaacgtacgtgcagtaatattattcgtatgtatatatatacgaatacgatggtaacagctatacgtactatactgtactccataagtgtagctacagtacaaccgattgatacaccaaggaggtgtcctttttctgattattaaggtacacattgttttcagatgtataaacaagccctaattatgtactctatccatacttgtaaaggaaatcgttttggacagtgacatggtctccaaaatacaactttgacttcttttttctataaaaaaatatttattgaaatgtgatatatgtatacttttattaaagtatttttcaagacaaatctatctatcttctattatatactaaaagtccattaaacttcctcaaaacgctctcaagtcgccacatggcgttctaataaattagagaaaatcctagaaattctgagaaaaaagcaaaacatctagcccttgattttcacttaaatttgtgggcctgttattttagaccatcagatcagatctattaaaaaaaactgaatatacaaacgtaacgggagatcagatcagatctacgtacgtactgatctatttcagactagcagaaaagtatgaacgtagtccttgtcaaaaaaaaaagaccgaatatacaaacaaacataatgtactaccggaaaaaataaagcccaaaaaacatagaagatatagataactattattattattagtgataataaacttcaaataattataatttttacaaagattatatattattatattattataattttcaccgccgcggatgacctcgcctccgccctcgtggctgcaagagccatgcctccaaccttgccgccacgggtgcccatgcctccgaccttgccaccatgggaatccacgccttcgacctccattgcggcttgctccggcggcctagctattgctgcgaccagtggtgtaggcggaagtttcttggggtagggaagaggctgagaagtggtggagagtgatgggaaaaaaagagaagaggggaggatggaggaagaagataaatctgacggatgggtcccatgtgcaaatggggaagatgatgtaaaacgtgacggcgattgcatggttccaattttgaaaatttcgagtaggcggaggtttcttggagtagggaagaggatgagaagtggtggagagtgatgggaaaaaaagataagaggggaggatggaggaagaatgtgaatctgacgtgtgggtcccccgtgcaaatggggaagaggatgtaaaacgtgatgtgtgggtcccccgtgcaaatggggaagaggatgtaaaacgtgacggtgattgcatggttccaattttgaaaaattttgagtggcacggctatgaatagacgaattgtaattgcatctatctgaacagacacatttacgaaaacacatatcaaattagcccttaaattaataataaagaatatttcttttcttaaatcggtggaccgttatatattattattttcaaataatgcactgtttaaaaagaaaagtttacaatattttatattttgaacccattaaataaacaatttacgatctatattgactaatttgtactgattcagtgaacccactattttagaataatttttaatgaaaatattttaccattgatttttatttaattagacaccgccagatctatcttttttttaaataataaagcctttgaagacctctctcggtccgtccgcactacgcaagcacacgccattgccttctacatgcacggcgaagtgtggtgcctgaggtagctaaagtggtctaccaaggtgatcacgactgccacaattcaaccgctttgctaaggtaaagacatatcaaatcattattgaatatgatcgggtctgttaataacatgaaaacaatttaaaggagtcagtaaagtatactaacatgcaatgagtagatagagaatataaacaaatagcttacaaacatatatgagtgattgcatgatgtgtcatatcgtgcaaagagttttaatagcgacaaagacatcaagaaaaaaggtgaatatgtgttaatttcaattgcaaaaaaacaaattaggcgaactattttttgttaattaagtagtcattaccctttttactaagtttcattagtactgatgatgtaaatcatatttaacttattaattataatcgaattacatgtaaaaatataatttactgcaaaacacttcaaaatttataaatgcactatacatactaattacatttgtataattcaggtcctattttaaacaaataagttccttcaaaccctgtagatatgtttgacctttagttttcagttagtttaggagtcttaatttctgaacaaactatatataatcttataatccaacaatacggatgcccgcgcatatgcgccggccaccttcctaggtcatataatttttatattttcaacctcaacaatttgagagttatttatgatttatattcctaaggtattaatggttttttttatgctcacacttaatctttattatgcaacataactcgatccaaggcctatggattattggctctctaattcttttcacatgaaacatatgatgattgcttcagcgaaacgcaagtctctcatcccatccaaatccaacatccagaaaagtccccggccggaggccgtctatagaaacgcgcgtcgatcgatccgtccgtccgacgaccccgcccgcattaaaaagggccgcgagacgcccgcgatggacggggactccaccgcagtttgttccccccaccactcctccgcgcggcctgcacgtacgcgtcgatccccgccgtcgacgcgagatccgacggccggcgcgcgtacgaaacacgcacgacgaccgccgggccgtcaggcttggccgtggcccacactactactagtacgcgcccgcgagtgtacggtgcacgtatatatgcgtacggcgctcgagtcctcggattggtctcaattacgagtaatgtcgatgatatagtcggtatattaattaagttggagacgggacagacgggccagttttctccgtatatatgggcacaccggcgcagcagccagcaggatatatcagcctcatcgtttcggtatacttgcaaacagaaaaaaaattgtggttaaaatttttatatatgtgttgctagtgatcttaaaagtaaaggctaaaaaataaacttcgatgagaaaatcttaaaatcaactcaaaatttaagattgaaaatttaaattttcactgataagcataggcgatgagatgagcagtatatctagctgcgcatcaaacagtaccctgctcggccccatcgagttaagcaatggcaggattgcaaaatggaaagttttttttttgccacgactataaatccatccgttttaaaatagaatcactttttagagttcttaatatgtgaaaatcagatgcaagcaagaacatgcacacacgcaacttcacattcacaaacacacgtgcacatcctaagggcctctttgaatcgtaggaatgaataaatggaggaataagaaaaacataggattctaataggaatataaatgtaaaacagaggattgcaaaacacatgaaaaacacaggaatgaccgtttgattgaaccacaggaaaaacataggaatcggatgagagagatagactcaaaggaaagtttgagctcttactaaatttcctccaaaatttctatagtattgtccattccataggaattttaaaggatatggtaggattcaatcctttgtttcaaatggcttcatagaaaattttactataggattcaaatcctccaaaattcctatgtttttcctttaaatcaaaggggccctaaacgtatacttatatactactccctccgtcccataatataagagattttgagtttttgtttgcactgtttgaccatttgtcttattaaaaaagtttagaattattatttattttctttgtgacttactttattatccaaaatactttaagcacaacttttcattttttatatttgcacaaattttttaaataagacgagtggtcaaacattgtaataaaaactcaaaatcccttatattatgggacggagggagtagtacttttgtggataaagattgatgtgtttagatccctgctaaaaaattttcaccctgtcacatcgaatgcttgacatatgcatggagtattaaatatcaacaaaaaataactaattacacagattgcctgtaaattgcgatacaaatcttttaagactaattgcaccatgatttgacaatgttgtgctacattaaacattttctaatgacggattaattaggcttaataaattcgtctcgcagtttacaggagaaatcagtaatttgtttggttattagtctatgtttaatactttaaatgtgtgttcgtatatccgatgtgacacgccaaaactttacacccatggatctaaacacccgtagaggccacaaaacctcagtgcaccctggtgaggcaatgcaacgtatgtcctgcaggatcgaacgcacaccagttaattctcatcgccgatgaacagggtttaccttttcgatttcgaagtagaaaccgctcctcactggtttatcgaaatccgaccaaaaaccggtaaaaacgatgaattcatgtcaacatcgtacgaaaaccggctaataccaatagcgatttcacaaaaactgaccggttttcatgaaattccagcgcagtcctcattcaggaacaaatcttgagtggtagtttttgctctttttgaaacagaggaagttttggctcagtgctctcattcaagacatagctaatgaaaaaaaactgaaagctctaaataaatattaaaatcaaatactaaattaggggtgaaaacggatcgaatattatccgctccgaatctgtcagaaacaaggatatattacgtgcttttagaaatccagcggatagtacaatggggattcatatgcggatatggtatctctaaaattcggcggatgcaaattatctaatatttttgccagattatcggatagaccgtttgtcggataatccaaaattatcaacccatataaccactctatctattttgtataacatgagctgacccatctaatggcctaattcatcaattaacctagatttctttgtcctcaacgtctatctcacacttgattagctgtatttttatattattgatatcatgcatttatgttttttaatacataaatacataattattacgatgggtcgttcattgattattgcattgtagatccttgtgttactaactcgatggtgtattggttgcatacacaataacatccgataaatttaatttattttcgaactaggtctgcactagatatgatataacccctgtccgtccgaatctgctccgtattcacccctaactaaaatcgagaattgtctccagttttaataacaagcgaaattacaagacgtatgacccggttatccctgtataggtgcaggacagtgtgacgtgtgcagcatacacgttcgatcgattaactggacgctcgtgcaggcagtactactaccaccgtccccaaataaatttatttatcacatatcacacacacatatcaatagaaaagaaaaaaaaaagctagaatatctctactttatcaaatcccaatacaactttaatcagtttatctactttcatccaattattctctacttttataaatttcgatgcaatgattactttaataatgaacttattttggaataaatggaggaagctaaaaatgaactttatcgacgagggatacccgtagaccggatatagagggtattggggtccgttggtacgagaatctacgtaatacaacatcaagcaaacaaaagacaaggattatactggctcaggccccttgataataatagccctaatccagttggtatgggattatatgaagaaaatcacagattataaagggaataacaaaactcgatgatactgacgagaccgtagtcgagttggtccgactagatctcccggcgacttggctcctgtaggctccgtaggctgtggtgggtatgttggcagtgatattcgatgctttaggtcctgcccagggggtcccttatataccgcaggtcagttgatctccaagtaggactcggagatatcggacccttcacgatatgtaaaaaacccagtcttgtccgagtagaactccttccatccgtaaataccatccctatcacgtgatagatatctttaatgtatacggggactacccgtatacgcgtgggtataccgtatcagtattgtcgaggagtgatcctctctagcgggacatcgtgagacccccctttcgtgagttcggctgggggaaaaagctcgcctctagaaatcacgcattcgttcccaaggctcctagctagctcgaacacaaccaaattatacaggttcggaccgctatagagcgtaataccctactcctgtgtatgggatttagactgagagttacaagagttcctagactcgggagaacactcttacttccctcctccacgagctcaggttttctgagagtcgtcctgttcctcggtgggcaaggtcctccttttatacctcaaggggataccacatgcaccgcatctacctactcttcttttgggtggggacccaccctatcttgaccaaaacttggcccgcgccttcgcctggaagctaaaccacagcttgtccttgagcgaggcccagcgccgtccctcgcctgacacgggggatagccctgtcattccctcattaatgggtgaatacttgcaatggccgccatccgaatgaccctccgatgggacgggtcatacctacctccactccgccggaagcagatgcaacgtgggagcacggttgtccgtccagtcagacgtgaccggcatcaggccagtcacagaccggtcattcttgaccatcacgcgtcagtttagcacgctgcacgtctgccctactgtattaaatgcgacagggggcagttggggcgctgcgcacattaaaggaggtttagccagggcccccctcctcgcttgctctccccgccaaatggtggctgggcgagggcctcggggcaaagcggcgcaagggcccgaggggcatgacgtggcaccccgaggctccgaccccccggccgctcctacggttcgcggaatgcgggggcaggaccaggctgtagtgacacatggcaggatgggaatgtagattcccctcacttcgcatacccccgggcccatatctctgacaagtatacaatttacatccaatgatagagggtataccttatccgtaaccctgacaaatttaatatgtaactaaggaagtaatattgtaacaagtacctgtaaataccgtcctataagtgaaaaaaaataagctagtacggagtaagagagttaatgagaggatagaaaaaaatacgaagaaatatttcacatgtaagaaaccacttttttatatatgtggtgtctatgtaacatagcgaatatgaataagtatttgggttgggatttccattagcatatacggtcctccatggattaatatagcttgctagcagttgtggtgcatgcgtgcatgacgtcatgctttgccacttgccagttagcacatgctaaaattccacgtgcggctaaacctgcgttgattctaacaacgttactactccatcaaacacaacagctgttttattttattttttttaacagacagctgtttttcttttgtttctttgaacgagatttttctttttcaattggggcgttgtcaatcgttatggtcggcaagccgtaacaataataacgctgacgataataagggaaaagtccgtgcaaatgtttgatttcaacacattcccggttactcgggtaggtgtgtgatatatgtcatatgtggatactactccctccattcaaaaatatttgacgctgttggcttttctaaacatatttgaccgttcatcttatttaaaaaatttaagtaattattaattctttttctatcatttgatttattgttaaatatacttttatattttatatatttcacaaaaggttttgaataagacgaatggtcaaacatgtttaaaaaagtcaatggcgtcaaacatttagggaaggagagagtattaaattatgaaagttgacacatatagtgtcacaactcagaaactaaccttcctaccacgaagttgtcactgatccaatctttgacctaattaatttgtcgacacaaaatagatactccctcctctgtatgacgcgttggctcatatataacgtatgacgagtacatttagctacttttccaaataaaaaaagaaaaataataaatccaaatttccccaaaaatttaaaaagttttcaaagttttattttctaatttttcaaactatacattatgcactccaaatctgccatcatcctaagaatattgctaccatacattatattctttgttcactccatgtgaagtaattttccgtattccttcgatcatccatttaatcccaaagcacctctcgtagtaataagttcttttatcggaattgttaaatgtcattcgacatattattggggttaaaatcttacagatttctaaccttaggatttgcatcgattcgtgctctgacgatcccagctcttctcctctagttcctgcgacaccttctcgttgccatcagaggaagacaatgcaagggcatctcattgctgccggcttgagggaaatgagagggtggaagggggtgaggggagggggaggaggccgcccgggggcatgggctcactggtgcgacaccttctcgttgccatcggaggaaaacaatgcaagggcctctcattgctgccggcttgaggaaaatgagagggtggaagggggtgaggggagggggaggaggccgcctgggggcatgggctcactgatgcgattgatgccttccagcagctaatgtggctaggcagcggcaatgacggggggagtcgagcgaacgagcgcttgatctactcagtcccatggcggctatgagtaaggagggaggagaggaagggaggagatatgattaagattgttgcatgaatcttgaagcagtcatactgtcgaagaaacaagaactagggtcccaattcccctagggcatcaggggacaacgatacatatcaagacgtacaagatctacatcttcaaggtatagtggcaggtgtgttcaagcaagggcctcatttccaagtcgtgcaaccatgaactccttcatcctcgacatcttcgagaagctcgtcctactccgaagaacagttcatgcctagtagtagggtggcctaagttcctagggtgccctagggatgtagggtgccccagatacgacggccgtccaaaaacgaagcccaatatctttgggtcccggagaggggcctaagtgcacttcatgccccgagcgagggccaaaatgcgttccatgcgctctcacttacgtttgtagtcacgtcaaggaaaagttatcgggctagggagttgctcaaccgctcccccatattaatagtgatatggtgcatgccttccatccatctcgtcgataacatggggagtgtgggggtacccatgcgagacgtcacctagatgggcctacggacaataaggacgggtgcatcttttttttactatcggcatgctcgctccatcaatcaacaagggaaacattgatccccgtctggatcaaaagacaatgattagaccaagcatgattcatttagtggtgtaggacccacttccacatcaatgtaatggcactgtggacttcccttaaactatataaagaggatccatgccaatggatagagggttttgattctagcaaactagcatacatccttaggctttcagttcccctcagttcctcaccatgtaaaccaatttcatcatccacacatagttcgtagataggagtagagtattacgcatcgatgcggtttgaacctgcataatcccatgtgttcatctttcgctcacggttagggcccgaactcaaaacttgcccctagtcgaatctcctaggggtagcacacacttacccgttagaggatttccacgctccgacatgtatggttcacaattcacatgattttatagggtatttttctgtcaaatactaatccatctgtttcatattataagtcgctttgattatttaaaagtcaaacttcttgaagtttgaccaagtttatagaaagtatagcaatatttatagaactaaattagttttattaaatctaacattgaatatactttgatagtttctttgttttacgtttaaaataggaaaaagtatgaattaccgccctgatctatcgtggtcgaccaaaattccctcatggaccacaaaaaccgaacattttaaaccctaaactatttataatagatgaataaccgcctagcggttttagtcctacattgccacacacgtggcacaagccccagatgtcaacctccacctcgttctccctctcttatgaagctagagggcccccacatgtaagctgctctctcctcttccattgtctacaggccacagctacagatgtctgcaccgcggtcctaggtcctgctgctgccctagggtcccgtcaactcctcgaggcacctgcgtcgccgccccatggtcccactgccgccactaggcactcacatcgtcgccctcatctcgaaccccgccttcttcagccggtcgtcactgccgttgcccccatccaaccgatgaagagagagggagaggggagagagagagagagagagagagaggaaaagagatgacaagcagcaccctccagggcaggtgggaaaagcggcgatggccgcggcagcctccaagactagcggggaaagcggcgacggctatggtggcggcatcggtgaaggtggcgccgtccagacaagttagaggaagaggaggatgtcaggagagtggaggtggtagcggcaagagagggaaaacgacaggcggctcctgcaaggcaggattcgacgaggcaagcgccatccgctgcggcccctcttccactcttcccccctgaagttatgtggacactggcgaggcgagccacgccaccgccatcccagtcgcgcccgttgctgctagccgccgactaaagcttcctctccgccgctcccatcgtcgcctggagcgcactcctagtcgtggcccctccccatcgctgcctagagccacccaaacatgcttgtcgccactcgccgccgatcaattcccactccccgctgcctgcagtgcactcctagccacgccccttcctcgctgctcccgctgctgaccagagctacccagtcacgccccgccgcccccactacaacaaaaggaatgtattaagacgcttggccgaagacgagattataatcgtcccaccctgaaaataaaggcgctccctgaccggttcccttcccattgtgcctaccgccagccggagccgcacccgcgcgtcgctcacctccaacaccaacagcacacaaagagagaaggggttaatatgacatgtgggccctatattttttattttattttttttttgctgattggatttccatatcggcgccacgtgtatgccatgtaggaccaaaacagctccagattaagtcggggggggggtaattcatccggtttcaatagtgtgtggtttaatatgtttgttggaggactgagaggcccctccttcttcagttcggccgggggcagcgggtgtagtttgaggaagcgagtatgctacaaagaaacgaggaggggggtcggggccgtgtccaagcggcgagacggcaaggattagacaggtttgggccgctgagaagcgtaacaccctactcctgtatatgatgatttttctgagctttggaagtctctgaatctctggtgtacaagctagggttgagtgtttttactccgactttggggaggatccctgtgattcttcatttaatggatgaagattggaggcttgcatgcactgggaacgtcatcccaggcattgcacctctcgtcaccttgatgggacagggcataccaaccgcgcgtggcttgccgctgtcccatctcgtccttgcaaggcacgctcgctccgcccacattgaatgcggttaggtgggcgcggaagggtgcctactaatcgcctttgcatggcggccacgtggtgaccaccccgaggggtcgaggcggcccgaccctctgggtcaggtatgggcggcctccactcgtccatggacgcgacccctcggggcgaacgccacgtggatgccgagggcggcacctcccctttaagcacggtacttctggtacccccaatccttatcatcgacaatattaattcgtactatcgcaatagttggagggtaattcatattttttctaaaagatattgctatattcttctataaacttagttaaagcttaaaaaaatttgactaaaaagttaaaacggtttataatatgaaataggggtagaataacattttttaacctaaaaccaccttaatagtttaactctttatattttttcacatggttagtatatatcgtagagcccactcataatttaccaatcccaaagaagatacctcgggcatgggtccctggaaatccccaacaaaagggccagtacgtgcgtgaatctggtagagtatggtaggagtactctatactcctactccgggtcatctacgccacctcccacatgcacacggattacataagcctcacgccccctcctctccattactccaaatcccctctgattagaaagagagagtgaaagcgagccatagatagatgctacgcgtagcgctagggagtagtagtagcagcagcagtcagcagtgcagtggagtacggtagtatagggagggctggtccaccgtcgcagtccgtcacacaccgggaggccttgccatcaatgcggaggggtcgggccgcattgattgcacatcttgtcctcatgccttgcctttccaacaccttaattaatggcgcccatgcgtgcctccaaaacctcccctgtttcccttccccctctccctctcccttgctctctcttctttaacctgtttatatttatctccccctctccgtctcgccgtctctcagctctctctgctactcctcctagctgcatgctaagctaaatcttctgttggattgcctagctttgctgctttgcttgcttgctgtggtgtggtgtggtgtgaattttgttgattggtcggagcttggggttgtgtatggtggtggtggtgtggtagctagtagctgctagtgctagatggtcgcaggggcgttggggtacatggcgagagcggcggacggcggcagggcggcggagctcgtcaccagggatttcctcggcggctgcgtcgccgccgacgacgccagggacgccgccgccgccgcagcagcaactgccaggcacgactccgtggtaaggccgtgttcttgacatatctctttcttcttcgctgttcaattgatgcttgattggctagtttggcttgtttagttgggtaattagagcgggagttaatgatcacaacctgctcagagtagtgatttatggccgtactgcgtgtttggtggaacagcaccgcagagtaacacaaaggggaggaattaattcgatccaagattttttctcttttcaaatttggtctctttttttaatggatagacaggtagataatcctaatctaagaaacttcgagcaagccattttaaatactagcaggagtatgttcattactaaattactttgctttgtcagaatatctactggccgattactcaatatgcgtaagagttggtacagtcaattcttttttttttctgtggccagtttatcttcctctgccgtgttatcttggcaacaagaattcttctcgtaattccaatggaaagaatgaaagcaaatattggtctcaattcattatttttatatgtaaccttgaaaaattcacagttttttttatccaaaattggtttatctttctcctctgatccgatttctaccttgatctgcttgtgtttgtgcagtccggcaagctgtccctgcagaagcagacgtgcccggcgacgccgacagacctcaacctcttccccgtccccggcgccgccgcgtccgccgccaagccgtgcccgtcgtctacggcggcggcggcctccggcgcaggcggcaccacgacgacgacgacgacgtaccacagcgtgtgcacgatcgagaaggtgaagacggcgctggagcggttcgagcgcggcaagcaccagcaccaccagcaccagcagcacagcgccggcgcgtccccgtcgtcgtcgtccgtcaccacctcctccgtgaagcgccgtggcggcggcggcgtcggcgacggcgcggtggagcagggcgacgggtgcgactcgccgtccgcggcgggcggcggcggcatggtggccgccgcgtgcccgaggtgcttcctgtacgtgctcatctcccggtcggacccgcggtgcccgcggtgcgagtcgcacgtgccgccgccgccgtcgccggcgccgaagaagaagccccggatcgacctcaacgtggggttcctcggcacctagctttcctaccctaccttcacctgcatcgccacggtggacacatgtgactagccatagctagctagccagccatgcccccaattctgttaggaaatcaatgaatcaatcaatcaaacacgtactccatagaacacgaggatgatcatgacgatgatgatgatgatactagtagtcctagctccactatgtaattgatcaaaaagcattttcgcccttaaatcaacttttccatttttgtcttcctcgaccaccatcctaatcatcatctcattagagcaattaatcaccagattagtagtagtgatctcatagtacagcagtagcagtactacatctgctcattaattgctcgacgtagtcgcagcagaaggtgcagttactacgattgctgcgcaaagtcgtgagttcgtgacgcgagttttaattagggatgtagcagtgcgtatcacgtttcgtctcgcgttcgtcgttgatgatgggggaggagttggtccagttggagttgacgtcgcagctgcagctttgatgaggtgcagtgcttggccgacatgaatggggggaagcaattaatggggcgcgatggagatggttgtccgtgccccgctgtcctcttgctcgctcggtcggggagggagggagggagggcagcctttgctaattgcgatggctgatgcccatcttgatgctgggcgcgagcgcgcggtggagtaggagtgagagtacacgtagtacggccatagcacagcgacgtttaaatggcgtgcagtgccgtgccgcgccgcgccgcaggctacatgccactccggaccgcgtcgtagttgcagtcgcgtcacgtacagtagtatcgtccctcgtatccgcctcgtcatttcgtgtctccggtctccccgatgattggacggacggactgctccccctgccgtacggagtactcccttcgtcaaaagaaaaaaaaaatcaacctgaaaataaatactccctctgtcaatataagaagtttcagttttggacatggttattaagaaagtagatataagtgagtggtggaggtttataattgaattagtagtagaggtaggtgggagaagtgaatggtgcaggtttgtgattggttgtgaagaaaatgtgggtggagaagttgttatattttagaacaaatcctaaagttgttatattttgggacggagggagtacttccttcgtctcattttaaatacaaccataagattccgcattcaactttgatcgtccgtattatttaaaacttttttataattagttttttattgttatgagatgataaaacatgaatattactttactcatgactcatgtttttaattttttttaaataagacggacgatcaaagttggacgcgaaaaaccatggctgcatttaaaatgggacggagagagtattcctataacaaatttagacaatctttccagatttgttagaatataaaatgtcattttcctatattgcttttttttttgacagagggagtactccctacatcctaaaacaagtataaccctgtaatttaaatttgaattacatgactacacttattttgaaatagatggagtagtttacactggagaatatccttagaataacttattttagaaatataaaatgaaccattttcatgatgtcaacgtttttaactaatgttggtgctgttgttcaacggttatttgacatcaatgttattgacatcggggaatctatttataaatatattttgttgcaaatttatagatccttttctttagcaaatatattctcgaggccaacataattgccgctgactcccttcttattattgagttagttttcgtggaaaggttaggggacatcgtcagacgctattatgttgaaccccaacatcaatgatgtcggcgccataaaaaagatctattccttaaataagtttttgaaaagatcaatttataaaataagtttttaaaaaagttttaaaatgtggaaaatccagcttgtttcacggcgcacactgagttacagtactaactactactacttcgtagtatacggttatatactgctcttgtgccgtggtacaacgtttcaaattcatcaaatccacggcgctgcacgcacgcacgtacgacgacggttacacattgtttccggtgactgcagcgacagtagttccgtgcgctgttgctacagggatgacacgatttaattaccctgcctcaacacccgctccggtctaccgtgtggacgagatggcgttcatttactgtagcagttttatctggagggttgattcacttgattgtactactcctagatcagatgatgagatcctgcgtaatggcaattactgtgtgcccctgtgctgtggaaactgttcatcatttactccttgagtggccgaccagcctagatgcaaacttataacaagggtaaactgcattagaatagaaagtcaagctattgaaaaacacaaaggctcaagtaattcatgctccactattctacagcgcggagaatttgacgataaattttctcaaaaaaaaattaacatatgtaaatataatgcaatcataatataattataatacaacttgaatgtagctttcaaaaatcttgcgataacatgctattttcgtgaagcggcagcaattcatgctccgctactctacagcggtgcggcattagagtaactccaatagaatggccaaatggctggccaagttaaattttagtaagtatggaaaaaaaaaaagccctccaacagcctctctatcctattagctaagctatccagatggccaaatcttatccctcactggccaaacttggagagtcaccctgcctggcaattcgtgggccccaccactccctctcccaccccatctctctctcccccggcaagaaggcagtgcagcagaaccgcacgacggcgacagtagggaggagagaggcgccggagccagccgccgtccgcactgtccccagccgcgcccaccgctgtccgcgctgtcctcggccgcacgcacctccgccgccgtcagcgtcgtccgcaccgtcgtcggaagtgctaacaggaagagatagagggtgagaaagagggggagaaagatgggaaagaatgggtatagatgctgacgcatggatcgcaatgtcatagactcaaaatagagaggacggatggagaggctgttggagtaaacaaccattttgacttgacaaatgaaatggagagacttttgaagatgctcttagcggagtactcctacagccatgaactgatctcagctgtagattttccatccgacgcagtatcgactacagaggatccgtccgtgtccctgaacttcaggttggggcggacttgtcttggactgtcaggcccatttcgaccggatatctgggccgaaaaatttactggtctggattttgacaattctatgcggaataagttcaccggaggcccctcaacttaacagcgagaatttttgagatcacacaaactagaaatgtgtacccctaaactcacacaaactgttcaaaggaggtcccatggcagtatctgtggatggtttcgctgacatggtatcctagtcagaaattttttttaaaaaagtatgtggggtacacatgtcagtagcacatattttttttcttttcttttattttcatcaccttctcttctctttctcttcttcttcttcagtggatgaggccggcggcgattggcgagcggcgggtgagcgttgcggcgggtccgcgggcagccgagcagcaccgggtggc

SEQ ID NO: 81663 - DNA, 7958 bp, Oryza sativa
tttttttctagcgtcattagacatagcctttttcatttagaaactaagaaaggacgacagcagtcggaactcggaacttttcccgagattttctcgctaagttcgcgaactagacttccccgcggagatgaaggggacgaggtcgggagagaggaagcgaacggtggactgaccgagaaagtgggcgaggccctcgagcccctccgggtcgctgaacgagcccacgccgacctccatacacgccgccgcctgcaacgccgaggaattaggggttagttaaacacacacgcacgcatacgcaccacaccaccaaatcacgcgagagtcgccgatgaaccgacgagcattctgcaggcgagagcgatcggggagggagatcgagaccttgtcggtgtcggagtcgctgatgaggaggcactcgagcgcattggggagcaccacccggcggtactcccgcttgtcgctgcgcgagcggatgaactccacattgctcgccgccgccgccgccgacatcgccgcttgttctccgcctccgctctcgcttctgctctcctcaccaccaccacgcggtcgtccaatctcagaggaatcgtggaggtttggtatcgtttggaaaattttcctatatatgacctcatttggatcaaaggaaagagcatctcaaattcctaattagggaaaggggagaaatcctatactttcaaaaggaaagcaaatgaaagaggtttcctcctaagggcgcaaatgatctccctccaaacggcagttatggccttcttgctgctaaaagaacacagggatacgaaaaaatgcaggaatatgatgaaaaatggaggattaggaaacagaggaattttataggattggatattcggaacacagaaatagaaagtggagaattcaaacaccctatagcagccaatgatgagacacaaacaaaaaggttggaggggatgtttggaatcctttgaaattcctgtgttcactggaatgctacagtattccttcaaaatcccttcggacttcggttaatcactgtgagtgagggattggaggggatttattccacacctattttggtatggattgattcctacgatgcaaacaagtgaacagtagcaaatccaaaaagaatcatcaatcctacaaaaaaaaatcctatgtaaaccctttcatccgaacaggccctaagaaagtcgtcgccggagctcgtgctgccaccgggatccgcagcgcacgcccgccgcaacttcagctctcgccggcagagctcgcgccacgtcgggaatcaacgcaggccaccacacgagctcctcgcaggctcacactacagccgccgccgccgccgccgccgaaggtcctgccgcttgagctcccgcacgagccatggtccgtggagttgtgtgcgagtcgagatcaccagtgactgagatgaaaggttacaggataatgctatgtaaatgaagatattagttgctagagtaaaggttaattaattagaattcctcctatccgtccaaacaccagggtcatgtatatatatcacatgttttttaatcatattctaacgttttgtattcatgtgttttattttaattagaattcctcctatccgtccaaacaccagggtcatgtatatatatcacatgttttttaatcatattctaacgttttgtattcatgtgttttattttctactccctccgtctcaaaatataagcatttttatacttcgacagtcttcgatatgctactttgaccaacgatataagtaagatgtttcaaataaaaagagttgcgctagtttgttcaatgataaacctagtaacattaattttaattttatatgattgatcttttttatttttgttctattaatagtcaaagttataaatatttgacttggcactataataaaaatgattatattttggaatggggggagtagcgttctgagctagaaaatagacaatatgttacttcatttgtatggtttcgataaaatatcactcaccgtaatacattggataaaatgagactaattgtctttagttaattagcatgtgacccatgcagatttgtgtggctagtatttttatattttctcacataatggcacatatattttcacattttattttaaaactagcaaaaatactcgtgtgttgcaatgcgatgtaaatgtttggagctgaaaaagaaaatattgtcgaaatggaaaaagtccaaatgccccccccccctaactttggatgaaatccatctagcaccctgaattctaaaaccggacatttaaccctctaaactttgtaaaatcagtcatattaccatctaagatggttttggatggtggttttgcatattttaaaagcttaaacgaacaactttaaataactaatataacgtatttacgtatcattagtggtaagtcatcaatttatacttatgcggtaatatcatactattattatgttggtacttgtttgtaagtgagagctaacaagtggtaaaaataaagatttaagtggagattttaatacatatattcagtgtgtatgtcatgtgatcaaactcatctaatttatatacaaattagataaaaaaaccattatacaaaaccaccttagggaataatatgatggttttgcaaagtttagggagggtggatgtccgattggtgctagacggatttctatgtaaagtgtatggggtatttggactttttccttttctaaataagccaattgatactcaaattggagcattatttaaattaaataagttatgggctattttttcaagaaaaacatttcaacttaaatatttaaggtttagtttgatttagattattaccgtggagtgcttacttcgtccctatattttagaacatagagtggctaattaatggtagagataaattaaatatttaaatgaatagcaaaataacatgtgttgcaacgaaggaaggcaggtttaattatgtatgcgtactatatacttcataatatcaaataggaagccccaatggttgcctgtgatcaattagttgatatatgttctgcttttagccgattcatatattgctttatatatttctcttgtgacaagtggatgtatgattgtttgtgaggagaggtaaggagaaaatcaagaagataggtaagactaggcgagccattagtacataattaattgagtattaattattttaaattttaaaaaatgaatttgtatggtttttagagtagcttttatatataaatttttacaaaagacaaatcgtttagtagttcggacaacgtacacgtggaaaatgaggtaaatcttctctcaatcttcaagtgaagaacacgggggatgaaaaagttttaaactacttttattcagactctctacaattatgcgataagttaatttatgtattcaattttaaacatccgcagtgaaacagtgcttaaatattgctgctgagaattatctgatcaaagcaatttataactgtaaaatacttgtgggaaagaagaaagatatccagaagctcatgcaaaatgtgagagggacaatgcatagaacccgactttatctgcactttgctctgaggattgttctctgaaaccaaaaaccactggtgcaaaatagtagtactactcaaccagccaaacctttaccaaagtgaaaagtcaccatgacgttcgcctgttcttgcagcagtgcacgtacccctgctctgagcgcatcaggctcctctaccttcaaaggtgtgagcctttctcactaacatgtaggcccatatgggcccgatgaaccccaggtccacctgttagtgacaaaggtatggtgtctttgaaagcagatgatcttaatccgctctgaacacgcgctcggctggttggcctgcgaaagacatgcttctcttatctcccttttctctgatcgttgtcgctgactctcttaggtctcaacctaggtaggagtctagaagaggagacacggactcatattggaggccgggggctgctgttgtcgtgtggacagcgaatcgccaaattcaggtggcgaccgacgttcgagttgtgttgtcccagaggaatttagattgagtgatttgagtcgaacacgtcgtgcgtgagggactgtagtgttggaacaaaaattaggatgaagaacacaacgtgacacatacggatgaaggcgacggaggaaactcctggtagaaacaagtgggtccaaagatgcaggcgcagcggtaacgcggaaaaggacaacttaccagagccatggtaaaagatggctgctacagtacgagatataccgttagaatgatacactttaataaacctttatcttttctctatctacctgagtaaccacacataaaataaaacgaagcagcagcgctcccccttgctccctcgctcatccacatcaattgcaaggaagggtggaggcatcagaagaggaagggtgaagaagagccaatggcaggtccatcaccaggcgaccaaaaagcaatgacatgtgtcccctctctcctcgacttgataccaagtatctgggcaatgacatgtgtcccctctcttcttgacttgataccaagtacctggacgtactagaccttggtatcgagtgtctggtaccaccatggtacccaagtatcaagcatgatacttataggtatcacctatgatatcgctaggtatcatgatactactggagtatcactgggatattcaaaaggatatccatgtatcaagagaaaactcaagacaaatcaacataaagtaatttcaattctaaaaaatcatatgtttatcaagagagggctcaataaaaaccaataagggaaatcgattccagaaaaaagtcatcataactatagaaacacccataaaatatgtagaaaaccccacatcaaaccctaaaacaagccaatgcaggagcttgagggtcacgagcccagatcttggtctaaagatctgcaccacaaagaggccttgtccttgatgatggtgacctcgtcgacgatggcgacatcttggaacgtggtgagcaactccacctccgtcatgtgctcgggcacctaccccactaacagcttcgcgatctcctcctctaatccgttcacacctccaccagcagcaacaacggcgatggagacggtagcttcctcgacgcccgacgcgccaccccgcacggccagctgccatcgtggcctccgtgctcatgagggtgttagtcagagagagtggaggggaaggggaagagataaaggagaggataagattgaataggtggtgtgaggagtgagggcaagatatttactagtagtagttatcccatgtctatgggacttcgttccctagattttctgatggtaaaaacatcttcaatttttataatagcagaggatagagatatattaagggaaaaaaatatgaattatccccctgaactattacggtcgattgaattacccccccaaaaaaaactcaaataccatacgttttataccctcaattattcaaaccagataaataacccccctgagcactattttaggttgttttgacctaagcttgcacatgtgacgccaatgtggcaatccagtcagcaaagaaaatagaaaaaaagcatgggcccacatgtaatctcccccagtcaagccatccctcccttgctctatctctctctgcagtctacacctaaggcaggagaatacgagaaggcggctgaggaggggcttggagcgatggctccagatccacctccagctgtggacgcagtggcggcagaggaaaaatcgcgtggcgccgtcccagcggatttggcagtgagctcagggagccatagtgatgtcggcttcgtcatcgtcgtcgcccttggagacgtacctgcgtggcgccccaccgacgcatgtggggatgacgtcaaaggcgggaagcgaggtggtggcggcggcgcaggggcgtggggaggggggcgtggagacgccgttactgctggcgaacatcctcgattggtcgaagatccttggcatggagtatgacggcaggggagcacgggcgcggacgcggcgcggtgactgttggatgagcgcggcgacgaggagttccgctggggtaggggctaggtcccgcacacgagctcctcctttgccgggagcgcatcgacgcatccttctccgcccgcaagggcgccggccgcacgctcaagggccgtgacctctgccatatgcgcaacgccatctgggagaagaccggcttctaggactaatgcctctactccaccactgccgctgtcgtgatcctctccatcaaagaggacctagttgccgcagtcgccccagttgtgcccgccgctgcgcctggagctttggcccgcctccccagccactcgtgtgagcttcggcctctgccaccgctgccgcaaccttcgtgcgagcgcgagctccgactcagtcggctgcccccgctcgttgcaggctgcggcaaggggagggagtgcccggagcttcggcgcctaccgtcgggccagccaccctagccactcttgtgagtttcagctccgccaccgctgctgcaaccttcatgtgagcgcgagctccgactttgctggtcgccgccgctcgttgcagcaagggagggagaagagagagagagaggagggaggagagtcttaaaggtggggtccacaccattttttaaaaagaaattaactggactgtcacgtaggactaaaaccactctagattgagccgggggttatttgtccggtttgtatagttaaagggggtaattcaatgtaccatgatagttcatggggtaattcgtacttttttctatattaaaataacaacataattttaaattatgtacaaatgatcaaactaaccggtgtgtatctcctatgctcacgagatgaccaaaacacttctttgtttaaccaaaactgattgatcgatctcacctgcgcgttcgtgcaagtgcctcccaagagtttgttcgtcgccgccaaggagaaggcccgaaaggatgaccaaagtcctgctcggtcctccacgcgctcatcgagccattatcacctccgccaaggttcacaaaaccaatcggttttcgtgtaaaccggccggttttcgtgaaaccgctagttattggtttgtgggagttaatctgtagtagtctattttcgtatggcgttgacccaaagtcattggtctttactgatttttgctaaactagtgaggagcgtttttcacttcgaagacaaaaaggtaaaccctgacctccgctcttttatcggcaacaggcaaatcaacgaatgaggatatccagatagagcatgaaccatagtggcatagtgccaagatttgcactagcaagcctagaacagtaggtaccaggcaaacgaagcaatcggttagcgtccaggatcacctccagcctccaggtacggcgttctcctggagaccagaatggatgtgtacgaaagagatgataatattatagctgtttggttggaggtagtttttagaagggattggaagtttagaggaataaggttattaagtgttttgtttggttgagagacatgagaattttgttagaatggagatggtgaattgaggaaggaactccctccttttcaatatctgggtaggggcaggtaattgggagggaataccttctttactttatctaagcaaaatctcagccatccgtttttattaatgacctaatctccaactaaactccctatcaatttccatcacctctaccaaacaatatattgagattaaaaatcaaattctcattttagtcccatcatcaaattttttgtctaaactacaatctcattatatcgagttaccaaacaaaccgagaatatgagaagccgccgccgcaaagaagccacgagaccaaggatcggcgcgcactccaattattaatagacgattgcag

SEQ ID NO: 81664 - DNA, 15269 bp, Oryza sativa
cccagatgaaaaagtacggccgcaagctctttatgggcggccaaaattgtaattagccccttgccgccctctgtatgggcggcaagggcctaatcgcaattttgaccgacggcggcagacgacgcggtcgacccaccgtctgccacgtcagcttgccgcccaccattagggcggcaggggctatttctgtaatttttttggtcgatagattatttctgtaaatattaaaaaaaaaatctaaaaacgaaaaaaattcgatattttcatggaattgtaaataaagatgtccaagtcaagtcctgcataacgaaagctcagattcgttggaaacttcaccgagttaacaaaaactctgttatgctcgcagaactgcacaaagtgaaacgggggacgataattccagcgaaaacctctctcggtctctccccttatcgaggagagtagaagattacatgcgtgtactgtacaccatacaagctagtggcggttaaaaaaatcgattcgttggtattataatatatctatcagtgttatagtatgctgacggagcgtgaggctcctcaccgggagaccgcgcaggcccccctttgccgattcggccgggggcgctaagtgagattcttcgccctcgatctgaggaacgtcagcgagagaggaaatgcgcaagacacgggcgacgtagacaggttcgggccgctgagaagcgtaacaccctactcctgtgttctggtggatctgtgtgtgaaggaatacagagaggccgagagcgaaagagagttcaggctctagaaaccctttgccagagtcccaactcccctcctttcttctctcctctttcttttttcctaggcctgggcctcctttttatctggtcaggggtcaccacatgggcctctagctgcctaagaagggaaacatgctttttacaatgagggctagtctacagccggaagtgacctctgacaagcagagcgcacgtctcctgccccgctcgcccgcttttccggtggacgcccatttcaaccttcatttaatggccagcgacttccttgccatacttgcgttgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccagtcgcggaccggataagcgtgcgctgcgccgcattaaatgcggcgtggcgcgctcgtccaatcccgctataaatgcggttaggtgagccccgctgtgctcacctaacccacacgcgtggcgccaaaaccacagggggtcggggcgccccagccctcggggccgaaacgggagcggttcgacccctcggggagacagagggaggggtggccacgtcatcctcgggtccgacccccccgagggggtcaggccacgtgggtgaccgcggctacccaagcctctagtcacgataccctcggccccatgttaccgacatatgctaattataattagatcatgatgttataatatatggataaacaattttgttataggttttgccgaaaattatcggtgtcgtgataccggtccttctactgtgatccgcccctgatacaagcatacataggtgaatcgaggattccacgcgcgtggctgtgggagatgctttgactatgctcaccatgtcttctctcgatacggagaaaccagcaattttcctgtgtcggtgcatctttggctgtgtttagatctaaagtttggatccaaacttcagtccttttccatcatatcaaactgtcatacacatacaacttttcagtcacatcatcttcaatttcaaccaaaatctaaactttgcgctgaactaaacacaacatttaacatttattgcggacacttaacatatcgaacttatcgggaaatttggtgagtggcgactgattcggcccgcatcaacttcgacggcgatgttcttttttctttttccttctttacaaggttggcagccctgaaaagtattcgtgtccttgtgctttcgtcattaacgtcttcttcccctaggggagatggtttgttctggtcaggtcaacttccaaacctaaagggaaggggcatagcatatcactagtgtactcgtataactgtagtattatccagcaatctgttggtttcaagcttctagtaagaaacagtaacagaaaggggttcaaataggatcatcgcccggaaaagtcgttggtaacaaaaatcgtcctaaagatcatcaccacacagccaaatgccaatacactacacactccataaaactcttttgagtttcatagcactgctgcatctgacgcaggaaatttcgctacatatgcttcactgcatcatgtaacatgctgtcatgttaccgggacaccggcgcacctaccctccatactccatgacccatgtttcctcgtctttgacagtgcgagcctgcgtgatgtgcgaagtgtaaacactagacttttgcctctgcacggggtgctcctagtaaattcccggtcgccgtggcgtgaaatccgtgaggattctgagacaccaagcaacgctgcaaacggcctccaccgaatccgaaactcccccaacaacctaggaatcagaaccggcaacgtcaggtcgcacttcctatgcgcacttgcagccggcgcccagcaaaggggacgatgagaagacgagattttctttcacggttcaagctttcacaattttacttgttcacttcttcgtgattttactttggtcgtatgggaagtgaggcaaccattggccggatacttgggtggaatttacgaaacattactgttttctcttttgttttctgacggaaggcagtagtagagagttggagaattattatagaacagtggtcgatactgcttaactatggagtttcatgatctcacaatctcaacttttcttgtaactactttgtttgagaggccggagtgccggacacatatcctctcaagtctcaactaggcttaagcaagctttcataaaaccgttcaggctaagctatcaaggtttgccatttgccaacttgctactatacaatgtaaaaaacgaaaaacaaaatctatttgatctctttaaaatattgggacgtctagtcaaccatctcagactttaagggtgggaaatattttcttgggccgtgtttagttcacaccaaaactcccccaaactctcaactttccatcaaaactttcctatttacataaactcctaactttttttttccaaactaccaactttccccaaacttctccttaatttcagaaactaaacacagccctgatgtcacgtataacaagttttgattcaaatgaaagttttctaattaaggccttgtttagttcgcggaaagaaaatttttaggtatcacatcggatgtttgaccggatgtcggaaggggttttcggatacgaatgaaaaaactaatttcataactcgcctggaaaccacaagacgaatcttttgagcctaattaatctatcattagcacatgtgggctactgtagcacttatggctaatcatggactaattaggctcaaaagattcgtctcgcaatttacatgcaaactgtgcaattagtttttcattttatctatatttaatgatctgtacatgtatccaaatattcgatgtgacgtttttgggaaaaaaattaggaactaaacaatgcctaaattcgcatgagtccgggatagtagattgtaaaaaaaaaacccaaggctcatgagttactcgagctcaatttaagctcgcctcgagttctagttgagtagagctcgagcctatgccaaagctcacgagctttgtcaagctgagctcgagctcatgtcgagttttaccgttcatttaataaagtagtacatcatgtatgccatatatctgtatccatgcggtgaagtatcttgcgttggcacaatatatttatcttattatttttcatcaatcattagcatgattaaatataaataaattatttatttcaagagattatccttgaaatatactatgttgcgctacttataagccgactttgtaggaaagctcaagcttgaaccgagcatgtctaaaaactcgaaggttactcgggctcggtttgagcttgagcctagataggtaagcttgctcgagctcgacccgttgtcagcccaagttacaagcatacccttacacccaaatccataacatgactttcactgaagcaatgatatgcgcgtatcaatccgacaaacaccaaagacaacacacaaagggcccgtttcgtagagcttttaacttctattaactctaggagttggggtttggagcggagttgtggagcagcctaaacttagttccacatctctaaatcattttgtgagagtgctccacccagctatattcccattttaggtggagttgaaattgttcggctaagctccagctccagaataggtgaagctggagctgaagccgtgccaaactagcccaaaaccacaacgtcgcacaccaactttcgtgagagttttgcaggaaaatagtactaccttcgtttttttaatatgcaacactattgattttgaacacgcatttaacaatttatcttattgatgaaatatgagaaaaatacgtaattatcatttgttttatcgctagaagtactttagacatgatttatatagcttttgcttaattttttgaataaaatgaatgatcaaacgtgtttaaaaattaacggtgtaatcaacgcttctcctttttaccctaaaaaagtatctctttttcacgatttcaaccgtcagaaatgcgaaacccacagatttgcgggtgccttcggcaagaaggcgtttctcctcccgcacgggcccgtgtgcagcccgcacccgagattgggcggcccgctcccacccccgtccgtccgtccgtcggaagcccaagccaaccgcctcgcgactccaccgcgtctctgcacatgcccagcccccaccacgaaattacccaccccccatcgcgagagaaaaaaactactaaaaaaatatcgcgcataatcccaattcgactccgactcggccattccgtccccaaacccacgccgactcgctccgcttttttaaatcccccaacccggaacgaatttttccccttcgtttccaccaccaccccccaccaccacgacgcggatggcatcttcgtcgtcttcgtcctagcgcgcggcggccgccacgcgaccctgtttgagagggggaaaggggggttccgctcggctaggcggaggaaggacgcagccgcccctgtcccgcggcgaatttggatgatcgaggcccgccgtcgagggtaaggagtgatggaggaagcggcggcggcggcggcggatttcgatggcggcttcggcggcgccggggaggacaacctgtccatgcccctcggcgacttcatggccttcctcgataacgaggactggaaggagcagcagcacgaggtgcgttactactcgccgccttgccctaattcgatttacgcccgggtgtatttttttttcttctgtgtgcgtcggatccgattcggtgcgcggggttgttggggggctgggcttgcgtctgttctagggtttttgattgcatcggggccggatgcgtggatttctcgagaagtttctgccttcaattaagcgatttaggatgtttggaggctaggcactgtgttttcccccacgagtgttgtgtcttgtttaggcgcgaatgatacaagcgtgatcaagcttacatgcggttttggtccggctactcagtttgaacaggtattttttttgttgttgtttcggataagtggagctctgggtgcctgaagaagagctaaaatcaagtccgttatgcagtttcattaaatgttggttggtcaatgacaataatctgacgacagatcttcaacaatcatcggtcgctgaaatgacgcttgatgtacagaggctcggttgctggtttattgggtctcatgtttgattcactgcccttgccgtggtttatactatgagaaagtgtgttgatgatggcggctggaagcgagtttactggcagtcgtggcgttgggggttgtgatgtggtacatgtatgctgttttcagtggcgatgggctataaatggccatcaggctgttgggattggagaaggtcaaacaggaagcagcttggtagtgagttggaagtgtgtttgctgccaaatggatacaatgatatgtgggcttttcgtgttgtcttttctgctctcactgaacttcaggcccctgtacacatgttctgtatgtttaccggtgggcatagatatacatcatgcagctatgaggtatccttatggcctgttaagaacacaggagttcagtatatttttcacttgaaacagttcgatttcctcatgaattggaaaaattctagtgttgcaaacggccaccttttcccctgaatcctaacacatgtattttagcagtagaaaatattgaatttgttgtgagcatgcagatagctaatagtctgacctcacaatatttattatgatggtcgatcctggtaaatgctttgtttttatgtgtgcttgaatgcttttagttttgcatttgctatgcctcattactaaagagatgaatcgtaaaactgaagtcatttcattaatgaaatgggagagtagatcctttctttctcaaacaaagaaaactaaagagatgaatcaaactgattttatttactgtgttgtgattgttgtgaccttgaatactttgggtgagtgctggggaaatataaaatttcttgccgcgttcagttctgtggcaaaataattggctgataccataccaagtgaaattgaatcttcattttttgtgctttgtttgaggaagtgtttttttgggaggttttgtcttttaattgtattttcaagttgttggttgctaggtcttgtatttaccaaccttgggtagtaatgtactccctccgttccaaattagatgtcgttttgactttttgcttgcaacttttgaccatttcgtcttatttaaaacattagtgcaaatataggaaaggataagtcatatatttaaagtacttttgataacaaagcaagtcacaaacaaaataaataataattccatattcttttgaatagatgaatggtcaagcattacaaacaaaaactcaaaacgacaagtattttgggacggaggtagtacttgttatgctcggaatttgtcatatggtttgtggtcagtaaccagtaaaactctacatttagttccagcatatgccatcataggctgttaactatgtgtggctaactggatatgttcatagatgtccaagtttccttgagtacaataactgggattgcattttttttcgtgtagctgatgctaattcttgtgtttattgtaagataagtcagttccttgccaggaatatctacctacttagctttgttgcatctatatatcatgccccttgtttagtctattatcttgtgttcccttgacaaatgtgcatatttgtaactaaagagctattatgttgtttaatacagggcaatcaaggtttagagatgccagtggacagcacaagttctgaaaatgcatttcaaaaccatgaaggtaccagaagatgctcgttttattttggtttctgctagatacacacttttcttttccgtgtccatttttttaatttttaaattttattaaaatgagcagaaatttttgagaataaagaaaattggtcaaactactcgcatacagatccttcacatagtcagatggatgtaatggtggaacttaacaatggtggagaatcttttgatcactcagaggatacctcttatagattgcttagcaatggtgagaaacacaagaaaggcttcaatctggaaaaaaaacatttttattttattatgtattatatgattttaattttggttttgctccacagattttttggaaaattcaaggaatggtaatcctgagatgcatttaccaatggatgcattaaaccatgctaaaactgttgatgaagaaattgtccctccatatgaagattatacaaatggtttatactatggtcagcattctatgcactccgacaatacacaagttagagtagataacaactttgagggcttggagccacacactaatacttgtatggcggttccctgctttgtaatatacacatacgtgtgtgctttcttagcgttgtaatataaagaaggcactaattatttgatatctcctgcagattcgggatgtgatatgttcgcagagcaatctggtttaagtgaagttaaatgtgagggcacaggtcccatgcttggtaattctgagcaggagggtaaccatttcacgtcagtgcctatgtttgaccatagtgctgttatacctgatattccttacaccgagttgaacatcggtgatgtgcctggaagcatgcagaatggaaatggcagttgcctaactgtacaaggagaatatctgcagggggagtatcaggagtatcctcagccagattatggatcgtttgatatggctaatgaaatagtgctgcatgatttgccacaaaacaatcagtcatatgagctggaacaattaccacagaatatatgtgaaagcagttcaatgcaagtgggctctccagatcaatattgtgatgatacatctctgtcggattattacatggatgatgtatcttcgatagagtcgatgtccagcgagcagaaccgatcagaagatatctgtttccggagtgagtctagcactgactcttctccggtgccctcaagcagaaactccaccactgaggatgctgataaatactttggagatgcaccaaaacatttgcagaattccatgtttcctgtcagtacccaacaccaacactcattcatgaactcaagtgatccaatgcatccaacttttcataaaaagtatgacattcctagaaatggcagctcttctattctgggtaactcatcaaggaattgcttcagtttagatagcaatcgtgattctgatttatgtattcttgagggtagtagaagtcttgctagtggacatgtgttgccaccccaaggattgcagcataactttcaacaatctgtgtgtgccaatcctaatcttcctcggtttggagggagatacaggccgcatgaggaaagaatgactttgcggcttgcattacaggtaatttaccctttttactcttggcggcacttgctcattgaagtaccataaacaaacaaggtggttttttttaaaccttttttagtccctttttttgcctaacccaaaggaacaggcaactaaactgcttgaggtttgatttgttatcatgtttctggtcactaaaacagaggagaatgtatgattttcttatgaagatatttgccttatatattttctgtagttgtcttgcaaacagaagaccattttgtgttaactagcaaaatgtccatgcttttctatgggtaaaattcccattctttgcttttccaatgcttattacaatatatgttattcacttaaatcaaacaaatattaaattattgcatatatcagaaaatatcagggaataatttgtaaaacatgcaaaattagtagtggtgggctgcggcagaaccacctccaccactagagtatagataactgctggtgcttatgttttcaaccttttctgcactgtgatgctgttaaacattgatttttgaccttttgtctgcattggatataactggtgactttgtgaatgttatttcatgtgatatatatgtggcatttagttccctttttttgttagccttgtgttatgctgtatgtgttgatacttttttagccattacttgatgcacctcttgcatccagtttgcttgtaagtttttcttcaatgtacttaaccaattggatgatgggcaggatatttctcagccaaagtctgaggctaatccacctgatggagttttagcagttcctttattgaggcaccaggtacactttgaaaccaaagctgttactccctaagaaatagtacttcagccaacttctgatttcgatatatctttttgtcagaaaattgccttgtcatggatggtacaaaaggagagaaatggttcgagttgctctggcggaattcttgcagatgatcaggtatgctagtttacctcactccacagtccacacccaagcccacatgcaggattgagccaaaagggcaactgtcctaatttatgatctgatatttttcagggcctgggtaaaacagtgtcgactatatcactgattttgacagaaaggtcaccagttccatcttcagctgttaagcaagaaccatgcgaagctgtaacccttgacgatgacgatgaggatgacgatgctgagcctcatttgaagaaaccggcactagcacatctagcagatacatgtaaacctgaagcgacaagtagtaccattaagacagaaaatcctattgcaaatgttaaggctagaccagctgctgggactttggttgtttgccccacgagtgttctacgtcagtgggcagatgaactgaggaataaagtcaccagtaaagctaacttgacctttttagtatatcatggtagcaaccgcacaaaggatcctaatgatcttactaaatacgatgtcgtgttaaccacatattctatagtaagcatggaagtaccaaaacaatcaagtcctgatagtgatgatgaagagaaagggaagcctgacaggtatggtgctcctgttggctcctcaggcagcaaaaaacggaagacttcctcttctaagaagaacaaaagtggaagcacaccagagagtaaattgcctgagaaacctctcgcaaaagttgcatggtttagagttatccttgatgaagcacaaagtattaaaaattatcgaacccaggttgctagggcatgctggggtctgcgagccaaaagaagatggtgcttgtcagggacacctatacagaatgctgttgaggatctctatagctatttcagatttctcagatatgatccatatgctgaatacaaaaaattttgcttcatgataaaaacaccaatcagcaggaacccaattactgggtacaagaagcttcaggttgttctgaagacagtaatgctgaggaggacaaaaggtcagtaattgattatattttcttgttgtccatctcctgcatgtacatatctatgaactcaagtaattgttgagttctgattgtgcttaaactacaagacctgatagattcttttttttttttgcttggctagaatttccagaaataatttttgtttcaccaatttggagttacttcgttcttttgttaagttaaatgtataaatgtatctatgcccaaatagcatgccagagagtttgctaatgtcttacgtagcctgttgaaaagtgccttcttatggctgtctttagatcaagttcagccaaaaaaagaagaaatttctagcttatccaagactaaggtatagaactttgagttgtatttgattattggtgtcctctaaactttcatatgttctagcggtctcagtgctaacttctggtagtcctattaatataaatttcacatacaatgcttaatatacataagcacagcttgatgttaatcaggactgaactggcaagtacagccactttaaaaatatctatctttgcttgctctaatgatagccttggttgataatatggaggtataattgtgattcaacagtttggcacccttcaactcccaacacaccgacgtgtacaggggtacttttaaatgatattcattgacggaacatagtttatttagtctccttccttttctccacctactgtgcttaactgcccctctgttaatacacaataattggtgccaaaatatttatctgcttgtcatgtagactgtagaggggtacttttaaatgatattcattgatggaacatagtttatttagtctccttccttttctccacctactgtgcttaactgcccctctgttaatacacaataattggtgccaaaatatttatctgctcatcgtattatgttgttattatctcttatgacctgttgtattgcagcaacgatgcttgatggaaaaccaataatctcattacccccaaagaccgtctctcttaagacagtggacttcactagtgaagagcgtgctttctataacactctcgaagcagaatcacgagagcagttcaaggtgtgtttagaatgttaattaatagtctcctttatgagaccttctatttcttttttaaatatgctgctgcctttttcatttgtcaatggtttattaaatatttttacttgacaactaccttagctaataattaggagcacattgtgtaagaagtagagtgtttactttcaccatattatgcaacctacggactacagatacagaaccctacataccttgtataagaagtagagtgttactttgaattaatgaatcatcctactaaaagaaagctcttctaagttctaacatacatggtatttagacattgaacttattccattcatgattaaaccaaacctaataatgctaatatttaaatcacttgatattaagtgcttgcttatgcttttcattaatgaacttttaggaggctaactatgcttccttgtgcaaataaacaatctaattgcaggagtatgcagctgctggtactgtcaagcaaaactacgtcaatatcctgctgatgcttttacggctcagacaggcatgtgatcaccctcacttagttcgaggtcatgagtctacttctagttggatgtcttcattggagatggcaaagaagctgcctgtagaaaggcagcaatcgttgctggtttgcttgcaatcgtgttctgcgatatgtgctctctgcaatgtaagtgataaaagtgaatgtgctgcctttttaaaccacacctaatatgatatcgtttctaccttcattctttgctctaacccatgttttgtgttattgttgcactgtactttgatattatctatccagctgtggtgtggattgtggattgattattttcaaagttggaatgcattttttgagttttctcagtagcacatagactgccttaggttactatcagaacatgagattcttataataggatttataagtgcattgctggggattgatcgtgagcttcctttcctggatgcttatacaatttctaaatccatagctaagtaccaaattatatcttgtggttagcatacaacatgatattatgtttgcatggctatcagcggcttgattttagtgaagaaataattctttgttgttcatgcataccattttcctagcatccacttctgattcattgatccgtacaccataaattgtgcaggatgcgccagaagatgccgttgttactatatgtggtcatgttttctgcaaccagtgcatactggagcaacttaccggtgatgacagtgtatgtccagtgtccaattgccgagtccgactaaattcaacttccttattctcccgaggcacccttgaatgtgctctgagtagatcaacctgtgagtttctgtctgatgattcctgtgaagacatggtgcaagggaagcaacctagatttgattcgtcttatgcatcttccaaagtgagagctgccctggatattcttctctcgttgcctaaactggatttaacccatatgagtgatgacaaaaataaaattgtgcatcctgacaaaattaacgggaatagtactccctctgaatatgctggcaccaaaataactgagaaggccatcgttttctctcaatggactagaatgctggatttggtagaggttcatttgaaatcttctcatctatcttatcggaggcttgatggaacaatgtccgtcgcagctcgggatagagctgtaaaagacttcaacacaaatccagaggtttgtattcaatgaaatattggcatatgtaactgttgaagggaagttctttattgacttgctctgttgacaggtttctgttatgattatgtctctcaaagctgcaagtcttggtctgaatatggtggcggcctgtcatgtacttttgcttgatctttggtggaatcctactacagaagaccaagctgttgacagagcgcatcgtattggccaaactcgacctgtcacagtgtcacggttaaccataaaagataccgttgaagatcgtattttggctctccaggtaaacctaaaactgtaagcttttcttttgattgcaaatcattcttgtagcctggaagataatatccatactgcggaaactgtcattaccatgttgatatcgaactagaggctggttttccttcgtcgaatgttgggaaaactatgtgaatgttgaagcaagtttgttttttttccttggccttcattagacagtaacattttcatcctgtctacctgttcttttttcttcaagtaatatcctatcgacaatggcttatggcatgtggaacagtatatatcccatctttgtattcaccttaatccacttggaccacccatgatacatctagaattgctacaaactctcatccagcactgcttgagttaactaacatgttattgttgacgtgagtcctgagatcgcacccttgtgtgaaatccaattttagagctaatcttagacccttccaactacacttttcttcagtatttactcttttctatcgtctcatgttgccctactaatctgttgtgtctgtctcaggagaaaaaacgggagatggtggcttctgcatttggggaagacaaatctggtgcccatcaaactagattgacggtggaagacttgaactatttgtttatggtttagcatttctcctgagattggacacaattttgctcgtgggatggtgtaacttgcatctataggtgaaatatctgtcaggagatagcatttctctaggcgtctagtgtttctagtttgtacaggtgctcagattttgtagttaaaggtggcattgtggtgcgattcattttttctccgtgcaagtggcaactcatcaggtaatttttcgatgagctgcagtggtgtcttttgatcatgaagatacaaaggagaacgtcattagctaacgccatatttgtacatagttttcaccagcaatcttaactcat

SEQ ID NO: 81665 - DNA, 17676 bp, Oryza sativa
tctataggtgtgcagtttgtaacagcgtgtagtgaggcgtgtttcatctacagggtactagtatctactggtgctgcttgatttttgtcaggcgtgtgcttacgtagctcagcaattttggaccgtgatgggggttgccggcatcggtcttcgcatgagcacaatgaccccgaaggcccgaagcagaacatgtccgacttggtggacacatgcccgcacctactgcacgaacaacagcggatccagaaaaaaatagcagtatgatctgagcaaactatataaagttatagtccaccaacccatctacgtatggtaaaaaaatttagtggggtcttcgtggaggttctcatagtcttcacacctgtagtgaggctcgagacaccactgcccccatgctggatccgcccctgtgcacgaatcacaccatgaaaattacttagagcggatacaataaactgattcagcatgcatgctccaaaatacgacatatcatcttattcttatatggatgggaaaaaattgagaagggagagaaaagtgggcgactaatctggcgccggtgctagcacggcctcacacgctcatgcagccgtgaagacgattaagagcaagtttaatagtaggctgtaaaccgactataaatttatatggaagaaagataatttaaaaaataaagagggttgactcttatacaagagctagccattcacatacttcaagataaatacattaaatgcaaaggtgagagatagagagaggaggagaaaaatagagataaccttatggctgatctactatatatgttaacctaatataagctataagctcatacttggctctattattaaacttgctctaacagcatttacaatgctccacgctatacagtggccaacaattttcttttttaattatttttacatatattaacactaaacatatccaacgtgtctcgagctctcaagctactactgtactcttggacttcgatggggagagccatggctgcggtggagctcggggcttgtcacaaagacaatggtagagttgaaggtcggtggagaatctagtacatggaggttaggtggggtgcctacctcgtgaatgtgggggtggataattaagctcatgagacgacaacgaacaatgaatgagctcggggatataaagctcgatgtaggagatgcttgagcttgcgagctcacctctgcgagcttgtggaggaggaggtgatggagttcgaggatgtagagagttcatatggagcttaacgatagaagctcaacaagaagacatagtggatctggagcttatctgcaatgataagacaatgattagaaccatgaaactcgacgaaggagcttaacacgttattagaactcaatctcacctatgcggagtctatgaagcatgaggcactggagtttaaagaactgcccttaccgtcggctgatatagtcaataagtaagttagctggtaaatggggagtatataagatagtcctgatttgtcggcttgtcattttcttaaaaaactttgctagactgtaagattagtttcacgtaagtggaaatcattccgatttagatgaagggatataaattaaaagtttttgggttggatagtcttctataaagtaaaaaaaggtggagtatgttttaaacaaataaaattcatgagattattaaatggacttatttctttggtcgtagtattattttctgttggcccgtcttaagttgttagaaagagagaataggatagtggcaagaggtgtgtggtttttttttcttaaactccaaatctcttttttttttcaagtcgtcgaaagaaaagtcgttaataacctgaagagactctcccaagacagaaggagagaaaaataatgcactcgtgtaacttaaatagtgtagtttagcaaattcgttaaaatccccttttgggaatcttcggcctccccagcggcaggcaggcagcgcggcggcacgggagcctctctcccctcctcctcctgctgcccgcgtcccccctttacctcgcatccgccgcggatctccgcctctcccgccatgatggacctggatccccgcctctacgagaacgtcgtaagctctcattctacctacgcaccctgcgcccttcctccccacctcatctttgattacctctcgcaactcgattgctttaagtattccttgttggttagtaggtaggttttctaggaacccatctctgctgttgctggaggaggggggcaaagtaggtgctttagcgaatcttgtttgcttcgagcgctgccattatgtgcccctgcttgatcttttctccgtctgggtgcgaattcggctttcttgtgtaggttggatccgtttagtggggaggatgcgatggttagtttggttgtttgggggtgctcatgctagggcttttggtgaagaaagatcgggaatttgttgataaggtgcttgcagtgcaaaaaaatcggtacttccacgatgaggtaggttgaagtggtcaaatcaggaactttcttcattatgtgtggcttctagtgcagaaaaagataggattttactgaaatcgggcggaattaattggcatgagcgctggaatccagcagaatgaattggcattctactggttatgacttaggcggcatgccatgccatgccagcaaccacagcttaacgtatcattctcttcggcaatactccagggggaaatccttgttgaacaggttgtgctgagtgtaaagtttgaaccaacagtgcacatgtttctctgtcatgtatttgttgaataagaccttgggatactggagcattttagacagtagtgcccatttggtaaaatctaggtaaaaggggtatgcctgatatttttccacaaattgatgtgacaccaaagctagcgaaaacgtggtgttgaagtcttttctgttgttgccctaaaatcagatgctggtctgtgctatctgctcatagatacttctgcatttatcatcgctcgattagcatcaaatcattattgacaatgctagttgcatgaatatgccatatttttttgtttgcatagatcataaatgtagctgtgttcattaagcaagtatataataatatcactgctgatattttccataaacagaacctacttataactgtcatttgtcgaggcttgaaagttttcttgttctaaatttcggctaacactggatgtctatgtttaccttcgtatttattgaaggtatatactgctattgacactaaattttcattttttccagtccgtgagtgataacgatgtccgcaacatagtgttgtcttatcttatgcacaactgttttaaggagactgctgagacattcttatccagcactggtttggaactgcctgttgattacactgtagatgtagataagcgtaaaggtatttattcacatatcaacactgaatcttgtatctttctttggatgttcaacacttgtaaaattgctgcataagcactttatattgttatgttagttcatttgtatctttttatgaatgctcatgtttttgtttgtctacacaatccttagcagcttccctttcaagtttcatgctaataaaagatgtgctctcagctcacttgttttagggacaaaaaggctgtgctaacgacaccgttcattagctgaaataatctttgtaaaatcaacccatcaatggaattgcagcataatttagctagtgggacatggagtcatttcagttcagtatagatgcagtttttgtttacttgtttgttgtcaatcattactgaacttgttggatgtgatctctgttgcacataattgcaaatgcaagttttattgaacacttactacataagttacacatgttatgaagtaatagaattgtgtatagctatattattctttagtaccttttccgtacaaagtgtaagataggtttttttctaatagcatgccattaatatagggtttatttcatggtatgactctttactgtgctgttacctctatactcctcatacaaggatacctaactttcttgtgcaacatggatttaggattaaatatagcccttagaaataataaattaataattatggggtttctggaaatttccgatgctctgttatcttggatggaatttgtaacttcatttgaaatagttggtggttaaagcagataatatggattgtatctaatctatcatgaacatgtacactgtgccagtattaaaaaatgcatctgcattccatttgtctagtcgcatgcacttgcatctaacgcttttgttttggtttctttcagcgatttttagttttgtgttggaaggcaatgccctgaaggctatagacctgacagaagagttggcacctaacttgctagagaatgatatggatttgcattttgatcttttaagtcttcacttcattgagttagttcgttctagaaaatggtaagtagctttatttttggaaaaaaaataactgtgccatgtattttggattaatctggatgttttgactgacagcacagaagctcttgagtttggtcagaaaaagttgacgccatttgggaaagtgcccaagtacgttgagaaactagaggtaacttttcctaaacctacatatgcttatattagacagttttcaggtcatgcaaattctgtcttcttgtcaggccatcaatttagagaactggcaatgatgttaaagaacttcactaccatttgttacccatacaaaagaggcaaaacaaaaatattggtcttgaaaaaactttcagtatggtgaatctagtttatcactatgcatgagatatagatttctattcaagtacttagctacttgcaaaacagtattggtacctggcacaccttcatttgccctatgttgccgccttgtagatctgatttgtcatcaaagttatgtcagcctgttttctgggctatcatgtattttgttatctttattaaatacatcagatttaaatggcagcgcggtttttgtattgcatttgtttagtaattgctggtgctatactgtcctatccaagtaccgatgctaggtagtccatcattatcaacgccggccattgggtattatatttattaaatgcaaaatatggtgaaaacgtttgaagtagaggtgccgcttaacaaaataaatatggaacatatggtgacatactttttgtgtattgaacttatgattggctgctttgtaatgctatgcttggaatactatgaaaaggtaacttttgttttatatgtataggactttatggccctcctagcttatgaagagcctgagaagtcacctatgtttcatctactaagcccagagtacaggcagaatgttgcagatagcttgaatcgggctgttcttggtatgttctaagatattgttcttggtatgttctaagatactatttgctgtggtctcatccgctgatgacacgattgtgatctttgtctcatgatcaatgacagcacatgctaatcgaccagcatattcatcattggagagagtgatacagcaagcaactgtggttagacaatacctacagcaggaagttggcaaggtaacatctctatctttttcttcatctcacgatcaatcatgattctgtacggctgcatcgtatcttgttgaacatctttttttttgttcttatctatcttaattatggctatttcttttattgaggtgcatgtttttccataatcataagttactacagtccacttaaacttctatttaactattggtgtgctttaacatcatgatgcatacatgacatttcaactcttggagcaggattcttacccgccattttctttgaaggcctttctgaacaagtaaggtgcaaccaatcaatcgttagaaagacacctccagggctccagtcctatggccaccagagttcccttcagaatgtgtaaaacagttgcgtgaaagcaagcgacgggatgctcatgcacatattattcagagaaccgccttctggattaaacgatatcatcagtggtgtaccaacaatatcatctgcatcgaaagaggaatgttgtataactgttgtttcctcatttacagttccccatttcccctttacccgttgacgccatcgaaagttgtacatatcagaaccttgagctattctgtatgttcgtgcagagatatcgtcagtttgaaccaatctgcagtgcacttattactatgcctgatgcttggtctctacaaactattggtgtgttttatggcgtccatttcaccatatcgactgttccattcaaccaaagataaaaggaaagcagagcaagtgacaagaccatgggaggagaattctcaaaaatttcttagaatgtgcacttgatgctatgcctgatgcctgatgctggtttctacaaaatattgatgtttttcatgccgtccatttcacgacatcaactgatcgattcaacccaaaagatgaaggaaagcagacaagaaagtgacaatacaatgggaagagaattctcgaaatcctcatataatcagaaaaggaaaacacgggtgccaactttagttttccatcgtgaacgccgggaatcacgaaagatgagagcgagcggagggcaacaaaaaaaaaaaaaagcttctttccgtcccgtgaatcaaaccgggcaaatcgtagaagacctatacgcaaattgcagaagacctataggtaagcgaatccagttcttccccagtagtagctttcaagtttcttgagccgtttacgctgcagtggctgccagctgctctgtgaattttgacgatgcttgctcttttttttttctggccctcgttttaccggttccactataaataggcaggtgagtgcttcttgtcgtaatagtaagctcatcacttggcaccagctgtgaaaaaagcttaattagtcaattctctccgtcagttgattttgtttggccaacggaacatggtaatttctccctgtttgttcattaacttgtgtgtatttatctgcatgtatgaatgattgcgtgcgtgctggcaaaaagaaggaatggaaataaaaaagatggttctttgatgtagagttctctgggaaacgaacatttatatgggagtatgtttagtgtcttcatgaaacttgttcgtagtttgtcctgctagtttattatatctttgaagtaaactttcagtttccaggttacactttcagaatttcagtagcttgcttggttataagatcaaaatgacatactgacatcaaatatctatcctgcaaaaggtagaaactgaaccaagcttagcttttgttggtcggtagaattttgttaggaccaagaggcttaactcatagatatgcaaggataacagaaatcctgttagtcaagaagagtaatactaccaattatattgatttaagtgctaatagatggtggattacttcatgatgtatcatgaacctaacacaaatataatgatctgttcatgtccaatagagctttaaaggattcaacgggaagaacccgatactcgttgggccgtggggagggttgggaggaaccctttgggacgacggcgtgcactccacggtgaggcaggtcgtgattactcatggtgcagccattgattccatcaagatcgagtatgacctgaaaggaaagtcagtctggtcagagaagcatggaggtgatggaggcaccaaaactgatcaggtttgtctgaattttgtccccaagtccctgacctgagaatttaagtactcagatgtgccaatgtcatcacaattttattccatctgcacaagtatgctacttaaaacttaaaagtaacattcttgaacggacatgtcatagttgtgctaatttgctaaatagattaagctagaaattcattgctgcaactgttttctgcaaacagaagacatgaacgtcttgctactttttctgaagaaatcacatactctgacaagaacgttaggctgcaggcgtttgagtttcagactgaggaagtggtgctgtttctaacaggtgaaactcgactaccctcaagaaatcctcacctctgtcagtggctactacggatcattgggaggctgcatcgtcgtaagatcactaacattcaggagcaacctctccaagtacgggcctttcggctccgaggaagggacgcccttctcgctcccagtggcggtcaccggtaaggtcatcggcttccatggcaaatccgggtggtttctcgactcaatcggctgccatttcaagaaggagaagaacgccactccgtcgtccaatgctccttcagctctcaggagcatcacgagacctcatgacaagaatggcaacaggtacgcagatagcaatgctgggtatgacatggttcttgccgtcagagacagaggtgacagctacagtgtcctgactagcaacaatcccaaggaacagtatcctaaccaatcacaggatgctactctctggaacaaggtaggataaattcagaaactctacagtgattacttggttcagagtcctttacatatattgtagctgaaaggggatttattagtacgtggaattttgctgtaatgtacagatggtgtcactgcctagtttctactcggataatgggaccatgacaataagcactccggtgagatttggtccctggggtggaaatggcggcaccatattcgacgacggtatatacactggtgttcgacagatcaatttaaagcgaggattgggtatatcgacgatgaaggtcctctatgatcgaaatgggcaggctatatggggtgataagcgtggatccagtggggcagcaagggctgagaaggtgatgcaatttctgaatttcagcttctgaaaaattactctgaaactgcacttcagcttctgaattttcagtttcaaacttgtgatgtactgctactagtactagtcctgatggtatggagattttgtttgacaggtagtattcgattttccatcagagatcttaactcacataactggttacttcagttcgacgatgatcatgggatcaacggtgatcaagtctctgacattccacacgacgaagaagagccatggtcctttcggggatgagactggcacgttcttctccagctgcctgaccgaaggtaggatagtaggattccatggcagggatgggtggtacatcgacagcattggagtccatgtccttgaaggcaaggtgttgtcacagagagctgacagagcattgaccgaaacgagcccgtctcggcacgccgatatgcttgcagtagcacagagggaaataggagatgaggtaagtgtaccatgtcccaaatgctaaattgcaagaagtattagtagattttcagaacatctttttctgtgttgctgatagtgaaactattatgaccaatgaaaaaaagtgttttctttttttttgtgagtgtgtaggttacatatggtgtggtgaaagaaccaataccagtagggccagggccttggggtggcgagggaggcaagccatgggacgatggtgtctacacaggagtgaagcaaatctacatcatgagagccgatttcatcggttctgtgcagattgagtacgacaggagtggccaatccatctggtccacaaggcacggcaacggtggccagataacacacagagtgagtttgattactcaacttgctcacctattttcagtaacaaaattcaagctgtttcataatgatccgagacaatgtggcaaagcagatgaaattgtctgcactgcaagcatcaaccagtctcatgtaaccaaagcttaaagacttcagatgagatttgtatgatgctaattaatcaactgttcaccaaaatgccggtgcagatcaagctggactacccacacgaggtcctgaactgcatatacggctactacaacacctgccaggatgaagggcccagagtgctgaggtcgatcactctcgtcagcaaccgggggaagtacgggccgttcggcgaggaggtcgggacctacttcagctcggcgacgacggaagggaaggtggtcgggttccatggccggagcggcctgtacctggacgccattggcgtgcacatgcagcactggctgggtgacaggaacagaactgcagctcccagctctaataagtactacatctccaagtacctgttttgattgagctctgcagaattgtgttcttaactttgtgtttgaagcatatgcttttgatgtgaagtccaaagtccaaacactttcagatttgaagagtggcgtgtgatttattgtgtgaacttaaaattattatccgtgtgcatttcctagattcagaggcctggaatgatttgatcatcttccatatgaaacaaaaaacatcagaatgtatgtgatttatttgtccggtttggagatttgattctctccagcaatggagttgtttttttttctttcagagaagtgataggcctaccgatcagactaaactttctgtcgtgtcaaagatcaccaaaagaggtagtgatctgatcacgatttcgttgtcatgtttcgggttcagtcgtcttacgtttgcccagctggtttccgaggtggagtcgctatgggatgaggacatcctggcgttattctttctttcactggtgacatcaaaggcggcaatgcatgcatgaagcatgacgtttgatgtgctttcaggattaaaattgctgcatttgtgcttgctgctggtaaacactaaacatgccatgttcttgagcccaacctggtggagagagcaatgcagagggagtagagtatcaatgctaatttggactctagctgtgtgacacaggtttgcagagagattcagagaaccggatgatggtgaagtgggtgaggaacagggcaagtggcatgttcactagtagcaaccaaaggacaattcgagcctagtggacactctatactagtagtactgccacgcaaattgctggactgaaattctgtcaagtctgaaaggattggatgaaccttgccaaaatatggtagtacacagcaggatttacttatattccaccatagatcagacactacgcacgaacgatcgtgtgtgtgccggtgtgtttaactaatgaaatgacggtgatttagccggtgccatgatttgtcctgatgaaaaacctcgctggctagctcagctagctgcgacgaacatccatggagagagataagattctgtgattctgtccgtccaaatcgccgccctcttttttttctggccaaagtaggaagaattcagagcagcaaaaggaattgcagtttcgcagggccacacgaacctgtcggatgcattcgctctggacagttttgaactcccctctggacgtggtcatcttaggagaggaagcaaaggaatcgtagggctgagaaaagaacccgtccatgttcatcctccaggcaatgcatgctttcccgccgtcataaacaatgtgctgtaattttcagagtcctcagggtttcagatccttattatttgtccacgagacttagagaaatgatacagtggcgcatttgataattggtaatattatgtgatagggaggctcacggtcatggagaatctcaccgacccggatggatcgatggatggatggatgcagcggtggaaggcaaagtcaatcccctagctgggagtttggtcggcaaatctgaagaccggtgatggagtagagtagccatccagccactagtggcgcatttcgtctagaactagtagtattacgccaagttttctttttttgagaacttattacgccaagttggaatagaattacagggatttcttcctctacctcgcctatcttacaacaggtacaatagcagactataaaccagctataaacacatttcgagaagattagagaggatagaaaagagcagcaggatatagatttgtagatagctgcaacacaaactccaacatgcatttgtatattacaggtgggacaaaatattaattgtgtagtattccctccgtcctataaaaaacagagtctagaatcggatataacatgttactacgaatctagacatatgtatgtctagatttgtagtattatgatatgtaacatccggtattatattggttttttataggacggagggagtatatgtttatagatagctattgaatgaattaactactaaattgactatatgactatagatgatttaaggccggttcttctaattagcttggcgccaacaactatccgatcgagcactgaaatttcgcatgtcgcgtcgggcgggggggagctgccactgccaccttaaagcgagccgcttctggaacgagatctccgctgttgcgaaaatcttccttgggactcgcgaaagacggggctcgaatgactcgtggccactggattttaaactacgcgcgagcctacttgcctattgccgggaaggccacacttttgggccttttttctcatgctgcgtccatgacaatagcatggcatgttggggggatttgttcattctctctcccggttcaggatgagcccccggtatcgatcggataatttttttagcatgtgttttttaaccatccaagcagaaactccaagttgttgctacttttgaaataaaaaacaattgagaaaacctcaaagaaaaaagagcaaagtggtagctacactaaattgcaagtttgtccagcggatataatatatttaacagccactactcctctcggtgaccttatttccacctgaattatatgcgatggaatcatggaataataactttgtaagcagtagtagcagtcaggtatccctaaattgcaaaattgtccagcggataatatattcaacagccactacttctctcggtgacctgattttcacatgtattatatgcattacttttacatggaataataactttgtgaagagtagtacttgtcaattaatgcctccatctctcaacagataacaccattgacttttggcacaacgtttgatcactcgttttattcaaaaaaatgtaaatactaaaaaagtacaagtaatgtttaatttttttaataaaaaacaagtcacaacaaaataaataatacatgtattttaatttttgatatgatgaataaccaaacgtcataccaaaaatcaatgaaacaaaggaatataactatatactacgtatcttaaatgcttccagcatgatgtacagttctctatctcctggtgatcttgttgaaagcaaagctcctcaatgcacacatgcagcacagcactagccaaattcccagacacccacatccctgtgcagggctttccacgcacgcaccggcaagatggatagagatatatcctgcagctcgatcgatccctatctgaaactgtactgcctgtgatacgatcttactccaactctctgacggataaggcttcatcttgagcctctcgcagcttagctatatctctctgctgccgctagctgatatggctctctcgtatccagtcccgatctcgatctctctccaactgggtcggccatccatcgatcgactcatcaattcatgcctctcgatcgcgagcatatatggtcatcatcgatcgatcagttcatttcagttgctggatggaccaaatcctgtgccttttgagatcgatcgatcaaaaagagaaaggatcaaagctatagggaccaacaaccaacggccggtcgccggctggctcgcacatgcgcatgtcgtagtagtacatatgcgttggctgacacacatgatacacgtactacacgcatcgactggtgatatatcgatccatctccatctcatctgcatggcaatggccatatgctgcagggagagaccacaccacccactgtctctctatccactacatcttctgtaatctctcctatacctcgcaagtatatacgtgcgagtgcatgcagatcgagctgatcagatgagatcgatcgatcgatctttgcaaaggcaaaggagagagaggaggcaaacaggatggagaaggcactagctagctgtagctttgttgctcaacgtgcaatgctgggtgtagatgatggagtagggggggagctagggccagatcttggagggagaagcccttttggggatttggttctttgcacaaatgcacaatgcttgccgccgctagtggcctgcatggatggatagatggccctggggtgccaccatgcatgcatcaccggacagatggatagatcgcaacagatcacggatacatatcgatcggtacaatgcaatgcatccactgtcagcagctacaatgctagtagcctagtaccatatcgatctttttggttctcgggtaatagctcagtacgacgtactaacgtgccaaacgaaagcatgcatgcagtacttctagctgtggtacaaatcgacaagtaccacgtactagtgtacgcatggatgtgattaggctgcgttggaagaagtgttgtggcggagcaactgctatacgtacgattttttttagatgtttatacgatgaaacgtttctctcctagcccataagtgctcttgactgccacgtgcgtatgcgccgtgtgctcgtgcccgttatcgtactaagatcgtaagaaaaaaatcgtacgtacatcaatttcctattacaaacctgaaaatatattcatttgatttttcttttttagaaaaagaaaacttctgtatagaaaattttgcacaacacaccgtttagcaaatccaggaaacgtgctaacgaaaaacgagtaataagttgatgttttgagttgccaaaaagaattcagccttatttcgtactcctccatcattgccaacgagtaattcttaatgcatttgacgaagttaatgtctaacaattaaaattttaactactagtaacttttaaaacttacagtttaaagacaatacaatgttatgcatagattattagtcctaaaatgtattttaaaaaattaaatatttacttgttttttatatattataatagaatcatatagtaaaagataaagatatattttgaagatcgttgtcattgtttaagacgttaaaaaactgggagagctactatatatggtatatgcactagagttgtataaaaaagatccaactctaatataattctgatgtataatttgtgtgcgagagagattgagaaatgggtggtttggcagtgtgatgcatgcatggcggcagggaaggcaaacaaaggtgcctactgttggcgcctccctttcaatgtctccaggaccgttgaccgatggtcaacgagcagcagcttagactagccacgtgcagcgcgagggggcgcgacgacgacgcgtggacttttgactgatgaggccgtgagtggactcgcggcgacgacctagtctctcttgacatcgactaatccctaattaaattaagttaaaccacattcttcccatgattcattagtgtcagttagccttaagagagattctgcgtgtgtgtgtgcgtgcttttgttttaagtggggatcgtatatagtttggccgtgttctggccagataatattagtggcgcttttgaccagagatatgcacgcgtgatttctgacatgtatggagacgatctcagtcaggttaatctgaacttggattgtagctgtttgtttaatttgtagcggtccagttgattggaacgtactacttggttaagactaattaattaccatgtgttacaagcatgtgacttaatacagattaattaattaaatatataatatttggcataacaactgtcgaaaaaggcatactatttggcagaacatcatatcgatcctaaggataacgcacagatatataatattaaatactaaataaataaataaaatagacacgctagctagactagctagcttggagtaacgggggcacgaagtcatgtttagttcccacacaaaagttctacgtcatgtcgcatcgaacgtttaaacacatgtatgaagtattaaatatagactaaaaaataactaattatatagattgcaactaatttacgacacgaatcttttaaacttaattgctctatgatttgacaatgtggtgctctataaaaatttactaatgatggattaattagacttaataaatccgtctcgctgtttactaacggattctgtaattagtttttttattagtgcctaaataccctatgcgataccctatataatactcgatgtaacacgctaaaactttacacccttagatctaaacacccccgtgatgtagtagtacaatcttgttcctagttggagtggtgcacactcccttcgttttagaatgaaagatattttggttcaatcataagtaacttttttattgaaaaaaagtaagtcatacatccattttttaagtaatagatgacgtcgttgatttttatcacgcgtttaaccattcattttatttcaaaaaaatatgtaggagtaattataatttattttgttgtgagttgttttatcattcaagatactttaagcatgatttatattttatacatttgcataaacttttgaataaattgaatggtcaaatatttattaaaaaatcatcggcgttatctattaaaaatggagagagtactaactaagcaatccagtcatatatgtatctaccaataaattgatcactctaggattaacatgtttttttttatttttaatgaaaatttctagagacatttcgctaggtgagatgaagttaaaatgacttgattgaataacagcatagctagcaaaaagaatacattttgagatttaacataacaatattcctctaattaagttttttcccttgatatatttaagtctagctagatgcgagtaaagatcgttagctttgaaataagatatataacacattttgagatttaccagaagaaaatcctcttcgtaggtatagtcagttaataaccttttaacataaaaatcattcatcttattaaaaaaatatatagtgctttcatttatttttctgttatctttttactattaaaggtgatttaaccataacttatattttcagtgattaactataccacttttcatagagaatctcccttaaaatctattgaatatagatataatatgattatagtataataacattgtaattaacttatatccaatcatacaaaactcagtgttatgcaaacaaaactcagtgtgaaggcgaagtcacaggatccagcgcgcgcatgtttttttttcctcacctccgtgcacgaatcggcttaaagtacacctgacagctaaaaatttgaaagatgttttctctgattttctatcaaaatatattaagcaaatctgatacactaaatataaatatgatgaatgataaaagcgcgttgtagcatgaacgatttttaaatatgaagaatgttcaaaagtcaacagccttctatctactacatttattcctaaatatttgacgctgttgacttttttaaatatatttaatcgttcgttttatttaaaaacttttgtgaaatatgtaaaactgtatatatacataaaaatatatttaacaataaatcaaataataaaaaaattaataattatttaaattataaataagatgaacggtaaaaaatatttaaaaaagttaatagcgtcacgaaaggagt

SEQ ID NO: 81666 - DNA, 6374 bp, Oryza sativa
acaggacatatcgaactttcaaagttcgacaggttgcggctacaggtggctgtcgaactacggttgttcgacagatacctctgtcgaaccacggttgttcgacagggtgctaaacatgcgatttcgcctaaccgatctatatttttgcgatttttcattaaaatcgtattattttcaaaaaaaatttcctttaagcacaacttttcgttttttatatttgcataaatttttttaataagacaggtggtcgtaagcaaaagctcaaaatcccttatattatgggacggagggagtaattaatattcaatttcttacttatccattgaaatatactccatataacaattgaagatactgcacgaatctccgcgcaatcagccgtgcagattcccctactatcccggccagggagtacacttcggtggacatcatcatgacccgtcaccgcagaggcaagcgcgggcgcgcgagccccgaccctccggcgaagcgccgccgccgcggccgcggccacggccacggccctggcccgccggagttagaggccgacgagctggaggctcctccggcgccggtacaggctccatcggcggcggcggcggcggcttcggagccgttgctagtgatggtcgcggggctgccgcccgggtgcggcgtgatggagctcaagtcgcggctcggggcgtacggccccatcgcgcgcacccgcatagacgccgcctcggccaccgggtacgtcaccttccgctccgccgcggccgccatggccgccattgctgcctccctcgaccccgacggtggcgtcaccgtcggatccaagaaggtaaggagatctgcgtgctgcagttggatgagctcgatttcaacttgctgtgcgtgtagaggaatgcagtacagcctgtacagggtcaagctttgctgagaattgtttgaaggcgctgctagatttgagaattttatagattggcatcacatccggccttttatctcgactttaaagttctgatggatgatggattatggatcaaacagagtttatgaaaattatttgagggcacagacgagagaatttagtattagaaagttgaaaggttgactttaaaaagttctctaagaaatgccgatgaagaaagtttatgcaaaaatcataccgtttgggagtttgggaagtgcgcccgcaataatcaaaaatccgtgagaggaaaagaatgctttttttaattatttttcatctcattttatactctgcatttgctgtttcattctagcattttggatttaattaatgtgctagttattcaattaacttacacatttgctgggctctacaaaacctactcaattccgtgatgaactggctaccttaaattcagtccaaggttacagtcaaccattttatctggtacaagtctataagatagtaaattatattcaatattgatcttgtttacatccagactgtgctggtatcttcgctgtcacaatttgttcatgttaacggtcgtttaaaaccaagtagaatacagatttagtttagaaaaaataaacaataaacttattttgcactttattttagtcgaaatgcatctgcactttggttgtgcagcaggcacaaaataaacagaacaaaatttctaacagattcaggggaagctatagcatgctacacatgttttgagccatttggtactcttgctcttcgatactcagattgctggttctttcatgggttgcaggttttagttgtacaggcaagcgaggcgccgaatgacttgagaagtacagctcaagccaacccagtgggggagaatacgcatgatgcgacgaagaggaatgcaagcgaatcttcagcgttctcgagcacgaaagcggctccagaaggaacctacaaagctagagaaatagtcgcctacgatgatctgttctgaacttctaataaccagccttctttagggaggaggtgagacaaccattcaggtttgttcttgtacactgctagggtctttaggtgagtaagctatgggtattttttagtgtgtgaaggtaccttcagatgggtaggtgtttcttgtattcagcatgtattgtggaagttatcatcaaaacatgagaatttatgtatgttagattgttaatattgacagtgccttaccatcttctcaaaatttctattcaagtgcattcgactattattcgtggctactttgaaaacatttgaaaaagatttagcaaaaaaaaaaagatcaaaagtgttttgatcgattcaatatttgacaccgtttcataaaaggcagaagaaccgtctgatcaaagaggtgaaaaaaaaggaatctgggagttgtgcttcgtatcacatcagtctataccagtaaaaatagagcaaaagtaaatcgaatatatcacactggcatgtcacaaatatacaaggtattattccgggaatgttcagcgagtactttttgttaaacatgttcgattaaaacgctccaacctgtaaagctctaaaaataacgctcttagcaaacgcctaaagtagcagaattttctagtgaaattattctgaagacggaaacactataattttaaaggcacataatatgaccaccttgtatatatacggaaaattttatccagatacacgtgtaacctattatttacgcaattacactgtctgcaaaacagctctatcaggttacattctcagaactgacaaaattgttccagctgcatgatcttcagtgcttggcactcatgcagcattttgcagactcactattaacctctcttcaaggcaagtgctttatcaacattctattggtaaaccatttacctgagacttttgttaacagaaatatcaaaccatgtctgacttatcttgctggcctgcgtgttgaacatgctattcttgaagcttttttgtcttcctttttggcataccactcaccatgtctgacttatcttgctgtcaaatttcaaaaaggaaaatatgtagttaatataacaggaggaggtaataaaataagaaattttaggtcattatcgccaaaggttaaaaagatatagccaaatcaatcatgtatacaaagaggaaaaggctgtacagtgacatctgactggtttgttgatgattattcatagcattgtgtcaatatgactagttaagctgattgttcccagacgtaagcagtcttctaatgatttctgattgattgcagaagcagacagcctcataacgctatctgattaatggagtatccattggcactagtcaatttttaattcattagcgttatatactcgtgcagtgacgatagttccagcattgatcccctctcttagctggttcatacaatgttgtgacatttcttaaaccttcaggctcactctgtggtataagattggagaagaatgttttggtggtattttttggcactgacaaaacattggaagtattagatgctattttctctaaaatagaagggcagaatcattctatgataaagaacaggatagggtaccaatcttgcgccttgcaatccattatccttgcagaaacggactgccaaagattgagaaggggcagctggggggaaatcttcagctggcattgcaaatggacgaaccattttatcaaatttgtccaaggtgagatatgatccaacttcctgcaatctttctggctccataattttcatagtgtgatcatcaggtagcaatgaatcttttccatgttcgctctgtatggatacatttttcaagaactgttgagttaataaccagaaatgttgaaaacaaacatcttacatttcatttgaaggggaccaaactcacctgtaaggaacttatatctgcaccacgactatatgtcatttctatgcgaaacctttttgggtcttccaaagaaacctgcaatagttgtccaatgacaagatcaatatcacttctcaccggtagtattagtaaagtaaaagcttatgattacactataattttttaatacctctgtattctcgaacatacgcaatacaatgtaactcatgtagtcaagttcccttgttttaaacagattatctagagcatttttgcaaacaagactttcttctccatccatagattcatcaaaattgcagtatcgaagtacattcattagagaatgtatatgtgattcctgacaacaaaataatccttagtcattcttatcagggagaagaaaacaaaaacaaagaatttcagttaaaaaaaaactccaaagaaatgtcatataggaaattgtcgtttccatgatgatgtatgctttttagagccttagtttttagggttttttttttttgaaatttctgtatacttctatagttatattgatatattaccataaatcaagaaagcataaacttaacaatttgcaaggggaatatgaaaactcaatgtaatttgtcttactgatgtaaaatagagccttgttcgaacacgtcgttcaggttccatcacattggcatatctacaacaaaattatttgaatatcaattgtattcttcatagtcaagattcctaactggaatttcgtacttactttggatccaagcagtatttggtttctttgtgcgaatcatcaagatcaattgacttcttgtttgagttaggtctatcaaaaccctcattcttaacatccccatagtaacccctatccttccgttttgaagaaggcactattgttggatcatggcatgcattagattcaccaccagcagcagcaacctctcgtctggtgttatgcaggtcaatcagaatcttgcccaacaaacggcgtgcaatctgaagaaaaggacatgagaaacatcataagttgcttctgctcattctgatcaggggaagatcacaagcaaagctacagatgctgctgctggacctcctgacctgagaacatttgcttatgcaccaacaagatctaccaccagccgttttgatcagagtgaaaacacgcgcaaagctatgtgcactgcggacagccctcctgatattagcacattcgaatataaacccatgaaaagcgccgtcagacgttcagatgggagcaagttttcaggtgcagcactaaaagcagctagacgaacctctcggagctgattctcacaaaattgtggatgcacctgccagcttccttatctgagcatgtttggatttgcgtatgccttctgtctgcgttcatgatctgagttcaacagaatcatccagcaacaaatgctctcaataaaagtgcattccattttgcccaaagtgcaagcacggctgaggtagctgccattcactactactagctgcagggcttatcagttcagacttcagagctcatccgtatctgcgcaatcagaagcacacatgttctgaagggaagtgctttatcttctcggtttccagagccaattatgtggcattttgcgagccaaatgtatgtgctcgtttttgccttgtccaatgaggttcttgtatgaacagcagtcgaatttgcgatgctatttaagccgcaaatgaggatactgttgtattgttcctttttgagaagatactgctgtatgttcattcttatacaagtgtgagcattccttcagaattcagatagcattactcttgtcaactattgatcaagatgttggaaagactttgaaaccggctgtttaagcacttgccagcattctaccagtctttctgaaagattataataagagtaaattgcatattgggaacaaatttttatctagtttgcagattttcactttaaaccggcaaacttcacaatagttgcaaaatggaccggtgttcttttccaatctaaaattccagtggctagtcttaaaataacggtggccaaactctgggattacaaccgaaatgaagctaatgcaaacatggaatgaaaaaaaaaacgatactatatagttttcaaagtattccctccgtcccataatataagggattttgagtttttgtttgctttgatgactcgtcttatttaaaaatgtttggaattattatttattttttttgacttactttattattcaaagtattttaaacacgaatttttttggaaataatacgattttaatgaaaaattgtaaaaatataggtcgattaggcgaaatcgcatgtttagcaccctgtcgaacaaccgtggttcgacagccatctgtcgaactgggtagttggtctaaaaaaatataaaaaagtacggctacaggaatcagcaggaacatgtcgaactgacaaagttagatagggtcacgtgaacagtcaggaatcagcaggaacatgtcgaactgacaaagttagatagggtcacgtgaacagtgccgctacaggacatagggctgcaggaa

SEQ ID NO: 81667 - DNA, 14835 bp, Oryza sativa
cgtgggatggtgtaacttgcatctataggtgaaatatctgtcaggagatagcatttctctaggcgtctagtgtttctagtttgtacaggtgctcagattttgtagttaaaggtggcattgtggtgcgattcattttttctccgtgcaagtggcaactcatcaggtaatttttcgatgagctgcagtggtgtcttttgatcatgaagatacaaaggagaacgtcattagctaacgccatatttgtacatagttttcaccagcaatcttaactcatcttgagcttcgcatttcagccgtatggttgtacatcataaaccatgtaaaagattaagctgaacttgtcttcgacaatttttttcagttgatcaaacatgatagtttatggggaatgaaatttgctcaaaagttctaatgaatgtgtggcatagctcatcactgatgtgtgtatgtaggccaagacgtgtgcattcttttgttctttcaagtccctagtcatccttgtacagtttattttagggggaaggggggatgttggtggtgagggttgagatgaggaagtcggtgaagttatattttgagattaattttgagtatttacaggtggaactttaaagtaagtatggttcctgcgctgcataaagctcagttggcttcctacactgtttgggggcaacaaaagtgatgatttggcaaaatggctcacggacactttggctgtgtccagttccttttaaattttcaacttttccgtcacatcaaatgtttaaacatatgtatagaacattaaatgtgaatgaaaaaaaaaatcaattgcacattttgcatgtaaattgcgagatgaatcttttgagcctaattacgttatgatttgacaatgtggtgctacagtaaacatttgctaatgacagattaattaggtttaatatattcgtctcgcagtttacatgcggaatctataatttgttttgttattagtctatatttaatacttcaaatatatgtccgtatggatcaaattctttttaccaaaacaacttacggcctttgtaactgcagtccgatggaataagaaacaaccgctcgtttttgttgcgtgataaggttgtaacttgtaagggctgcagccgctgactattctcgcagcgcataattgcgtatcagagctccagatgacttagcacaagagcacaatgcatttctcgctatccccaactttgaatcaacgatttttttacttctcccatctcacaatatagcaacctaatatttaggataaaacatattgtactgtttaaatttatgtttaaatttatattattaggatacgtcccatcgctatatcgtgggatgggagtacattttgatcatgcacatgtcaaagtgtcaaaaactacaccatacaatctgccacttctgtatgccgtgaagctaagcctgaaaaatcagacacaaaaagggaaaaaaaaaagagaaaaccttttggcatagctacagttgatgaattgagccccaaaaaaatcttgctcatggatcgagaagcctatcattgatccccgatcctcctccggcattggacccagacgatccacactcactgacgcctgggccatcggtgctcgacgtgccttcgacggacaccggagcgaccaagtccggcggcgggaagtacgacggcaccggcatcttgggcggcagcgacggcagcggcgcctcgaacttgagcacgttcagcgcctgcctgatgctcggccggtgcgcgtggtcggggtgcgcgcaccacaatcctaccaccatgagccgctccatctgctcgaggtcgaacttgccattgagcctctggtccgcggcttcgaggatggctctcttgccgtagagctcccacacccacggcaccagcctcgccttgctcgggtcctcctcgtcgagctccgcggggcggcggccgcacgcgatctccagcgccacgacgccgaagctgtacacgtccgactcccggctggccctgcccgtgatgacgcactccggcgccaggtagcccagcgtgccggccagcacggtggtgtgcggtggctgccgtgctcgacgagcttggcgaggccgaagtcgccgagcttggcgctgaaggtggcgtcgagcatgacgttgctcggcttgatgtcgcggtgcaccacgcactgcgggcactcctcgtggaggtagagcagcgccgacgcgaggcccagcgcgacgttgtaccgcgtcggccaggagaggggcggcgccgcgccgccggccttcttgctgccgccgccgccgccgtagaggtggcggtcgacgctgccgttgggcatgagctcgtacaccagcaggaagtcgccgcggtgctcgtggcaccagccgacgaggcggacgaggtggcggtggcgcagctggctgatgatgcgcacctccgccgcgtactccttgcgcccctgcgtcgagcccttggacaccctcttgatcgccaccgccaaaccgagctccttcaagaagcccctgtacacggcgccgaagccgccctgcccgagcttcctctcgtcggagaaattcttggtcgccgccgcaaggtcgctgtaccggaaccgcctcggcccgctctccacgaagaactcctcgtcggcgagctcgtcgtaccccatctcctcgtcgatgtcgccatcggcgagctctccggctttcctccattgcgacacgaaccagagcacgccagcggcgacgagcacgagaagcaaaccgcagagccccaacacaacccacaggattaccgtctcctccttggtgtcgatgctggaggtgaactcccagtacagcacctggtgcagctcggcggcctcgcccgtggcggcggagaagccgacggcgacggcgtcggggaggtactccatcagatcgacggcgtaccagagcacggggtccgtcagggccgccgccgccgccgcgtcgccgtaggagagcgcgacggtgaggttcttggcctggccgtcgtacgcgacgcgcgcgtgcgccctccggccgtccttcatgctggtgggccagtcgacggtggcggcggagacaatcccgccgaggtcaacgccgacgtggtcgtcgctggggtcccactcgttcttgtaggtgtcgaattcgacggcgacgagcgggcgcgggtgcgccgccgctgcgcccccgcgtgagaaggagttgaagaggccgaggaggccgccggcggagctgttggggaggacggaggggaagggggagaggaagaaggcgaggccatcgccggaggcggcggaggggtcgggggcggcgatggagaaggagaaggcggtggagaaggaggcgcggcggcgggagacggggtcgcagagcgggacggggcgcgagaagaaggccctcccggcgctgctggtgatggggccgatgcgctcgtcgcgggtaaggcggatgaacttgttgaagaaggcgtcgccctggaacgcgatgcccgacggcgccgtgtccgccgaggtgaagttgtaggtgaaggagaaggccgcggcgggggacggcagcagcagcagcagggcgacgaggagaaggaagggggcggcggcggcggcggcggagatccccatggcggagaagctcgggttctcctgccccaggccaggcgagccttggaaaagagatacaaaagcttactacatttgggttgaccaccaacgagaaggctcgagctggccagctggtatctgcttggttgtgtcgtactgtaccgttcttctatacgtgactacgtgctgtgcatactgcccgcatttgcagctgccaagttactgtcatgtatgtgtgcgtgccttgtgttggaatgttggatgagggcaggatgcgagcagagaatcgatttcgagagcgttgtctcccaactccgcagggatgggaacactggacgcgcggggcgccgcggtggcagtagcgagagagtgggagacggcgacatgaatcatgatgcatccagcgttcacaattccaacaaaaactggtcgaattctgtgaaatttcgacgttttggcatgactcaaaattaagttctgattagaatttcgaaggttaaacagtagatttggtcgaaatttatcgaaaaccgtgatacgatatagctcgaaatttagtggtcaaccggtaatgtaaaccctggatgcatctctacgaggcgacgagccgacgacggccaaacaactaccatttggagtcttccctgaggaatacaaagaagcctactccctctgtcctggaaagccagcctttttaagattggttggacaaattaacagaaagtaaaatttactatattggccatatttaatagttgcatttgtcacattagattgtaaaaaaaaaatacaacaagtaattaagtaatcactactagtagtattgaagatctatttaatactcccaccatcccaaaataagtacagttctacacatctcatatctaacgtttaccttccgaaccattgtcacctcccctcttttatcggatgggttgaggagattcacatcaaaacaaagcttcagccacgctaggtctggtggtggattctatctgcgctccatcttcccaactgcttcccggttgcggatgaccatttcccagcctggtggctccacactagaagcctaatccctgcagcaagaagatgcttcgacacaattgttatcctagtagcctaggtgatctagaaggaacaaaacaaccgggtcatcaacaatcaaccctttccttagttgatcgtcttcgataagattgcaaaagaagctgctcttcggtgcacggtcaggagagccaacgcctagaccaacgtatagcaatggtagtcttttttcatgagatttcccctagtatttttttcctaaggctgctttgtcgccgggacgacatgtactaaaaacttctttcttaatacacaacaatgtgcaattctctagtgtattagctataaattaacgaatgattatagggatatggaccatactaccatagtgccaagatgcactagctagggtatagaagcttggaacagtagatgccaggtaagccggacgctcaaagcaatccgttagcgttcaggcacagcattctcctggacgagggtaatacaagaccagaagtggccgccgcaaagaagtctccggacgaaggatatccttgtcctgacccgccgcgcactccaattctaaccggctgcctggagtgcaccgaaaggaagctataaaaccaaatcaaaccccatccacccgcggaagcatgcgcgccaacgcactccccacgcgatcccacagccctccgcttcctctcccctttcgcctattcatcggtaaaccaacgcgccgtcgcccacagatattcccccgccctttttctctttaacctctcgcagccagccagccaccatccgaaaacaccagaacccgattccatcccggttgctgttcttataatacgtggagaagaaactagactagcttcttcgccgtgagggctttggtgccggagcatgtgccatcctgggctgccgcctctgccgccggggtgcgaggtcaagcggcggagggcgccgccggtggcgcgagtgggttccccgccgcccgtgccgcggcgggagcagcctcatcaggctcagccgcaccactactgcgtgtgctcgcccacggcgcaccgcgggtcgttccgctgtcgctggcaccgccgcggctactacgagtggggcgcctcccgccgcaggtagggcaaagcccgttcggtgggtgacgcgtgcgcgcatggtggaaactgctcgacgcatcgccggccagctgcgtacaactcatggcgtcttcttgcgcatcatgttcggttgctcatgtgtttgtacacagacacacagtgtacagttgttcgaactcggaaggaaacacaaaacaattaaataagcgtacattactctatagtttctttcatccggaagtgcgtcattagtggattataattcataccagaagaatagcaaatcgtgtataagactacaagagcgtctgagagtgtaacgaattctagctgactagctgtcagtccattgtgatccggcctggccctcccttcagtgagcggtacagaggcctggatcgcttgaagccgaatatgtcagtgattcggtaagttttgggtgcatcagcttcggcaatagccttcttgaattctgccaaatgtttgccgccgaagacttgtacgcttaatgtcttccgttgaggtgcaccaattcttatgtactgatcaaaaaattcgatgaattcttctttcttgagctctcttaggagagatacctgcaaaagaggtatatcgcacaactcttttcttttctttgagaagttatcctgtgcttaataacctgttttcattatattcgataccatcaaacaattaactatttgctgaaaacagagcacttacctcagaccttcctctatcaaactggagagttcctgcctcaatctctgcccaatagaagtcggattcctcccacaaatttttggacttctccagtttcgaatcaataagtgattttacatacctctgcaaaaagaatgtcatattaagtgattttacattgatgtgcaaagaacaaatttagataaattcaactataatgcatcatatatccctgttcttttatcgattacaacccctccaaattttgtatacaattatgcatgtggaagtttaccccaaaatgaagaagaattgaaagaacatgatgtgagcacttcaggaagagaaaagaaaggaagtgtcatgtaaatttgaaaacacgaaagcttgattcaatggaagctaagaaccttaaaatccttgtctgacaattcatggattttgttttcaaacatcttgaagaattcatcaactctagcatcaagatatgaaggatcctaggcgttcaacataagatcagttagagagaaataaacaactatcatgccaatcattctagccttgaacatgtacctttactgtggactgaataacaatctcgagtgccctgactcccctatcagatctggtaaacaaggatattcattgtaagctaggatttaaatggtcaatatctcctcaaaaggcaaagtaagaagcagcaagtctaagacaaaacatctgctacgtaccttacataaagatctgctatatagccaagctgctcaatagttcgtagctggttggcggcaggctgcctcgcaattaaagcgaacagttgaagtttgatatttgaaagagcatcatccagatgaacctgaatataaatatcaaactatgattggcatcctcacatgcttctttctacatatcatcatgttttctacttttcaaacttcaaattcgtgagacatcacactagtaaaataatagccctcatttcaagttaaaattttccgctcaaaaagatattgaaaattaggccccaaaaatgagctataaactttatacatcttaaacttgatcaaaattctcgcattgtcactcttttttcacgtcaaatgttgttgagtagctagaacatcagttggtggctcaagtatgtccccagttctccaaaaaagtcaatagaacataatcgaacatgtcactgaaggaaactatgcgttatgtcccttgtgctggttcagtcacaagcaaccatttcaataagctatagttactgacgaattccttttcattcttggctacattgttcaggaatttcacattaagaaattattttgatcatgtaattgtacttcaaattttgttgtggttgaatgagtatttcatattactttgcatgccagtacgatatgtaataataattttagcaaatagaagtaggtaaagcctcaagtccactgaattttaggaacaagatcaacaatttgtaatcagtttggtgaacattagttcagaagttagcgatcatggatcagtaatgtcttttgttaatagtagttgcatcccttgcacgaaagatgaggcctcagggacatttacctgaatatgttggactactgatgaattctcattcttctgatttaagccctcaatttggtggtagcactttaactcattttcaagggtgataacccttctaatcagatattgtgatggagacattgatttgaacacagacttaggggtattgaatatagtatcttcaatctcctggacaatagatgtagcatcatttggttcaatgttccctagaaggagaaaagttaatcgataagtacgactggaaattcatcctgttacagtccttagcaaatataaatacatgatgaatcgactaacaataacttccacctaaccttgaatatagcattccaaaaatgtcttcgatagcaaatgtggtatgaactttgcaagagaatctggttcaagcttagaaagagcttcaagtttctcaacccaaggccaattttgatcctccaatatcaaggagagatagtttgaagcttgatagtacggttggctgaacttgaaattttggtagtccttgacagcagtttcctgtgatggtaagatgaaataaatcaatgaaagaaaacgacattgtcaaaagatcctaattggtccgtggcagagcctgttatctacagaccgagaacaaagctcattacaaacaagttagaccaaacaagtacatgtgatctgactatttttgataattttctggcaggttcaaaataatacagcatgcggaactgaaaacagtaataagattactaaattaggagtatgaactgttatttgtgatatttgctttcacacgtttgaagcttacaggatatggcacaaaatccttcatgttgttgtaattaaaacattatttcccccaatcttaatgaaacaaagctttgatcgtctaacaattacaacttgatagataacaattgcctaataaaagtaaaatccagcggtcgaaaaaaaattgatgcacacaaagttcaaacaaagagaacaattaaatattgaaacctaaactccaaaataactgaatctacctaccttcaaggcacaaaatctgttcggtttaacttcaaagttagatatatgcttcataatggcatctagcagaatccgcattttgtcattgtaaccacctactgagaccttacatagaaagtaaaaaggttttagtttaattcaaactatcctaataaagcaacctaatgttgcatgaacaatgaatgtttttttttggctggaacactccttggaaactaaatgagaacaataaagtagttcactgactaaacctggaatccagcagaagtgcgatatattgaatagaataaaccagcaatttgagcatcatacgctgcaaaggcacaaacatttcgtaaatacccaaatgggttattaacatatggataaatatgctaatatttgtactatttgtgaagtggtgctaaccatatgcattcaagtaatctgccaacaaatcaacaaagagactcgtagaaatgactgcttcgggggaatggcttgttaacggacagtggaaatcaattacaatgtgaacctttggagtggagaacagcatgtcgggcatataccacaaccgtgaaagcggtgtctttctcaatattgctggaaatttaacctgcaaacatttattttgtaagagatatttactatatttaagattcagcaattcatttagaattgtgctaatgtggggaacaaacacagacgaggtgatttaaatccaaccttttcatgcgcttctttgagtgaaaaatcttttggaatgaaaatgttaggctttgggatacagagcttctcagtaggagctttttgaatccattgctgccaaagtagaacaatcactgacaatatgttctagcatattatctctatggattacaataagtagccacattctagcagtatgtaatgtggaataagataagaggaaaactctagttcaaaaaatcaagattattcaaaaaggacaaacctgtatcatggaaggagtgacattttcaacagaataagctgtacaataccatggctcaacagaatcagttgttccttcaaactttttagattcccagagtatcctgaagagggagagagagaaatattacataaaaggaaggggaaagtcacaatatttagcttcgtacggtattttaagtgctgaactggacatttgtcagcttgtcagaaaataagtgggcaagtaaatataattgactaattttgggcctaactttctaagatcgcatatctggaagaagttgaaaccagtaagaatgacaaatagtgatgcataactcttaaacctattaccactttttacttcagaaaagaatgaattcataaatgtttgtgtgttgagatacctaaatagtagatactgtaaatagataggaggcacaaacaatgctgccatgtgaactgcataaatgtaccttactctttcagctgacaactcatcaagtatcatatttattctatttggagcatacttggacggcaatgatgctccaaccagccattcttctggtgggaatgactgcaagcagttcaaaagatctttcatattgaagatagctaatggactacagatgaaaggtgcatttctccaacatttcagtacaacattgaaaatttagacaatagaatagttggtaatcggtgttatcacataatgctttgcgggaggtgtatcagcaatgaatagaattgatcatatggaattgcaaaccatacattatgtacttaatgaggtattgagaagtatacccgcatggttgttacaatatctgtcacatagctgattggatgaactttgtcctgataatggaattccgtttcatttatcgccacaagctaacacattcaaaaacatgttaccatcacattaagtttatctatttaaatcaatcccaatatgctcaagacatgtagaaaaagcttgatactataaataagtgatgtttgaatttgttgatgatgagatgataacttgaaacataatgagatcttgctaaaagaaagtacgactcatatgcaaatgtttctttttttttggaacgtgacttgtatgcaaatggttgtagtgtagttgatagagtctattgtccagaattagaagcacatctgtcctgaaccctcataagttctcaaaactaacaggtcctatactcctattcggtaaatatcccatttgttaaccaaaatttatattccttatagaattcactgaatgattaaaacctgtaaaatattcccaacaaaggtcaactgacgttcctaaagaaaacttttccaatcaagatatgaaaagatcagaaactcaattatgtggaataactcttgtttgggtagtttgggaactctagaggaaaagatcagaagtcgtagaagtatcagaacttctaaccataaaacatggatttacacactgcgtaagccatgttctttgcaattacctcatcatagatccactcatggatcccattttcttttagtagaagaatatatttgaagaccaagccaatgatgtcttccatgtgttctgaaatcattgcatgtgcacgcaagaggcttaaataataacaaaatgtgcttaaaacaaaatagccatgttagttataattaaagatagaagctgaccatgaccagcatcagtgagcctcatgctaattgaaaaaaaaggagtattgggcactgtcactgccctccccggccgacaaattcatagcccatcctaaagtagtcaaaattgagcatatttcacatgtagaaagaataaactagagtgactatgagtagataagggaggcaaaagagttgtacagcaatcaactggtgaatgtacttgcctagttcctttatgatatggaagatggatccctcgccttcatgctcaattaagtgactcaaataatgggaaggaccttctttgtaaaagtggatgttaggtgtaacaggccatgatatgtttaggtaatcgccttcagatatcgggatagctttgataacaagctgcacagcaaatttcatgtcatctaccatcacacacacacacacacagatatatatatatatatatatatatatttgaccgaaccatcacatatattttatttttagtgattgttgcaagtattccatcttctccattttccacaattggtgttgcttcaagtttctacctgcatatgctcttctgaaagaggttgacttgggcatttgaagcttctctgatcagtgtttttgatgtcactaaacatgtgctcaacaaagctttggatgcaatccaggctctctaccaaaataaataaataatctcagtaacagataagtttgtatgagaatggactaaccagtaatatttaccctttccataaacaacaaggtgcataaggtttgctgaataattctcatagaacttcaaagctcctgtctaatgtccaatcccctctcttttggttttgtttctagcgtttcacagctccctgatgcattaaatgacaaattagcataataataaaaatataaaacattttaacttgttttttttaaaaaaaattggaatagtatttcatgcaaacgggatatacaatcactgcagaaaagtagctaattacaaagcacaactgttgggagaactgaaccattgtatgatatgaatttagatttcagaattgacatgtcaattttcatgaaagtttgttcatatttcaatgtgacctgaagaaaattgtggtctgcaaaaccaatataacagctagattttagcctgtttggatcttcactttgttttctcacaagaaatgcaacccagtaatcttaacagctagcaagatgactggtaagatatccacaatttctgaacataactatttgcttaccaatattgaatttatgataagggtgatcctttgaagccagatgtttttggagctggatgggggaaaaagtggaaaattaggtaacagtgaagcatgtgctatgagattcatagcaaaggaatggaaagtactgtgcatgctattttttactttcttttttattggaggaccatttacgtgcctatagtctcaccaattgtttatagatatatttatataaggaaacacgccttgtaaataaagaataaacacatattgatctgtgagtgaaaaggatgcatgatcctatgctttaatgttgcagcttctaatacagtcatacatatttggcagcgcgcatggaagaatacataacatatcaactaccaaatttggaatgttgcagtacctgatacattctccagctatcagacaacaagtttttcttgtgttctaggacgaaaaaaaagcaaagttagccaaaatatgctttttactactctccaaatcaaactgtgagttttgaagtgtaatgtaatgttaaccacccacaccaaaaaagcataacacgatgttagatacaaatagcataaaaaatcaccatgtgtaaagtgaataatcagaacttaccagaatcaacagccttaatctctctaagaacagcatcttgcgacatcaatggcttaataaaaaactgtgcaaatctgcacaaccgaaaccaccaatgcaaattgttattttctaacaaaaagcatgaaaaatcttcagaacaaaaaccaccaccatattcaactcacacgataaatacacgtgtgcacacatacatacattaaatgaactaaaagtattaaaaaaaaggtcttacctgtctaatgcttcttcaaaattggccgcattgacataaaaaaagaaagttgttgtctctgaatatgtataggcatcgcaatagccaccgtgctgatattttttacatcaacccattgtcaaaaacatagcctaggtatttccaagcattataatatttttgttatgtgtgtagctctttaacaacttgtggcatatgataggatgaggattacaatgctattgctcatcaggacattgtccttccgcttaaacagcaccgcacataatgccatgctggcaagcatggacattagcttcaggggaacacaatgggatataacatgactttagggtcacgaccacggataaatagcatttggtctgcagtttgccagtgtgcacacatgcaaaccagtcatagcatagattactcacagtattccatattagaagtcgttttggatttgttctaggtcaaacttcttcaaacttgactaagttcatagaaaaataaatgtaccaatattttcaacacaaaacaaatatactataaaaatattcaatggtggattaaataaaacaagtacctctatcatatacttcgagtaatcattttccccagggtatttctcactggcataaaatagcatgtgttctgcaaacaagaccatgacaataaatcaagacaagagaacagataaaaaactatggtcaatgcaggatttttttcttaattcctgcaggaattaaacttaaattgtgtgaaatactatataatttctgtgaaatctatgtgttccaaaagaggcctaaacggttactgaattttgaacaagtcagcattttcttcacaaaaataagtggttttgctataattatggcgacatttttgctttgattacagtcaaatttgatttaatctctctttctatatatatgtattagctagtatagctttatgtatttaatctctctctctctatatacattatttagaaattatatttacaatttagaaagctaagtggatattctttgcctttttttaaaaaaaaaaagtagagtccaatccaaacagacttgaaaccagaaaaa

SEQ ID NO: 81668 - DNA, 13668 bp, Oryza sativa
accgggactaccaatccgggactaaagatcgctatctttggtacaccaaccgggacgaaagatcgatctttagtcccggttggggttactaaccgggactaaagatggctcagccgtcccggttggtattaacaaccaggactaaagatcgagctgaccttttttttttttgcatggccctgttgccgcatggtttatatatatatatatataaaccatgcatatatatgtttcagtacatatatgcatatatatatatatatatattatattatatttatatatgtttcaatacatatgtacatgcataatatatatgtatttatacatatatatgttatgcaaatgcatatgtatatatatatatatatatatatgaccaaaatatatttacattatagaaaatgtgtacacatgcatatagaaacatatgtagtcatgtattaattacaatccattatatgtcctagctagctacgatttcgacgtagtagtagtcgctagctcagaagctaaggacctatgaattgtatttccgtcgtagtagaattcacccttgggatcaaggatttgttcgttgatgaatcccatgagttgttcttgaaccgccgcgataaattccttgtgcgtggtcaggttatccctcatgcgaataaactatatgaatgtatgaaattgattagtaattaaacaagaaatcaacacgtaatgaaattttgaatttatttgtacgtacattgagctctcttatggtgatgatttggtctgcaaggcagtggcaatactcgcacacgtaatagccgcacaagttagttcccttcttttgctttgcgcactacaaataaatgacaaacaacgagagatctaattaatatacacttgtatgtatttgaatcggagaaatataaatgtagagcatgtgtactcacaggaaatttgaaattccgcctaagtctttctctccatttgccgcggaccaaatgatggaaccgataccaagccttacatggagtttaaagatatgattcgtagtagcaattaacataacaagattttcttaattaacagagaaacttatgacggtacctgtctataagttcgaaaaccttgtcaaacgtagactattttttatccattaagtcatatacgttgacggtccaggccgacaggtcgaagagtaaaagcacccagtggaatctgcaatgtgcgtgggatgcattacatatgaaacacttagcaagttcgtacgggaatgaaatttggtataggaagacaataaaattaaactaactctgtgttgtacggcaacagtatgaacgtcttgtaatgctgtgccttcaggagatggacgagattgtcctctgtggcttgcggatattggtcgagcattgtgacgtttactttatgagggtcgatgaatccaatatcgaaaaccccccgccatcgggccctttgaatctccattctacaacgataaaagggagtatattattttctatagtctacttatatacaaggacctaattaattaaaggagacgtagtaagaaatctaactgaacgatatacttacaaaatccagcaactcataatagagacgtcgagggcgtccagctggtatagttcgtagattcccttgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccgggatcagtaataaattcttctatcgtcatttctttaccggtcaccaacggctcgatctcctggtttggttgctctccaagctgagggactgatttggactttccagaagatgctttcttcagcgttcgctcatagtccgatagcttaatggcctccttggcaggtgcagacatacccctgaagaagttcatgacactcgggtctatatgaatcttcttttctggacttcgaggcttgaattgtctcttgacttctgatgccacgtaagcgtcaagctcctcttgcgtgcaatcgtaccccgggtccttgttcttggcggtgtcaactttcgccttcttcgttgcccttgtgtgggcaggcagtggagcttggggggtccttgactttgaaggtgccagaagaggagcttgcggaggagtcggtgtaggagaccaaggaggagtcgatgcaggagcctgaggaggagtcggtgcaagagcctgaggtggagacggtgctggagcatgagaaggagtcggtgcaggagcctgaggtggagacggtgctggagcatgaggaggagacggtgcaggatcctgaggaggagatggcagagccggaggagatggtgcacgagacgccgcttgtcgcccagggaggatgatgtaccgccgccatagaataatggcatggcttgtgtctcgtagatgcgtctcaccttctcctccagggtaatccagctcgagatcctcgtacgcgccttcgaccaactcaacttcgaccttggaatatcctgctggaatcggcctgcagtggtaagtacctgaagggtccgttgggatggccatgcccgacgccaccttcatgtggtgagaggttatttattagtaatcaacatatataagcagcaactagcggaatggtcaaatctaaaatatataaactacgagcttacctttattgataagttcttgaaaggaatatgcagctcacatggtgtccgctgagtgatgtcatcaatggggcaggtggattcgtcctgggtttgcatggcgtccatgctcttcttcgttagctgcccgtcaacttctcctggatcgtctcgtcaaatcttgtatcgtagtactttgcaaacagggcatgcttctaggttctcatactcctcaccgcgatataggatacaatcattcggacatgcgtgaatcttctgaacttccagtcctagcgggcagacaatcttcttagcctcgtacattgtctcgggcaatttgtttccctccggaagaatgttcttgacgagtttcaataaatcgccaaatgccttgtcactaaccccattttttgccttccattgcaagaactccagagtggtatccaactttttgtgcccctgctcgcaacttgggtacaacgaagttctgtggtcctctaacatcttgtccaatttataggctcccttttcactttcgcagttctccttggcgtcctgcaacatctgaccaagatcatccgtaacgtcgttaccatcagcatccatttcctcctcgcctgtttgatttcctttaaatccaacgtactgagcaaagtccgaaatattgtcgtcttccacttcatcttcttccatttcaacaccttgctctccatgggatgtccaacaattatagcttggcatgaaccccgactcaaacaagtggaaatgaatagtcctggttgtagaatactccttctgattcttacacttattgcatggacaacaaataaaacccctttgcctgttagcttcggccactctcaaaaaatagtgcacgctgtcaataaactcttgggaccgccggttagcgtacatccattgccgatccatctacatgagtcaaaaaaaaatcgtacaaaaataattattcttacaataatgacagtcatacaataattataagataattacaaactgtttcaacagtcatacaataatgacatatctttattcatataaaaatcataaaatattacaccaaataattcttatttactatttctaaagttttaaactaattttaatatgttttacttcttttaattttcattttagtttgttttctagtattcaagattaactttcactatagttttccttctcaactattttataaaaccttctttagcaaatcaactaaatttctatatattctttcttccccacacaaattttctccctcatcaacttacaactaaattttggagacaaaaaagtgtgcaaaacatagctgcaaatgtaatatgacaaaaaaaaacattggaggatgaagttgcaaaccttttaggaacctccgatttgtatgtaatcaccaaaataaattcactagaaattttggcatgacctcccctcttttttgaagaaattttgaagcttgctcgggcagctggaggaggaagaagacatatatatataggggtgggactttagtcccggttggtgttagatcccgggggactaaagatcaaatatgcccgttaccttttttaaccgggactaaagatcatctttagccccgatttttattgcatccgggactattgtggaattcggccgaccgacgaaagatgagtttctccaccagtgtatgagccaccagccggtagtagctaacaccttctacctcttgcggcagctcgtctcctagccgcggggccgcaccggcgccgcctcccttctggcgccccttcgtgtttgccacgagaagtgagccagccagccaccgtgaacagaacgatgccctgcttgttgtccgcacgaaaaaaaccttaaatctataaagatattagtttttggtgaggtacaaccactgcatcgctcctctcgccacgcaatcacggtactgttgccctgttcatgtgcttgctcgccgttcgatgaacatagctatgagtgtttctagccgtccaacgtacggatggagacatcgcttctggtcgcgtattaggttccagtcagccatcaggtctcttccctgtttatcgtactagtgttgctttcctgttaatctcgcgacacatgtatgtgagcggtcgtgcaagcatgcagaaggaggaacggcgatttcctgggacgacgctctgcaactaggcatgagaagtttcgatcaaagttctataatctgttcacctgcaattgctactcattttgtggcaaactgcttgaatcggcttgcctacaatggctccgtgaagtggaatgtgttgaatgtggctgctcttgtttggttgcatggccaatgggtggataaaatgcctgttgttcgttcattctttccttttctaactgtgacacgcgttggcatcttaatggctggctggctttcctaatagggatggcagccttctcttctctcttgattggatggtttgtatttgctgtatactgcatgaaggatatagtgtgctgactgttttaaagaacatttgcactaaatcctgtgatgaattatggaacgaaccaagaactcactgaaatgattcattctcatgattatcatggaataaatcacaccttgtattgaacttggaagaaaacacatgttacctacgccacaaatgcgctacatgttatgatgtcctctgtttttttttgtgatcctagatctaagttggtggcatcctgcaaacggtggattccttgttcttattagagtttttatttatccattgccatcgccgttctgttaatctgtcgatcgtacgcaaaacgatggcggttgctcactacaagaaaaatactctgtatagacatttttctagtactgtagaggcacttatcaaatacctttacaacaatgtagaggcattttaaaaaatgtctaataagtgtcttatggtgaattgtctctacagacgaagagacattttataaaatgtctataagatggtagaggcattttttagagacactaaattgtaccgcaaacatataaaaccagtccaaaaaagagaataaaatagtttccttgcttttgataagtcttgaactcatgatcttttggttaaatcattctaatctttgatacactaaccaactcaactccatgtcattacttgtatacttgttcctttagttacttatatttaatcctttagtacacattatcattctaaaaagtgtctctacatagtttaaaatgtctcaacaaaatgcctttatatattagacgcattttatagtgccgaaagaatgcctctacgagataaaatctaacaaaatgatataaaaatgtctctagagtaaaagttttctaggcaatttttaaagtgcctctataaagtgtctctacactataaaacttctgattttagaagcaatttataaaatgcctctacaaaagtgcctctatacgaggtttttgttgtagtggctgcaccatgttcacaaattcacgaccacatggcgcggtgaaaatcaccggccagccatcgtgagagttcgtaaggtgacacggttgctttacgactttgtcacgagtgtgtggatcgcccagcaaataatgagctagaccaatcataaagccaataactcctcctgctcccacctaacctaacgcgacacaagaaaaaagcacgcaacgggagggagacatgcggatacgataccggaccggctgccatgccaactcctttgcctttgcgagcaacaataatctcgctgaatttggaagaagccggcccactcccgcgaaaaaagaaaaaaaaaacagagcaatgaaagcaagaggagccgatcacggccctgaagtctgaatcgaactcgcgacgaccggcggggcaaagtccaaaatccacacgagcgcgaacccgcatcccgttcggccacgtctccctcccgcgaaatctgggccgtctgctttgtcacttctcccaccctttatcgtcataattaatatttgtgatgaataaattgactttgcaaataatttaattaatgaattggtttaaagatgtgtggatgttggtgtgagtgtgtgtgactaattggggtcatgttgtgatatctgtgctcaggaacggttgtcttgtctgattgtgtgcaggtgacttgaggtcaaccttggtcaatggtgaggaccataactatgcttagggaggaccagaggtttagtgcagtcaggataccatgtgagaaggtgactagagtcaagattcttgtatgtcaacttcggtcaacaatggggatcgggactacactcagggaggagttgaggtccagatagttaaggataccagatgacgaagttgaatactagatggcacatggtggatggaccccgtgtggaagagatcttcacaacgggcttcacgatgtgtgtgcagcgtcggtgtttacaaagaaaattggaagaagaattagagactatggttgctacagtagtatgcagtatgcacgtatgtgttgcacatgtgtactgcatgtggttgtcgacatggtccaggaagcatatgcatgtatgtgtggtgcatggcatccacatgtgtgttgatctgcggaaaggctagttagcgcgcgccggcggcacgcgccctccttcacgctcttttttttttcttttttttttttactttttttcctcactttttttctaatttttttttatctttttagcatgttttgagtttgaaagtttttaaattttgagttgaaaattttcaaatctggatttaaaagttttcgaatctcgatttgaaaattttcaaacttttcaaatctggatttgaaagttttcgaatctcgatttgaaatcgaatctcgagttaaaagttttcaaatctcgagttgaaagttttcaaatctcaaattgaaagtttttaaattttttcaaatctggacttgaaagtttttgaatctcgattctcgagttgaaagttttcaaatctcaagtagaaagttttcaaatttggatttgaaagttttcgaatctcgagttgaaagttttcaaatcttaaattgaaagttttcaatttttttcaaatctggacttgaaagtttttgaatctcgattctcgagtttgaaagtttttaaatctgagttgaaagttttcaaatctcaagttgaaagttttcaaatcttagttgaaagtttttaaaatttgactttaaaatttaaaacttaaatcgaaaattttcaaatctaacttcaaaaattttcaatatgttggtaaaaagatctcccaaaaaaatctccagaatattttcttaattactaccattagtgttaagtatattaactaatatacgtaattaagactaaaagggaggaagtgctcgccaggtccttttcccggcgcgcacgcgcgcgctagcactccccgttgatctgattggttggtttggcacccaagctggtctacacgggtagatggggctcgttggttggctgcatgccgagtgggctggcccaggaagcagcagcgggcggtgaaggcctacgcgcgaggagatcgagtcccacttggtgtgattatctgtagccggggcggctgcaggttttggaaattgtattttgctttggaaatcgagggatgagtcctattggaaatacgagctctacttctactctgagtaggagttttttaagtataaatagatgagaggttgaggctagaagcatatcagctttttgggagagaaaagttagggtttgctttgagctttaattctagttcaagagtttgatcctagtaggtttgtttggtcttgttcgatcctacattatcatcaccttccgtggcttccgccctccccgccttgctcgcctaatccgaagcccaaactctcctcgtccgaagcccaaactctcctcgtccgaagcccaaactctcctcgctcgaaaacttgccgcctcatcacgccggagagcatcatcaccgcatctcccaccgcagcagccatgaacgggatcggtgagcactcgcctctcccctatttcactttttgtcgcgctctggctgttttttttgggtgtttccgtgattggggtttatggcttactgtttgcggcggcgggtttcttatgcagagctctcatcaggggacaaggctaaactcgtggagacgctcaaggtataacctcttcctctcttgctgtgatgatcacttcaattggagcgatcgtgcaatgatgttttgttgattcggtgatgtgcttgtgcagaacaagctgcaggcattggcggagcaacatgttgacatgctcgagagcctggcgcccgcggtcaggaagcgcgtcgatgtgctcatggagattcaggtaaagacaaaactgctaagactagagagagcttcgatttgtggcatattttcgttcatcctactgtttattatgcaaacccattgtggcatacatagtgacaatatcgtcaatgaaacgagtttttgcatggtttaattccctctattccagaggctttcttatacatattttagtattgttatgttcgtgaggataaaacggttggattagatattttatcctttattatctgtagttgcttctatactcttaagaaattacaaattatgctctcgtatgccagcgatatccattgatttcgtaaatagatttttttaccttagccttttaatgttatttagttgattgtgtatatttactacaaactttattccacatatttaaaagtttctaaaacatgttaaatgtttcagagccaacatgatgaactagaagcgaagttcttcgagtaaaaagctgctctagaagctaaatatcagtagctttatggaccattgttctcaaaggtaacacatactttttgttgcaatgtaacacaatctggccttacctcacttatctttcctttcaaaaagagttgcatgttttgtgtacatgcaactcttctctaagaaacatatcttgaattatattcctgagttttcaatatgatgtgttgttctggtgaccttttttgtgcttgcaaatttccagcgttctaaaattgtgagtggtgttcttgaagtagagggcgagaccgaagaaagaggtgatatatcattcttgttcatacaataggtgttctgggcatgtctggggttattgatagattgggtacccttttagttttttctataatcttgtcacgatgctttcatgcagaggaaaagggtgttccagatttctggctcaatgcaatgaagaagaatgagattcttgctgaggaggtgagaggcttttctagtttgtaaatttccactttccaaagttatcaatgtttatgctgtcattagaacttgagcttatttatttgttaagtgtgccgatttgcttagtgccgatgatttttgtaatgaatatttttttccttttccactgccatagatccatgagagcgatgagtaagctctgaagtaccttaaggacatcaaatggtgcggaattgatgatccaaagggttttaagtttgaattcttcttcgatacaaatcccttcttaaaaaatcaagtgctgactaaaacataccacatgatcgatgaagatgataacccatcctagagaaagcaattgggtatatatcattttgttcctgcaaatttgtgtttttgttaggatgaaaaaaaatctctcttgcatttcctatttgaaatattccttgactgctttattttttaggactgaaattgaatggcatctaggatattgtttgacacaacaggtgctaacaaaggagagttcagagagcactaaacctataacaaagactgaagaatgtgagagcttctttaacttcttcagcccccctcaagttccagatgatgacgcaaaaaatgacgaatataccgtaagttgaacaagtatttattctatatacattgattcctgaaacattatgcctaaacttatgtcctttttggttgctgcttcttaactggctgaagaattgcataaccaaatggaacgagattatgacatcgcgtaagctattatgctccatttcattcttaaccaattagaattggttttttatttttggaaaggagaagcgattaatattgtgttattatgcatgatgtatactgaaatacacaattctttaaattatttatgaacagcatacttcctgcatatattatctacttataaattagcttgcccatgttgccagatctactcttagggacaagattataccacacgctgtttcttggttcactagagaggctgttcaagacgaggattatggggcttcttgggtggatgatgaagaagaggatgacgacgatgatgaatatagtgatgaagaagcataaggcattcaagtgtcgtttgttctactggggtattagaaatttagatgcttttatctccattgttattcctctattttgaacggaaggctagcagagttgatggacagcagcatgagcgacctgcggagtgcaagcagcagcagtttttcttttcctttttttatcttagttctccgaagtcagatggagtgaaggatatgtaactactaaaagttgatttttcaacttttctatgtgcttttttttattttctcccattgttgccatatactagaagtacaagcgcaacgcgacgccgtgcatgctaacatctacattgggttagtaagaggcatatcaaaagcaacaacatcaaatcaacgccaagatgaaggaatcctgaaaaagaagtcccaaattttcatgcttcaccaatcacacacaacaacacaaacacagggaggcaccttacccaccggaagtccaccatgccggcgacgcctccttcctcgagcagctccactcctcctatgtcgtgccctgtcccgctaccttagttgctatatggccacaaccttgtgcagcatccagcctcagttccggccgccagcaacggagcagcgccgctgcaagcttcagcgtggcaacggcagccaatgtcactgccaactccggtggtttcctcatctggctggcactctaccttgtaccctctccccgctccattcccaaaggcggccggtggggagaaaggagcagcgtggctacattcactatgaaaggctttgagcaataaacaggattaaccgaattcggtcttgccttttcctaataacaattcattccttgagttttgactaaccaaattttgattgaatgcgcacccgtagacaggaatcaattatatagccaatttatttactatggcactgtaactaaacactttctctgaaagtttcctgcatgcttggaaccaagaatatatatatatatatatatatatatatatatatatatatatatatatatatatatatatatatatatagctgttagagaaacattgatcccaattgttgtaagtagaagtacatcactgaaacacatgttcaacagaacaatttccaagacaagctcatccctgaatcaaaacttacaatgacactcatggtaaaacgagcctgatacaatcacataaaacaaaatcaattgcgcaggataaacattgaaacaggtatgaacatgaactacgagaatcaatcaaaacattgaagataaaatattttcttccttcataacataatttgtgcaattgtcaagaatcaagcaatcgtatcacaagataattcagatattcctcaaatatgattcttaatgagcttacaaagttacaacttacaaatcaacaataatgaatggagtaaccatcacctcggttttgtcgataggcaatataattggccaggtgtagaagtcatgctgccttctcttgatcaaatcctgaaaaaagttgttcccttgcatcagaaagcaacttttctgcaaacccccgtgatttctctagcccaagtaattttgggtatatcgtcttgtcactcgccaagtccttccccgctgtcttgccaagctcgtcagaagacatggtcacatcaagtatatcatcaacaatcctatcgacatcgcatacatgcgcaaacgttcaatctgctcataagagcgacctcccaagattgccccaataaccattgatgcctcaagaatttgatgcctattcttttttctaattaaaatgtttctaatccaaccaacacactgtcatttcttcagtaaaattgtgcttaagcagctgtgagctttgagtctaaatgatatctcgagttaaatcttgttacttattttcaagtattataccacaagagggagaggcaaaagcctcacctcatggtcgcaatcgaccatctactgcctgttgccaggacgcgagctgcacgatccctgcaaaaaaaaaacttggaatagagcggtcgatgagtcaaagggggagttctttggtttgggggaaattttggaatagacctggttgttgatggagctgacggcatcgtggtccctccaagcgaagtcgtcggtggggaggacgacccgccgagctcctacaggaaggcgcggcacaacgtggactgcggaagggccaagcagacagtcagtacgcgtgctcgtcggcgtccctgtaggacttgcacgaagctggcgaggtggtgctccatgttcagctcaagctcgttgtcgccgctgccgaccacccgccggatcagcggctcctcctcctggttggacactccacgcactgccggagacaccggaactcaccctccaccgcagaaggcttgatccggtggggggagggcgaacgaagcggaggcaggatccgcgacgaggagggcagccaccggtggtgtgacgatacggtggccgggcgggaggaggtggggaatgggaagcgattgggggtaggtgtggttgtttttcaa

SEQ ID NO: 81669 - DNA, 48125 bp, Oryza sativa
  unsure (1)..(48125): unsure at all n locations
cgtgacttggccggccggacggcggaggatgggatctcagtatctgtctagctatctcagttccagggtagcaccctctgctctataatcttgtagagatttcgtggcattaattatgtttcgagttgttaattagattttcaatccagccattattagtttgcgcaagtgcaaaccggcctgcaggctgcagctagaatctccagtttttaattaataaagtaaatatcaacataggccgaccaatccgtgctactggatttgcgcacagctgcacgtgtacgaccgacgaacgtgcgtcgtacttgcgagagtgtataccttcacatatgttcaaccatatagtaaactccatattgtagcatatctatttttacaagcaatatataacatcattgacttttatatatgttttatcattcgtcttatttaaatttttacaaatatatacaaatataggtaatgtttaaagaacatttcaatgataaattaagtaagaataaaataaataataattatattttatgtttaaagaacattttaatgtttacgtgcgtacgttcgtagtagtgagtgtacgtgcgttgtgagtgtctgcattgtactgtgtaattcttaaaaaaaataataatcatatttttttaataaaataatagtcaaacatattttaaaaataaacaatgtcgcactccctccgtcccataaaaagcaacatagtattaagatgtgacacattttaatacaacaaatctgaacatataggatgtgtcacgtcgtagtacgaagttgaatttttttggacggatggaatatattataaaaacggaaagagtacaatatatcttaggtgtagctatatttatggcgccatatttttcatcaaaaaatagtcggcatgtatttatattgtaagtccctaaattacatatgtaattttagtgtatttacaatgtaagtctcaaaattacatatgtaagtattaaaattatatatgaaaattcaaaaattacatactaattacatatgtatgtggggtataaatgaggtgtaactactgtgtaagtgactgaaaaaaaatcaactgtaacatatggcgccatatttctagcaactccgtatatctttagttttcgcataagaatacacgtatatggtcggtacaattatgcaactccgagggcaaagctagcgctgctgcatcacggcgcgttaggtcacgcaatgaactggataaccaaatctcatttttcatggcgtataatttccaaaatctcgatgaaagtgactggagtactatatgctagtagcaagtagtacgtatattaatttattttctatactagtacagctagctagggtgtggtgcagtgttagcaacatttcttgccgacatgtacacacttgaactcctatggctatggcgttcatttgagtatctttctgcatgcagctgtgtaaacattatctgtaattgttgcgtacgccaataagattagtttgtgctattattctctacaatcatctctgactaatctgtcaatttttctactgtgctactgcgaggaattaatgcacggaatgatcatcgtgttttcttacgacatattgctggtggcggggtgatcgtcctcacatcctgtgttgatagatttggctgatcagatcgactagtcgtttccaaatactcttttactaattggtacagttaatcgttaacatcgtcgtgcaggaaccccacacatacatacatacacacacatatatatatatattttttacctcgtttttcatatatagcaccattgatattttaacaaacatttaactattcatcttattaaaaattaaatatagaaaactaagttataattaaaaattttgatgattaattaagtcacaataaaataaatgataatcaacggcccctactaaaaatgacttttttgaatgggcaccccaatagtttacggacggatcataagtgttcgtgtatgtaaaaatcgaccctcatttttccatacagctccttaagatattcgtatgaaaaatatttttttcgaacagaccacttaaaatatccgcacatgaaaataagggtattttcacatgcgggactcttatctcacccgattgcaaaaaatacccctagaagtttcccactcctttttttattcttcactctctcattctctcccccccctcacccccactccactcctctcctctcccgctctctctccccatccggcggcggcgggcaacgatgatggtgagggcttcctcctccccccctcctcctctcccttctcctccatcccgacgttggtggagggttcgggcaacaggggagggaggaggaggggcgcgatggcgtggattcgacggcggccaccctccccccatgcaacggtggtggatcgacattggggaggcactggaatggcagattcggctctggctctagctccagcaacaggagcgggcagacccggctgcccctagccggcttcgaccaacgacggcgacgacgaggagggcggcggtttctagggttatgttttcgtgatttctagtttctttttttcggatttctatttttacgtgcagacgacataagcacccacacgcgaaaatcgtactttcgcgttacaaaaatagcgagttccgtagaccatttggtgtgtgcggatcgttttaccacctgcgaaaaccagattagaccatataaaaaaaccgaagtcatatattaaaaaacaagccacaacaaaataaatgatagtcaacgcgttatatattaaaaaaataaacaaatgtgtgtgggtatagaattaaatttgaaaatacactgtttattcattttttttcttataaatattcgggatgtaaaaaattttgcgtaaatatactgttgatctcgcataaccattgcgcgagaatgacgtgggaatgacatcgtggacggtatcgcgcggcgaaggcgcgagaccgcacggtatcgtgggacaacagcgcgagaccacgcggtctcgcggaatggtatagcgagacagaacggtctcgcgcaagcactgagcgagactggtgccacgctgattcaattagcgactaattatcttgattagcgaattattaattaagcactaattaggataattagttgctaattatcattagttaattgctaattaagtaattaagcactaattaaatggagccggtggacaatttcgctgtttgattccgcgagaccgaacggtctcgctcttccattgcgcgaaaccgcgcgctctcttgccttcgcggcgcgataccgcccatgacgtcatacccacctcggtttcgcgcaacggttgtgcgagatcgacagtatatttacacaaaaaaatttgcatcccgaatattcatgaaaaaaaattgaatgcatagtatatttttagttttaattctaagatgtgggccctgtgattctatgaagaggaccgaacgtagcaaccaaagcagataaacagtactactccccggcggcccggcttaatgccccggatatggttgcagttgcgcaaggaaatcttatgcgtgcgtgcataaggatcgtgtgcccgtacgtgcgtctgttcatgtatgcgtgtgtgcgtagtatatatgcatgaatatgtcacagtacgtaatgcactcgtaagcgttcattctagctatatatacccacatcttacaccatgaaactatctcgtttcaaaatattcctctcagcaaaaaggtcgttgtcaaaccttaagtacttgtgtggtcgtattcctatatattccacacatcctccggtagttttctttatgtagatgtttaatttaaatttgtactaattgggattggacttttctttaagaacgaaatcatatgggcgtgggcacgtaccaccttgacagacaggcacacgctgacagtgaaacggaaatcctaatttggatcggtgtacgctagctcgcgattaacatgacagacacgtgcaaattagtatatatcaatttcccagaataaaaggtaaaaaatcacctacaaggctacaaacacgtatatagtcggatcaaaataatcatcgtgaggtgccaataattaaggtaacggtgtggagcaagaacccaacaaaaccaaaaaccagacacggccgtacggtgacatcagaagagatgttctcgctagctacgtgctgatcatgcaggacatcgttggttcgcttgcatgtgcaatgccgggtgacacgatcgagatgtgatgcgatgctatctcggcgcgagttaatgaggatgagccaaaattagtgctcgcctcatcatatccccggaatttgactgtttgaaacgcctgcgcgcaggatcgatcggctacgttgtctgtacgcgcgcggcgttctcgcgtgacgcactttggcagatccatcccgcaagagatcatctcgatcggcgcgtcctctcctccccgtgcgggccgggacaaaccgtgtcgcgtcacgtattttatctccgtatatctcacggcctgcagtccggctctcgctcgatcgcccgtccgtgcgtgcatgaaaccaccatcaacacatgctcgtgtcgatcgatctgtataccacgtaccactacgactacgcaacaacacatgagtaggtttttgctctcaacatgttccgttttttcccactagaacgtaggttgtgctagcttttaattctggcacaaggttgttgcagcgatgtgcatttatgtgccagtaccgaccatgtgtaccaaactaatcggattgatcgatcgatcggtccaacgcgcgaggtgccggcctgtgcacgcgcctatccattggccgcgccgcggaatcgtacgtaccgctagctgctgggctcgatcggtcgatggaccggccggttccctttcgttgtcccactccgccggcgacaactgtgcatgccggaccgagacacgccggatcctcggcctgagccagcggccggccggggcggttccaccaggtgcatctcctttgatcgatcgatcgatctcctagacatcatcgttgttagtgatcaaagatgtgatgggcggtacgtgcagcattgattgctcggcgtgacgatctctccaatcggagcgatggagcggcacttacgacgagcagagacgggacctcctccgtgtcattaggaaaggatcgcacagtggacagatgatgacaattgacagtctggtaacaatgatgatatccttatattaaaaaaaagaagaatgataggtgatatatatactactacgtagcatcacagtataattgaggagaaggattttaatcactcaacggccggtgagccgtccagaactacgcatcgatcaatcaacgtcttttaacatcgactaaaaatgtttgcgtgccacggttactagcgacacgaatatatcgagtatatagtggagtactacgtgaagggatcaaatcaaggtggatgaagacgtaccgacacgccatcgccttcacgttattacatcctaacgctgtgcacagtacgtgcccggtgcccctcgatcgccctcgtcttataaatgcagaagttgacgcctggcgtacgtgacgggctgaccggcatgcatgcatcgcgtgctacacaggtgagggccggccgggagctagcaacgcactcgggacggcgcgctttaacgcgcggccaaattaagcagcgccgcggaacacacaggactcgaccgatcggcacgggcgggcgcgcgagctaggtgccgaggtggcgacgtcgcatgggcgcatgcaacgcccagcaggcacgcacgcgagagacccgaccgatcgacaaacgtgcgagcaattcgatccgtgggaccgaatcgggcagggggatctctcgcgatatcgatcgatagcgatcgagcgccggcggccacgcgaaacatgcacggtcgttgattagctacgagagcctacgactctagcaaggcataggcacacggaccactggcgccgcgccgggcgcgcgcgcggtgccgggtggccgatcggctagctataggctgctgcatgctggatcggaagggaataatcttaggtcgactccagatcgacgacttaggtaagcatatgcatgggaatgtccgtttgctgctggatggtccagtagatggtcctatagctcgcaacgtacgtactgccattaccagaaggaatggaatgcgatcgatcggtcgatttgccggaacactgcaattaatgctgcatttgagcaagttcaatagtatagccaactgttggctctaaatcatatatagccaatttaatagcccattcatataatagttatctataaaaatatacacattattaatacctagtcttacctctcatacactcataatgtattagagttcgtgttgcagccgacttcaaatctgtagcccgatttcttctctctcttctcttttcttctcgatatgtgattatagctggcttatagcctgctattgtacctgctcttatgctcttgcgacttgcgaggccggtttttggttgctattgacttgatttttagtctttaatctattttttttccgtttgaagaaaaaaaataaaagcattatttatcctttttattacatagaagatgcacacacatctcaacacacgcgttcaaagagacaaagactaatggtagattttttttttactttaatccatacggttctgaccttttaattagataacgatatggacttcaaaatatattctttgactataatttttttattgtgcatataaaaagtaagtaattatttaaaatatttttaagactaacatatgtattacatatcatgttctagtagtctcttcaatccaaaaactattagcaattaaagttttaattgtttgacctctgtctagtttaaaacatcaagaattacgaaactggatgactgtagtactaaaatttgaaagttgtgtatcactccttatttggtttctcctacattactcgatttttttttgtttcagaatataccatctgaaaactcaaaactgcatgtgctattatcttttacttttatgctcccaattcattgtgtgcatttattgtgtaaacaacgatccgacatttattgtacctcccaattcttccctcctcccatctatccacatccactatccgtggagtcgctttagttaggacgatagcatcgttttgtattgggatgacaggaatgcatgcatatctcacacttctgaaagctcggacgcactaaactaaggattgattagaaagagtggtgagaagaggagagaaaagaaaaatgtgcctccataaagcaatatatgggccggtaatgtttctgatttataggataatttaagaaatgttttgtgtgttatggatgggtcgtaatctaagggcccctttgaatcacaggaatgaaaaaacggaggattaggaaaaacataggattctgacaggaatgtaagtgtaaaacagcggattgcaaaacacaggaaaaacataggaatgaccgtttgattggaccacaggaaaaacacaggaatttgaggagagatagactcaaatgatttcttccatgaggttctatctcttgttaaaattcctccaaaacttgtatgggaagaggcattccataggaatttcataggattccatagggtttattcctttgatttaaagggctttgtaggaaaaaaaatcctataggaataaaatcctctaaaattcctatgaatttcctttgaatcaaaggaggcctaactatacgtcgtaggtgggttaaaattttattctgtttcaaaggtgtattctttattttttcacaaaagcgcaaaagaaatgcacgtaagtatagcagtagaaatagtgttttttctgttatataacgcaattgaccagactggccgttaaggtgtattaattcttttattaattggcatattttgatatgaatcatcatgcaaaaaataatacatttgaccagcatcaatttgtttaaaacaatccagataaactaagtaaaacatattacctggtgccatgaaatctttttatgaacgttatattatactccctccatattttaatgtatgacgccgtcgactttttatctaacgtttgaccattcgtcttattcaaaaattatgtaattatcatttattttattgtgacttgattcatcattaaatgttctttaagcataacgtaaatattttcatatttgcataaaaaaatttaaataaaacgaatggtcaaacgttagttaaaaagttaacggcgtcatacattaaaatacggagggagtactatatactaaagctgaagtaaaagaaatgcaacatgaaaaaaaacatttcggtgagcttgaaacatcagtgtgggctgattgattacggcagagcgtgcaagcaaaactaaagccgcagaaatgctttacgtattttgagatgaggctgggaaattaaaaggtatgtcgtcacttgaattttgaagtggaaatcggtactacaaacagtacactttgtgctgtacgttcagaccacgcaacatatcacaggtactgtacgtatatatacgtgcgtacaacacaagttgataatcgatcatgacctccttgcattggtccctatagctaactcaatgtcttggatcgatcaacagtataacaacttatagctcgcgcatggctagctggttctttccatgtacgtttggtacatgattggtgcacccgtatcaagttgcaaatccacaacatgctcgcgatcaattgagaaatggaccactcactcagttcacacaccatgtatgtatatatatatatatatatatatatatccaatcaagccctctatagtgtgactagtactgtctcgatttatttcttcttgatgaacactcaatttttttttttgcttttatgaacactcaactatcttatatctcagccaacgattgagccacatgcttacccttacatcatattacttgaatgttggcgtttgatccttatttggtgaagctcgagattctgagtagcggtgagaattagtttaaaaggacatggattttaagctttgtattctaaattctacaattacactaaatacacataattaattttaaaaataagctgcaacggctagaatctctaagccacggatatctcagagctaatacgcccgactgcaggatgcgatcatatccggatcaccttttatacctatacctatatagagagctagatttaacctagctcgcacgaccaagcacgtgtacgcactacgcactctctaccgtgagttaattcgcgcgcgtgcattaactggagtctggaaatggtctctgctggcctggccggccggatcgacccgggcggccccgcgtcgcatcatgtaacaactctcacaagtcgctcgtatccccacccgccaaccatgtcttgtccctcacgtgcgcgcgagcacgtacatgtgagaaaataccatgtcctccgctccgattccccagcgcgcgcccctcgcccggccgaaaccaatggccgaattctggtgggcgtggcgtgcggtgcagcgccgcaggggtcgtcgtcggatgggagagtgttcggaaaaaaaggcgaaaaggcgcggacgcagcgtatcctgccgcgatcctgtgcaatcgaggatgtggatggacacaagcgacggtttgctgtttgcattgatctctctcccgttgttcttgccgttaggtggcgcctagcgagctacggttggagctagctagccatccacgcaagcagcctagtatgagatatacggagcatgtgtgtgcgcaagcctgcaaggccatccagccgcagccatgccttttgttgacacactgaaaccgagatgttgaccatcagctgctgttattactactagcacactgctagttgcacatctttctcctttttagctgaagatttggtgcagctcgtactttggtaaaatgccttcctgatcccgcagaaagcgagcggattcggggtaaagctcgatgctgctgtagattctccccatctgcatgctctaacgaaaggttggtcaagatacggaaacgggagaggatctggatttcttttggttaactacctgatctcatctccctaaaaaagctagttagcgactctaagattggattatagtacgtacatttgggccttccctcgagttaacacgcctaaagaactcatctagaaagttcatcgcacatggcagcaccaggacggggagccggccgggcggcgtacatacgtcgccttagatcccatttgccaatttggatcatatcgatcaaagtgaactaacccagccagaatgcaagaggagaagtgagatcttgttatctctgaacctcttgtcgttggttcagtatgatataaattcaggccgatcactcgatccccgatttgtttcccttttttcttttgcgattggagtacggatctagttgggcgtggctagctgcctgcctggcttagctgtaattccgaattctgcaccggccatcatatgctggggcgggcgagtcaggcgcgaccgcgcgagatgtgcatgagtcgtggcgcgtcacgggagttgtttattcagggggggcggccgtgttgtgctcctgcgtcactcagctttttctctctcctatcctcctcggtctccccccctttcccactttgtcagttcgtcactccaccaccgcctctctctccccgcctctcgcctataaataccgcccccctcgcctcgccaccaacactcacctcaccatcatctcttctcctcgtgctcgtcactcgcgagcaaatacatcgccatctctcctcctcctccttgtcgtcatagtgcacgcaaagaaacacggtttgcaatggcgtggtgcttggtgttcatggtgttcttgatctactgcctcatctcgactgtcgggctgccggtggcgccggccgacgaggcggcgatgcagctgggcggcgtcggcggtgggcggctcagcgtggagccgtctgatgtgatggaggcgtcccttgactttgggcggctcaccagcgccgagccgctggccgtgttccacccgcgcggggccggcgacgtcgccgcgctggtgaaggcggcgtacgggtcggccagcggcatccgcgtctcggcgcgggggcacggccattccatcagcgggcaggcccaggcggccggcggggtggtcgtggacatgagtcacgggtggcgcgcggaggcggcggagaggacgttgccggtgtactcgccggcgctcggcgggcactacatcgacgtgtggggcggcgagctgtggatcgacgtgctcaactggacgctggcgcacggcgggctcgcgccgcgctcgtggacggactacctctacctttccgtgggcggcaccctctccaacgccggtataagtgggcaagctttccaccacgggccccagatcagcaacgtctacgagctcgacgtcgttaccggtgagcaccagacaaaacctgtacagcatctcctcaaacttcttcttccccacctcctcgccccaaccaaccttccgccatgcaagcacacacgacagttatccctcgtaagtttctgacgcgtgtccgtcaccgcgattcttttacagggaaaggagaggtggtgacctgctcggagtccaacaacccggacctcttcttcggcgcgctcggcgggctcggccagctcgggatcatcacgcgcgcgcgcatcgccctcgagcctgctcctcacagggtacaccccgaaatcccacccagcccagccgtcacacccaccactggctgcgtacgtacgcacgcgcgacacagtcacacacatcatcggatcacctcactcttctcctccttccgttgagctgatcgagcgagcgatatgatggcgccgctaatctacccgttcgctccccgtgcgactttcccttttctcggcgtcatctcactctccctccagggcttggcacggagcacgacgtgacgacgaccccgttcttttgcgtcaccgccctcgctttccaactaatggcccaatagggaactgaggcatcagcgagcagccatgcaagtggcggccgggcgcgccacgccgcgcgagggaaagcgagcgattgatgcgcgctgctgggctggctgatggcctctcgggggatctttttgttaagtaccgcaatttcaccacatgtcgatcgaaaccccacaaaggggcacggggcacccaattgaaacgtgttgccaattgtggccgtcgcaaaggaaagtcaccgttgggagctgacacgtaggacaggatcgatcgaccagcgaccgagcagggggtagtgttaactttatgttgggtcgctgttgaggtctacggtctccgagaaaaagcgtctggagatgggatttttttttttgtgtgcgcgtcgggtcaggtagtggaccaggttggttgggaatttggggccgacccgatggatcgaccgaatagtttgtgctgaccaattggtggtctgcttataaatatactctatatagaagcgtttggttagctgatcgtgcgatcactcacaagattttgttgtcatatgcagctcaattagctaactaatccatgctaactaagcgtgtgtgatctaacgctgattaagctgtgtccatatgatcggtacggcccgtgggtaataataatttattaatttgtcgttctgacctgcattgccaggttcgctggatccgggcgctctactccaacttcaccgagttcaccgcggaccaggagcggctcatctccctgcagcacggcggccggcggttcgactacgtggagggcttcgtcgtcgccgccgagggcctaatcaacaactggaggtcgtccttcttctcgccgcagaacccggtcaagctcagctcgctcaagcaccactccggggttctctactgcctggaggtcaccaagaattacgacgactccaccgccgtaaccgtcgaccaggtgcgtgtccgtcgtgccggcgcgatcgcgcggccggcgccgtctttcctgattcaccaataattctctgcctccccccctgaccgcccatttgtttatgacgaaatttcttaattattcctactggagtagtttagtactctaatggcagggcacctagtcaatcattgggccatgtttttagttagttatgggcggtttagtcaagctctctagtgtaatccaagcccttgatgattgtatgattgcacccacatgctgagcacagtggatcggtggatcttgcaaacgtactagtagctgtctagatcttagtcccactgacaaaacatgcactattttatcgaccacttaattaatcaattaattacgcagtactagctattaccactagtatagtactatacgcaagtgatgaaaaagaaagacgaagtagatcattctaaactaggagtttaaataattagtttcgatttttttttccaggacgtggaggcgctgctgggcgagctgaatttcatcccgggcacggtgttcacgacggacctgccgtacgtggacttcctagaccgcgtgcacaaggcggagctgaagctccgcggcaagggcatgtgggaggtcccgcacccgtggctcaacctcttcgtgccggcgtcccgcatcgccgacttcgaccgcggcgtcttccgcggcgtcctcggcagccgcaccgccggtggccccatcctcatctaccccatgaacaggcacaagtaagcagctcgccacactcatgcccccatatactatatccagccaatctacctgtcgtaacagtaatccagtagcactcgcgcccgcagcgtcacatgaagcgcggccgtcctctcacatgcggcgcaacacgggagggcgcgggcaggtggccgatgggctgcggcgtgcgcgcccgcgcgcgcgcgagagagagcgtcccatgattggcgcgggataaacaaatatacctccagatgggcagcagattgcacaggatggatcgtgctgccgccatactttaattccgaaacgcagccgccgcatctccggtgactggaattggccgcggacataccgcgcactagggcgacagggccctattctaatcgctgcgtggtggcgccatgccaatgctaggaacagaacagaacagacggggggcgggcgcatcatcagtcaccttcaccgccttgcgccgaccggttattctaaccagggcgcgcgccgctcccgttcccaatcgcctttccacggcaccagttgttaagcttcgctagtggccagattgcacatatgtgttgtcgctttcacattagtacttaacctgaaaggacgtgtcgatcagaatcagcacagatcttgctgctaactgttgttgcttttcctactctgctccaatctttcctctctctttttttttctcggtggatttaaatactaaagagaacttgatttgcgtacgttgcaggtgggacccgaggagctcggtggtgacgccggaggaggacgtgttctacctggtggcgttcctgcggtcggcggtgccgggctcgaccgacccggcgcagagcctggaggcgctggagcggcagaaccgggagatcctcgagttctgcgacgaggccggcatcggggccaagcagtacctgcccaaccacaaggcgcagcgcgagtgggaggcccatttcggagcgaggtgggctcggttcgcgcggctcaaggccgagttcgacccgcgggccatgctcgccaccggccagggaatcttcgactcgccgccgctcttggcggagtcctgaaacgaagacgatcgacgaacaagatgatggctagctaggcgcatgtaattagtaagaatcataacaggtgattagttagtcttaatctgatgtgtagattcctcgccccataaaaaaaaatctgatgtgtagacaattctgtacagagggatgtatcagtttcatgcaaaatgtgtgcaatgtttttttgccggtaaaagtcggcgtctgcctccagttcctcttcgaagcgtcgtagttacccaaggacgagatatctcaatcactgatccatcaacaggttcaggccctgttccgcatggactaggaacagattagtgacagaatctggctccttggcgagttgtatcgtgggtgaaagtcaagttcgaaagggaaagaaaggatggttacctgatacacgtgttttggcccgtcggtccattgaccaataccataccagcaatgcctactgtaactcctgtctccgttggggcctcacatatacagtagtattctaggttgttgcactactcctaaacagcatcaaaggtcgaattgtactacaactagtactcaaactattgacagtaccaaggtactatactacccaactccacactgcaaaagatcctacttccgtggctgcaaattccgttcttccgttcatgcacttaagctgctcatcgacccgtcaggcagtgcaacgtcacgaaggcacggagcatgtccactttagcattacacaagaccgaagacttcaatgaactgaaaatcaggcgagtggcgacgcgcgccgcgcggagccgaacagaacagaaacgccgggttcccgggcggatcaacgggatggcccgcccgctgccgagcagcaaatttgcccagctttggtgcgtgcggagacgatgcgtaaagacgaaaaaagcagcgagaccgcaacaggcgccggcaagggaagggacggcttcggcggcatgcagcggcgggaacgcggccaggttcaccggctcttttccgttgatgcgcccacgcggcgaagtctctcgcctttgacatggcacccgtgttgctccacccgtccgtccggtcccccgtacgcgaacgcgactacgcgagtggctggctgtttggcatttttggctctaccaagagacgtcgcgaggagtcgagcaaggacgaaagcgtcgttcccatgcctgacgtgccgaaaagaaaatgtttgtcttctctgcaccatgaacagagctgcgatatggcaggatcgatccctctttcaccagggatgcaggcggtggctgcccggtctcatcggcaaaaactccaattaaatttagtattgatgagtaaattgatgataaaatttctatagaaaatattgaagtttgctcgagctaaaaaaaaatctttcagctccacgcctccaccactgaattcggggtgtgagattgtacggtgatgctactgcactgtggcttgatgccctgagcctgattgtctgataatttgattggtgcctgtgaatgtgattgctgtgattgattggcgtggctccggaaaatctggatgctggactcgaatggttggcgccattaaccagatcagtagaataataccagttccgttctaaagtaattatttttctacgattaaactttgtgttaaaatatttatcactctaaagtagtactccatcaccctccatttaaatttctccctattacaattatcactatatactcttaaccatacatcgttaaataagggttactatagttttttaaaaaaaaaacttttatctatatttaactagctagaatgataaatacttcctccatttcaggttataagatgttttgacttttatcaaaatcaaaccgcttcaagtttgactaggtttataaataaatatagtaatatttacattaccaaattagttttattaaattaataattaaatatatttttatactaaatttatcttaggtaaaaaaattgatattttttttctataaacctgattaaacttgaaacagtttgactttgaccaaaataaaaacataacctaaaacggagggagtattttggtacgaggaaatactaacggcaatcttgttcggcataagaacttcttcaggtttacaagggttcacggaactcgtggcccaacacacgggaatgattgggccttcaaaaaaggtctctcatgggccttggcctgtctactccatcttaagattgaaaaattgatgtcccatactcctatttctgattagattagtctgtcgcagacatgaaaaatcgtttttcacgtaggcaagtgaaaaaggccatgttttgcagtcgctagaatcttttgttctcatgaagtaatatgttgcttcgttcaagcaaattgaattgcagacaaaaagaaaatcggactattaatataaggtccatgaagttgcccccaggattcgtcctcgaactcacgccctttgcggttgtgttaagtagtatcaaacaacatgtgcagcagtccgcgtgagaaactcagaattcatttactgtagtacctcgaacagcatctactgcttgagacgtcaaatcgaatctactcctatgtatgtatatggccgtatccgtatgagcagaagtattagaagcttaggaataaaagcagtagcaatacctgttctgttcctaatccagacgaccagcattagcaaagtcgaaaaaaatccttatccccaggtttcatgttcttggcaaaccaccgaagttgatcaattcctggttgcttcgagacaaacccatgtggagcaaaatagcaagttagttcatggtttgtccgtacgtttttcagcaaccaaacttgaaacaaaaatccgtcatgctttattataaaactatttatgatcataaagtacagatagactaacaaggcaagtgaacgggtaaaaaaaaaacttttagagtgttggcaccggtgtcattagcttcaagaaaaatgatttacttctagatgcttttttttccaagcctatttataaaattagtttttaaaaggctaaaatacagagacatacacatatatatccaatcacctttaaaaggatcattcctcaatgatcatcttgatcttggattctcgatgggaaatcctctaagcacctcggtgactgaacccataggttggccactgggtgttggctaaagccaaccacaagagttgtgatgaatagtggagacagtcggggctcttcgtagagggagggggatggggttctgcaactgaactgatagaacaataatagatcacccacaaatcactttgctttgagctatgggactgtctactggtagaaaaaaatccgtcatgctttattacaaaactatttatgatcatgaagtacagatagactaataaggcaagtgaacgggtaaaaaaaactttcagagtgttggcaccggtgtcattagcgtcaagaaaaatgatttacttctagatgcttttttgcccgaagcctatttataaaattagtttttaaaaggctaaaacacagagacatacacatatatatccaatcacctttaaaaggctcaatgatcatcttaatcttggattctcgacgggaaaccctctaagcacctcggtggctgaacccataggtttgccgctgggtgttggctaaagccaaccacacaagagttatgatgaatagtggagacagtcgggactcttcgtagagggagggggatggggttccgcaactgaactgatagaacaataatagatcacccacaaatcactttgctttgagctatgggactgtctactggtacaattctcgtcgtcagatctgccaaaacaaggtttacaatatcaacatataaacttctttatttttcttttgtgaaaactagacatttcggtccgacttgagatagcaaaccattatgtaaacatgacattttttaatcaaactaaaatttaattttttgataaaatttagccaaattccaccagcaatcaatggttttcaaatggttctaaaaaactgaaataacctcctgagagcattttttagtgccggtatgattcacatgaaaaacaaaagaactgccaagttatctatacatgttagatgatctcgaatatcgtgtgacgcatcatacttgatcgactaataaatatccaaaaatggatattggaacgtattcacatgatgtagcctctctacacgtcatcaatattatctccgcaaaatcaacttttgattttattctttttatgtttataccgcgtcataaaaacaaggtacatgtgaaaccgtactaatctactttacgccatctcccacgtccccctcttcttatatttcacctccacgccccccttcgtctacctgcttgagtattccctaccttcaccataggcggagatcgagttccacatacggtattttctactagtactctatttttttctcttctatcaccattatggttgaatatttccttttcaaatccttaacccttgaaaccacagacaccattgtaggttttttcgcgacctcgaatcatctccgatagtgtcggctaggcgcgccacccatgcgcgctggcgacgctccgcgcagagcaaacgggagattatatggtatcaaaacaatgacttatacaccagaacaatgacttatacaccagacgagatccacgcagcatgttcctctctatttctttctttcttcttcctactagtagatctagatatatgatttcaaaactttggatacatatagttttgaggtcttccatggcgtacggtgaaaacttcctttttgcacggccctccccaccattgagatcaccgtttttttttttttggcctatttgcggcgcgccccggtcggccgtccctgtagctcagtccacccaccgctctcacttccatacgcggcccgccgcacgggtgcgcatctcggcgtcagaaagggctacagccctacagtgatggatcggacggaccgtgcggggaagaaagagaaacacatcggcgcaaggcgcaacctcgtctccgccccactcgccgaaaatataaattccccaatccaaaatattacccatcccccccctttttttttctctctcctcccttttcgtctcgccgccgccgccgccgccgccgccgccgcagtagagtctgcagcagccgcagccgccgccgacgcggcggctctctctgctcgccatccgcgtccggcgtaccggctgccgacgcaggtgagacgctaggccctttcctcccggccgacacgggatcggggaggcgcgcgcgcgtggcgccgcgggcgctgatgagatatggttgcggcgggggactagggtttgagggttagatgcgccggcctgtttggtttggctgttggggattttttggagtcgcgaaaggaattcaacgttgtctcgaggggaggcgtacctgagtttctcccgcctgcttgtagctttgcgttccgtatatatttccagtgaaattcggttgcccgcgcttcgtaacgaagggcttttggttttatatggatggtacttgtgtgcagtgatcatggatttctgtgggtggattatagttattctgaagccggtttggcttgagttttgagggcttagcacaggtttgactagcctgccattttgatactgtaaagtacacatgctgatatagtgatatttctggatttctgtggttgggttagttaccctggaatcggcttggcatgagttttgaaggcttaggcgcttagcacatgtttgattagactgccattttgagacagtaaagtaagcatgttgaatttagcacatatttccttgtttctgtacacagatccgaagtcaggctctgtacggttctacgattatttgatggagcatgatatgacagttgaagattttattagaactaatgggttaggggcaagtggattgatagagaccaataatcaaggtgtatccacttcttctgtgtctgattgtcggtcctgcgagcatgtcgagaatgggagcccttccacggcccctcccttttgggactctgatggtgaagatgacgatcctggtatgcaaataacactacttttgttcactgtgatgataattaccgtaataattcaaaatgatagcgctagagtttgaaatttttatagcctatttatgggaaaaacaaacagccatttctcaactaagagttatgattagttccttaggaagataatattatgttgaaatatgtgtctggcaggccagtgctggaaactgtaatcttgagggacgcgcattaggccctgtttctttcagcttgggattattataatccagattattgggagtaagcagaaagaaacaaacaacttattgaagtagcttattataatctgttaagctcatttaggtgagctttttccagattattgggtgaaaaattacccaccatgccaccccactccctctttagacttgcaaacccaataatctaggctccattctactacagattataacaatctagcttatattaatctgactcaataatctagattataataatcttaagctgaaagaaacagggccttagtatggacagagattacatgcttaaatttgctatgaagacctgaaagaactattttttctagtcatactcaaaagtatcattagtttgtttactcctattgtttcttcctcttgtacacataacacattcaacgtgccagtgcaatgcagttgcccttctgaatattgcacttttggccacctgtacttatctctacctttaagccctatgtttcactctgggttaaataactaggttaacttaactcatttcttgtgtttggcagcagacgtagttaacctaagatactgtttagcttgattagtatctgtttagctgggttgacagttcagaagcctagaagggttaattgtgtctttttagctaattcactttttggttattcgctaatcaccatatttctgcttgtatccagaaacagttgcctgaaaacatgtgtttcttgcttgcatcccaaatacattatgttacagttgacatatttttatgtcatcatcatatgccgtgcattcctatccatgtcaatatatcaccatgtcattaagttaacgaagcttcctaaaaacttatctccaaaagtattatttgccgttgtacatatgaattatttatccacgaagaatgctgttatccattctattcttggtctttgtaaagttgaactgagtttagggcataaaaagagttttggagtacacatgctgctgtctatggctactaatatatgttactagtatttaccaacatttttgtttgacagaagtgataaacctgcgaacttcttgtcagttacagttcttgacacaatagtaattatagttccatcttcaaattaacctgttttttttttctttagcgatgtttctttctttattgtaattgaataattgcagctacatttcatttggctaatctctgtcagttacctcagggcctagaccttcagatttatttgggcgatatacttggagaattgaaaacttttcaaaggagaaaaaaagagaaatgaaaagcgaaccatttgaagctggtggttacaaatggtaggattcctgatggtaacttactagaaaatttggtcacagcaattctcttttcggagctggaaactctaaattgcttagtagctcagtttgtaatgcattctgcttagattctctattccattgactgacaaatcactcatcactaattgttatttgtgcaggtacattctagtttaccctcaaggatgtgatgtctccaatcacttgtcattatttctatgtgttgctaatcatgacaaacttctcccaggtttgctgttattatgttggctaaactatcttatgtgttcctcacagtatttaatcacacccttaacacatttcaggatggagccatttcgcacagtttactatagctgtgggtaatcttgatccaaagaaagttaaatattcaggtgaggcaatctgtgattcttattgtttgaattaaacactctgtttcagagtttaactaagtaagtttgcagacacctgcacaaattctggaagaaagaacatgactggggatggaaaaaatttatggagttgtcaaaaatccaagatggtttccttgttgatgatgttcttgaaatcattgctcaagttcaagttatcaggtaggcagtttaccaattttcaggattagcacctaaaagagtaaaatttgtttgcagttctatatgattgaaataaattgcatatctatggccttatatgtaaagcattccacagatatgcttttagatatgtttttcctatgtccctgaaacacgaaagatcacttcatttaattgttcctacgatgcttttgtgctaagatgattttgttgggggcatttatgctctccataattcaagttttactcttcatgtgcagtttcgacttattgaaatcttaactgtaccctgttgtgagctgtataaacctttcttttgtttttattgcatgttgcaacatgttatactgcgatttattcaaagatctctctttgttaatgcctctattttctctaattatttaagtcctagcttctatgtttaatttgtcaatgctcaactatggtgtgctcagaaatttggttatatacttataaattgattgctggacattcagtaactgttctcttctgcttttcaatactggagggagaaagtggatcgcccatttcgttgcctcgatcgcccttatcgacgagaattactccgtgtctatatgaccaatatagagcaaatttaccgacgctttgttgaagagcgcagaagtaaactttgcaagctcattgaggacaaaatgagatggtccaggttatacaattaaagttatcaacatcctgttatcctttcataatgattaagtatctgtgcgcgctcgcgtgtgtgtgtttttaaaaaagttaatactaacacatgcatatctttgtttgtactgcagtttccgtgccttctggcttgcaattgaccaaagcacaaggcatcgcatgtcgacagagaagagtgatgtcatactgaaaataatagtgaaacatttctttgtggagaaagaagtaacttcaacgttagttatggactctctgtatacggggttgaaggcgctcgagtgccagagcaagagcaagagcaagaaaggcataatagactcagtggattttgtagagctgccagtgcctatggtccatgttgatgtggacatgtttgttttggctggtgatgtcatagctttgcttgagagggcagctttagaacccttgccttgtcagcctgtgtctccaaaggatgacaaatgttcccagagccgcactaaggtaggtatttttcatatgatttattcattcagtttctggactatacagttaataatattgagtttctggcccccaaaatgaatgttagtatttcttgtttcactgatatggaattaatttagtttagttcaaatctctttagtttgcatcctatgtcaaacttatttccttgtcttcccagtttccaccattatttgacctatttttagacagaaggccaatggcccagcttatattgaaagccaaagggttttacaacgctgggggttacccagttcaaaagcagcgcaacgcaggggaagtagtttgccttacaacagctttagaagctgaaacagagatggcacgcaggcccgaacattaaaaacaaagcaaaaagagccggggcatcaggaagtcatcccacaccggatctcagtgattgcacggctgccaggatcttctcctccagctggtccagttggacctatttaatattttaattttgcatcctctttcatgctttctccatagtttgttgttaagcaagaatgattctttttttcggagtttgttttcttgaaccttctgatttcaatgaataaatgtggttaaaacaatcaccaaactgtagcgattcattttcattactagctcttcttatgacatttcaatttgattggtcatgtaaagcttcaaacagtggttttaccttcaaaattccagtttggcatctttctgtactttagttaggagaatatttctatcttaaatattcaagttggatgaatagaatttctagaagtaaatttctctggtggtcaaagttgtaccttggagactgagaatcaaaacaaggcttctttgtgatgagacttgagtagtagtagaatgagagtgaatttcatttactttcccattttgtggtcttgatatgtgaagattgtaagcatttgtattacttgaatgcagtatagctatttatctcactgctcagtttttgtcattctcatctttctaggatggcagttctggagaagttaacaaagtttcgattgaacgtgaagaaaggcgcctaactgaacttggtcagaagataattgaaacatttgcactatcccatatattcaggtaatatatttcagttcaatcatcttgttacctccacatgattggttttctgggtacatatcataaatttgtaaaaccatttgtcctatgttgtccttttatgtgattttcttagtaccatattttgtttagtgcttgatcaaccagatgactcatgtggtcacattcaacttttttttttggcttgtatcaatgtgtaattgtgaagtggtttaatgattttgtgtggtcagtttccgagttagtatgctgaggctgccagcatcacacaggtctggtggtggcagaagaatgttaatgggtctaggtggagagtaaataaagtgattggaacagaaaccggaagagatagaggctcagttcttttctttcttaaattcattaaggacatatggcatcctcatatgcatgcccttaacctttattaatgtggcaatacttaacctatctttattcgtatcctcgctctttgccaatgcaaatgtctaggtcatgaggattactaattcatgcctctaacttgaaccctgttgcacagctcccacccaactgaacttttcttgccttgcctgacatgggtacctatgttagacttgcccataccccgtagtacgtgtccaccatatatctcatttctgttttacattgaagagtgtaccttttgagttctattattactgagttagcacgaagcttttccatgaagcctcctggtgttttgcattgcagtatctcccttaaagttccataaaaccaaacaaacagttctgtaacacaaaactggagctcatcctcaagttctcttagaaatatactggcatagtccattatctcttagattagcacaagataaccttttcatccttttgcattgcctcttacattttgttttcacattagtgggattgaggttgcctatcaagaagctgttgctttgaagaggcaagaggagcttattcgcgaagaggaagaagcctggctacttgaaaatgagatgaaggggaagcgtggcagtaccactgaaaaggataaacgtgcaaagaaaaaacaggttaatttttaacatggtcatgtcatcttcatttattttatgttagattggattttgttttactcataatgatcgattatcattttcaggcaaagcanaaaaaaacaatcgtaaggttaaagacaaagatagagaagaaaaatgtgattcaaattttccagaaagaagtcaagatgaaaacacaattcatgacagggaagactctaaacaggcaggacaaatatccatgaaagtagatacctctgaagaaggtgcctcagatgtttcagacaatttagatgggtaattgaggtatgtcaaagttccaaactgacacagtcaataatatttcaaagcctgttaataggatgaatgatgttgatgttgagatgaaaaatgttcagattcagaagaaacattctactatggagaataagtcattgtcatgttcatctgagtctgctactatgaacaatgcgcaaggcaaaataaataacttgttagaaagtaaagatcagatatcacgcaacaggttggttagcattctgtcttaattttgcattacttctcttggcaactagaatttgtcttaattgaatttatgcacagagggaaagctcgcagcaggagcacaagcaatatgaacattaccgaggatgtggatgatcttccatcaagcacgactagctcagacaggaatacatctggctgtggcccagctccaaagcttgatcaagagactgttctacttaccttgaaagataggcttcggaaacttgggcaacgtttacatgaggttaagttattctttataaaatattgagctatatttccactattgccttgttcatttatgttatgaaattgtcatcttaaagcatatcaccgtcaccattggtttcatggactcagttttgttgtctagtagtgctttgaatttgcttgtttatgttggcaatgaaataggttagctattctgatgatagatttagcaacaattaacaatatggtttgcaaggagtttgaacttttactagactaaatcataggatcaaacaccagagccattttattatgctaacaatatggctagacttgtaaaactcttctgtaccatttgccgattaactgcaccttctccctgtttttactgtaaggatgataagcacagtaatggaatactgctagatagcattccaaatgaaaacataactttgcattctttttggtgttaggactaatattacttcagcatcacaaatgcacacacaaatacacaacaagctagaaaatgcaagtacagaacacaggagatcacaagatacaacagatccataaacaaattcattgtgttatttacatcatactgatgcattgcatggatatgttcctgacaaaatatgctttggtgaattcacttcctgaattggaattttatttagtattttatagtcatttcatagtaacacttcaattgtcagttatcttgtgcaattgtttttgtactgctgaagattgatgtatctatttctatttatgtttgttaacagaaggaaattgagggcaggaaactactccaggctcatttggaaaagaaggcagcagctgagtcagcaactggttcatcctcatcactctcatccaattctttagaagagactccagaggttctgaagagcccagatcaatcttcagtaactatctctgatgctgatattaatgcatcaccttcaaagtttggtgccagtaaagaagtcactccagtaacaccaaccaccatcctaagcactgagcctgtgcctactgttgcttccaccctgagtaaagatgagccagttttgtgtgaagatcatgtatcatgttcaactccacaaattgatactccaatcacctcaaatccaccgcaagttgttaaaactgtacccttccttcaggcatgctgcttgttggtcacgctattcaagcaccgtctagatcaccggcaccacaggttgatagggtctctaaagctattgctgctcccaccaaatcacctgctccacaggttgataaggtctctatagctgttccgactccctcaaaatcacctgctacacagggtgagaaagtcgctaaagctattctggtgcccccaaaatcacttgctccacaagttggaaaggttgctaaaaccatcccgacaccaaaacaacctgcacctctggttgacaaggttacgtcacttgaccctgtatcaaagcaaatgtcttccatgtctaattcagaagcccgagaagctattcttcccaaaaaggctgcagtcctgtctgtttcccaaactcctgcaatatcgaggccttcaagtgctcctctgttccaggtaccaagatcaactttaccacctacgccagcagttcaagttcccccaatgctttcccgctcaatgaccctggctggacgatcgaggaatgaaccatccccttctgttccaagttatacagcacagacctaccgaaatgccatcattggtaagagtaatcttgatacagcatcagcaagtcttgatcattcaacttcttttggccaaaacgtcgcactttcacagccactatcatcgtatgcatcagcagcatctgccatggtacctccggtcggaaggaatggccaattaccaggtaaacagggcttcatgtttgggcaaggaaagtccgaagcaattgataactggaacccatggaaaggtgatagtaatgctaacaaatacatgtggaaagatgattctccttaccatcaaatgaccaagggtgatgcacatactcaatcttggagggacaattcttatcagcaagcaggatgcagtggaacaggggaacaaggcgaatttggggggcttcaatataggcagttccagagggagattccaacaaaccttgtctcataccaattgccagggccagttggagaagaatttccacaccttgatatcatcaatgacttgcttgaggaggaacaaagcagtgggagtatggcagagcctaccctccacggatatcatacattgggcttgccgtattcttccagaggaaacttagtagactctgaagtgacttccataagtagttctggccggttaaacttggccgatcattactatgacgagggctacccgatggcttatgacaggctgaatgctctttataggttaagagaagggcaaaattccacattggatgcttattccaatggaaggatggactcgattacttcaaaaccttggctacataacttctcaaatccagcagtgaaccttggagttaacccaaatggattttcacagcaaatggggaactacaccaatttagggagtgggagggtgaatggagaacatctgtatcgccatgccaacgggcaatggtgatgcctgtacacaattgataataaatcctgctataagttgtcacagaccatggtggcagatgtaagcgtcgccatggccaccaggttgtaacttttaattttaaaggggcaaagaaataatacattgtgtaaagcattccagtgtccgttaaattttctgtcggctgctttcatagttttatggttcttctttatttcttttttggttggagtataaaacggaattttaacaagtcagtccagaagagttctatgactacttcatcgggttggaaagttccagattttgcatatacgtgtttgtggttttctcttacaagcctaaaaaatgctgtaatgggctcggaaacgaaagaagtgttgtgattttgcagtggcaggtcggatagttggatgccaaggtaacggagctgagatgttccagggtccaaataatgcaagtatgcagcaacctggagaagcaattcaaaactgaaggtaccatcgaagtctatttcaacttcagattatatacccacatgactcctttgctgctattaagatgaacaaatctgtcttggagtaatacaattaaaaaaattatgagcaaacccaaagctcaaaaaaatgaaaaacatgcacagcttacaattatgtctgccttgtgtttaatacaagctttttctatgcaatttccctcaaactagaacagattgccaagtatacaatttacaagatggatgggtatctgctatacaaataagttgtgtaaaaaactaaaaagaagttgtgcgtgttatttactaccagcaattgctcgcagttctcttaggttgctagcgatttcctgaataaacatcacaccttctttgccattcctgagtgagtttatgctatgttcaataaagttgcggtctccttctagcgtcttcaatcttttgttcaagtttgagatttcttcttgaagcgtgctaagatcagtcttccgactcactgttgaagaatgagcttctttagctaagaaaacgggctcctgggcctctcttgagctttcttggcattgcagtgagccatcatctacaacgtgcattttgttggaaaggtaatcctctatgacatctgaatttgacaagtgaatgttagtactgttgttggagtaggattgaagcttctgctccagcttcgtcaagcaatcaactatatatgccctctcctcttcaaagctcactaatgaatttataccacttggtgtggtaattgcaggagcttcaagaccagtttcatcaagcaaagtttcggcaatgttttcttcattaaaggagacctgattggattgtttctctgttggtccacctgcaaactgcatcctgtagttttcgagctcagcttccaattcctctatttgttgttccctctgagcaagtagctcgttagctttagcaagcgcatcactatcatactctgcttgttcttccatcatccgctggtaatgtaaagcttccatctgcatggcagccttgtcatcctgcaatctggtaatcatagccaaagcttgacttgcagcaatcgctgaagcgttcctttcttcttccagttccttgcagaggaggtgtatagattttcggtcaagatcaatctgtcgtctcaaccgttcagtggcactttcaccttccatctcacttacagtgctaccctccagtgactccaaaccagatgcatttctctcaattgaaattctgttcgtgatgttctgcactatcaaatcatcaccacgcccatacgcacgtgggctagggcctgggtcgacccatggagcctcgagtcctctggaagccgagagctgtgacagcagtaacctcaattcttcatttacactagaagaggaatcctttccaagaatcacatcagtcaaggtgggggatggcaagctactcttggcaccaatggcaagcttgtaggcttcattcatgctaatctgagtgcttagagatggtctcctttcaccaatagtcgcgcttgtttgcggatgttcctcgatgacattgagaccctgaaatacctcactgtttggtctaatagcctgtggtgatataggagcttcttccacaaaacctaaccaaaagggttaaatgtaaggaccagtttttgaaatactgttgcttgagggaaggtagaaatcaactaaccttttgctgtaggatctttggaatttgtattggaaggatctttgagtgccgcttcatgtgttaccatatcacaagtctgttcagcctccttagcataatcttcagcttcatcaacagcttcagaactagaattaacttgtgaaacatggtcatctctaaaattaactgaaagggaaaacaggtcggaataaagaaacctttcagacatatatcttgattcttgagaaatagtcagtcctgaggtacagccttacctggatcatcatcaaccaatgcacttttctggtgaaactctctacttgatgtaacagtaatttctgacctgtgaccttccagatcatctgacatttttttattgtgatggggggttagacgaacaggaagaaaataccattcagtttattgttaaactatgattaagatatacctattgtgctgttgtgctctgaaacagcaatgttttgttctagtgttgtggactgtgatgaacatggatcaatggtgctttcactcgctccatgacatgcctcgttgtacccaagattctgaggtgactcgacacttgatgcaactggaacttgggaaacattgacatctgcatgattatctatgctattaatctttcaaactgaaaaagaagttcagtaggagtcatcccagtttggggaactaacagttacctgtcaaacctgactcttctttgacagctaggggatcatgctggcatgtctgtttttctaatgaagcatcttctgcttccatttggccctcaccaattatactatcaggatgatcatctacaagaacatatggcaaggatatatcatatgagtcaccaacatcggtttccatcggaacattcatttctaatggcctgaccaactcagtggaagaagcagcaaatttctcggcagtggcatcttcattcaaatcttcctccatacaattggttttatgatggtgtgaaattttgccatcatcagcacagggagcctcatcctcggagccagatgtcatctgcagcacactgtatcgttcatggatggagtgatcactctggtgacaaatatctttatccaaagatttatccacttgatgaagtatggaataatctgtgcaaatctttggtgagcaaacagcctcagcaggttctagttctgtgatcattcgagaaaacattgtcggtctctgttgtgtataatgctgtgcacaacatgagcaaattcttgtatcatgggaatataatccttgattactatcaggtagagtggcagccattgttggctcatcggtgcggtcatcattgttttctacaagtgagtcactgcatctctcacacatactttgggcacctgcaagtttctgatgtagacggcagaaggccaaagatgagatctctgacttgtgagttttgcagatcaattccctgtagaagcatggtttctcattacccaggacatggtctagccttgagcagaaagggcacggtgccggtaatctgcagaggcgggcaaatctggtgaccaagaagcaataaaccgcatcgatgaacagcagcagcatcaagatccactcgagcaacaccgatgacagtgtggctgacaatctccgtaaggttggcatccttgtacccatctttgaacagtatgctcaattcttcacaattgctgtactcaagttctttagattggtgaaaggtggctggtgttgaaccagaatttctgaaggaatcaaaaacaaacttaatgagtgaagtgtataattgatcctactaatgagtaatgatatgctgttctgaataacatagcaactactcatcaaaagctgtaaacatcaaagtttggtgggattaggacggccttttatctcattattgagcactgatagaacggtaaagtaatgatggcggtgtcattgtagcggatatgcttgattttggtgaactaaaggcgagcttagctggagaaaagacaggaaaaccgaacaccaggttggaaaaccactagaaaacagaaaatcaaaagcgtccagctctagcagcagccataatggtgatcaatagacccaggaccaagagaatgttggaagcatcagtccaagtagtaattgttacaggacaatttcaagaagcattaagaacagtgatgctgcacagaagagctttcttttgaatcccacaaactccgatgatgaaagaacagctcaaactgtctcttttgtaaggggagaaagaaaagaacctctttgaaagcttgaaaaaattttaacaccaaaacagactaaactcttccagaaaccacccagcaacagaacaaaatccgatcaaacaaagagaacaataagcataaagctaagcaacctagcactactatagcctgcacagcggattcccctataattgactagcctctcccatgtaagaacagaaaactcagcaaaatcacaccatccaccgggtgtgctcccgagctctccaaactacagaagcaacctagaacccgagctcaccaactacagaagcaaacctagaaacgaaagctaaagaaagcaagggaagaagaagaatgttccgaggatcatccagcaagaacatacatacctgcaagctgcagcggggtcgccgcagcgcgctgagccgagatcccgatctgcgatcgcggcagccaggcaggcaggagcagagggcaaaaagagagagagaggagacggaaaaggttggcatgcgccgaccaaactcgccacgcctgagctatattattcccacccgccggaacgagccaaaaacgaagggaagggagacaaagagaggaagcaagtggagtgggggcggcggcggcggcgggggtgcgacgcctcgccggggcggggccggcgggcggctcaaccgaaagtcggctacgcgggccggcccgggacagcgacgccaccccggtcagccagccgaaaggtagtatggttggctggctcttccttctcgtctcctcgtaatactgtacaacatttgtattttggaacacgaaatttgtttagcccttgtttagttataaactttttcttcaaacttctaacttttctatcacattaaaactttcctacacacacaaactttcaacttttccattacatcgtttcaatttcaaccaaactaaacacaccctattcacgggagatgtgatgactactactccatcattttgtttatttgagaaataagctaaacaatatatttgtaaaggaatacttactatgtcaatataagagattttaatattttgcttacactgtttaaccattcgtcttattaaaaaaattagaattattatttttttgacttattttattatccaaagtacttttagcacaacttttcgttttttatatttgcacaaattttttgaataagacgaattgtcaaacagtgcaagcaaaatgtcaaaatcccttatattaggggacggagggagtaataatttgtaaataaaacttttaaatacgtgttttaacgatctaaaagcaaatgctaaaaaataaactacgatggaaaaaccttaaatcaatgaaattttaaatttcggctgataagtataagagtcaatccattttatgccatcgacaaagcgcgggtctacagtatgccactgacaaaactcagttctacaatataccatcgaatgactcattttcttccttatatgcaatcgacgttagtcaaccgttagtcaaccgccgttaaaagatgaaaaatgaccattttacccctagcataaaattgagattttgcataatgccatatcgcggtaaaaaatcttggatgataaaaagacaagcaatttctatttttcatcaatgagaataaatagtggatcatgatcagtgaaatcgatgaggatgcatcgtaccctaggggtaaaacagatattttcttgctcttaacggaatttgactaactgttgaccgccggcgatggtatgtaaggaagaaaagtagttattcgatggtatattatagaactgagctttgtcaatggtatattgttgaatccatgctttgtcaatggcatagaatggattatctttataaacataagcgaaaagataacatcgcacgagtttaaggttatgtgtatttttaattgtttggtgcaatttttttaattgaatcgcacgaatttcatgtgctccgaagagtgaatcgcgtgttaatatggtttgactgtactggtctcaacgtacctccggatgtagtcaacaatgatgtagattgttgtgctgccggtcgttgctcgcagactatggagttaatcaaatagtaaatcagctcatattacctttttttgcaaattagtttaggccgttttctatcgtacagtgtcctgtttcaaacagtataatacttgttggatactggatatggtattctatcagtatgaactaatatatattagtactagttgatatatatcagtatatataaggctgatacccgttgatgacatttgatatccatcggcatcggttggtgaaggttttattgtgagcgtgggacgcgtattgttgccgctcaggtgatgtatatgcatggtgcatttccctgcgattggttgcaagtggagggtgttaggcagttggctctcgatagtagcacctaatgagcaaccaaacctttctagttaatatattatgaactttcattatttttcaaaccttttaaaattgtaattttacgaataaacttttcctaactaaattttaaactctaaacattttgatcacgtcacatcgccttgtgtggcaaaataaaattgtcataccccccgctagactggtgtgacgaaacaatactcacttttggcagactggcgtggtcggccaaataaaacactggcacaccagtcagttcgacatggtctttttttgtcacggttgacgtggtcaaaatgttcatattcgaaaacaagttttgggagaatttattaataaagttaaaaatttaaatggttcagaaaaataaaaaagttccttagagttccaagtttagtatacgcatagactcatgtaagcatgataattgttgatatggaaaaatatcacctgatgcttcatacaattaaatattctagcacacatcatggtttcccaaaccaccgaggccggggttaccgcgcggtaaccgcggtaactgtggaaaactgtacgaaaccgtgcaaaatttatcaaaagttcaaattatttttaaacttatttaaatttaagaaggttaccatggtttttctattatcgtacccgcggtaagtccggtaaccacggtaaccgcgcggttaccgacggtaccataaaccttgtaacacatgcatatatgcatgaaacgtggtgaatttagttatacaaatattcaaataagagttagcgagtcaaacttcaacattaatatttcaagctttaattaaatcaatggctattacatcgtttgtaaaggtgttaggtgcttagggcattagcaatgcgtccttaatctgttatacctgagctgccaaatagactaggaacttcaaaagctacaaggttcacaatgcaatgtgactttaatctggacacataaaatccggagacaatcatggaggctactcaaccgacagtgagcgtgacccagcccacctcgtagtcttgtagcctcaaactcatcgcatctatccctttgactcgtcgtctccagagccacgactcctcacattgcatcgcattcccctcccgtgacgcatcgccttcctcgcctcctcccacgccacctcgccgacgacagccacggctgtgccagctcttgctcccggtgtcgatccacagtgacgacgacctccgcagctatgcctgctgcagctcccggcgtcggttttgccctacttccacggcgagcgaggagaggcgaagagcgtgggaggcgaaaaagagagcggcgctcgcgcgggagggaagggcgagcacggagagcgagtatcacgcgtacgcgaggacgaccaggagggcaatttggggatcgagggggaaatcgcgccgggaggaacggcgcggcgaagccacggccttcccagtgcacctcaacctcctatccccatgccaccgattctcaatccagccaaagcacgggtgcctaactttggtcacgcgcgcttgtgtcttgtgggcccaacgagaaacgtggcggcgattttccaccgttcgcatacgtggaccgcccgggccaaacgacagcacacgacaccgtgaatggtcttatcgtgaccgtggtatattctaacctcttattttaggtaccactgtctactatgacaacagtgatggtcgctatctctatttataatttttatgtgctttcactagataatatgtgtgaatgacatggcgtccacgaggtatgtgacgataaatcccaaatccagaacatggaaattcaaatccagggacaagacaatcagcatcggaatggccaaaatgggggaaaaaaaccagcagaccagctcattgtcacccacatccctgtctctctaccctaccatggacagctcccccccgggagccgcatcgggcggccgtcgttacccccgtcgccgacgccgcgcgggccgtcggatccccgcgcaatcatacacacgtgtcgccgtcgccctcgtcgtcgtcgtcgcggccgcctccgcggcatccgtagtactagtaaaatgcagcgcggaaggcggaaggaggcggacccaaaaaaaaaaaaaccgaaagaaagagggtagcggcctccgagcttgtgtcccaggcggcctctacgtggctcaaccaccgcctcgcgttccgcggccggggggctcgcatgcaagcctagctagcttcacattcccttcccttccccgcattgctgcgagcgacgctgcttctgcttgcttggttcgcttggccgccgccagatgcgatcttctccttcctctccgatcctctccttggcctccttcctcccgttgctagctcgtgcatggtggcttcttcttcttcttgcgccggtttggtgatccttgttgcgccggtttggtggtgatccgatcgaggacggaggaggagcgcgcgggggatccggtgatgggagaaaagctgtgaaatgagatggtggtgatgcgctactccccgaggtgggctgctgcatcacagattgatgattgagtagaaatctattatactacgtcgtcttttcttgtagatggtttctttgtgctgtttaatctgctttttctgtagagctttagtttttattttattttatttttacatatcacgtagaaagattacaggcttttttttagaaggtgaaaaattgcaaattttttgaaagaacgaaaaattgcaaattgagcgtagatgcatttttttactctttatcttggtcgtctgatccatccacggattcgtttgggtctagctaagaccgaaaggtatcaagaagctgggaatatctgcttttttggacaaaaagacacaacaagattggagtttttgcatctactagttcatttattaggatagttcgattcttgcatatgagtggaaaagaacttataatagactagtcttgactcttgactatgactcttatcagttagatggatgcccaactgcgttgttattatacagcagtataagaaaaatatgtacttttgtcatttgtaggggaactctaatttataattactttctaccttgcatgtatgctatgatatgaacagaaaattttctttttgtttatctgttaatcttttcaaagggtcctatttgatatgctccagtgtaaaagaaaaacagactcatgccatatgtcctgcaaataatcctattatcttttagctaaaaaaaaaatcctcttatcttatagtctactgaaggcatatggtggcattcaggtgcaggtgtaaatgcagtcataatattcggcatgagatctgtctctgagctggtgtggtctccggatgagggtttgagcattaaaattgcagcgtccagcttaagtacaaggaaaacttctcttcattggaatgcagataccttgagcatagtaatatcttcacctcaacagagtggtgctggggagagtggtcatatcatagatgctacagtagaagacgcagaaaagatgccatcccagttacgaactcgcagtgacagttcagcgagagtattcatgtctagcccaagtagaataagaaacactgatgctcaacaatctacttctataagatcacatgggcaagattcaagtaagtttaaaagacatgaaggttttgagtagttcaaaggcagtttgttgatgctttgattttattggcctaaggatctgcatttatcagttgttgttcgtcttagcagcacaactttttcaggacaaatctaacaagagtactgaattaaatttttgaaaaaaaaaagagagaaggaaactgctgaattaacttttcaagaaaagtggagactgctgaaattagcataatcagcacaaattgtaaagcatctctactgattgtttgctatgggcatctgttacctattatccaaatagaataaaaatcttatgggttttccatttctttcattggatggccatttcctcacttaatgcctggcttaatacctgtagaatactgtggtgggatggatgtgatgaatgaagggaaagaaacgtctgacaacttctgtgtggataagctggagaaagaggacgaagtgggtagctgtcccacaagatactgcaacgatacttcccacagtctaggtaatcaattaagaaccatgctcttttcaattcctgacagtggagaccttaccgtagcattttacaggttcagcttccagaaaagaggtcatgcctattattgctgaaaaacaggctttctgtgcaactactgtccatgatgaaagatcttgggcagctaatgcttggcgtgctcgattagtaaaagcaattagtcagaaggactctgttttgccaaagaatgcagacaatatacattcaacttcggcctttgggagcattggtaatacagaaaacatgcctggcaaattgacaagtatgctaggtaatagaaatgacagtagccaagatcaggctatgcaggaaaagcataggatgggcttattgttgctagatgtgagtccgtgtctgctgtgaatcctgttgctagatgtgagttagcatctggtgttaatcctttagcaagacatgagtcgacatccggttgtaatcctagaaagctcgagaaggggaaagaaaagcttatctatgatatgagtaattgtgttagcaacacaaatgaaggtgatgacagcaatgagagtatagagagctgcccaagtacaaaagctccgaagcggaagcatggtcaattttctgcagctgagatgacgtctggaaataaaagatgtagaagggaagataatgagagttcttgttcaggattattccacaaaaatgatagctctttctttaactggatgtcaactctcactaatggagtaaaggtgtttgatgaaactactgctgttccacttaatcagaagttttcagcagctacaggagaggaatttccaacaaaccctgtgccacttcaaaacaactgtggtgttccgctgcaatccgttggcttcaattctctttttcaatctctttatagtcagaatgttatgataacttcaagaaatacctgtcaccagtcagaaagcagttacaccgccaacaggctaacactgggtttcaagagtagcaaaccagttagcatgggcagagaaactcttaatgtggctactgagactttagctgcgggcagaattcaaatggattcttatggtgacagaggggcatttcaaaatcaaatgggaattttccctttaagagcagaaagaaatcagaatgggttccatggaagctcttcaaatgctgcatcgggacataaagatgatttctcagaaagcttatgggtaagtagacttttgccaaaaacacccatgaaagtgatggacacaacgcgctgtgatgaagaaactgatttttgttctgctaacccaaaaggtttaggtgatagttcatcaccgcaggattttaatgtggagaaggaattaaacaattcacaatactttactagcaaaggaagtgacaatgaaactacaagtagcaaatgtgcggcgcctcaagacgaaaataaaccatcagaaacaatggcatcaatttttgctaaaagattggatgcgcttagacatgcaaatacatcagcagtacatgtggccattacatgtgaccatggaacacccaaagggcgtaatcacaaaacaagttcttttgttgttagttacaatagtcatgatgagcaagaatctggacaaaaaactcacaagtcttctggtggagaaggaagaatagttttatggacaggtgacaaaggtaaggaacaattatctcctgggaatgacaaagaattaggagaaaaggttttgtctaagcatgaaaatcagaattgtgaagggagctctgatggaaaggtggtaccccctaaatgtaatttagaaacaaacacatatattgaagaaattgatcggaagagactacaaaataaagaaggagcaccaaattccatggagaatcagccagataacaaacaaatggtaccttatggtattgtgcccaatgatgtttatgacgaagcaagtgtagtttttggagccttgcagaggctccgtttgtctcgctccgatataataaggtactctaaaggattttacgtatcatctttgaattctggtacttaatcatttctaccttctatctaaatcatgaatgcttgggtttggagattccataacattttctacatttaaagaagggaacatcgaaagaatcacattaaggaatatttcattgggcaacagtaattctcatatagcttcatatggtagtctgctgtttttcagttatcaagtacttcataggggtgactgggaaaagtcaccgagctactgagcacataaaaaagttaccttctatgaaaaacgacatgtgtctcggctactataaagtagaatatgatacatctatttaaagtgaccattgctaatgagaaaatgaataatgagttgtaaaaaatgatacatatgccttacattcccctaggaagccaaaggtgccttaaaattaaaatagctttgagaaatattattgaaacagtgtctgtagtattagtaggtattttctctagtttaatactaatatcagtgtgttctggacttctgttcattgatcaaattaatatacataggggtatccctctctatgtaagtgatctccaagttagggaaaatcctgagaacctgatatttaattcatgtgtttgtactactatttcttgacagatggatgaggtcaccagttatgcacaccaccttagatggctttttcttgcgtctacgatttggtaaatgggaggaagcattgggtggcactggatatcatgttgccaggataaatggtaaatgactaaacaattgtgcataatatgttgcagaataatgtgttcctttcttttttaaaaaagaaaaaacaattagataaaaggaaaaggaagtgatatgccttctcttacaggagtactggataagaatcgcctttctgtgaccatcaggaattcaacttgccaagtagattctcgctttgtatccaaccatgacttccaccaggtaatgtatcaaaagatagtactgttgtccaagttgttatggaccacggaacaacaataaaaaaaattccaagtcaaatctttttttttcttggagggaattttattgtttataattcaaagtctaagataagtgaatctcatcttttctaggatgagctgaaggcatggtggtcagctgccatgaagagtggctggaaactgccttcgcaagaagaactcaatacgaagctacgagaaagagagctgcttcgtttttgaaacggaaaaggcacagacgccccagctccagatgacagatgccaacatcaattacagaggtttttctcttgcttgcctctggtctgaaaacgccagcgatgcaagcatcatcactaccggtcaggctaattaagttctgcactgtactgctgggattgctatccccacggttgatggtatattgagagagaaatcaggctgccgtttcgtgccgtggcgtaagcagcttgtattgtattttaagtacacgatttgacgatttgatttttacgatcggatgagcagttgcacgagttgttaactacttattgctcatcctatctgctgtaaataggaagctactaacagtcacagtgcagtgcaatcgtacaatttgtactactgctgctgctgagtataaatacttcctgaaagaataaaaaaagttatgctggctgccaatctatgctgtgttgggctgggcacctatggttggaactcatcttggacgtaaatggacgtaaaacgacgcaactcatgttagtatgaattatttaagtatcataacttttaaaatagagtaatacaattttctgaagcaatctttccatatatatatatttttttaaaaatacagtttatcagttcgggaagcataagtgtgaaaaacaaataaatagaagttgggaaataatatattcggactcatggatgatagattgacgggtgaaagtaagtttagaaagtataatactagtattttttaaaaaaaaattaataaatgtttgataaagaaaattttctttaaaaaacggattacattatccaatttaggagctgtttagattttagccaaaataagccttactaaactgtgttaatattaccaaaattttgacaggattttatatgtatttatcaaagtttggtatcaatctaagggcccttttgatttgtaggaaaagtatacgagatttggaggattttaatcctatggaaaatatttctatggaagcttttgaaataattgattgaatcctattctatcctctaaaattcctatgtaataagtaatcctatagagattttggagaaaagttagcaagaggttcaaactcttggaaaaattcatttgagtctatctctttcatccgattactgtgttttttctgtggtccaattaaacggtcattcttgtgtttttcctgtattttctaatcatctgttttacacttatattcctgtcaaaatcctacgtattttctattcctctgtttttctattcttgtgattcaaagggaccctaaatgtaaatatttttttagccactttacttaaaaaaatgacattaatctgaactgtcccttaatagctcgagaagtgtctccacgatgacggggcctcacccttgagaggcggagatcacgcccgataccgtcgaacggcgagcgcggccgcttgcgctttggcatcagagccgcgcgcgtaacgcataaaacggcagattagtcgtctgcccgtgtccgtctcagctcgagaaaaaccatcgaaacctgacgcgatgcagcgctgcgtacgtgctgctgcgacgcgacgcggcgatctttaccttttgcctcgcttctttcccgcacgcgcggctcgcgcatgcatgcacgatgcgtatccccctcccgcaccggtccctaccttagctccctccaccaccgcacacttttggatctccctcccctgctccaccctcctggcctcaaactaacctgcatcttcgtcgacgcgcgacgccctagcttggcgcgcgacggacggatcgatcatcggccgatgcatgcatgggcgcctgtgttctgagccagcatgcggccagctgcatcgtcgtcctcctcctcctctcgcgaccggctgacgatcagccggccgacggagaaggacgacgtcgtagaagagaagagggacggcggcgacgtgacggcggccgtgccgaggctggcggtgtacggcgccggccgcgtgcacgagatcgagcggttctcgcactacgttggtacgtacgtacggtttctctccatcgatcacctaattaatttacgttactttgtttttgtttgaagccaaaccttaaacgtacgttgctcttctcacgttgttagccagctagcgcgtcgcgtcgtttctgaattcttaaattccatgagacgtgtgctccgatagtccgattcttataatgattttcattgggatcagttttacattcgtaagagcaagtttaatagcataactcattactatctccaaatcatatatagaaaatacaatagtcaattcatacaatagcgcttactatactattaatacccgatctcacttgtcatacacacattacgtcttgaagccgtgctgcagctggctacatatctatagcctgctgtttttctctctctttttttatctctttaaaatatgtttatagttgacttatagcctgctattgtacctgctctaacacatgaggcaaagaagcaaagctagtggaaaaaaaaagggggaaacttgaatgcaggtaaagcgactttggagccagtccatggacgcatcctctgtatcggattcgatgcacagagttttgcatctgaacattttggttaagctagctgtagtgtaaaaagttcacatggaccaaaacattttattctcaacacttcacaaatgcaatagaaatgactccggctcgggcgcctgatggagggtttttaaaatcgggagctgatttcagcatgacatcagcgtcacgtatccttgcaaaaccactttaaattgatttttctcttaaattacttacccaaattatgatccgatcgcactattaaattcattacaattaaaatttcaaaacaagaccacacatggatatattccgacgaaaaaatagcttattattgaattatttttaaatgttgcacgatgttccatcaggtatatcggaattgtttcactaagtagatcgaaaatgtttcactcgtttaaatcgggtgttgtttcaccttatataaaaacaatgtttcagcaaatagcgaaagaatgtttcagttcactataacgttagatctatgcatagtgaaacattgtgagtacactaggtgaaacattttttatggaacaaaaaatgaaacgaattcccataatagagggtttccaaaatatgtaggtgatttgttgcaatagagtatttcagttcactgcaacattagatctatatatagtgaaacattgtgagtgcactagatgaaacatttttttggaaaaaaaaataaaccaaattcccttaatagagggtttctaaaatatgtggataattaatttgttacaatggagtatatgttgcaaataagtggcaggtgagagcagagacgtggtgaggctcagggacagagagcgcgcgtcgtggaggagggagcgcccgatatttctccctcccccgagcgaccgatccggggcattccccaaatgcaatagccattttttacgatcatctgtaatagtatatcgtacagttttgtagcgcccgttccgtcgtggcgcctagcgggaaaactatctcttaaaaactctatttgcgaaatctgtttctttgcttgttgtctagtgtccgtgccatctcagatctcaaatccccgatctatcgccgagttcaatcccgaatccaaatccttcccaaatcaattcctccgcaaaagtctattttgcctccccgggttcgatgggccgaatctctctcggcccatctccccctccctccccgggtctctctctctctctctctctctctctctccctcttctccgctctgcccgcccgtcgcgcgcgcgtgcgcgtgagccgcgccgagccgagccctcctgcctcgcgtgcgcgcgcccgcgtggccgctgccctgccgcgcctgcgccgtctgcgccgcccggccccgctgccccgccgcacctggtggccgaccgcctggtcgccgccgccgtcagcctctgccgcgtctgcccgcgcctccgcccgtgtcgtcgccccgctccaaaccgccccgccgtcatcgccgtcgtcatcgcccggcccccgccactccgcgcgcaagctgccaagggacggaggcagagctcctcctcc

SEQ ID NO: 81670 - DNA, 2754 bp, Oryza sativa
ttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacctttatatggattttaattaaattatgacgcatttatatggattttaattaaattatgacgcaataatgaattatttttgaaaaggaaaagagaattattgcgtcagcggctagggtttcggtggaccgggcgcacgggcgacggttcacgcgaacggacggccgagatcaatccatccaaaacggacggccgagatcgatcggtccacgaccggctcacggggaacggcaacgatgacgtcagcgacgacgtcacctccggcggcggcggctcggcggctcggacggcgcacgctcgccggcgaacggcggcgcttcgacacgaacggaaggcaccaacggatagaggacaacgcggcgaactcaccggtgaccaaaaccacggcggaagagcaacggacggcgccggcgacgaggaagaagcggcggcaaccttcgggtcgacggcggcaacggcgctccggcggtcttcggcggcggtgaagcggcagacggggacggcgacgaccttgcgaacccgatggtggcgacggcgatcgacgacggcggctgcaacggcggcgcgacgcggctgaaccaacggcaacgacggcggcgactagggctacgcggaggcggcgctagacgcgacggcaggctaaagcaaaggtggcggcggatagaggagagctcgggggtccttttataggtgcaagaaggcggcggcgaaggcccacggcgaccggtgacgagaaggaaagatcgggttcgggagagagagaggaatccgattcgatctcgaatccaacactttccaagccgatttagccgatgtttccaaaggggaaaaggaagaggagatcgaggagattgtttcccctctatcgattcggccggagaaggaaaggagcggccggatttggaaggagacggcggcggcttgcgctagggtttcgggcggcggcggcggcgcgaggaggaagacaggcctgacagacgggccccacctgtcagcggctgagagagagaggagagcggcggctcggcggattgggccggactgggccgagggaaagagagagagagagggttttgggccggctttcggcccaaagccaaaagaagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttctaggcttttaaaatcatttctaataattccttttaaacaacaatttataatttaaggatttttaaacaagaaaagctcttaacaattataattagatcattaatgatcaaataattactgaactgttctttgtatcatttaggaattgagctctgaaaaatccgagaaaatttcagagagttgacttaatcatggagaatttaataaaaattaaatccatccatgctttagatttaggaaattttatttcccacattttacttcacttgtaaattaaagaacatttaacataaattctattattaatttattaaattatttataaatcctgaaacaaaaatcaggatgtgacaggtaagctccaataacatgtgtcttaggctcttagacacatctattacacccgtgcggctcttagacacgtctattacacccgtgcggcgcagcgcgcgagacctttctagtactattcttatgcccaagaggaatcaagccatatgaattaaattagtagctaaatcaaaaggaggaatttggaatatttggaaggagaactaaggatagctttaatatcaagagacgggtcaacaattaattccaataaaattggaattgcaaggatttggtttggaggattttcttggaccataattcataaaagggtttcaaataatttgaataaaggatttttaataaaaaaagtttaatattcaaaattagatttcaatcaagaaattcctcaatttaacaaaatatatttttaaataaaaaccacaaaagagattgaataccaaggagaggttttatgcaagttagttttaggaggtctctctaattatttttttctaggtttagaaggttattagaaatataagaatcggcatgacacatgactagaaaatagttaatttttaggatgttacaaacctaccccattaaataatctcatcctcgagatttctgaagagtccaggtagtagtgtgggaattttattctttctttggtccttcccaaaattccggatatccgactgattaatctgctggtagataacttgtattcttggaatattcttggatgtatgcattgggtaataaaaagctgtagattacttgatttaacttcatgtggttcaaagtttgaaaatccgacacttgacagcctttccaaatagagacatgtcatagggtatttctgcataggattcgatctttcgagcatatatatatatatacacttattgaggaggtcagactttttt

SEQ ID NO: 81671 - DNA, 28409 bp, Oryza sativa
ccatttgatccttatctgctaaaagaatccgacaggtgtgcatcactaatatccaataaactcttttggtagcaattctccagtgctgcttaccttttttttttgtgctttatgtgggttaaaatagtctctctagcaaaccttaaatgcattttaaaaaagagtcttgttgaatatataattgtgagctgtccacattattacatattatacatttatactaatgctctgttctgtctgattgccctgcagatatatgcgtccaaattttgagtactggtccatggtcaagacgacatacaacaattataacagtgatgttgatgatgagctagtggacctcgatgcacctgaaatgaatgtcggcagtttagatgatcatgttgagatagatctcaacagtgatgatgacttggaatactccatgaacaagatgtccataacgccgaaccgctctttctttcatcaaattatggcaaatagtgacactggccttaccatgcctgcgaggatcagaccatcaataagccccccatcataatgggtccaaagatcatcgccgccgccaacttgttgttcacttcacaaaagaaacagccgtatgctgggagtgcattaggatccagcttgtataagagtacaagtatcggatagaattggagctttacttcatagctggtagaagggtcgaacgacccatcttttgcgatgtatccagcccaaataggttagttgttgggatgaaatgtgaagtacagatgtgttattaaaaacgaagcgggagtggttgtgactatagactagcaggtagccctctggtatgtaaaagacaggcctgttttgatgtagaacgatttaccaatattttttatatcggaacagcagctgtctaactttgatactagatttggttggtcggtgctgtttcctgaatatgcgttgacacttgacgaattcctatatcgtccattcgtctgtgaagtgtcaacttgttcaatactgtttaaatttcaccatacaaatatctcaagtgccgagttgttcaatactccctccatactcgtaaaagaagttgtttagaacagcgacacggtcttagatcaaaacacaactttgacttcttatttctataaaaatatttattaaaaagtgatatatgtatacttttatgaaagtatttttcaagataaatctatacatataatttttacatttttaaactcaacaactttagagttatttatgatttatattctcaatgtttgatttaaacattgtcctaaacgacttcttttatgagtatggagtagtactctttaatttcaccatacaaataaacgtgtcaacttgttcaataggactgtttaattttaccatacaaataggcaacgcagtttgtcctgtcaagtgtcacaactggttcaatactgtttaattgcaccatacaaatactaggcaacaaggtctgttcacgtaatctcaaagttctcagctcagccagtgaatctgaccatcaccttattcaattgataaaggcctatatataatgctctggtttttttttttgaacagaaaaaacagcacagtagtgctttttcattgaatatagaaggagaaaatacaacccctaggggtaaaacaaaaagatctttagactatacactatacagagtgcgggatgagctcgcactctgcaaatataatgctctggtttttacgtacaagacagcatcacgctttattctcgacacttgtactcgctgcaaatgtgacgagcttatttatacagatcgacgcattcctgaacctgtgaagcgtgaaccattcagaccctgcaaagccaccatcacacggacacggagagcgagtcagctagcgaaacacataagaaagcacgaaaatacaatatagatgcatataaaagcgtactggttgtagtcgatgacgatcctgccggcgtcgaggttgccgatggcggcgaaggcctccctggagaggtcgagggtggaggtgcaacccggcgacgggcagcggtcgacgatcttgacggtgaccgtgccgccgttgcaggggttgggcacggcgttggtgcccctgacgcaacgcaccgtgtacatcctcccgcacgcccgcccgccgtcccacagcccgtcgctcgccgccgcgatcatcgtcccctggtcctggaacccgtagcacgccgacgctgcaccgcaacagcacaagttactacagaaaatatgttccagaaatggaatagtagaagactgtccaaatgtccaatggccccattcttttctccttaagatgtataaattttatctcggtttctattgacacgtttttcaaaccgctaaacggtaagttccttacaaaaactaaactattaaatagatctatttttaagtttgtaataattgaaactcaattattcatgcgctaatagatttatcgtttgtgtgcgctaatatcatctttatcttaatctatctcaaacagacaaacaccaccacatgtttggtttatgttattttcatctttactaattttagcattatcaaaattttacaagcagaaaccaaacacattattattaccatcataagttcatggccctagcaaattttagtaatttgggcactctgcaatccgaaaactctcatcagagaatttggcgagagcttttctcctatcaaaatttggtattattggcaagttctttttttccgacaacaaaccaaacacatcattcagaattaaggagcagtttggagatgtacgggtgtaaacggtgtagaaggtggcggtcccttcgatggcctgcgacgccgagacgaggcccaggagcagagctgcagcgagcaggatgccaactctagccatggccgccgctagatcagacacaggttctcgtgtaggattggatgagcaagaagctgaagtgatgagttatccattgctagctacgaggttgatttatagaacagctgctagcctggtacgtactctgggccgtggaaaatcgtgcctgatgcatggaaagttcagacttgcattccgtccagtccgtaggcaacaaacttggaaaatttttagtcctgtgttgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaacatctgcccctagaggcacccggaccccccttatatataagaaggagtccggattacaaaagataatctatgtccctaacggaatacagtcgtgaccgactaagtcttaaggtgtttccttgatatacaagttaggaaacaaacccaggatacatataagatattctatctatattcggtatcctatattcagtccaaatatcatcgccgtgtagatatgggatatccataatctccacagtagcccccgagacctttgcagtcaatcatcgtagccttctcaaagataataatccgagtgcttcaaacttttcatgccaaggcctgccgagtagcgaagacaaagactgtaaagggcgaaaagataaaaatatggtgcatcgaatagatgcacctaattaggtgtagcccccaactatgtgattagttaacgaactaaacatatagttgagagaccaaataatagcacaatcgtgcatcatatgacaaaagcacacacggcgcctaaataggcatgctagccgaccgctttttagccataatgaaaagagtccgagtggtttacactctaaaaggttcacgaatgaacacactggacaggcatccgaatataaaactctaaagattacccaccaagtattataaaaattatggtaatgaataagtctaatagcctaggctatgactatttaccataatgaaaataggtatataacataccaaggaagtgactatgataaaaacaagtcattccaaataacccagacagcttttgtagcctaataaagctaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgcttttaaaagtattgggctgaagtactgttcaggcctaggcccatttgcacctccgatacccttaacaagaaatcccgagatccaagcgacgcttcgtcttccccgccggaactctcaccattttccccactccttgctacagtgtagaactgcgccggcgaactagggttcaccactccactcaaatccaccttcgaaaagtgcatcaaaatccttcccgtgatccaccgccttaatccctcatttctccctagccatccctcgaatcaaatcagcgcattcggataaaatcgatggcggaagagaaggaaagcttcgaaggccaatgggcgccgtccgacgtaacggaagagaacctgaaggagatggtggcgcacggcgttctcccagccaaggagatcatcgggtggcggccagcgtgcggtgaggcttttccgacccctgatacacatgagatcgtagtcttctcgcatttcttctatggcggcttcgctcttccgacctcgagatttttccgcgggatattaagcttctatggaatcagcttgcatcacctaaacccaaattccatagtccacattgccaatttcatccatgtatgtgaagccttcttaggaattaaaccccacttcgccctgttccgccgaatcttctttctcaaaccccaaccaaacaagagtaagccatgtgtagtcggaggggccggatttcagctgaggggaactctgagccagaaatacttctcaatgcccttcaagacttcaaacaaaggatggcatgcgaactggttttatgttcagaatcctgagcctgctcttcccgaatactcttgtcttcccccggtgtaccaagacacttggaactctcttccaatcggagatgaagctgcccaagccttggaattgttggatcgcatgttaaaactcaaagaacgaggcttgcaaggagagcagatcactcggcacttcatcaaatgccgactggcgccaattaaagaaagatcccgtacagcttttgagtttgacggcaagcatgatcctaatcgcgaagaaccagactctctggatttcaaaatcatgaaggagagaatgtataaaatcttctcaaatgccattgtcgtcagctactcacaccagctgccagttgtgccatataatgcattcaatccgcctccgcaggtatgtatctgaaatcttcaacttatgaccaaaatagtatcttgtcttcatgttgagttaactaaccatggaggcatctcattcaggaatacgtattgatgaaatctgatcccccaattgctcagcgccgatctcctcgccagcacaccattcagggaagtggagggccgacaaacaggtcagacccacaacctcaaacctccaaaccggctggtcagacaggtcctcgtaagagaaagctggtgcttaatgacgacgagggcgatgacagcaacaaatctggggacaagggcacgcccaacaaactcccaaagcataccatgcccaggaaaaaactggctggctgtcaaatgccaaagattagaacatcttccaggtataaacttctcggtaccatctccctttgatatgcttctctcatagaaattatgctgaatatcgaaaggacactttgcaggaaaccgtccgacatagatccaactggaaaagatcctgatccggctgtgacagagccaaatttatccaaagatgctaagccgtctgccgaaaaccagccgactgccgaaagccagccgactgccgaaagccagccgactggcgcccatgcttcggatgacaaagccgatccgagtgaccagccgcaactggagaccagtcggcaacagctgaaactgcaacaacacaagagcccccgactggaaaccagtcggatgtaggtcccgatgaagaaatccctgaagttgaagtgcaaacgacaacttcccaaggaccagaggccggtaaagactcaatgattaggtctctaaataaagaacaaggaccacctcatgttcagccaggaacatcctcaggtaacacatcttctcaagtgatgccgatttaaataacttcagcttactcgtccaatgtcttggaaatacatcaggaacactaggcgatgacgaagaaacaattcctcgcataaaggcggctgatgactcccgtcctcctatcttgctcaaatggtgggacgagaactcgcaagttgccggcatcgttataaatcgtcaaaaagaagatgaggaagtgtgccagctgaagaaagcacttggagaagccacttgcattgtgaatgtaaatcttccgggtgactgcctttaataactttgttctctctttagcagaactgaatcatgatccatcatgcagagaatccatcttcgcaatgaggccaagactacaactttggaaaagctggttcctcatttgggaactcttgaagcagttagggaccagctgcatgaggccaaggagtatgctaaaaagacagagaaggagttaagggaccgaattgcccagctccaggattcaaacttcgagctaagtggttcatcaaaaggtaaccttccagatctattccattgatttatgctgtcataactgtatcctcaaatatttggatttcaaacagcacaagctaccaggatggcacaaatggagaaacagattgaagccttgaaaagagacaaagtagaactagctgtgcaaagggactcagccttaaaggaggttgaaggtactgccagctgacaatttgaactttcctctctttaatgcagcaaattcttattataaatgtgttttgtagaccgtaaaatcaaatctcaagctcagtttgatgtcctggttggtaagatcaagaagcttgaaggagcaagagacgaagtcgccaatgtcgctacaccacttgtccaagctatgttccttaatgacagtggtccgagtgcacttgacgcaaccgaaatctttgacaagctgagagtagcaccggatgtatacttcaagaatatcaagaaagctggaagtatgggagctagtatggcattggcgatgaccaaatccttgtacccgaggattgaaattgacgccattgatggctttgcagacgggacaagcgaagaagctgctcttgatcttatcagtaatgctcaaagtgcggctgacaagattgcaagtgatgttgtagaacaattccgcaacaacgaccttcagccgagcaataataactctgatgatgaaaggactgattctgactgagtgtagatgtagcaaatggaggcttaatttgtacaatactggtgtatttatgctgtgcttgatagttctaaccaagtctttgatttcttaaaagcttttatcaagctttgttgagcctaaaacccaaagaagctattaaaaactttcagtcctcgcagactaagtagaaaaaatcaaacaaggcaatgatagaccaagtaagcaaattaaattgataaaaaatcacactccattattatgatgatagcccccgactgacaacggcaagaagaaaacttgatgttgacagtcaagatagggaagtacaatgataaacttaagcgtagaaacgacgaagatgttcaatgttccaagagttgtcgacaagagtaccgtcttcgcgcttgagtcgataagaacctggccgggtgacttcagagataataaatggcccttcccatagaggagataacttgtgccgatctcgtgtagtttgaattttcctcaaaaccaggtcaccgactaaaagggcacgagatcgaacattgcgattatgatagcgccgcaacccttgtaaatatcgagccgaccgaatcaaagctgcttcgcgggcttcttccaatcggtgcaagtcatccactcggtcttcttcgtagcgttcttcacgaaaattacgaaagcgcaaagactcaaattcgacttcactcggcaacattgcttctgccccatagacaaggaaaaaaggtgactggcctgtggcccgactgggtgtagttcgcaaagaccaaagtaccgatggcagttgttgcacccatttgccggcatagggttttagccggtcaaagacacgcgctttaatcccttgaagtatcatgccattagctcgctccacctgtccattgctcatggggtgtgccactgaggcgtagcaaatcttaattccgaagtcctcacaaaagtctttaaaaactccgccagtgaattgtgtgccattatcagtgattatccgattgggcactccaaatctatgcacaatgttgatgaagaagtctcgagcattatctgctgtgattgtgacaaccggtttggcctcaatccacttggagaatttgtcaatggccacaaagagatgcgtgtaaccgccaactgcctttttgaacgggccaaccatgtcgagcccccaaaccgcaaacggccaagacagcgggatagtttgcaactcttgagctggtagatgaatttgtctggcgaaaaattggcaaccttcacatgtgcgcacaattttgtcggcgtcggacactgcagtaggccagaaaaaaccctgccggtaagctttgccgacaatggtgcgtgcagcagcatggtttccgcatatcccagaatgtatgtctttcagcaattgtctcccttcctctaaagatacgcagcgttgcagaattcctgaagggcttttcttgtataactcagattcatgcataacataaagtttgctccgccttgaaatccgctcggcttcatcttcatcttgagggagctcttgagaagttaaaaatcgtatgaagggctctcgccagtcggcttcaaccatagctacgtcatgagtgtccgcatcttgagtagtatctttatgaggtacggtcggtgtataaaggtgttcgacgaaaacatctgagggcgccgcctcgcgcttggatccaaaattggcaagtctgtcggcggcttcattgttgtgtcgaagaacgtgactgagctcgagtccctcgaacttgtcttccaatttgcgcacctcttgtcgatatgccatcatattgtcgtcaatgcaggaccactctttcataacttggttgacaaccaactgtgaatcgcctcgaacaatcagacgctttatccctagggaaattgcaatccgtagtccatgaaggagggcctcatactcggcaacgttgtgggacgccgaaaaatgtatccaaagcacatagctcaatctttctccagttggggaaatcaaaaccactcctgctccagtgcccgaaagtcgtttggatccgtcaaaatgcatggtccagtgctccatgttctccgcgggggtatcctcctggcactcggtccattcggcgacaaaatcagctaacgcttgggacttgattgaaattcggggcttgaatgatatgtccaaagacatcaactccaaagcccacttagcaatacgtccgtttgcttcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaataaatcggtcgctggactttttggacatggccttcttcctcgcgctcaacgaccaagactgtgctcacaacctgggaggtagctgatacgtacagcaacaacggctcctgcgggtgtggtgaggctaagactggtggctcggtgagaagtttcttgaaatcttcgaaggccttctgtgcttcgggtctccactggaagttatctgttttcttcagcagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatgcccctatgagacaccataaagccaagcagcttccctgacggtactccgaaggtgcacttttcagggttcaatttcatcctgaaagcgcggatgctcacgaaggtttcttctagatccgagatcaaatcatccttttgcttggtcttgacgactacatcatccacataggcttcaacgttgcggccgatctgcgttgagaagcatctttggatcatacgttgataagttgctcctgcgttttttagtccgaacggcatggtgacatagcaataagctccaaagggcgtaatgaatgaagtcttcaagcagtcggattccttcagtcggatctgatgataccctgagtagcaatccagaaaactgagaagctcacagtcggcggttgagtcaactacctggtcaatgcgaggcaacccaaaaggatctttgggacaagacttgttgaggtcggtataatcaacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactctttgaaatcttggtagcgggcacttctccttcgctcgccgtggctgcagccagtcggatatcctctcgggcggacgccatctcgcgggtttgagccatgtcgcaactctccttgttgcatgtgacggcttgcttgatgtcactccgtagggataggactcctcggggaccagacatcttcatcatcatgtaagtgtagtgcgggacggccatgaacttggctaacgccgggcgtccgagtatggcatggtatgctgtctcgaaatcggcgacttcgaagctgatgttctctgtgcgaaagttttcccgagtaccaaaagtgaccgggagggtgatctggccgagtggagttgcggatagtcctggaattactccgtgaaaaggcgcattgcttggttttagctcggagcgaggaatctgcatatcatccaaggtcttggcgaagaggatattgagtgcactgccaccgtcgatgagagttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccagggggccgccgaagatatggttgagctccttgcggtgatcttgaaaacctgccggggtgtcgccgtcatccttcttcctcgacgtgctttgttcttcgtcagagttctttcgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtccttatgattgttacttccacctcctcccgtagccggcgtacccttgttttgcttccaactgggacccgactgctttgatgcggtgacggcgtcttcagctttggcgtactcgttggctttttcaaacatgagcttgactgtcctgggaggcttacgcccaaacttgccgactagttcttcgtggcgaatccctttggtgaacgcggcgatgatgacgtcgtcggtgatgtcggagatcttgttacgttgttcagaaaatcgccggatgtaatctcgatgggattctccggacttctgaatgacgttgtagagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtctcctcctgctgcgcggattgcgagaccgtagacggtaagccacgattcggggttagtggtgccgtcatacttctctattccagtcggtttgaagccggctggccaatccactcgacgcaggtcgtcggtgaaggctgctactccgtcaaggtcgtcgtcgtggcggtccggcgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcgccggtgatgctgaggcttggatgacggtagtcatgagatcggaagtggggaactcggctgccagtcggcgtgtggacgctttcggagttaactgggaccgaagccgcaatcatggtcttcgtctggttcaagatgttgacgacgtggtcggatcgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgctgacgtcgatcctcagcctccttcgcggtccgctcacggtcctgctgctcacgccgtagccgttcttgttcttgtgcttgatgctcctcctccagtcggcaacgttcttcggtctcccgggcttggcgttgctcctccgtctcattattggccatgaaaacgccaaagtagagaggggtgtagttgtcatctaggcttccgtcgaagtcgtcgaagtcgttgtagcgagaactaaattcgtcgtactccacgatgtcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaagacgctgtcgtggtggagacggccgctaaatcgtcggggagcttcatcaggactggtgggtaagccccatcatcttgatctggtgtcgttggagaagatgcgatctcggccgagtggtttgaagccgactcggttgagatggtcttgaagtagctttcagccgcgttcgggaatccaaacgggaccgaaatccggttctctcccgactggtctgattccgagtcgaggagagaaatcttgccgaagttgttggtgacgaagtcgaggctgccgaaccgaaacgtctgcccgggcgggaagacgaggtcgtcgatgccggagatggaacccattgcactgatcggcgaaaagcttgacgctacccctacctggcgcgccaactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaacatctgcccctagaggcacccggaccccccttatatataagaaggagtccggattacaaaagataatctatgtccctaacggaatacagtcgtgaccgactaagtctcaaggtatttccttgatatacaagttaggaaacaaacccaggatacacataagatattctatctatattcggtatcctatattcagtccaaatatcatcgccgtgtagatatgggatatccataatctccacatgtgtgtcttaaggttaatcttgagagagatagaaagagactttaccggcagaacatactacaaccatttgttttagtcagaagagaaaaatgaaccgcacaacattgtgcatctggaaatagccaaatttccagtccagaagctcaatacgccgccataatgttgacaaactagcgcctatctatataccgacctattataggcaatttgcgtaattttttgaactgttggaaaaaaataaagggttgaatccactggaaaattcagcaagttcgctatcctcatctggaagctgatctgtaaccaggaaaaatattatttcttcagttacgttcatcggtttatgcaatggaaaaatgtgccaagtttcttcaacattgtgcctgatttcttcaaaaatgtattaattactaattagtagcagagctactgggatgaacacgaagaaaatgcggatgaggagcaaaccggatgaacatccatgacgccatggactcctctacgctatagcgattagcgatgacgaggacaccgtgtgggcgcttcgcaacttgccggagatcctacggagttcgccgccgcgtgttcttgcgtcaacatcgccggagaacgcagcggccatcacggcagcgccagacgcgcccggcgcaagggaaaaacaaagtacagcaacgaacggaccgatcaacttcgagtcccagcgaacggtgcagattgggccgaacatcaataggagggacaaaatggtccgctgcttctcgccttctcgtgggttcaattgggctgtgacgggatgaattcataccgtggactcgatttgcaccgggttttcaaagatagggaagacgttacaccgagtattgtgattgagggggcgattcaatcaggattaagagtcaagggaaacaaaatagacttattcatttttagagaatctctggttgttgtttttttcataggaaacagtagtggttttgaagcaggaattcgttcacttcataaatcatttctttttattgaatttcgattctgtatgtacatatgagccaagtccacctaagcagtgaaccatgagacctacgactctcagatgatcatttcttcatctagagcctgcaaaattgcaaaaacaacacctagtgagtgaaaaataaacattgtatattttatacattacacacgactgacacgagtatttatatgtatatatgcagagtatggtacgtactgttggtagtcgatgaggaccttgccggcgacggggttggcgatggcggcgaaggcctccctggagaggtcgatggtagcggtgctgccggggcagcggtcgacgatcttgacggtgatggcgccgccgcggcacgggttgggcacggcgttggttgcccgacgcaccgcaccgtgaacatcgtcccgcagatcttgccgccggcccacagcccgtcgctagccgccgcgatcatcctcccgttgtcctggtttccgtagcacgccgacgctgccaaaaattaagcaagatgtcggcaaaacgaatgttagatctcacgaaaattataggtgaatttggagcttcggaaatgcgaaatgtgaagatgtattcgaggtaaagcttaagactgaagtggtgtacggttgtaagtggtgtagaaggtcgcggtgccttggatggcttgcgacactgacacgaggccgaggagcagagcggcagcgagcaggaatgcgatctttgccattgactacttgtggtgttttgatttgacaaaggcaagattattgcaggttgcaacttcagttcttgtcaggacgaaaaatctttgacggtaacaaatttgttccaatacggacagtcggacagaagaatttataggagaataagagatactaaatctgtctctggagtagtaaataaagggagttaagaggtaccaaattaaatccgaccttacgctaatgtggatatatacatcactttatcttatcctgggagacatattaaaatgtgtgatttgtttagagaaaaaaacaaaaaagtggaaaaattgtcctggtgtggatagaggatcagcatgataaagagactaaacttactacgttgatttagcaacataatgacgagtcttataatttctcatacgatcgaatataagactgacatttgttaatgataaaatgtacataaaattttatatatctgtttctaccgatttgtaagttaatatatgttgaaaaataaactacgataaaaacatcaaaatcaacttaaaattaagttttaaaatgtaaatcttatctacgacttataagaggagcaaacgatgaagccgttaaactctcggacagttctacttttttccaacatggacggctctatctcctcaatgttgcatttgttacaattctaaagactactaaaattgactacacattacgtaagattcgttgaaattgagtagtcccatttgggagctttttttagtttgaaagactgacaggtgttacattttagtgagcacaataataataaaaaattttctcatcaatactcgatcataatccttgaatattcccaactatttttatgtactatatccaaatacaatctccgggtcattaaatcgttgtaaaatgcctaagcagaaggtacaccataaatgcacacctatctctcccttccccaatcgcacacaactccaaaaaaaaacatataattgtttacgctgtaaattatattatattatattgtaaaatttaaaatatttgcatatgcaattttgctaatccatacaatataataaaagtgagataaaaataattgatgacctacttaaaaaaggaaatagaagaaacataaaaaaccttacatctaaaagaaacgagatgtagcaatcacacatgaaaaaagtgtctggaataaggtaacaaaaaagagattatctaaaaaattgccgcaatttttttatgggaaaaaactttcaaatctctaaagtacaattgtaatatagttccatataactatactataactataatataattttatataagtattaaaataatatatgtaactttatttatatctaatttatatagagattataatatagttacaatgtctaccattgtagttacactataactataattaatatagctacatttaaaagttttttgccaaattataaaaaaaactcgcgacattttttagcaatttccaaaaaagaatatggcataccatatttttaacagaaatatagaagtttgaattattcaataatcatttacataatactttggagcacttgagatctcaaagctaagccacctttcatctcgcttgatgcattttctctgaatagaactccagctgggcggctgcagtccaggcatgagtccacgaaggatgcctttcattagcttgtcacagtcttctaccgacagagatttgctctcctcgtcagacagcctcggcagccggccggcggcgagctccaccgcgacgtccgtgagacggccgacgctctccacacagacctcgtcggcgaagcagcatctccactcgaacacgcgcagcttgggcgcgcgcacgacgagtaccgggtgaagagggcacggaaccgcgggagcaggtggtaggcggcagggctggacgacgacatgggctcggtcgggcagcggcacgacacgcggatctccctcagctcgtcggcgaggacggcgatcccggccttggtggtggcgctcattaggtgacgtcggtgatgcggaggcgcttgagccgcggcatggtgtcggacgtgatgtcgatgctggccgggagcgtgcagtcgacgatgtgcagctcctccagcgaagggaagacgacggtagagaggaaatcgctcgggcgcagcaccgtcaggccgtccaacgcaagccaccggagggaggtgacgccggggccacgcacgcgtggcggcctcaccgcgtaccagtacaggcctagctcaagctcggtggtcgccggcggcagctcgagcgaccacacgccggcgtcctcgtcagggagtcccctcttgcactggacgtgcagctctagcctcgacgcgttggccagcgcgacgaactcgttcgcgtaccggcactcgaacgggacgtccttccggtaaccaatgtggagcgtctcgatggtgtcgtgcaggccaccgtcgtcgtgacagcgttggcgaagcatgcgctccatgctctgcacgcgcggttcgctcgactcgcctagagatgcaaggttgccaagtaccgacatacgaaaccgaacgtttggaagccgggtgtggagatgttgccacctccgtgaaaccgcggcagtgcgcacggcgtcgtgataggggcacatggataggatgtgcaggaggatgtcatcggggagcttgctgatcagatcctcctgtttctcagtgactttcttaggctccgcttgtggctttgacacttttccatttcttttgttctgcctcttctttccagccatgatgggcgagtcctaatttacctcctcacgctggagtacgtgaaagaccaacaactgcacaccttatttatagggtgcacgtctattgttttccgaatacatgttgtacttactagtacctattttaccaaaaccgaactggattcggtacagagctctcaggctctcaccccggcacgtacactaaacggaaaagaactccagcgcggacacggactacaccatgtccaagttgcacgctgcacatggcctaattaaccagccatgcaagtccacaggccagtaattaaggtcaaacgagtgatggtcgattttaaacaagaaggaaaaataccggtttttgggtgccagtaccggtgtttgaagcagctatgcgcgtcacgactctcatgacgtgccagggcgccgcgacagcgaagaaaaaggctattgggcgatcgcgcgcgagcgagggacgagcgatcggtcagatttgctatttctattttccacgtgaaacgtgttggctgttcccttgccgtcatcagcccttctcaacgaatgaacaagtatatgtgaccttgctttatggtcggctcgatcattattcatgccttgttcgcagtgtctgagatggaaagtgaataggtctattttgtctccctcatctcttgctcttggttaaatcgcatccctcaaccacaaaaccgcttataacacctcccacaatttaaaaaacagtgcaaattgacaccttaggtggtttggaaagtaattttgctaacgtggtaggtcgacttagtttaagtgtactgacgtggtagcctagtcatcaaagaagtgaaaagagaagtggatcctacatataaatgacaatgataaaagaaaaaggtaggacccacttatcaacctccttctccttcttcctctcttctatttctctcgcgttgccgcgacgacgagcatgaattgtgaccacgggagaggatcttggcaatgcagcggtagttcccctccctagcaccaacgaggttcccaacgggataagacaccggcgtcgtctgcggcggcaaagttgcaaaggaagagaagcggcgagcaactacgcgtggggaggcgatcgagtagcgccatgggtggaggatggcgagcttgatgtccttggtgcggaatacaatctcgctgtggacccgactgacatctgggtcgtcaatgacgactgaggagagatcatgcatgtcacgtcagtaaaactgctttcaaaaccatccaaggagtccatttgcactggttttaaaaaattatgggaggtgttatacccggttttgtggttggggatgtgactcaatcaaggacaaaagatgagggatgcaaatagacttataccgatgaaaaacgaaagagcccattttgttacctgttttgggctagatttgttccatttttattgtcttcgcaagggaaaagtacaccaaaggtccctcaacttgtcatcaagttacaaaatcgtcccgaccacaaaactagatatcggccgtcccttaactaatcaaaatcggtcacagtaggccctttggtggtgttgaccccggttttgtcctacgtggcgactgagtcagcgtgggacccacgagtcaggatgccacgtcatctatctccttcctcctctctctcactctcctcttctctgggcaagccggccggcggctggagaggaggtcaccgggtgaggcgggagaggaggagagcagcgccgcgacggcggctggctgcggccgttccatggaggccacatcccgcgtcagcaacaccaacaaccacccggcggcgacgacgaaccttctcgttggcggcgacgacgcggccgtccacggggagacagccgttgctcgcccctgctgccgccagcttctcctccgcctcccgcgcccaggacggcgacagccgcagcgcacgcatcaggcggtcgcagcgtttccatctcaatgtttcagttccagacaaacactgcgatggcgagcacagcggcagcaacaacaagtgagcagttcccaccggcggccatggggcccgtcgccgctgcgccgttgctggaagaaccgtcgtactgggcagtgacaacctcgaaacagctgacgatgcatacgacgagcagcacgagcgcaatgaccggcttggaagaagagcgctccatcttgttctgctttcgcttgcatgttcaaagttcagaactcagagcagagacgatacacttgagcattttgctcaaaatggcaggatttatatagaattgcttgatggaattatctgtgaatgttgacatggtaaacatagtacatatgcacaatacaagtttgtccttttctctcgatcgtgttctgctcgccaggttgagttggggttgatctgaacggctggtttgctgttgcatactcgtctgaaaagttcaacaagcagatgaggtgctggctttgattttattgctggtgttccttcctttctgcctgtaccccaaccaccccgctctcctcgaggcgcagcagccgttcgcctaaaaggaaaccagtactaacctcaggatggtgatggccgcgacagcctgatgcgtgcgctgcggctgtcgccatcccggcgcgggaggcggaggagaagctgtcggctgccgggggcgagcaacggctgtctccccgtggacagccgcgtcgtcgacgtacgccgacgagaaggagagcatcccctcattcgccgtcgctgcggggtggttgttggtgttgctggcgcgggatgtggcctccatggaacggccgcctccccactgcggccgccgccggcagccgtcgtagcgccgctctcctcctctcccgcctcgccccggtggcctcctccccagccgccgaacagtttgcctagcgccgctctcctcctctcccgcctcgccccggcggcctcctccccagccgccgaacagtttgcctagagaagaggagaagagaagaagagaagagagagagagagtgtgtgaggaggaagggaaagagatggcatagcatcctgacatgtagggtccacgtaggtcccaggtcccacgctgactcagccgtcacgtaggataaaaccggagtcaaaaccaccgaagagtgaccggttttgattaattaagggacggccgatatgtggttttgcggttccgggacgattttttaactccatgacaagttgagggaccttgggtgtactttttcctcttcgcaatggggctaggctttttcgtttttggagtggcccaggaaggtccaaaaccaagtgatggctaacctgttagtaataagtccactttgactcccttaaacgtggcccgaatctaatccataaccctaaaccgtaaaaccggatatctcgactccccgaactattgaaaccggtgcaatttgactcccttgatggttttggagagtggtttcgctaacatggcgctgatgtagcaatgttgacctagtatgtgggttgacgtggcgcttaggtggcatttgaattaaaaacgtatacgtgggacccgtttgtcattcacacattaaaaattgtggggcccactgacatgtgggccccacatgtcatcccctccctctcttcttcctcccttcttcctcccttccctctttctttctctttctcttctctctccttcggccggccgcggggggcacaggacaggctgtagcggcggcgggcgagggccagagcggcggcgacggtgggctggatcaactactgtgtaccgcgtcgagctcaccttccacgacgaccacgtcgtgacctgcctcgccacgacggcgcgcggtggtcaccgcccaacgccccagcgctgtccgtggcgcgcaccacgcaggccaacggcgtgtggttgtagagctcaggggcgtgttccgcatcgtggccagctcggtgcccatcacgagggaggagtcgcgccgtcgcgcgtccacaactacagcgtcaccgacgacgactgcctcgtccacctcaacctcggcttcaagttcgaggcgtgtcacgccccgaactagtcccgaccggaactagcccgtgacactccaatttagcctgttaatcgataccagtcccaggaaacagtgctggtatcacagggagacagaatatcacagcaacagaggtctctttattatagagtagaagtacagtcatgttgggctgcggacagatcccgagctcacaactgcattacaaaagggaaacggaagccaggacttggaccaaacatcacaggcgcgacttgggaactaggccgaaaccctaaaactcatcgtagccggcttgctcctggaagaactcctcatcagcatgatccgcttcatcttcttcagcaactggggggggatatttatatagagcaagggtgagtacgggggatactcagcaagccaggggaaataagtgtttgatgcaggcttcaagggaaggctgttgtttttgcaattgattttatttgaactcttttatgaaaacaactaagtgagtgcttctcaaacgacacggatgagacagtgcgtctcgtccggtcggagtatgtgcaatgtgtcaatctttaggatttaaacaaggttggcacccggccaacagctttttcaacggccacccgggccaacaacttttcaaacggccacccgggccaacaacttttcaaacggccatccgggcctagctgatcccatcagctgtagatttttcaaacaccgaacccccttttcacacagcaacttcacaagcagtagtcaaaccaaactacgctaggaatcacctcacatccgcccatgaccgtgggcacggctgttcgaacagtttgttaacctctgcagagggggtacactttacccacacgacattactaacccgggtcacccagcccgtggggatcagccacgtcgggagacctccaagctttcatgacaaggcatttcgaaagccgacacaggtttaccatatgccgacgagaggggtcccagaccatactgtgccaggaagcccaggggtcctccccgacaccaccccggcgaatccacatgtctctcggcatcaaggctcccccgattagcaattcactcagccaggggcgtcccattccacccatgtggtcgtacttgtcttatgttcggatgaaattccaaggaaacggtccttaagtgcaagagcggaaaaccgtacacccggtacgttccccggtccgcggttttggaaattcatttagttcgcaagcaccgacccaggtgtcgggttttccaagtctttttgtaaaactccaattttacccaagttgttactcagattttaagtttgaaggcgaccgtcgatacttgcacagagtgcaccagtatcgaggcgcaactgggtggttacaaggggacatggtatagcaattaacaaaggaaggatcaaatgcgacaaattaggtaggtccgccaatctgccatgcagacgggacaaacagattaagtgcgatcctatcaatgcataatattttgcaagcaacataattaaatttcaaatataggctcaagatgttcaaaggtggcttgccttgctcgagatctggagcttgatcctcgaaatcctcgcactgcgggtcttcgggctccgaaactatacgcgaaacggaacaactcaacaaacggcgaaaaataagccctattaatgacctctaagcgtgccattagatagatctcgagatttggggaattttggaagttgaacggagtcaaacggatttacggttgggaagatattgaacttctaagattattgaatttttgatctaaaggaaaaggatttaattaaatcctttttggaaaagaaaaagaaaagaagggagggagggaatatagacttttctcggacggctagggcgcggcccaagagaaatggagcggtccggccgagctaaatgggccggccggcccaaggcgacccaaactcgcgcgcacgcgggagggaggagagagagagccggtggaccgggctcaccacgcgcggtcccgggtgggacccgcttgtcagtggctcggctcaccgtgcggagggagcacgcgacgcacgcgcgcgggcagggaagggacgcggtgcatgcgcgcggtccgcggtggacgcaggtgcggcgggcccacgcgtagcctcacggctcgcggtggatcgcgcgcacgcggagggaccgaccggggtcggcccgacccggtctggctgagctggcgccgacgtggcgcctacgtgactgccacgcgggccggcgggaggtagacgacgacccggccgcgaatggacggcgggcggcggcggcgagcggcggagcgaaccacggcgatacgggcaacagcgagcacaccgggcggttgcacgtgacaaggggaggcgagccaacggctcggattcgccggaggttgctcgacggcggcggattgcggcggcggcaaccggcggcgggagaagagggaaacggcgacgaggtcacgagaggtcgattcccggcggtgagagcatctacgcggcttcgggaactcgacgctagcgtcggattgggcggaactacgccgagcgaggccggcgacgagcgggtgctacggagctcgggcggcgacggcggcgagcacacggcgagcgacggcaacggtcggggcggcgccggctaactacggggagtctactcaagctactaccgaaagctagggggaggagatggagcgaggaggaagaacggagagaggcactaccgtgcgggacggggcgcagtgacgagaggccgacggcgcgggagtgatctctccggcctcgggccgaggaagaggaagaagagggcgcgctcggagtccccttccgcgtccacgaacgcaccggctctcccggcgcttggcgatggacggcggaggcgaggcagagcacgggaacggcgacaacggtgaggaggcgaatgggagaggaaaggaagggagggggaagacgggtttaaaagggcggcaatgtcggtttgagaggggaaccgacatgggcggtcaagccggcgagctggcgttccggctagcgtccaaagcggcgacaggaggtgacgccggcgagaggggaaaaaggggagaaaaaaaggaaaaggagggagagaaagggggctcgcccctttgccgattcgggaaaaggaggagggagcggggcgactcggcagagggagaggggctctctgcctccgccccttggaggctagcgcgcgaagtggcgggggccgggcgatgaccacggcgatgacggcggggcggtttggagcggcgcgacgacacgggcgacgggcgcgggctggcgcggcagaaggtgactgcggcggcgaccgggcggtcggccactcggcacgcgcgcgcgggaaacaacgggcggcgcggctgggcagcgggacagggcgacgcggacggcgcaacacgcggctcgggcgggaaaccaccgggcgcgcgcgcgagcgacggcgcgcggggccggctttgcgagcggggagctcgcgcgagaggagggggcgctcagcgcggctctcgcacgcgcgagcagcgagcggggggggggggggaactccccggggaaagcgagagacatagagagagagagggagggagcgtcccgggagagagggggccggggaagagatgggccgagcggaattcggcccatcgaacctgggggaggcaaactagacttttgcggagggattcgatttggaaggaattggattcggaattgaactcgacgatagatcggggattgagatcttgagatggcacggacactagacaacaatcagagaaacaaatttcgcaattagggtttttaagagataatttttcccgctaggcgccacgacggaacgggcgctacaaggcgctcaccgacgacgtccatggcgtgctcggccagacttccttcatctaactactctactgatttcatttgatgatgatgattacccatttaccctgatgagttactgactgacatggacgaaaattttataggacaacttgtctcgaatgcatgcctccactaattgccaattggcagggcagataatctccccaacaaccaacacaatcatgatgcactgatacacggtctgaagctgcatggactggaccaccggcgactccttctccggagcggcgtagcgcctccgccttcgtgcgattccggcaaccgcggagtccttcgcctatactcgccgcatttcatgccctaggaggctgccgtctcggccccccatggccagaaccctccacgaccccaactccaggtcaggaggcgaaaagcggcgcccactccaactactcctcccgtggtcgcgccgttcgcccagtacgtagccgactcctcctccacattgcaatccgccgccaccggtctggcccccacccaccgccgctgcagcctatgccccccgcgggccgcggccggccgaaggggagagaagagaaagagaaagaaagagggaagggaggaagaggggaggaagaagagagggaggggatgacatatggggcccacatgtcagtgggccccacaatttttaatatgtgtgaatggcaaacgggtctcacatatgtttttaattcaaatgccacctaagcgtcacgtcaacccacatactaggtcaacattgccacatcaacgccatgtcagcgaaaccgccctccaaaaccatcaagggagtcaaattgcaccggtttcaatagttcgggggtcgagatatccggttttgcggtttagggtcacggattagattcgggccacttttaagggagtcaaagtggacttattccaacctgttagtagtaacaaggacacatgaggttcacgtgggttttttttcttttactttttctaattcttttaaacccatttgcaaaagtttatatacataaatttacttatgcaaagtttctatatacaaagtttatatgtacgatgcatacatatataatttttatgtactataattgagtagtctaaatgcacataaatagatggaataagttcacattgggtctctctatttgtcgtccaattcgattttcgtcccttgaccgcaaaaccgagtacaaaccgtctcccaacttacaaaaccgggcaaatgtggtcctatggcagtatggagggcggtattggcctacgtggcacattgaccatcctacgtggcgcgctgaccacgtttctcctctcttttttacagcgtcgcgcacggaccagtggtcctcgcggcggagcgggagcagcgttggatggcgggagcggccgccgcggcgctcgcggcggaggacggcggagcgcggcccattcgagcacgaagatggcggcgccgaggccgccgacgagcttgaggatgacctcgccgtcgtccttccagacgtaggaccgcagctcggcgaggaagtcgccgacctgcgtgaaggcgagcagcgcggcggcgccttggaagatggcggtgactacggcgggagcgggagcagcg

SEQ ID NO: 81672 - DNA, 11000 bp, Oryza sativa
tcccaattttgatggagctgaaactgtttggttgagctccagctccaggaggggtggagctggagctggagctgtgctaaacaggccctaactacccgggctcaagctctgagatcgtcacgccgttcgctgacacagctggcggctgccctcctcgcgcgggtgacggccgtcgatcgttgtagtgatatcaccgccagaacggaggcgtcgtccaccgagcgtggtctcacttacgatagcaggagcagtacgccggccgggatcgagggataacctgcatgccgcgacgatgtggacgtggagtggctgtgtcgtccagcatcagcgccgcgcggccgacgcgtcgggccggagccccggttaaatttcttctgcacgcagctgagcatctcggcacgaggctactccctgcccagcgacgccgcgtcgccgacgtaccgcctccgctataccgatccggcacctcatttgtcacatacccgtgccttcaggcacgggaggggagaaagggtgtgcatatagatggccatatggcccacccggcacggcccggcccaggcccggcctaggcacggcccgaggcgatcgggccggcacggcacgcctggcacttcgtgccatgccgtgcctgcccacgggctgaacctcaggcccaggcacggcccgacagcagtcgtgccgggtcgtgtcggcccgacggcacgctgagcccaccgtgcccgggccagcccaggcacgccaaacactaactgccacttgttcacttcagttttgcacatacatatcgaaaatgccatgtccatcacaaaaatcagcacaaaaccatccaattcacaagttaacagatcacaatatcacaagtctcagattacaatatcacaattcacaagttatatagtatgtgcagtatgacaattcaattcactaactcaacttctaagtctcacagttcacaactcaagtcacaaatccacaatcacaaaacactttcaaatactaagtctaacagttcacaaatcacagttcaaactcaagtgatcagtcacaaacactttcaaaaataatagtagctgtgtagtgcaatggttgcctcattaaaaacctttctaggtaaaaactcacacctcgtgagaaaaccctagaaaggaaaaagagtgcatcccacagctttcatctaattatcacattaaagtccaagtccagtacaatcatccagttccagtggcactgccactggttacatcatcaagacataaattctcaaacgattttataagctctacattctcagcagtgtgctgcaacttcttgtctgcctgcacccagtccttgatcaatgccaaagcttgcaccatgttaggacctagacgtcgtcgtcgctcctcgatgatcctgccagttaagctaaaagcagactccgacgatatagtagaaacaggaacagtcaagacatctctagctaatatggacagaacaggatatgtgtgtttgtgctcatgccaccagtttaggatattgaagtcatcgtcgaattggttgacagtgtcactatcaagataggcagacaactcagaggcattcaagttagcattagaagaaacagcctgaatcaaagcagtagcagaagttctcctggaaaatggaccagcaccaagtccagaacctggactggcactagcaccaagtccagcaccaagtccagaacctggactggcaccagcaccatgtccaagtgcatcactggcaccaaaaatctttccccaggctatctttttcttaccagcagtacaacctggggttattctttgcaatctcacagcaccaaacttactttcatactaagagaaaatgtcagacaatgcagccctaacctcagttaaataagtagagtaatcagaggtcaaaatttgtgacataatttgtagaacattgctaaaacctctgatcttagccctaggatccaagataaaagcaaatgaatacagaaatggaatctcagaccagtatgccaagaacttacttttcatgggaacaacaacatttctaaagttattatcattctcataagtgttaagatgtccagcaatctcaagaatgtgatgcataattaatggagatgttggataataaacaccagacaaaataacagttgaatcataaaattgttcaaggaataaaagcacagtttcaacaattgtccagtgcaaatcagtaagcaatagtctaccattttccctaggataatgagtttcaataaacaatgaaaaaagctccttatgtgggaagagatgcttgagcattagataagttgcattccatctaacatccatgtccaaaccaaacttacgaggtcgaacacccttagcaatacaccagtttttgtataaagcaatgcgctgattagatgcattcacaaatgagatggctgttctaaaatcttgaagcatgggtttgaaaacttctagaccagccttaacaatcaagttgattatatgacatgcacagcgctgatgcaaatataaatcaccaacatatgcagacaacttaggttttagaaaatccattgccttagtattagaagaggcattgtctagagtaatagaaaaaaccttatcagtcaaaccatattcttcaacaacagaaagcacacgttcagtaatattctcagcagtgtgcttcacatcaatcagcaccaaacccaaaatccttttctctaattgccaatcagaattaacaaaatgagcaacaacacttaaataatcctccttagcattaccagaccatatatcagatgtcaaagcaacagagttaacagacttgaacctctcaataagcatagcacgactcttgtcaaagtacttaaaaacatctctactaatagtttgcctagagacagcttggaatctagggttatgaacattctgaatgtactcctcaaaagtaggagattgaccaaaattcagtggtagatcctctacagcaatcaatttaaccaactcagttctagcataatcaggatcatattcccatggacgaacagtaccatcagcattgagcttaagcatagactgtgacaaattactagcagttctaggtttgcatgacttgagatgcctaagcaaatgaccagtgccaccagatgaatgagcagacaaagttttttttgcagtgattgcatttagcagaaatgcgaaccttcgcgccattgcgtgattcaaagtgttcttcgaagtcatcccataccttggatgatcttggccgcttgttggtagcactggagtcggtgccggacaacgcgcctgagccaccatcaccgtcaccgccaccggtaccgtccacgtccggctccgtctccggctgcgacccatcgaagtgaggaggtgacgaagtgattccgaacacctgcacatgttcctcctccaagtcatcttcgtcatcaccccgcatccccatcaacctcaactcgtggttgcaagaggatggatcgtccatcgtcggcactccggttcctcaacggcggctaccgctcagcgacctgcaagacacacagaatgagagaagagagcagttagggaccggagagaagtagaaaaccaagagaggagagaagagcagagataggtgtgtacggtgtacctgcgcatccggagcaccggagttgccgttgatgatagagatcgacggatctacgagaagaagatagcagagactgggtttggggagtgatgtgacaaagagctcacggagaaacggtgagcgggcgatagtggcaaaaaaaatgaaaaagaaagaggaaatcgagagcacggccaacgatccaaagactggagaggcggagatgagacaaggtcacggatccggcgaggcagcgaccctcggtggtagatccggcaaggcgttcatcagagacggcgacggagagggatggagagatggaggcgtggtcgcgtggaggtggaggcgtggatcgacggaggcggaagcggaggcggagcggtcaaggcggaggcggaggcggaggcgtgcgtggatcggcggaggcggctagggttagggttagggttgtgagggaggcggactggcggaggcgagaggacgcggtggcctttatatatgaggcgtgggcacgcggcggcggctcccgatgggcctcgtcgggccgtgcctaccgttatacaggcctgggccgtgtcggcccatcgtgccgtgccggcccatcgtgccgtgccggcccagcgtgctgctgcgggagcctaggcatggcccggctgtcgggccaggccggcacgggcacgaacactgacgggccgggccgtgcttgggccgggcagtcgggctgcgggccatatggccatctataggtgtgcagtttgtaacagcgtgtagtgaggcgtgtttcatctacagggtactagtatctactggtgctgcttgatttttgtcaggcgtgtgcttacgtagctcagcaattttggaccgtgatgggggttggcggcatcggtcttcgcatgagcacaatgaccccgaaggcccgaagcagaacatgtccgacttggtggacacatgcccgcacctactgcacgaacaacagcggatccagaaaaaaatagcagtatgatctgagcaaactatataaagttatagtccaccaacccatctacgtatggtaaaaaaatttagtggggtcttcgtggaggttctcatagtcttcacacctgtagtgaggctcgagacaccactgcccccatgctggatccgcccctgtgcacgaatcacaccatgaaaattacttagagcggatacaataaactgattcagcatgcatgctccaaaatacgacatatcatcttattcttatatggatgggaaaaaattgagaagggagagaaaagtgggcgactaatctggcgccggtgctagcacggcctcacacgctcatgcagccgtgaagacgattaagagcaagtttaatagtaggctgtaaaccgactataaatttatatggaagaaagataatttaaaaaataaagagggttgactcttatacaagagctagccattcacatacttcaagataaatacattaaatgcaaaggtgagagatagagagaggaggagaaaaatagagataaccttatggctgatctactatatatgttaacctaatataagctataagctcatacttggctctattattaaacttgctctaacagcatttacaatgctccacgctatacagtggccaacaattttcttttttaattatttttacatatattaacactaaacatatccaacgtgtctcgagctctcaagctactactgtactcttggacttcgatggggagagccatggctgcggtggagctcggggcttgtcacaaagacaatggtagagttgaaggtcggtggagaatctagtacatggaggttaggtggggtgcctacctcgtgaatgtgggggtggataattaagctcatgagacgacaacgaacaatgaatgagctcggggatataaagctcgatgtaggagatgcttgagcttgcgagctcacctctgcgagcttgtggaggaggaggtgatggagttcgaggatgtagagagttcatatggagcttaacgatagaagctcaacaagaagacatagtggatctggagcttatctgcaatgataagacaatgattagaaccatgaaactcgacgaaggagcttaacacgttattagaactcaatctcacctatgcggagtctatgaagcatgaggcactggagtttaaagaactgcccttaccgtcggctgatatagtcaataagtaagttagctggtaaatggggagtatataagatagtcctgatttgtcggcttgtcattttcttaaaaaactttgctagactgtaagattagtttcacgtaagtggaaatcattccgatttagatgaagggatataaattaaaagtttttgggttggatagtcttctataaagtaaaaaaaggtggagtatgttttaaacaaataaaattcatgagattattaaatggacttatttctttggtcgtagtattattttctgttggcccgtcttaagttgttagaaagagagaataggatagtggcaagaggtgtgtggtttttttttcttaaactccaaatctcttttttttttcaagtcgtcgaaagaaaagtcgttaataacctgaagagactctcccaagacagaaggagagaaaaataatgcactcgtgtaacttaaatagtgtagtttagcaaattcgttaaaatccccttttgggaatcttcggcctccccagcggcaggcaggcagcgcggcggcacggcagcctctctcccctcctcctcctgctgcccgcgtcccccctttacctcgcatccgccgcggatctccgcctctcccgccatgatggacctggatccccgcctctacgagaacgtcgtaagctctcattctacctacgcaccctgcgcccttcctccccacctcatctttgattacctctcgcaactcgattgctttaagtattccttgttggttagtaggtaggttttctaggaacccatctctgctgttgctggaggaggggggcaaagtaggtgctttagcgaatcttgtttgcttcgagcgctgccattatgtgcccctgcttgatcttttctccgtctgggtgcgaattcggctttcttgtgtaggttggatccgtttagtggggaggatgcgatggttagtttggttgtttgggggtgctcatgctagggcttttggtgaagaaagatcgggaatttgttgataaggtgcttgcagtgcaaaaaaatcggtacttccacgatgaggtaggttgaagtggtcaaatcaggaactttcttcattatgtgtggcttctagtgcagaaaaagataggattttactgaaatcgggcggaattaattggcatgagcgctggaatccagcagaatgaattggcattctactggttatgacttaggcggcatgccatgccatgccagcaaccacagcttaacgtatcattctcttcggcaatactccagggggaaatccttgttgaacaggttgtgctgagtgtaaagtttgaaccaacagtgcacatgtttctctgtcatgtatttgttgaataagaccttgggatactggagcattttagacagtagtgcccatttggtaaaatctaggtaaaaggggtatgcctgatatttttccacaaattgatgtgacaccaaagctagcgaaaacgtggtgttgaagtcttttctgttgttgccctaaaatcagatgctggtctgtgctatctgctcatagatacttctgcatttatcatcgctcgattagcatcaaatcattattgacaatgctagttgcatgaatatgccatatttttttgtttgcatagatcataaatgtagctgtgttcattaagcaagtatataataatatcactgctgatattttccataaacagaacctacttataactgtcatttgtcgaggcttgaaagttttcttgttctaaatttcggctaacactggatgtctatgtttaccttcgtatttattgaaggtatatactgctattgacactaaattttcattttttccagtccgtgagtgataacgatgtccgcaacatagtgttgtcttatcttatgcacaactgttttaaggagactgctgagacattcttatccagcactggtttggaactgcctgttgattacactgtagatgtagataagcgtaaaggtatttattcacatatcaacactgaatcttgtatctttctttggatgttcaacacttgtaaaattgctgcataagcactttatattgttatgttagttcatttgtatctttttatgaatgctcatgtttttgtttgtctacacaatccttagcagcttccctttcaagtttcatgctaataaaagatgtgctctcagctcacttgttttagggacaaaaaggctgtgctaacgacaccgttcattagctgaaataatctttgtaaaatcaacccatcaatggaattgcagcataatttagctagtgggacatggagtcatttcagttcagtatagatgcagtttttgtttacttgtttgttgtcaatcattactgaacttgttggatgtgatctctgttgcacataattgcaaatgcaagttttattgaacacttactacataagttacacatgttatgaagtaatagaattgtgtatagctatattattctttagtaccttttccgtacaaagtgtaagataggtttttttctaatagcatgccattaatatagggtttatttcatggtatgactctttactgtgctgttacctctatactcctcatacaaggatacctaactttcttgtgcaacatggatttaggattaaatatagcccttagaaataataaattaataattatggggtttctggaaatttccgatgctctgttatcttggatggaatttgtaacttcatttgaaatagttggtggttaaagcagataatatggattgtatctaatctatcatgaacatgtacactgtgccagtattaaaaaatgcatctgcattccatttgtctagtcgcatgcacttgcatctaacgcttttgttttggtttctttcagcgatttttagttttgtgttggaaggcaatgccctgaaggctatagacctgacagaagagttggcacctaacttgctagagaatgatatggatttgcattttgatcttttaagtcttcacttcattgagttagttcgttctagaaaatggtaagtagctttatttttggaaaaaaaataactgtgccatgtattttggattaatctggatgttttgactgacagcacagaagctcttgagtttggtcagaaaaagttgacgccatttgggaaagtgcccaagtacgttgagaaactagaggtaacttttcctaaacctacatatgcttatattagacagttttcaggtcatgcaaattctgtcttcttgtcaggccatcaatttagagaactggcaatgatgttaaagaacttcactaccatttgttacccatacaaaagaggcaaaacaaaaatattggtcttgaaaaaactttcagtatggtgaatctagtttatcactatgcatgagatatagatttctattcaagtacttagctacttgcaaaacagtattggtacctggcacaccttcatttgccctatgttgccgccttgtagatctgatttgtcatcaaagttatgtcagcctgttttctgggctatcatgtattttgttatctttattaaatacatcagatttaaatggcagcgcggtttttgtattgcatttgtttagtaattgctggtgctatactgtcctatccaagtaccgatgctaggtagtccatcattatcaacgccggccattgggtattatatttattaaatgcaaaatatggtgaaaacgtttgaagtagaggtgccgcttaacaaaataaatatggaacatatggtgacatactttttgtgtattgaacttatgattggctgctttgtaatgctatgcttggaatactatgaaaagttaacttttgttttatatgtataggactttatggccctcctagcttatgaagagcctgagaagtcacctatgtttcatctactaagcccagagtacaggcagaatgttgcagatagcttgaatcgggctgttcttggtatgttctaagatattgttcttggtatgttctaagatactatttgctgtggtctcatccgctgatgacacgattgtgatctttgtctcatgatcaatgacagcacatgctaatcgaccagcatattcatcattggagagagtgatacagcaagcaactgtggttagacaatacctacagcaggaagttggcaaggtaacatctctatctttttcttcatctcacgatcaatcatgattctgtacggctgcatcgtatcttgttgaacatctttttttttgttcttatctatcttaattattgctatttcttttattggggtgcatgtttttccataatcataagttactacagtccacttaaacttctatttaactattggtgtgctttaacatcatgatgcatacatgacatttcaactcttggagcaggattcttacccgccattttctttgaaggcctttctgaacaagtaaggtgcaaccaatcaatcgttagaaagatcacctccagggctccagtcctatggccaccagagttcccttcagaatgtgtaaaacagttgcgtgaaagcaagcgacgggatgctcatgcacatattattcagagaaccgccttctggattaaacgatatcatcagtggtgtaccaacaatatcatctgcatcgaaagaggaatgttgtataactgttgtttcctcatttacagttccccatttcccctttacccgttgacgccatcgaaagttgtacatatcagaaccttgagctattctgtatgttcgtgcagagatatcgtcagtttgaaccaatctgcagtgcacttattactatgcctgatgcttggtctctacaaactattggtgtgttttatggcgtccatttcaccatatcgactgttccattcaaccaaagataaaaggaaagcagagcaagtgacaagaccatgggaggagaattctcaaaaatttcttagaatgtgcacttgatgctatgcctgatgcctgatgctggtttctacaaaatattgatgtttttcatgccgtccatttcacgacatcaactgatcgattcaacccaaaagatgaaggaaagcagacaagaaagtgacaatacaatgggaagagaattctcgaaatcctcatataatcagaaaaggaaaacacgggtgccaactttagttttccatcgtgaacgccgggaatcacgaaagatgagagcgagcggagggcaacaaaaaaaaaa

SEQ ID NO: 81673 - DNA, 63365 bp, Oryza sativa
tcgtctcggcagctcttggctccgcctcctatcctctcctcttcccctactctcctctcttctctctctccgcctccaccagtctccccctctccctctccaaaccctccatagctataggcagcagctgggggtgctggcggcgttgaggcattcttgaatccggcgtggtcgcttccccagatccatcttttttggatcgtttcttcgggcgatttggaggagcaaagaaagccctcccaaatcgcagaaaggagccgcctttgcgaagctcctgctgccttctctgctcgttgttcctggcctgggatcacatatccccgcaaggaaaaaaaaggagccgcctttgcatttattcttttggccccttgggagatcgccctcgtcaagatttggtgggaagtgggaacccaattcgctcgcggttctcacttctccttgtgtggaaaggcgccgctttggctcctgtttccccccaccgctcgctcccgcgccgctcctctccctatatatctatctctctgactatcttgttcacatacgcctgcgcgcctgcctaactttgttttacttcgatccatccaccggttttcggcatcccccgtctcggcatttgatcgttgcttagtcgcttgttgatttgacgcaggccagatcgctgtctggcgcttgttttattttgagttgttgcggtgtgtttgctgttcttggttggaggcatggctgcggcggcgaacggaggtggcgcggcgctgttcagcgaggaggagctgcgggacgtcagcggggtgcgccggtgcgaggatttcgtggaggtgacgtgcgggtgcaccagccaccgctacggcgacgccgtgggccgcctccgcgtctacgcttccggcgacctcgaggtcagctgcgagtgcacgcccgggtgtcgcgaaggtccgtgctcgccactgtgcatcatcagtacaccacgtcctttttgcttgcttgcttgtttgtctcgttgttcttgatttcatgtcagcgcgcgcgtcggtgcacgggtggtgtttgatctctttggttgtggcgtcttgctcccatgactggacctgcatgcaatgccggctcatgcgcctcgccgctgcctgcgcccagcgtcgcctgtttcttgtactttgtaccatgctcctgcccatgcattgctagtctggctcgcgggactgtcgatttcggcaattaaatcatccccttttctgcaatctgcatgttcatgatgtatctttttttttagacatgtccatgatgtatctgagcgtaatatcgcctgcatcttacctttggtttaggaccattaggttcctcttcttctgtggtacctaatgcacgtaagttgaattttgacattgtgtactccctgcatgctggggatgatgaggttcccctctgttcagtggctgtgttcaatcactcacattacattgctacgtctctgtttagtatgaggttttctttcgtgtgagagctagcttgggccatgttctggtttgtagttgcatgctgctctcttatgcaaatgtgtgaaattgataattgcgatcttgactccaacataggatgcttgcgtttgatgagagcggaatggaaaacttactgttgtgttgtctctgttctaatgttgttacctggtggctatattttttttgtttccgaaagctgtagatgctgcattcagtttctctatccccgatgtctgtatttcagtgtgtgtccgtactgtgctgcaagtatatttagttgaggcatataacatcagtgctatcactgtggattttacaatacattatactcctccttgaatggtccccagagtgttgattgcaatggtatgtaggtacacacaatatttgtttttaacatatttaatacatgaaccaagatagtcttgctttaatcaaatgtggtttgtacttgttctagcatggttcacccatgtaactgcagagatgtgtgaagtgataatatcataggcaaagctaaatatagcaacaacttatgactaccccatcttgtaacttatgtaccactgcacctttcagttttcaaggattatgaaatctagatataagtgtgatataacaaagaaaaattgtctagattaaaatatgcagttctttttttttttgtgataatttataatgaaggccttcaagcattattagcatgcccatttatctgggagcatgcactgtggggttatctatatatagctgggaatttctttgttcagcatgctattgctctaggtttgcatgcaactatattgatttaactatttaagtaaaggatgttgtagatgcatgtatttccaagttaactttgcagtacttgcttttactttattcttttgggaaaatctgtttccagttacatgttgtacatggcatcgctttgttgtcatatttctctatcttctgactgtatccaaatgcaagtaatatctttgtactagtatagtactattacaagcattgtacaaaatcttggtaatatatgccagttgcaactattatcatgctttttaagcgcataactgccatttaagttttgtaagttgaaatttgcagacaagttgacgccttctgcctttgagaaacactctggaagggagactgctggaaagtggaggaatactgtgtgggtcatggttcaaggagagaaggttccattgtcaaagacagctctgctgaaatactactcgctgtctcacaaatctgctaatggttctaacaaaggccgtaatggtcgcctgtcacaccgagatgagtttattcactgtacggaatgtggcaaggagaggaggtttcggctccggtctaaagaagagtgccgtatttaccatgatgctcttgctaaacctaactggacatgtgctgatttgacaactgataggtatgtactgtcaccgcttgtgttagttaacagtctagcttgctaatatcaagctatactgtttgccgagatatatgatatgttcatgtcattgttccaaagttcatgccaacctactgtcgggttcttatcgtttttctttttgttagtggtattgcggatacttcttgttaagtgttattattggagaacagctgctacagttgtgctattttattttattattattttttgctttacatgtccatcctttttttttaaaaaaaaagaacacattgacataattgctagttttcttatatttctgtgctttgttagttgatgaaattgacacgtgaactaaatattggtggtgcgcataccctttgattgctggagtacacttagtgtccatatgcatgttacttttctgagtttctcaactggtagccataacaatgatagtgacacaagttaatgaaaatccagcactccagccgcaggctttgcaatccaagatggcagcccatgtatctctagttctctctaccatgaccatgattggtattagcgtctctggtagctgcctgtttcaagcctgcaatataacaactatgaattattgatgcactgcgaaatatttatgctaattaccttaatcaatgttttgcacaacaaaattgtgcacatactccctctatctcccaaaaaaactcaacttaggaggggatgtgaccccatcccctcctaggacaaagggtagtccaaattcattgtcctaggaaaggtcacatcccctcctaggttaagttttttttgggacggatggagtagttggtaattatctgtatattataagacactttgacttttttctaagttaagcttcttctagtttgatcaagtttatagaaaaacataacatttttaacacaaaactaacttactatcaaaatatattcgatgttagatttaatgaaactaatttggtattgtagatgatgctaaattttactctctccatttacttttgatagtcatatttcatctaattctacttatcatccatctaaacatgctactagttattcctcgtaaacaagtgattcaataatatttatatttctcgatgctcatgtagctaatcttgtgtggaagaatgtagagtcatgcattaaatccaagaaagtcattaagatgatatattgttggattgaaatatacctattaaaaataattttttcagatttggaaatatgcttatcaaaagtagatagagggagtatatataattggtcaaagttcaagaagtttgatttgaaaaaaaaaaataaaacgtctataatatgaaacagagaaaaggaggggaatttagcccataaatgccctacagtgtctgcatgatcaaactgcaattgtaggaaactactaatgctttacagttaacgtattagtagtttagtactatgtctttggttttctactatctactgtgggagtagcaaagtcgaaactgctgccctgtagtgccgtctgttggaactgttgctatgcaagtttctcgccaaacacttccagatctctgcagggtcatgtactcatgcggcctgtagccacaggacacattcagtactgtatccctgtagcattcagtagcatgtagggaaaattttctaggatcgctgaagggtgctgttccttcagtaacatgagtacatgcattctaaatttggctgcaatgtttacattaaattttcctttaaaaaagaagcattgctttgcctagtgaccagtagtgtacttttatgcaccgttacctgttctgtgttccttccatcctcagtttgacatttcttggttttccatatttcatatatttgctttgttcttgtgtacatttgcatatatatataaccttgattgatcccaccagggtcacctgcggcgatgaggaggagcgcgcgagccgcaaggtgctgagaggctgctcccgctccacgtcgtgcaccggctgcgtgaagtgcgtgtgcttcgggtgcgagatctgccgcttcaccgactgcgggtgccagacctgcgtcgacttctaccataactccaaggagtaggaggatgaaacaatgcatgaaacaccaccatgggacatggtaggatgaaacaccagcatggtcgatatacccttgcagacccagatgttttttagtcaaaccccccaggtccaatgattccccggcttcactggggggggcctcctattctgagaactgagatgttctttgactagcttcttcccatagacaacaactagtaccggggaaagccggccgatttttgcttcatataatttaccaaaattctattcatgttcattttagtacattgctggggaagtgaatcggttgccattggttgaatctttgtatgcaatgcaatgcaagggggtttcggcgtctaagggtgtgttttggatggagggatatgggtagataggatatggcggcccattttttgtgggtgtttggttcctgggcaggggtgggatggggcggcccggggaggaatattccccccagatgccggatggggggatccggccgaattggccggatgcagccgcccgagcgctcgggcgagtaggggtgagcgacatgtgggtcgcgtcacccctctcaccacgaggcgagctcggcggctaggcaaggcgacgaccgtggaggcgagctcggcggcggcggcggctagggcgagccggcgacgagagaggaggtgagccggcgacaaccggatctaggggggcgccggcgagagagggcgagcggcggcgtccaaggagagagggcgagcggcggcggccggggagaggatacgaggcggcgggggagagaggaagcgcggcggtggggttgccagcgagaggaggcgagcggcgaccggcgatttcgagaaggcattttttttctccttccccttttatttctttctgcttttttatttctatttagatttttttagtagattgatatttgttgggtgagaatttggaggggtatactcaccacctgtaatgaaagggtgattgcaaccactcatccatcccactccaaccaaaaaaaaaatggatcaccatatccactttcatccctacaactaaaaaaactggatcgccgtattcactccaccaaacaaaaaactggatcgccatatccagtaaaatatagaccatcatatcccatccaaccttgaccggaaaccaaatacaccctactaaaatgcttgagctcgcgatggatcgcttggatggatgcgctccgtgagctttggtagaaatgtcgcgagcggcatgcgcacgtagcatggggatgttgtccagtgatggcgatattattcggggtccccctaccgcggcagcgctggttgcagggcacgtcacaccacccacgcggcgccaatgaggcggcggtcgtggctgccgcgcgcggcgcgcgcgccgcgggatcattcgcgcggccgcggccgcggcctcgcgctgttgcgcactaggcgtctgtctgtcatacgtcgcgcgacccccacgtctctgctgcctttccgctgtggattggttggtgttcgcgctctctccactgctgcgcgcggctggtggcccagagagccggcgcagagagcggccgcgggagtttgcccttgtcaacttgtcgcttgtccgcgagcggtgggggtgaagcgacggcgtctcccgaggccggtgtcctgcacgagtgatgaagcgacaccggcttcgtactggccggtgtgtctcaaccctggtgcgtacggacgcgctgtacgatggttcaccagctcagagacgtgccatgtactgtacgatgtggctcaccggctcagagacgccagagcagagactagtactccagtactagtaggttggtttcgcgtataagacggaacaaaaagcggttagtaccgagtacacagtgttaacgccggctcttcctgctgtgcaactacagtggagggcgcgcgtccgggctccggggtaaccaccacgtactacttgagcagtggaaggcacgcgacggatgtgacaggaggcacggtggatccagcaagagattcgctcgcctgtcagccactgtacctataaatcatttatagtcaatttatacaccaattaattaacaccaattagttataaacatatattactttattaatatttgatcccacatgtcatatacacattgcgtcttagagttcgtgctacagctagctactccctctgtaccataatataagagattttgagtttttacttacactttttgaccactcgtcttattaaaaaaaataaaattatatttatttatttttacttactttattttattatctaaaatactttaagcataacttttattttttatatttgcacaaattttttttaataaaacgagtagtcaaacggtacaaacaaaaactcaaaatctcttatattatgggatggagggagtacaaatctatagtcagcttctcttgtctcttctcttttatcttgtaatgtgcttatagttggcttatagtctgctactacatgctccaatactactagctacaacatccatcccaaataagtttatttataagtttttatgtccaacatttaactatttattttatatgaaaaaaaataaaaataataaggccctgtttgtttcagcttaagattattgtaatctagattattaaatcagattactctaagctggattataataacctgacataaaataagctacgagttgtttgtttctctagataattagaggcatctaagcgtagtgggtctttagccactcaataatctagaaaaggctcctttaagagaagattattggattatagtaatctggctttatagattataataatctagcataataatctacttgtttgttttagcttacttctaataattcatattataataatcctaagctgaataaaatagagcctaaatcgcacatacgttggacacataaaccacgaataaatttattttggatggaggatgtagctgccactgccaagatcaaatactagtacagtggtacgagtactgcaccgggagctgtggcgtctgggctggctagatgatgcagccgagtttgctgacgtgggtgagtttgtggctgacaaaactctcgcgttcgtcaaaaagttgtcataaaaaaggcggttcactctctcagcctcgcagcatcgatggtgtgcggtgcggtggaatctcgccatgcaccgcgtcgcaacacacagtagttgcacaattgaagcctgcctctgcctgcgccagcagagcatacatgtaccgatcgatgtactgtacggccacacccacacgggactacggatggaccgacatacatatacggatcaccagccagcaattgttacctgctaaagcgccaaggactctgctgaacttgcagcatggatcggcagcctcagatgcgtggatctagctggacatgcgcgacggagggagacactggccaagcgattttctagcagatgcacggtagtgaactgtgatcatggagggaccgtcagggtctaatggtacaactgtacaagcgtacaccactacaactagctacaacgactatctgaacctctctctcctaacaggaaggtgcccgctcattaatgtgtgaaaatttttttacgaatgcccatgtgaggatgtctttctagtaaaaatatttcttttactatatcatgaacaaaattaaatttatttaatgtgctttgatcagctgttatgattttttttcaattaccttcgcagcatataaattctaaactaaaatcactttaaatcgcataatttttaatttatgagaaacttgtgtcaaaaaaatagatctttttcctatgaaagtccaatttgtttttgttatattatgtttgaaattttagatatgttcattctattagtcatgctaataaaatgtttgaaaatttctatttagaatgggtttaaaacccaacagttttcattcttttcatcttcattttttaagaaaatggagaattccactctatgaaacatccttgaaatgatttgatctctataattgaagataaaaatataagtgggttaagcctacaacccaacataggataaatatgtccattctaaattatctctctaattaagtaaggaaaaataaaatagaggttgtagtatttttttagcaaattaccactaaactgaagtgtcatgtaacaaatatacatttctatattattcaatgctaaatgtgaggaacttacgatgtaccatagcaagttttaccaaaaagaaataaatggatatggtcttttaattcctatcaggaattgacttatatattgccgaggccacatcatgtctgtttcactgctaagatttattggtgcaacccacgttcttggtatgattggtatgatattcaactggccacatttttatttttaaaatgttgtctataaaaaataatgctagatggggtacatgttatgatgtaaaaaaagaatatcatttcaatatttttatttaatttatcagtgacttcatagatcatatatataatttagatggtataatcatcttaagattatttatttatctcctaaaaagatcatttattgataaaagcatcaatatcaaattgtatgggtaaatagctcctatatacatattgagaaataaattaattaagttgatagaaaatcgttagatgtctaatgggatataagtaataggtcaaccaattgtataaaaaaatcatgtgggatattttgatttttagtgagaaattttagtagtttcttttatttagtggacgcctcaatacatatatgggtccagaatataatttttctattagcatttaaatatagtcaatatttgtattaaattattgatttcaatagaaaatataatagttcaaatagatcataagagacacagggacaactagctagacctgatagctagatccgtttgtgagaaattatttaagcaagacaagtacaagcaacttataagagcatttatgtactttaacgcccacagggatggggaggaagggaagaaggttgagatttttctttaaaaaaatagatctaataatgacgtaaaattatgtgtctagaaaccaatgattggatatttctttgacttaagaccgccatataacggtttagaaacatttatagaatgtttaatggactttaacacgtatgatgtctacttgtgggatttttttcctataaagataattttaattttaattatgatatggataaaaaaacggagaaaggaacggagggtgcgtacaacagtcggtacttgcgtgcgtgcacatgccgcaaggaggtggggatggtgggaggttttggtttggtaaaatagatatagtgatatactttattagagtatcacgtattgacttagatgtatttatagggtgtcgcgtagcagctcgagagcgtttgtagaaagtttaataaatttttagtagtctctctgtcgtaaaatataagtgattttaaaatagtaggatgtgttttatccgttcaaaatatctatattttaagacagaatatataaatagatagacaggaagacagatagatagatagttgtatgatctccagcgaaaagttaaccaaaaatgcatccgattgcaattgcctgaccagtgggacactgggacttagcaaaccacaaaccacagttaaacaacgacctgtgcagttctgtttaaccaagccaagccagctgccagtatccctatcacaccagccaccggctagtgggccccatgacatgagtaagaggaatatgggccccacctgtcagagagtggcagagagattagctctgttcgtgcagatttctcagctcacctttggacccgggctatcctttgaactggctatgcggctttccttcgcccttaccctgtctctctgcctgcatgcatgcagcctcagcagcgagtgatgcatgcacaagcatagcacagcaacctgccatcttctcctttaaatacgtcatcgcttaatttccaaggcttccgttttctcctaaacataactgcgtagcaggcagatctcgtcggcatcttgttccagtttgacagttacagtacagatcgacgtgtagaataactgggagaaggaagaagacgatggcgactatgaagttgggctccaagccggaaatctttgttctggaaggcctcacatggttatcctgaattcctcgtttctttctgttgtgttaattttctgtatgttgaatttatttttttttctagttcagaattctcttaaaggatctctatcatatgttgagtttaagagatctgatagttgatgttcatttactaaccatatcagtaatcagtatgtcaactagtgctttaaaaccatgggtacttctgtgacagattgtatggagatgcgtaggttctcaaacaatgtaaaacacaatcaaattaatttctgcaccgtaacgtaacaacagattgagtttcacgcatgaactatgtcattcccaacctctgatccatgttgttcactggcaaatcggctggaaatctttcatggcacagtatgttcatctgtttgatataacacattcacgtcccaaactcccatgcacgcacataggtcgattcagattatccctcattgctaatctatacacgtcaattccaaacgcttacattctgtttgatataacacattcacgtcctaaactcccatgcacatactaggtcgattcagattatccctcattgctaatctatacacgtcaattccaaatacatgcttaatcttaatcttgtcaatcgccaggagatgcatgacggagctggagagtgatgtcgtcgtggaagtaggagaaatgtcattttacctccacaaggttagcgcaattattctctaaactaatcaccgtgaattaaaatatcttgaattgcattgagctggcctggtcgagctgacgtgtagcagttcccgctgctgagccggagcggtgtgctgcagcggatgatcagcgagtaccaagcgccgcaggaggacggcggcggcggcggaggcatgtgcacgctgcagctggacgacatcccggggggcgccaaggcgttcgagctggcggcgaggttctgctacgacgtcaagatcgagctcaacgcgcacaacgtggtgtgcctccggtgcgccgccgagtacctgcggatgaccgacgactacgccgagggcaacctcatcacgcaggcggagtccttcctcgccgacgtgctcgccaactggaaggactccatcaaggcgctcgagacatgcgagggcgtgctccccaccgccgaggacctccacatcgtctcccgctgcatcaccgcgctcgcctccaaggcctgcgcctccgacgccgccgcgtgttccaccggccacgccgccgcctccgcctccgccgtggccgtggccgccaagaatgccagctacgacgcgctgtggaatggcatcggctcggggggcacgccacggggcgggggcggcgcagcgggcgcggcggcggggtgctccgggatggactggtggtacgaggacgtgtcgttcctgagcctgcccatgttcaagcgactgatccaggcgatggaggggaaggggatgcgccccgagagcatcgccggcgcgatcatgttctacgcggggcggttcctgcccgggctgaagcggaacaccagcttcagcaacgccagcttcggcggcgactgcggcgccggcagccgcagcatcacgccgcgcgccgccaacgtgtcggcgccgtcggagggcgaccagaggtacttcctggaggagatcgtggcgctgctgccggcgaagaagggcgtcgcctccaccaggttcctgctcgggatgctccgcacggcgatgctcctccacgccagcccgctgtgccgggagaacctggaacggcggatcggcgcgcagctggaggacgcctgcctcgacgacctgctcgtcccaaacctcggctacaccgtcgagacgctctacgacatcgactgcgtgcagaggatactggactacttcatgtcgtccacggacgggctcgggaccgggtacacgtcgccggcggtggtggaggagggcagccagcttggggcgctccatgccgggagcccctcgtcgctgtcgccgatcaccatggttgccaagctcatggacgggtaccttgccgaggtggcgcccgacaccaacctcaagctgcccaagttccaggcgctcgccgccgtcgtacccgactacgcgcgccccgtcgacgacggcatctaccgcgccatggacatatacctcaaggtgatcacacacgtcgctctatctagctagctgcattgcatttcgatttcatctcgtgatcaacacacgtacgatgatgatacggcgtccatgcacgcagtcgcacccgtggctgtcggagtcggagagggagcagctgtgcaggctgatgaactgccagaagctgtcgctggaggcgtgcacgcacgcggcgcagaacgagcgcctgccgctgcgggtggtggtgcaggtgctcttcttcgagcagctccgcctccgcacgtccatcgcaggctggttcttcgtgtccggcaacgcggcggcgggcggcgacggcgctccgcagccgcacccggggggcagcgccatcgtgcctaagggcgcggcggcggccgggcagtccgacgccgacgcggaggccgacgaggggaaggggaaggagctccccgccgaggccatcaccgacgtgaaggcgagggtgtcggagctggagaaggagtgcatgagcatgaagcaggagatccggcggctggggaagccgaggagatcgtggagcctcctcaccaggaagtgcaggttcgggaccaaggtgcagcaagcgcagcccaccatgagcagcaaatgagaggcgcctcacgccctgcctgcttcctgcctaacccaagtatgaaatcagtacaagtactaatcccttcaattttgatcctatagtctctgagctttgctgtaccgagctagttaatgaaatgcaataagatgcttatgtttcataggataataagctagttttaggccttgaacagagtccttcaatatgtactgtcatttctgatgtatttcagggatttattcttaatatttatatattaacaaagaagaaaaatagttagtaaaccaaactgtttcctgccacaaagaatcaatacggccctaggaaccattgtgatcatgcaggatttcaaaaggaaaacattaactataggcacatctgaacctaggtaaaaagctcttgaggtatccataaaaggccccagtgaacatatattacattaaggcaggaaaatcctttagctatatgctgctgtaaaatggaataacttagatacgaacaacataggtgtagggatgtacaaggcgccaccacagaacgacacatcctattctctcccgtccatcgaagcagctctatcaaaaggccgatctcatagcaccacgagctgcctcacgtttcatctcagcagccttcccacttccacggaaatacatgtatacttgctgcatttcaaacggccaagttcagaatgacatctcccaggagaaaatgaagacagcattgcagcggaaattttattgcaacaagaacaaaatcttaggggacagcacattctagttgggagtggagacatcaatgcaaatagaaatgtatatattctgaaggcacagcatgacgcatgatgatgaacggcagaatgaaggagtgttgctgaacagacaccaaggtgttactatttggctttggctaagatcaagttttataaaactcacctggatgacaacaacgctgagtagtgattcaaggcagaacagtccaaatccaatgaagtaaaatatctgtcgaaagaaagtgtgaacaatgttgatgactcaatcaattgtatgagacatgccaatcaaataaattaagcaaagcatcacgaactcccagagtcccagtgcggcagtgcttactcactgaggcaaaaggtctgttaaaaaaatgcaaatagggtcctcccaagatactaaccctgatatctcaaattaacttgaatctagaagaaaaacattaagtaaacagtgagacttacccccacaatagcattgtttcctatgacatcaatagccggcaaaatcccactgtggcaaaaaaaaaagggagaggcaattagagaagtggtatttataaattgaagtagagaaaatggacagcctgcaagttgaattgctacaagtttgtaacaatttagagcatcaatagcagtgatccaggtattaccctaacaattaacaccatcacctaataactatgcaaatgccacgtaaaagcaacctagaactgttgcacaggtacctctatgagccaaatactaatatatatgctaaaactgaagaataacaaagtctcaaagcacttttaagtcatagccactaagacactatccagtgctccaatgttgctgcttaaataaaatgtatgtttagttaaataaaataacagaacacttacgccagagactttcctttgaaaggaaatgggggagccacagcagaccagatgcagaacagtatatggatctgaaagggggcaaacactgttagcactgcacggaatatctgcaattttgcaaccaatagtgtggcaaaccattaatcttatactagatcattttaaccttacagttaccagaaggtaagggtcttaccaagtaaaacaggaaaaaccatccaaacttcaaagcactctcagtcctgcaacatacattgtaacaatacactatgtcaaatataagaagaaatagtgtgcagaaataacaaaaacacaagtatattcacaacctcatcgcattgtaaagggggcgataccataacacataggctccaggtacaccagatataaagtagataatggctagcaaccagatcataacacctattgaattgaaccgcaggattagtttgaagtgtcagtgcagatggcagctgatccataagataaatatatagtaaggtactcagtcagccatacctgcccctttaatccatgctgctgtagttgcaattatgttccagaaaagacatgccgccaatcctgcatgacatcaaagtttgcacaataagaagcagctttgtagagcaatgctacaccaacatgcaaataggtactagctctcacaaccaaaattcagtccactaaatagtgcttctttttacaagatgccaagtattgttagcgttgctttgaaaatctttttacagaaagacatttagcccagctacaaaacagggtagacaccacatgcttatgcttattaggcttacataattactgcaccaagaagataataactatttttctcaaaagacacaggttgcaacttctatttttttaaaaaagaatctcttaattggatatataagtcaagattagagaagttcattgatatcaaaatgtctcaaagtaggcacgtttttctcatgtcactactcacttctggcattgactcagcagaaattcattgattggacagtaaatgtagtgattcaggcagtattttattcacaatgtttaagcaaaaggatataaagaattgtggttccaccaggtattttagttcttgtgacagctttcccaacatgagggaacaaaaagagagttaaaacttaaaactaaaactaacacttacccaacaatgaagaaaatgcaaggtattgcatcctttgtaggtggattggtatctcatttgaaatgtcatgatgaataatagggaagaagggtggccagtttttctcttcaatgacaatcccagctgaaaaataaaagaaagagttgaaaggcagaagcaacaactaaaatggaaaatagattgcaacagaacaaacataagcacaaaattagcaagaatagccttttcaagaaagacgaacacaatgtactccctccgtcccaaaaaacacgaatctagactggatgtgacacattctagtacaacgaatctggatagagatatgtccagattcgtagtactaggatcataggatgtgaaacatccagtactaggttggttttttatgcgacagagggaataatatagcataaacaggagcatttctaaattgtacaacaagggatacttgcctacaaatctcattatattgcaaagtgtaacttaagtctcaggctctaaatctaaaattagctatagttttctagtcaacttcctaattaaccaatcgacacaaatatcatgaacaactgtttcctatcttcgaatattttttgttagaaacacaaaaacaaaaagattacacgtactcagctgcgagaaaaaaatatacctctggatgcagcttcttctcttcttctcaattcctgcgtatcagggaatcacaaaaaatcaggtggtgtatttaaagaaaatacaagagcatgcttgtacgcaaatctagggtgttttaacctccaatcatgtgaaacttgttggatcaaatttttactctatgagtaaaactcagcacactcacagattcagcattctatacacgtaattctcgtgcgcaatattttatgaaaagaggagatatctagatgaaatcatttgataatgttagtttgcattagcacgctggtatccttctgtttatctaaaaaaacagccatccttcttttcaaagtgctataattgagtgtatagatatccatgttttgttcatcatttcaaaccaattgtgcaatgtcaatgattcaattaatggttagatcagcgaggtctattgggtgccggatctttgtgtcaaatccatgccagctaaatatctttcacattgcataatggttactagttcaatactcaatactaacacaatatataggtgcttcccaatacatcataggaaaaaggttaggaattaggactttggccaggggaagttgacaacttgattcattagaatagttttttacttcatcaaacattggttaaaaatcacattgctcatgaaaagatcaattgaaaattccaagtttcaagcataactacagaaggcacatacgctttcccgtttgtttagctcagcctcctttgcctgcagttctttctcctttttcttcatgtcctgaattacatacgaacatactcaatgcataagcaaccaaccacaaatacagcaacaaaagaatatatggtatcaaacatccaaaccaaggaatagtgaaaccatcattactagattaattgtgttcttcagccttttaaagagataagataacaaaaaatgaagcatgcaactgttgttacacactaacagagtaataatatcagagtgaaagagctaagtacagtatgattttctcacgctgaggtacagaacataacttgtaaatatagtagcacgtagtattaccgctcaatggaaatacaagtaccttggttgaatcaagaggtatgtccactgtggcaccacgatcattatagaacccaggttcgtgaggaagaggtggcatccgagagttggaagctggaggtacacttccaccctgcagaacagggtacatttaaaaatgaaacaaacagatagttgaaggaggctgctaaaattagaatattcagccaactctgttatccctttttacgcctattggccgaaagctcaaaatttgacagtttagaaatcctagatggagcatgtgcacgcatacgcacaattcacatgattatggactcgctgacacgtgcatatccagcaaactgagagtaaactgactgcaggcttacgacactaaatgtttatactggcagagacaatcttcaatctcctaatgttatagacgatctgaaccaaacaagtgtgaactgccccattttacggatattttccaataattctaagagtagaccgaccattttcacaagttatacatatcgattgcaccacatattccctcgtaaaaccagaaacataacgtcccaacacaacctaagagccaattttcaatccgagcatcatttctcctatgaaaatgtataacaatacaaggggaaaagttgccacgcctcgcgatcagctagcaaatagacaagcaaaaaaggccgtattcgcgccatccaagtccaaccccctaacagcggatcctaaatcactaaccctagcgccaacaactcaggctgatccaaagcaccccacatggcgtgccgcgtgcaggaccagacgaagcggccacggccagaaaaccagcacaacacatgccaatccgggacgcagctcgactaccccatccacacaggcgcgaggacaagcttctccatgcctagatgaagcaaggaggaggcgcgattgcgacgcggagggggggtttagccccccgacccagctacagcctaacccagcagctcaccgcgaaggggttgacgtcgtcctcgtcgaaggggttccggtcgtacctccccgccatagctcccctccaccccaactcctcctcctcctccggaagcggccgcgtcggtggtttctctctccggcgagggaaggggaacgcgcgtgacggtggcgaccaactgctccggcctccgggcttccgcttttacgtaacctagtgggtttggaatttgggatttgttcaggaggggcttattttagtggtacttcctgtctccgctggtgctaatctctgacctgtgggattcttcgcgtacttgctcaccggccgacaggtggggccaggtgaccggtgggcggttgagacttgagagttgagactagtcggccggcaaagaggaacggacggggtggtggtactgcacaaatgcaacaagattgtcagcgtttgtgttagtacttgcaagtacgttcttaatttggagctgaaatttgtccctcatgatagtagtattagcgaaggggatctgatttaattcacggttagtacgatcggcgggttttgattgacctgacaaacctgtcaccaccctaagtttaaagaattggaagtttctaaatggaacacaaatttgtcctgacgtacccgcttagtaactgagcaaaaccatcgccagccagaattggtaaaaaaaaatacagacgagtgttttcttaagaacgaaggaaacagggcttaggaaataatcaaatgatgacaagacagtcatcagcacccagctggtttgaatttgaagtcaaacggggaatgggtaatgcgttcaaaccgtgccaaactctgtcttcaaaacttcaaccacttcgttgatggtgaattgaattatcaccagattccagattacacgggcaacagtttcattacatgaaagaagagaatgaatcaccacgttgaactgacatcaaccatttttgaacttgcttctccctcatccggggctgtccatgtaacaaatgttaattacagattatgcacagccaagctcacatgtacaacaggggactacgccgaatcaaaagccaagtcaaaacacaattacacagctcaattgcaaagctatggcaacaagctacaaaaactgtatggcgctggcgcgttttttgccaaaaagaatgatgtctagttatctactctcactgtgttgtactagtatgaatgaacctccccgcttgtttcagatcaccaccaagtcttgcaaagacaggttcagttcttgggcaagttgtgctgattgaccaccccgcctgcaccagcaaaatatgaaaccatcacagaatgtcaggaaaggtagctccaacaaatgacgtgggtagcaacaaaaataaacaacatggtgcacacgaacaactgtcagcaagcttaagaaaacaatagtctgataaagtaaaggataaagcatctcatacagggaggggaaggaaaggaattacataatcaacgggtgtagaacttgctgaatcttttgcaaatggttaaaacaccgactgcaacgttgcaacctgtgacatcaacgaagtcagcaacagtccagttcatcttggcataggcagagcaataggttataggatgctacaaacactgcagttctttaaaacaatggttcctaactgaagtgcagggacagaacccacttgtcacctcacatccagtgtctctttgcaatttgcaggttttgcggcgtcctttaaatagcattcccttgaataacattaatgcacgtacctctgctcagcctgaatatcaactccaactgctgaatgagctgacaatgttgaacgaataactggtccaaagatctttataagatccaacaacaattccaaagaaacaatggcatgcctacaaattgaaattaaaggcaaagtaaccataagacaaagttactactaaaccaaacattttctaatgtaagatgccaatatctccatggttttgtaaagaaaatagatccatgaccttgcttgcaatagaatgaacagactaacaagaggatagacaattcaatttaacagcagcatcttgtgtctacatgtgtgcacagagcatgtgcgcttaagttactatgtatcacttggtccagtcagacaagaaccaacatgcaatggaatagagacatccaatatatcacctttcagccttgctggtcagtaaccccgcaagaacaggcagaaagcttaagaaaatgtctaggttgaagagatcaagtttccccttcagagtactaacaacatcagctagaacctgtaaaaaaaagggtcaaaccattagcagctaaaaaatatgaagtacatgtacatccaagaatatcgcacggcatcttgagaatacttacagcattgtcaggcaactttgccactgcagcaatcgctcctttgataccattttggtcaaagacatgacgcatcatctgaagacagttaacattaatatcatatgctgatggagtgatggctatgatatatgcaacttttactagttttcaaatgctttcctcactgactattccccactctccacttgtaggataattagtagatggtgggaaaagtgcatgccaatgcataatttacatacaagtgtagatcactctcatcttatatcaggctatcagaaataatggattcaaagctagctgattaattttagggtgttgcgggattgatcaacaatcttcactagagctgacttcaccttcaatttataggtgtgtccacaccaattgtctttaagaaaatgccaataaatcatttaacgcaagtatcaaagaaaaaggtaatgttcaattctaagttgtctaattgtactcaatagactaacaacgataagccattttccctgtactgaatagcctaaagaacacagaagagcttcatcatatgtataatctatcatgcaatggcatgcaagattggttccctgtttattggatacaaaaggtcaaggaaggaattctatggtgcacatgagctggtaacaaacagaagtccgcaagtaaaaagatcagagacaggacacacctctaactttgtcagccgagattttacggcatttataaattcatcatggttctgcatcaaattgattggaatcatcgcctcatcaattgttgacaagtccttctcatatgcctgacttggttctgcctgtccattacaaccattgcaaaatataatgatttgagtaccgaaaaaattcgtaaatgctagagagcatgaacaaataaaaatggagcaaaggtaaagtcatatttttctagcccatattctgattttatttctgaaaatactccaatctcccagaagtacttaagtccacaaaacattacattatgatttatgacaatctggtttctaacaatactttatcccttctacttctatctccagatagaatgtacttcgcagtaaggggaaaaacgaatacagaaatttacattgtataatatgcaagaatgagtatgtatgacatgtcccagaaagataaattggtttaagaaaaatgtttgagattatcaccaaggactttaggaaaatagtaagtacagttcttaaacattcatgcattcatgaatgcaccaaccaaccagataataaggtcaaattgctttgaaattaattgggcttaaaattatgggtacatactgaaaaggaggaaggaccatcagatctcactgcacggtcaccacaagaaccagttggtggtgagcactcaacattagtagcctctctcttttcccatctctcaacaagagactttgtttttcctaatggcacagcaactgcaaaaggagttaaaagtaccattaaagaactaattttagcacaagtagataccgagacaatctcttaacgtacacacacctcctctgacatatttgaccttggttgtttctgtagtagaacatggtggctcagaggctgtagcaggaaagagtttcatcgtcaatttgccaaaatgaacagaactgcagagtgcaaacttagaatgtaggaaaggatctctaagacttactatcatttgactgaagttgatgctccaacgacactgttctgtccaatttttctgtcatttgtgtattatcacctttatccatactatcaactttatccacattatcatattcttctttcttgtaatatggagttagtccaaaagagaattttaagccagagaaaccctcagagcaaacatcaggatcagttagcatggattttgttgagttaacactatcacccacaaaactattaactgaaagtttccttgaatgaacaggagcatggaaatcatctgcaactgcagctctccctctgattcctccactaatgctgcctgctgttttgtcctctaaaatgtctctaggcataacgacaggcacagaaacagtctgtggtgtagtgtaaatatcttttacagatactgactcagcaagatggccttttttaacagttgaagaattattagctgttcccgtacgggatgctagcgaggcatccctctgtgcaaaattgcgctccactgtttttctatttgtgtatggactatcagcagctttcatgcgcctcattggagtagagctctgaatagatgatttgaaagaagaatcaggtcttcgaggagttgcaccactcttatctctcttggttttatccatacttgctggagtcaaatttgagccacgaattccactttcagctactaccagaaagagagagagagagagagagagagagagcatcagtgtgaagtatcgaagtaaaggtacttcaatacattatacataatgagagacaaatgggtgtttgaagcagtaccagtccctgtttccttgaccttgtacagattttttggatgtgtcgttgctagagcaggaatggacttggcagtggtatcaatcgttttcgaaggattgtcgtctaaagaatgtaccagctcagcaaagaaatttgctttgggcaaaacaccaagagcatagggcccaatgagctggatgaaagatattgattagaccatagaagaaatacatcctatgagacaaaaagtaaaactcaccgatatatcagcaacccaaacaccaactcggcattcgtggtaggagcatcccaagagttttccttcataaatactaaggtcagccaaattgctccatcccatgtcaacaacgtcatgacatcttactggctcccaagagaatacctaacaaagtgctcatatagttgaacagggaccaaaatattgtacatcaacaacccacataacaaaatcagatttacctttaggctttggtctaacccacagaatagggtttttccatctgggtgaaagaccgtagagcgaacaccagtagcctggaagagaagaatgtaaagaatatcataacagaaagatgcatttacccgtcatgcatgtttgaatacaggaacaacagggaacagggtaagaaagtttaaactagatgtaaaagcatccattaaaaatctctaaaagaaccaacccattgaaaaatgtgacaagggaggtcataaaccatttttaaggattggaaacaaaatttatccctagcacatctttcgtgaagttacagtggtgctaaatagaaaggagacaatggatgtaaaacatgggcaccaacgaaatcaaatgcatgcgtacaaaataatgattgttataatttgtctctatggtttaccaaaatattgtgttaaacatacgcaacaattagcctggtattacaaaaatgtgtaaagcaagtacctcgggtccagcagaaccaatcaattcaaaagtttcaagatcccaaaacttaactgttcgatcagctgagcctggaaaatattaatgaattcaatgagtatacccttaaacttcttaaaacttcacttactgcacatagaaaagcaataacacattatatttatttagatcatatatcctgtgtattctcaaaaaattcatagtatcatactaaaccagaaacaatttggtataacaaacttcagcattagctttatcaatgattatactgcaaagaaaataaagatgctgtctccaaaagtctctgttttacaaataactgccaaacgagtaggtacctgttgcaagcaaaaattcttgcggatgaaaatcaatacaccggatttgcccactatggaacttgaagtcatgtagaagctttccagctgtcaagtcccacacttttacaatattatcttctccgccggtgacaacccatcgtccatcaggtgtaaatctgattgttctaattgctcctctgtgacccttatatgtgtgaatgcatccttttttctttatatcccagatcttaagatctgtatctgaagaaccagatgcaaaaaactcgccaaatggatggaattcaacagaggtgcaacttgatctgtgcccagtaagagaccgcacaactgcatatcaagacaaaacattaataacatatctagcttactaaattactaagaagcacagttgttatgatctatgggaacactattaagttatgctttcaatggttatccacattagccaagcacacttcttttatccaaatacagaagcgtagagcatagacattttgacgaagatttgtgagtttcctaaaatcgcagccactgaaaatcagaaaaagaacctaatacagcggataccaagcatttgtatcaaaatataaaataagtttgtactaacaactaacaagtacattgatagtaccactatcacggaatgtaatggctatgttttctataattgtttagaaatgaacagacagttacaacaaagcaaaaggcaagtcattaaggtagcacaatttctaggacttataaagcaataagccaccaaccacacccatggttcaaggcgctaggcactagagggttagcagggctgacgcctagctagcaggtgcctaggacaaactaactagtaaaacccaagaaattagcaaacatatctctactattataaaaattgaagatgttttttaccggtattttggtacgtcatatgtatttgagtcggtttttaagttcgttcgcttttggaaatacatatccgtgtatgagtcggattttaagtttgtttgcttttggaaatacaaaagaagtcgtataagaaatttcttttaaaaaaacttgcatgctaactttcgatggaagtcagactcctaattgcagctcacgatttactaaaaataagccgtataacaataataaaattaaaatagcattcactcgttgcaacacacaggcattttttctagttacataaaagttggataatataacactaaaatagccacctaatgcaccacctagtgcctaattgcagttgctacacggtgcctagcgctgattttagaacactgaccacacctttagcctcttccaagtcccagagcttgatggaaccatttgaagaaccagcaagcacaagcacctctgctgtatcaaactcaacagcctcaactgagccagtgtggcctgataagctctgcacaaacaataagccagaaacacggcatgagtcaaattcaacataaccaatagaagtgtccatcactgtgataggggcacaaaccagaagtggtgtctgtttgccaatggcccacaggttaaccttgcggtcgctgccgccagtgataaacacacggcttgacttcttgccgatagacaaggacctcacttcagcatcatgtgcgacaaattcctctaatttgggtttccatgttaaggagttataaacttgagcaatgcatgcttccaaaaagtagccagtaacagcttccacagctatgatttgtagtcaactaaaaaaggtgaataactgatcaaaccgtatcaatacatagctgtttttttcccggatgaacttcacaatttagttatagttgcttcggaagcaaattagacttggtgattcggaattggcgcattgctaacctaaactgggcactaaaggaaactatttgctgaacctgttgaaacatttagtggtagttcagttccttcttgaaatcagaaacgacttcaaccttggcgcagattgccaagaaagaaaaaggtggcgaaaattttctcgagaccaccactgtcgctccaagaaactacccacaacaacacaagactagaatttgagggaggggaaataatactccccctcaaccgctcgagcaaatgcctacccagattgctccggcaaaccacgattccttcctcctccgagccaaatcggatcaagaaccgggcaaacagaagggcaacccaacgacgcagtagcagcaaaaaaaaaaaaaaaaggatacggagcctgtagccgcgcttctcggggtccatcctcccgtctctccgcccctgctccgagccgctggggcaggccgacgcgctggcagcggagtcgtcgtgtcgccgtcgacgacgagaggggggagagggttcgggatccgagtacttggtattctgagcaggagaagggaagggagcgggggcgagagagatgacagccgcgtcgccttcctttttcctcttcctctctctctctctctctctctctctcgcagcaagcagtgaaaacgagaggtgtggagcggcgtgggtaggtgggtggggggagtgctgtgccggagtgagagagtggagtttttgtcgcctccctttctcccccttcgcctccctttgcttcgcttttgttctcgtttcttttcttttgtaccagagctggctaaagtaaggttctcttctctcgcgttccttgagaatgaaataaaggaaagtccccacatgaatctggacctttctctttttttctacattttgatactactagtagttcgtagtagaatggaatttttggtacacaggccattttgcaatatatataggttttgcaatgaatactcgctatggctttgagaagaaagttagcagcctcaccagcactccaacagttgtaaggtggtgtttgaatacagaaacttaactttagcctatgtatttagacactaatttaaagtattaaatataaactacttacaaaactaattatataaataaaagctaaattgcgagataaattttttaagcctaattaatccataattagaaaatatttactgtagcatcacataggataatcatggattaattaggttcaatagattcgtctcgcgaattagtccaagattatggatgggttttattaatagtctacacttaatatttataattagtatccaaacatctgatgtgatagggacttaaaagttttagtcccatctaaacagctataagatgattggcaagagtcaggaggtatgtggtagatgtaaaccattagtatcacattgagtatatgggatatgacaaatagagaatatgttgaaaagaagcttacccaatacccatctttacaagagatttagggcgtttttttttgggggggggaggggtggagagttgggagtacgattcactaccaaataaatatgcatggcacgaagtggtgaagataaaaccatacttcaatagttggaggacacaaccgttaacctagagagtcggctagcaatcatcaaagtagtccttcctacatcggtttcttcctctctttttctctcgggggaaattgatatgtgttaggctactttgaaaagaaaaacttctcatacatatcataatctcgcatataccctcgaacaaccttacgtatagtttatacaaaagcccaccatactattatagcaggatctaatggttgcttctcatatttatatttatagtcccaaaaaagacaaaaacatgttagaagagaaaagaaaaatatatctttcatgcatgagtaaatacaagatgatgtgttttgtaaacaatctagacatatgctcagaccatcttaaaatacttgcatgagtacactcaaagcatacacctagtagaaataaaaataatgatgagtagtaattttacagtagggtaacttggacttcattcgttcctgggagatccgggagattgagagagaaaaacatctcgttttccgcgcgcgcgcttccgttttttgcaaaaaaaatttctataggaaagttggtttaaaaaaaccatattaatctatttttgaaatttaaaatagttaatacgcaattaatcatgagctaatgactcacctcgttttgcgtatattcccaatctcctcaatcactttctcctcaaactcaccttggtataaggtgtgtttgcaagagcaagttcccaatactctcctctcgttttccgcgtgcatgcttttcaaactgctaaatggtgtgttttttgaaaaaagtttctatacaaaagttgttttaaaaaatcatattgatctatttttgaaaaaaaaagctagtacttaattaatcacgtgttaattgaccgcttttttcgtggataggagatgggttcccaaacacccacctccaaacacagccataagcacggaccaaaataagcgaaagcacatatatgatggtgtgaatgggcacttgcatccctccttgataacggaaacatcaaaacggttggtattcggtactcccaacccaccacccttaatctccataaatacggtgttactcgagagttggcatgagctggcccatagatgccaccgcaaccggtatgaacagtggcagtgtgcaaacaccataaaacctcagcttggcctaccggccgccgcccgccccatggacagggcctacgacaagcacaaattgattactctatccgacttgtttggtaggtcgaggagtcaatgtgccgtccggtgggaggtcgctcgcgttcgcgggcatcatcaggcagcgaaaaaaacgactttcccgatcccaaatcctcctttccccttccgtcttcaggcgagcccacacgagcatcacgccgcggtgcgctgcaagcctgcaacggaataatgcaaagcgaagggaagcggacgcgcgccgcgtacgggccgcggggcgtggcacggcacgatttctcgaaagaggcgtgcgaggcagcgaggcgcgacgttgcgggcgaagtttacagcaggctgcagcgacacgagccggcccggcgccgcggtgcattggcacgcgggcacatgacgtgccggtatcttgtgcgggggaggtgggccgcgcgcgcgggggggtggggtgtgtgtgggggtggtggtggtgtcccgagcaccccgagcgtgggggcgtgggggaagaggtgcttccagccttccaccgcggcatgtggcgcggacgccgctggctccaaggccgacagatggccgtggcgcacacgtggggaatcagcatagatgacagtgattgtgcttggggggacgttcttagttggagcttaatgacagctttcgtcttaaaaatctctctgggttgatgacttgatggctctgttttctgtcagatcaatggatcatcaactggatccaaatgccaaactccagtctcagaaagacaaggggaacatgtccaatctcgatttctcgaaagaacacgtgttcagatagttgaaacatatgctcgtgttccttcaatcccgcggtctagtacaattcatgggcctaattgggccttaaagttgatggaccggactttgtgttaaagtttgtggaccagcccgaagaacgccgagcaacacagaaaggaataagttcactttaactcccttaactagaggccgaatctaactcatattcctaaaccacaataccggatatctcgaccccaactattaaaactggtacaatttaactttctgattggttttgaagagcggtttcgctggcgtgacgcctacggtggcggtattgacccaatcttactttcacgtgaggttgacatggcgcttacgtggcattatagttttaaaaatatgtgtgcgacccaattgcattaacacaaaaaaaaaggtgggccccactaacatgtgggcccacatgttagcctctctctgttcccttcccttattcctcctcctccctctctctctctttctatcagcgcactcttccccctcggccattgaagggcggcgtcaggtgagaggacaggcgatggcgccctgtgtcaacaagcagtggcgcgtcgtcgtgcaggcggagccacgcccctaccacttggatgtcgctgccatcgctccggccgtcgcggagtttcggtgcaccagcttctaccgcctcagagcatgtggtagcaacttggcttcggcgttgatgatgcccacaccttcaccgccaattcgcccaaccccaccacccgcgccctcctccacctcactatgcctccccctctgactccacctcctccgccaccgctcatctcatccatcccccgccgctgatccccaccgttgtccccactaccagatgccaccgccgccgctcatctcatccgtcccccaccgctgatccccaccgttgtgcccaccgcccgatgctgctgccgccgctccgactgtcgtggagttccggcacaccggcttctcctgcctcggagcatgcggcagtggcttggcgtcgacgtcgacgacgcccgcacctccacggcccactcccatcttcccgtcgcccatccccaccacccgcgccctcctccacctcactctgcctccccttccgacttcgcctcctcttccgccactcatctcattcatcccccaccgctaccgtcaagtgcgacgacggcgtgtcactctctaccgagaaagagaaagagaggaaggaagaagaaatagatggaggctgacatgtggggcccacatgtcagcgggctccataattttttttgtgtgaatgacaaatgagtcctacatacatgtttttaactctaatgccgcctaagcgccacatcaacgttatagaccaggtcaacactgccatgtggacgccacgtcaacgaaaccaccatccaaaaccaccgagggagtcaaattacaccggttttatgggccgcgatatccggtattgcagttcaaggatacaaatcagattcggacgccagttaagggagtcaaagtgaacttattccacacaaaaaaaaatcagctcagactgctagaccttgggcgaatgggccaataaggcaataacacactttccaggcaacacagacatcgcaaagagtccccagttcccgcacaacacaggagctgcctgctaaatactacctctgtcatatccaacgtttgaccatccgtcttatttgaaaaatttatgaaaaaattaaaaaaagttagtcacttataaaatattattcatgttttatcatctaataataataaatgtactaatcattaaaaaattttgcggaaaattggtagtgtcaggattagagccggactcccaatcttctggaaatcgatttgcgacaaatgtatttttttcagaagttaccagtaagattctacgaaaaaaaaacgcgtctttacccttaaaaagagcaagagacaataaacactcattttgcaaggattgatagatccgaactaatcaaacactcatttgcaaggatcggagtatctttctgtgatttgattgctgaggtagaggtagacttagggggtatttgggagacaggggctaaactttagcccctctctcaaaaccataagtccctaggagcttagcccctctattctaaatacccccttacccaaggcacccaagacggaggaagaggagaaatcggtggagtagctcgggagggtggagagatggggagaggaagaggataaatcagtggagtaagctctttcagtctctcttgctcctgtaatcctgtccggagaggcggagaggcggacgacaatggaattttttttattttccattttttttattaaaagttttacaaaaataattttccatttttaaaaatcgccatcccagagggcggcgaaaatgacgtggcagacggccgttcgctctcgggcgacggccgtcaacgaaatttgcaggcggcccccttgccgccctccgctagggcgattatgtactgtgcggggggccgcctgcaaatgggcggcgagggggcatggaattttgcaggcggcccccttgccgccctgggggagggcgatttttgcctcccccctataaagcacagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagtatatctgtagcacacaacacatatgtgtagatccagagcatagaatataatagtatgaattgagacatagacagtagtgttaattgtaagatgtagtttagtttgatctggagaatataacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggcatcgataggcctgcggagagaacatttcaatcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgatataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcgaggcaggagattcttccaatgcgcgaactttgatcaggtatgcttcatctattcgaagttcaaatggataaaaaaaactaacttcttcgtacacaattgtaacatcttacgcagacatatcgtccaatgtgcaacttcatcgagtgggtagacatggagaacccacaaaacgatggaacccgtgcttacccacgtagtgaaacaagatcggactacctaaggcggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaagtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatgatccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtacagtgtatcgatggcacttcttatctatcttatcattacaatgtttaattatggtggtgatttttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattatattttaccagtcttggagattttaatcttgtatagttttcaatataaaaagatttgataactattgatatttatacaaaaatataaagcacaatataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggtcgtctgccacgtcactttcgccgccctctgggatggcgatttttaaaaatcgccctcccagagggcggtaggcgaccacttctgtcaattttcaaaatgaaaaattatttttgtaaaacttttaataaaaaaaattaaaaataaaaaaaattcgacgacaatgtgctctggttatgtgggcttgtttacaactgggccagcgtgggagaaacggaggcctttaacgtagcagcgcggatcttatggcatctgaaatttgccacattgctttctgttcaaagacagacagaactcagtacaagtgttgaggaagaaatggtcgccgcctgatacagatgttctgaaactcaacattgatggagctttccgtgcttcagagaagactgggggtttttggcttcttggttcgagatcatctgggatgtggagttcttgcggaagctgcacgtctgacttatgtacatgatgctatttcagttgaagcggaggcttgcctggcagcccttccagctgttgtagcgcatggtatcacatctatcctggtggaatctgatttatctgtgctaatttcggctcttcagactaatgagtatgcctctgctcctggtgggtccatcttcagggagatcaaagtccttgttcaggtagattttgccaatgttgagtctgtttttgctcctcgtgcttgtagtacggcggcccatgaactagcccaacgtggtgtgaattgacacccgggtcatgcaatggtgtggactgaccccctccctgattttgtacaaattctagtggattgtgataccactgatccagcttggtaataaaatgtcagtgttgaagatcaaaaaagatgatcgatcgacctttacccctcctcctgttccaacttccaacccatcctcgcatgagacagtgcaggccgacgcgaggagattcgccgggttcatccaaccagcacgtgagacgccggtgtttgctggaactttccgtcgccgtgaagcacacgcgtgtcgattcgcgtcgatccgcccgctgccgaagcgacgtccggtcgctgcggcgcgcgattcgctcggtagtcactcacaagatcagagctgttgcggtgcggagcttttgcttggaccaaagataaaaaggcaaaatcttctcttgctctaaacggtactccactcgggaaaacttaaatcatccctataagagatatccctttatttttcatgttacttaaaaagtcatcaaaaaaattataaaaaatagtagaatagatcaatatgtgatatgttactttacaaacatgcaaattcaaattcaacttatacaagtagaaacaaaaaataacaaatttgactatgaagtgaacgcgtaattcacggtcaaatttattatttttgttttgaattgtataactcgaattttgactcacatgtttgcgaaaagatatatcatatattgatctatcttgataaattttaaaaatatttgataattttataaatgacatgcacaaaatgaggggatgtctcctcgaggaaaaaaaatccgcttccactccactcaatcttgtagctaggagttgacgaaaagctcgtaactcgttaactcggctcataacaagctcggttcaactcagctcggcttgtttcattttcctaacgagtcgagctggtattttagctcgttagaaataacgagccaactcgagctggatcgcgagccgtcgagcctaaacgagctaggatgacatcaagtcggatggccaacatggacatcctttcggcccaactaggcccatctcggccatgatacaacggtgttatcatatgatgcgcgtggccagcctaactctcgttatctcatatacataaaccgatagatggataaaacaaaagacaacaacaagaaaaagagaaaaaaatggaaacgtagaggagatcgagacgactccggcgaggagctcgctacagctaatttcgctggcccggaagggtgggggcacctcgaaggggaggaggagcccgccctcacggaggcagaagtcggtagccccgtgccgggtcgtggcggtaggggcggtcaggggcggagctagagcgaaacaacgggtggcactactaggaaaagcattatcgcaagcggccgaaaagggtcttcgcagcggggcgcccgtccgcctgtaagccaacgactgtgaatatcgccgatcttcgcaggcggggcgcccgtccgcctgcgaagataattttcacaggcgtacgttggctagtccggtccgcctgtgaaaataggaatcgtccgcttgcaaaaaaaaaaaaaaaacttccgcctgcaaagataggtagaaaatattgaaatttaattataatttggccgtaaattacttttaaattatttaatagaaattcttgcaggtagatttttatgtacatatattggaagattatcaagcatttggtactgagaaatctacatatattgcataaatcaaaagtgttgccaaaatatatatattacaatatttttttacattgtcacttcaaataacgtcatctagttacattatggcatagcagtgttccactcccgaagatccttgaattcgtcacttgccgctaggacaccctctgggtcgaagaaatctcttttgacatgacaacactcgtggtggatgaagtggcacagatcacgctgcacatttgtgatacctgtatcgtcaaaacttgttcgacattctaatcttggcaactgcatgcattaaaattaatcaatatattagtatcataaatatcaagagctgtctagtacatagcatagagacttacatcctccgcgttagtcctgtatcgtccattaaccctaaggaattagcacgcataatacccgcaaaggaccgttcatcgcggttgcttgtgacacttcaggacatatcatagaaaaaagtagttaaaatttgcaattagtgaaacaattggaatacataaagtgagtggagtattaccagccaataggtacgtactagcagcttctcccgtgtttgggtctgttctccacccttgaacttgtagtattggtatgcactgtatggatgtcgtaccgtttcagagtaaggaggatatttatttgtaatacattcatatacaaatgcaagagtcataataacttactactgtaagattgttagaaattctttgtattgcttgtgattgtaatcgagaggatccaagactaccacgattccgtctttagggtggatgagtaaacagatataatgatcgctacatattaacaacattatagttagttagtaacagctaaaataagacatatgtgtacaagataaatgtaccggacttacttaaaatgataagcggccatgacgactctcttattttgaaagtgcaagaaggctcgtccaatgtactgtgcgacagtaatcaatttctccttgtgcaagcccttcttgtattctgctatctcttttggattcttacccttcagctggtctgaccctggtgctagcgtcacggtatgctgtgtttggcagatccgagttggatccaagaagtcgatgggttcttttttcttcttagcatccatgtattgcatcctatagaagaagtttgttagtaacaatcacatggatttgtattgtacatatttttcatctaattaattaaaactcatactcacatgcaccaaacaccgacgtagttgacatccatcttatcccgacgatatatggcgtagagatatgagaaatctagccatacgtaaccttcttcgccgaaacaatctgccggtgatcgagctgttatattgcccaagcctttcttgctggcctccatgtagaagttatgtaaccttctcatctcccatggtgcttctttcagtgcccattccggcaagagtgctttcccatgttcgtacttttccgggcaatcatcggttgcgaagtatgttggcccggctagttcagaagccttctgggggtcgtcatctctgagcttggcacgttccttaccccctctgaagacggttagcatgaacttctccttgctcgcatctttggacttggagtcgtggctcctaagcactcgtggcacctcggggtctttcgcaggagaagggtcttcaaatatctctggctctgtaccgtcccattccaatcctggtacttcttctttgtctgacccgaccgatgccacaaattccacctctggttctgccactgtaatctccatgggcacatccggcactgaaatctccatggctgtctccggcggtgcaatctccatggctgcctccggcaatgcaatatccggtggcacttccagcactggattttccttttgcatctctagatcatccgccttatcagtcaccttcctcttaggaggcctcggaggttttcccaaccccggtttaggcaacacaggtttttccccagcgtcagtgcccaatccaaaggatatgtcattcttgtgccagagaattacaagatcgaccgcatccccaagtacggatacaccatctgcagtcgggtagtcaatgttgtccacattttaaattactcaaattagtacaaactaattagtacaaaaataaactgtgtattaacaatatatcgtatgaacaaatttaaattctctgagatttccaaatttaactagtacttactattatgctaaattaattagtacaaacaaatttaaatagcgaaactaatgactacttactattatgctaaattaattactaaaaaacaaatttgtacaaaatttgatatgttattatcaagtagtgcactaattgacttacttatttcatcgacatgttgactaaaaaaaatggaaaaggcaaacatatcctctacatttttttaaaaaaaattgttaacataccctccaacatgttatctaaaaaatttgacaaattcacatatcctgcaaaattgaacataccctcccaatttcattcacatatcacccacattcccaaattcacattcacaatcaacatataaccccttattcacatatcacccacccctcatgcccattcacacccacatgcacacacatatataccccctcacacccacatgcacacacatataaaaggaaacacccacatgcacgcacgtccgtgttggacgaacggccggtgacgagcttcggtcgtggacgacgaaggaagggctggcgacgaggttcggccgtggacgacgaccggcgtcggccgtggacgacgaacggccgacgacgaggttcggccgtggacgacgaccggccgaagacgtcgttcggccgaggaagtcttcgctcgtggacgacgatcggccgatgaagccgttcggccgcgagcggaggggtggccgacagcggtggaggggccgacggccggcgccggtggaggggtggccgacggcggtggaggggctggcggcggtggaggggccaccgacggccgcgctcgcggtggaggagccggtggcggtggcagagaccggtggcggtggaggagcctgtggcggtggatgagccggcggcggtggaggagccggcggcggtggagcgggcgcgcggtggaggggtcggcggcggcggtggcagagagctcgacgacggtcggcggcggccgaggacgtcggtctcggtggtggacgacgacggttggcggcggcggaggacgacgatcggagagcgaaggtcacaggcggggcggcggtggaggacggcggaggcgtgcggcggtgaaaaatttcggcagcctgacggcgccaaaatttctagggttcccgcctggacttagaaattttggcgctgcgggcttgcccttatatagggcaaagatcttcgtaggcgggcggtccgcctgcgaagatcatcttcgcacgcgggcggtccgcctgcgaagatcatctttgcaagcaggcgatccgcctgcgaagatctttttttactatcttcgcaagcgggcggtccgcctgcgaagctcttttttactatcttcgcaagcggatcgtccgcctgcgaagatctttttaacaaactggtaattgcacataaaaataattacacttttcaaatattactaattttaaattttttaactaaatttttacacttcaaatggtaattgcacataaaaattagtatgaactaattaatatgcaaaatgttgagtacaattgttcatcaatttgcgatatgatcacacatcaccttacatacgaccattacataactaattacttcttagatgcttacatgccactccacaatcattaccctttaacatttttgcccacactgtccgtgcgcatgtacggcttcacggtcttctgagtagatgtctcgacattcttaatcttctatacaaactgactataaagtggcatactatcgtattggttgtaatcttcgacatcttcaactccatccactcccaatatcttttgtttccctggtagcactatatctttcttcaaatttgaagggtctttcacataaaacacttgtgccacgcgattggcgagtacccaagggtcatccttgtgacccatactcgcaaggtcaacaaaagtaagaccgaacttatcaacattgaccccgttcgggtattttacccactggcacttaaatatggggaattgcattgtgtgcccatagtcgatttcccatatttcttcaataaacccgaagtatgattgtttttccccggcttcatcaattgtctccacacggacactgctgttttgcatacaggtcttattatctcgggctcttgtgctaaacgaatatccattaatgtcatatccctgccaagaatttactgtagttgatggaccacaagccaaccgcttcatagttatttcatcggtagtttctccctcaggtaagtctaggtctcgcaaccaatctatgaagagacgcttgtgttctttcattatccactcggtggagcgacccttattgttagctcgtattagttcgatatgttgatcgatgtacggctcgacgatagcaaactgatgaagcacgctgaagtgagcttcttggaatgatttgtgatcatgggtgacgaatctcttctttcctatcgttcccctgccctcaatctgccctcgtgtcggggcacaggtactccaattgcatatccatctttgaggtaatcgataaaacactcgacaacctcttcagtactataaccctcaaccattgatccctctggatgtgcacgatttcggacgtaacccttcagaaccgccatgtaacgctcgtatgaccacatttgatggaggtacaatgggccaagcgcaaccatctacggcacaatgtgaacaatgaggtgctccatcatatcaaaaaatgacggagggaaacacatctcaagttggcactgggtctcatgtgcgaatgtacggagatttcctaactcttcgagactaatgaccttctatgacactgcgttgaaaaagtagcacaaccttgtgatagcaacctttaaatgctcgcccttcttcatgccagcgcattagttccgcatctcgcgggtttgagtatatttgtttaatgcggtctttgacaggaaggtaccacattacaagctgcgggatttttctctgtcgtccctcaattgcttcagagggttctaggccagtattgctatttgacttgtaccggcttgcaccgcatgttggacattcatccaaagaagcgtactctttcctgtacagtatgcagtgatttacgcacgcatgaatcttttccacaccaagtaaaagggggcatatgagtttctttgcttgatatgtgctggatggtagtgagttaggcctcggtagcattttctgcagaagttctaacagactgtcgaaactggtatcagaccatccatgtctcacctttaacttcataagttcaagaactgaccggagtgttgtgaactcactgtcacagcccttcgactcatcgtacaaaacttcctttgctgccttctgtaaagcttcaaagttatttagccctctagccaaccccatcagcacctcgagttctgcatgacgtaacatttcctctaggtcgattttgtcctcaacagaaccatcgttatgcaccatgtcttcaacttgtgtcggaactacattttcaggcccgtccacttgttcttcgccatgaagtgtccatatttcgtacttgtccataaatccacgagttactaagtgctcattcactttaaaagcatcgtcaaagtcccaggctatttcattcttacagtcagcacatggacaaattatcttcctcatattgttcttctcagcgtgaaccttggcaataccaataaatttagccacttcgtttctatatggagacaaaaacctcggccaatgatacatccattcccgactttccatatctctaaaagttacacgtaaaatatttgcacaattaataccaaatttgtagggttcattgaaaaacttatcgctattcaaaactaattaactaaaggttaagtgtaaagtaataaaaaatcatagtttatttcaattttttttacacagacatgccaaattagtacattaggaaaatctaacaaaatcaaatcatcggcatattacaaaatactataactattttttgattgcaccgaataaatagacatttaaaattttattctctctctatacatgacaagatctagatctagatctagaactaggtggtggatatgatagcaaaaataaaaaaaaaatgagaatttatgttaccatattaaaccactacaacaagaggcatcaagtattacacatacatctaacatcaacatatgaaaagaaataaaattaaaaaacatggagctcttccttcacaattttggatgcatcgagctattttgccgtaggacctcccctacagtatcgtcaccgcagtagagtttaaccaccaaattcgggatggattggtgaatagacaagtaggacagtgctaccagctagttaactcagttcattcttgactttcggcttgtagctttgctacgcaacctcgcattcgaaattagcactatgaccgtcggtgaaaaagaatcaaagagaatggtccatgaattggctgggtttatcaaaagcactgcaatggatggcagagggtccatagtacccgaagcactagagtgatccagtagctgggaagggcgattttctattcactcatgatcggccctgacctagtcgacgtttataaaaagaacatcacctccctttttggttagataccgctccgttaggtactaatgcttctacctatcacccatccatcacaaattaaggtctaaaagcttaaaaaaaatgcatacctagtgtgaaatgagtagatctaagtaccgtagaaaaattccccgaagatttgaagttcaaaacctccccctatatttaagtcactttaggagagagaaacgtcagggagaatgaacagggctcggggaggaagaagactatataggggcatttttgcaggcgggccatataagcgtcgcctgcgaagatctatcttcgcaggcgcacgacgtctgccgcttgcgaagatcaatcttcgcaggcgacgcttatatggaccgcctgcaaagatcaatcttcgcaggcggaccgccccctccaccccgggtactttttttgccggcggggttttggctctgaattacatgcccgcctgcgaaaatcgatcccctacgacgccgaaaatgagttttctagtagtgtggtgtcccttgcttaatttactctattttagatcgagtttaagctaatacgagtgtctaagtttgtattgagggggtgcatacatggtgaaaatagatgaggtatagctaaaaaaatttcttgactgggttcctgggcacccccctaatatatactagctccgcccctagtggcggtggtcaacgtcgggtgctttcaccggcggtgcatgctggcgagtgaaggtgcaactataaggggaatccagcggcaggcgacgatggagataaaggtgcggtgggagacgttcctcgagctttgtccagcctctcttcgctggacgtcgtctctcactctcgtcgccaccatctcccatcggcgccgccgtatggggtcgtgggctcactacgcgccgccactagagctcgccgtcatctagctggcaaccgtagaagcaccagcaccaggtcaaaacaagctcttcttgcccgtctccaagtcgaattgttcccaactccaacgccaagccgctaataccgtcgtgctagccatcttctctccatctactactttgatttgctagctgagccaaacaagttggctcgagctttcaaatgagacgagcctcatcagctcattatcctaacgatttagaccgaactgagccggggtgactcgctatccacccctacttgcagccacacgagaaaatattgttggccaaccggtcagccatgtggagatcaaaaccaagctaattactgctgctgctgcatgctgaatgcagtaagatgtactccgttgtctcctacgtaataatacatctacatactagagtatagtaatacgttgaaaaatataggaacatttatagtactaaactagtcttattaaatttagcattaaaatatattttaatagttgatttgttttatattgaaactatttttatatttttctataaacttaaacgaagccaaaataattaattttaaaataaaactatgaaacggaggtcgtattacacatgcggcacaggacaaattcaacagcgacaagagaacgaagcggacaggagggagctgcaagcctgcgtcgtgcggcaacagtggagaatccgggcgtgtcgtgccaatccggtttggcagcggctgcgctgcagggagatgtgcacactgtagcagcgtcgtgcagcggtggacggcgaaggaatcctgacaggtgccaaaaccctccttagatccgggggacccccacccaccatacacgcatgcgacccactggcacgcggacgggtaggaataggatgtggtagcatccgaggaacaggggcagtttcgtctcgccggcgttgtatttccacatcaacgtgatatgagtaggcttgctgctacggtacgaagcatgggtgatggcctgatggctacacgactgcgtcggtgactcggtgtggctctagatcgagtcggtacggtattggtttgttgactcgtactctcgtactggtcattgggcggtacacgtgtatctttatctgaaccgataatggtgctatccataacgatcaacggtgccttcacaaaatcacaagcgaatgattttactgccttgctagaacttccaaagatacccgcttcagaaaggctttcaccgtctccactccaccaaacagaaacacagaatgcataatgtgtgattacgatcaggcagagtggtacacaggtactgtagtctgtaccctgtacctattaccaccattttaagcgaacaccatcaaactcataaataacctgccactcactcgctgcacactagtccttcagtttcagtcccctcgcatcgccataaccacctcgcccaaatcgaagcacactagagagccacaagacccctcctcccgacacaaacaaccaaccacactacccttcgcgctggtctcgaccaccggagatggccgcctagctagtgtgccggtggcagctggaaggcatgggctgctgcttcagcaagaagcgcaggaagcagctggccagtgcagctgtgttctcccgccgctgcaagccgccggccgaggcccgcgacccgccgcccccgccgccgttgccggaggaggagaaggtcaaggaggtgctctccgagaccccgagcgctaaggtcagggccgaggcgaagcccgtcgccaatgtggctgtcttggaggagccggaggcggagaagcaggcgccgaagcctagcgccgatgcggatgtcacggtgagcgatcttggtagctgcatgtcgctcgccaccgacgataggtccgaggcggcgtccgagtcgtccgtcgcgaccagctcggtgaccgggccagagcggtcgccggggaagccggccaggaggaagcgcccggtgtccgtctccggcgagctggcccatgccatttcccggcgcgaccgcgccgccgccgccgcctacggcgtccgctcccgcagcgcccgggcctcggcgtcccctccgccgcggcgcgagcaacgggaccgctcagtgcggaggtcgccgtcgccggcagcgaagcgtacaccggagcagcgccgcgccgcgagcccagccccgtccctccagcggaagccgcccgtcccggtgaggccgtcgccgcggcgggtgcaggaagcgcctccttctccgctcgagcccccgcctccaccacctccgcagccagaagaggacgccatgaccgccgacggcgagcccagcattgcggacgccgccagcgccggcggcgacggcgaggggaaggagtcgctggacaacccgctggtgtccttggaatgcttcatcttcctctagtggcgctgcactaccgccgtcgtgtcctccttcgtcaggtggcatcgcgctattttcctttgaaaatgttgcgctaatcttgtttagtttagatgttctgtgttaagctggtgtggtaattagtgggtaaactacttgtggtggtgtaatgctactgtcatattccggttattaacctatgtcgggtggaatgacagcagctttgacttttggcgtaggatgggccctccgattggaattggacggcgcttgaacgttggatgtttctttttggcttttggactagccctcgctgtattttgtagagctctttttcactaatcgtcaattcgtcatgtctaacctctgttcccatgtggagtctaccaacaatgtgcacgccatcacatggcgacctcacattttctgacttgttcggtgcgtgagtcatcggatactttcactttcgccccctgcccatgctgcgccatcgaacaatgtttccgtcagggacatccatccatgcatgcagcttttctgatctcatccccagattcagcacaggatcagatctgccaaaggagcccgtcaacctaggcaaacagatctagcgcccgggatgtgtgcgctggtgttaaacaaaccgccaatgctccgcttaaaattctcatcaaggtgacatgcggcgcatcatggcgctgcacgaggccgcgcgggtcgacagttctcgggatcgcgccttggttttggttcgcccgtagcgcgcaccgtcctgtcgactcggagcagagctgcgctgcgggcctgcggctgcacccgcttgctctcgtccccgtcgtcgttatgctgatctgcgttgcgcgcttgtctcccgtgtaaagatttcgcgccgcatgcgagctcacgggagcaacgtctgtgttggactgatggttgttggttccggtatcaacatctgactgctgttcggatgttcggtggtacgagacctgaaggatggcacagcacatggatgcggttggttgaagccaaaccccattcatgctgtctgtaggcccacgggaattcatcgagcaagtcaagattatctgaatttcttcatggcaaacccgtggtttcctgtaggacagttagcagaatttggcactagtatttgctagtactgtcgcatgctggcagcgaccagaatgatgaacagtggtgctaacacagggtggatttctaatcatcggcgaggactgtcccagtgcgtgcgtgattgattggtctctacctagctgtagcccgtaagagccgagcagaaccggttcaatacatactggccatactgctacgtgggtctgtttgtcatgtgggccacactgtcccgtattagtgtctcacgtaatccaagcttacaaatcaggattccttgtattgcggccgggagaatggagatattattatctccatcctgcttggacctgcggattctagatgtagaacctttcgtcctgagttctgactttttcatcgaaaggggcggaacgttgtcctacttcgccgtctggtttgataaaatacggtgaaattcatgctcgcggcggctagtgccttcacttcagccgtttgtccacggcaagcgtccaacctgtagcctcgtacgatagaggccgtgaatccgttatataaagaggacgcttaattttggggcctcccttaaactgccctgggctgtaacgtcttcttaaatgggctgggttattaattcaagaaaaaagtttacttaaggtccctcaagttgtcgttgaattccaaaatgtccctgaatcagaataacagacataacacattcctaatcttgcaaaatcagatcatattgatcctaggatagtattgctcccagttttgactgacgtggcggctgagtcaacgtgggacccacatggcccccgattttccacctttctctcatctccccatctcgatccaggcctccaacctggaagggggggggggggggataatggggagaggtttgacagtgcgacttacgggagaagaggtgtggtcggcctcctggtctagggctacacccgtgctgtgtgtgccgcctcgcgcatcatgctccctgtggtctcagcgtccctactcgtccgcctcgactaccaacacgtctccacctggtgtgtgtgtcctcccagatttccattgctcttcaccaaagcctcgccatcatcctctctcccgcgacggcaaagcactgcatcgtcatcgggcacaactggtttgccttctacgacgacgaggttgcccgcctcgtgaatgccctcaccgtcgaggagattcccttccattcgttcctcggaaagaatgtggtagtgttgaaggtcgtgttcacgccaaacctgatgccgagcggcttcactgtggcggccatcaccaaccacggttgagtcacttacacgactagtgggaacatcggatgaacctatgtcgagtgttcgcatcttggggatctcagctacggacactactaactcatgggaggcggcaaattgcatgtccttcgcctcaccgtcggctatcgttcccagtgaaaactggcatccttcgaccactgtttgacaagcctagcaatgtgttctatccggtggaataagattgggttgctgacacatagggctagcgtgggttccacgctgaatcaacagtcacgtcagttaaaaccagaagcaatattgtcttgggacataatgtggcccggttttgtacgattagaaatgtgctatatttggtattccggttcaaggacgattttgaaactcaacaacgaggagggatgtgaagtaaactttttccttaattcacaaacccaaagagagggttgggctgtaactcataaaactgaagattgggttgggctgtaagcctgaaactcacaaactgaaatggagatgggccatggccatatgactttttttcggttttagattttttaaaaaaatatttacagaaataatctatcggccaaaaaaattataaaaatagaccctgccacccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggtcgggcggcaggcctcgctgcctataaaaggcctgctgcctagcccccagccctcattcttctctcctcaattccagtgaaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagatgagtgtaccttctataaaatgatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaatgcgggtggcctctagctttggttccgtttgttcacgcgaaggatccaggtgtgcagatgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtagatgaaatggagaaggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagtcgttaccaagcatacatgttttctacctagtgttcagaaataccacaggaatattacttgtgcatttgttgcatctgagatgtatgcgcatgtcatcgataatctcacatatgaaccaaggtcaataatccgacacatcgaagagacatataagtatactattagctatgccaaggcctggagggccaaacaaaaaataatagagatgagatttggaacttacgaagcctcgtatgacaatttgtcacgcctgcttggtgttatcgaggaaagaaaccctgggagctcttacgaagtgaagaaattccccttaattgaacatcctagcaagagtgtgctgtaaagggcgttcttagctctacatgcatgcaagatggcattcgtgaactctcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtgtgcctgatacatgatagttgttggtatgacttaatcgtcctctcgagctcctcggggaaccgttggagagtcccggctatctccgagaggcgctgggcgaggcccccttggttggcggcgtacttcgcagtccgcccgccccagaggcccacttgccggccggcgcggtctagacgggagacggcgtcccgaagcatgctgggccctacctcgcctgccaagcggagggcctcgacctccccggcggacgagtctagcgcgccctgcagatcggcgatggtgtgttcggcagctgcgaggcgagcggttaagtcgctttcgcccgcggccgccccgccaatctgtgccctcgcgtccagctccttctcccgcgcctcgagcacagcggcccgctggttcagcgcggccctctcggcgcgggcatcttccagattacggcgcgcctgttcctcttgcgaagcctcgcggagggacaggctgtccgccagccgttgcgccgcggcctcggcctcctcgagagctcgctcccgctcggtgagcgcgtcctcgcggaggcggagtgcggactcttcttcggcacaggcggcttcgtgcaccgctagtgtgacctcccgaatagcaacggcggcctcgcgatccgccaggttcccctccacggcgcaggcacgctcttccagcgccatggcacgggcctcaagggcttcgtcgcgtcgccgggatgccacctcggtctccgccgcccgccgttctcgggcagcggcagcgtcaaggaccccctgggcggcatcgagttttttctctagctccgcctcccagctcccgtattgaaggcggagggagtcctgcgcctcgttcatcacagtggtggcgatgagggcagccccccgctcctcctccacctccttggcgatctcctccagcaccttccgacgggcttcgagctctgagacgtgccgacggtgtgccttgcggcccacttccaccatggcctccaccgagcgtcgcccctcttcgacacgcactcatgcggcgtcgagctctgcccgctctgcttgcagggcctccacctgggcacttaacccgtccaacaccgtcgtgtttgcgacggccaaggcctgcagaaggggttctgcgctcagtggagcaacagaaggcgtggggaagagccgtctcggtgaggatgccgcgcggctcggcccgccgatggacgtgccggactctgggatatcccccggacctagcttgtcctgagcgtcgcccgagggattgggcccaagcgatgcgcccgcggcctcgtcgcaagctgcctcagaagttgtcgccgcctcggcctggcgaagtctggcctcttcccgagcggcttcttcagcttggcgagcttggacggccacctgaacagcttcctcggcttctcgaaggcgatccgcggcctcttgccggtcagtttcacgggtcgcctcggaggatgtcgtcgcttcggcctggcggagtccggcctcctcccgaacggcttcctcggtctggcgagccagggcggcctcccgagcggcctcctcggcttcccgaaggcggtctgcggcttctcgccggtcagattcccgccttcgggcctctgtggtcgccgggtcctcggcctcagactggccggacttggaatggcgggagggacgcgacgggatctcgctgaaacagaagaaagaccagaagacaaaacaagatggatgagtgaaaactcgcgttaaaggaatgaatacggccatgatgggcgtgggacgaacctgcgagggggtcggttaaacgaccaccttggaggggaaataaggtttccccgggatggttctgtcccccccatcttgcggggccgtttcttcttccgctctccctcgggctgcgacgtcggcgtggccccctccgggcgcctgctgctggcacgcgccgccccgccccctcggggaggagataggggaggggttccttcctgcttcctcttcccccgggcgtcggcagggtggccgctccccgggcccccgtcgcgaggcccagaagcacgaccccctcccggggtagatcgttcccccctgcggctcccacccgcgccatcgtggcctcgaggagcccgctcctccgacgccccgaccgcctgcatgatggtcaagatggaggcacggtctggatcactgcagagggggaggactccttgaggaatgagggatgcctccacggagctgagattcagcacccgttggaccactatcttgaagtcctcaggagcccagtcccatcggaccccctggtgggtcctcatacagtcctcggacccggtgtactcccaggcgtcccgggcgcgccgctggagtggcgcgatccggcgacgaagatagtcgccgaataccatggcccctgtgagcccctgagatcgcaggcccgccaggcggtcgaggacggcgtcgtagccatctcccagatctaccggcgcccgccagttggaggcctgcgctggaggctggcttgggagtcggaggcgcgattcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgaaaccggctgtacggtgaagaaccaccgaaacagccgaagggatgggcgcaccccgatgaacatctcgcacaagtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccttcgcccagcgagactatctcctggccggtcgcagattccggcatgaagcggcgcagcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacatgaaacaaggagttagggcgcaagcggcgaagacaaggggaataatggcgagagaaaggaagcaaatctcttcctcggcgactttatacccttgccaacgctgtgcccggctcctcgtttctcgcgcccactatcttgccccctcgattctcgcgcccactcttccacttatcccattcgcccgtttacggtgcatgaggtggatatgcggctgtggcagtcgagatggaacatctcgtgcgcgcgttaattacgctcgccgaccgaagcgccatcaccatatctccaggcaaaacgaaccggcacgtcccgattcgcgcgtaatgtggcagtcttgaagagaccgttcattattgacagccgagtaaccattgccgatgtgcgtgatttgcgactgttgggtttctgcccaactgtggaaaccggtcccacctgtcaccaggccttaggaagtggcgtcacgcccgaccgcttccctcgaggagggtaatcgcctcggcataacgccgggggctactgtcgatgacatgggaccgggagtatcgtgactagaggcttgaggtagacacaatcgcccacgtggcctggcaccctcggggggggggggcgtcgggcccgagggtggtgtgttcgccctcctctttgtctccccgagggggtcggaccgctcccgccttggccccgagggctggggcgccccgaccccttgtggattttgcgccgcgtgtatgggtttggtgagcacagtggcgctcacctaactgcatttattgcggtttggacgaacgcgtcacgccgcgtgtaacgcagtgcagcgcgctcgtttatccggtctgtgaccagtcacagaccggtcagatcgtgggtcaggtggcgacaggcggtctgacgcacgcctcgccccgtccagtcaggacgagagtctccaagcactcgtccctagccggagccggcgtgttagctcctggagatgacacgttggttccggtcagatatataccaggcttcatcctaaccattacaggcaagatgttgtatgaagaagggcgaacatgcagattgttaaactgacacgtgatggacaagaatgaccgattggtgaccggtctgacaatggtcatgtcgtcagcagacagccatctcccacgtcgcgcctgcttccggcggaagtggaggtaggtatgggctgtcccgtcagaaggtgattcggatggcagcgatgcaaatctccgtccattaatgaagagaagtcaagttgaaagaaagggagggagagatggtgcatgtgggatccccttgagatataaaaggaggaccttgcccacttagaaaagaggaggaggaaaaaacgatcccaggagaatcgggggctgacttgcactttgtagcttcttcatacgcgaatccgccaaaacacaggagtagggtattacgcttctcagcggcccgaacctgtatacatcgcccgtgtcttgtgtgtttccagtctggcgaaccttccacagattgggagcttagaacctcacccagggtccccggccgaactggcaaaggggggcctgcgcggtctcctggtgaggagcccctcgctccgtcagcgagcgatagaagagttgcagtttgggagtatgaaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttcgacctctcccaatggatagtccaacattggttagaagaactggattggagattcggaaattttctcagtggattctgcatgaaccaaaagagaaatgggccaaggcgtatgacacaggtggtgctagatatggaataatgacaacaaatttggcagaaatttacaactgggtgatgcgcggtgtccgtggactgccactagttggcatagtggagttcattttacatgggacatgcaggtattttagggatcggttccaggcagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagccgacgacacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggagtttacagagactaacgatgaagtactcaatattcctgacccatcgaagctccgaggcaaggctggaaggaggaggactcgtcgcatccgcaacgatatggacgagtcggaggctggcatggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcacgtcatcgttatgtactattagtaacgtttgctatatttaaatagcctgtactcttgttgtacataattaatctcatgattttattactattttataattttgcaagttatcttttgttttacattactattttttgaattgttctaacacgaaacactatatttttcagagatggcacgtcaggatacacctcagttgttggacccggcgatagatcaccgacaccggtctcaccttactgcggtgcagggggctcagcttgggacgttccgagcacgaacgtgcggtgagctactcacggttcacgactcctttgtcgagaggtacgaacagtgttttactataagttagttgcactgtaatattttttataatgacatattaatttgttattgcaggctatgtgaggccggcctcctaccgatgtgtcggctggtggaggctgcggccggcgacgcggacccggccagacgatggactgtggacaggtccctcctagcagctttggtcgatcgatggaggccagagacgcacacttttcacttgccgtgcggtgaggtagcccctaccctacaggacgtatcgtacttgttggggctaccgcttgcaggagacgctgttgggccagtgaccacggctgtggactggcaggacgatctgacggcacgtttcgcactagtacagcgcacaccgcacctcccgctcaagccgttggcacaccaccgcaacaccggacctacgaagaggtggctgcttcagttcaccgtgagtgtttttgtaccgaaatgacaatcgtattacatatttagtccgcagttaaggtgcctaacattttatcgacggcttgcaggttgagcagctacaggcggaggccgacgagtactcctacagccgatgtttggaggcgtacttgctctggctttttggctgggtgatgttctatggcggtcacgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctaggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcaatcaggcgtacctaccataccccaccacgttcacatgtcaggggtatcactcgattttttgcgcctatataagtcgccttaacgagtgagacctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatactgatattcgaggaaggcgcttttttaggtgccctaactatgaccgtgaggtattttattatctgcatatgcttattcatttcgtatgggcaatcgctttattcttcgtaacactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttttactgtcatgcttccttgtcccattactacatcgtcgttgtgttcaactattgcactacctccctcctagttcgaatctaatatcatctatgtaaccgcaatgcaaatagttatatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctgggt

SEQ ID NO: 81674 - DNA, 4109 bp, Oryza sativa
attaattaaaggggacgtagtaagaaatctaactgaacgatatacttacaaaatccagcaactcataatagagatgtcgagggcgtctagctggtatagttcgtagattcccttgaaattgatccagagaatgtcatctccttgcaagaagtctatgtccctgatcctcgctccgatcatctctctaccggtggcgcttatctccatgtacagctgatggaacttgtacatttgtgtgggtagggactgcaccagctcaggcttgacaagcggttaccgagttcgtacatgtatttcacttccgccttttcgattggtgcgactcctagcaattgatccgtagttagaccggtgtcagtaataaattcttctatcgtcatttcttcaccggtcaccaatggctcgatctcctggtttggttgctctccaagctgagggactggtttggactttctagaagatgctttcttcagcgttcgctcatagtccgataacttaatggcctccttggcaggtgcagacatacccctgaagaagtttctgacactcgggtctataggaatattcttttctggacttcgaggcttgaattgtctcttgacttctgatgccacgtaagcgtcaagctcctcttgcgtgcaatcgtaccccgggtccttgttcttggcggcgtcaactttcgccttcttcgttgcccatgtgtgggcaagcggtggagcttggggggcccttgactttgaaggtgccggaagaggagcccgaggaggagttggtgcaggagcctgaagaggagtcggtgcaggagcctgaggtagagacggtgctggagcatgaggaggagacggtgcaggatcctgaggaggagatggcggagccaaaggagatggtgcacgagacgctgcttgtcgcccagggaggatgatgtaccgcctatgccatagaataatggcatggcttgtgtctcgtagatgcgtctcaccgtctcctccagggtaatccaactcgaggtcctcgtacgcgccttcgaccaactcaacttcgaccttggagtatcctgctggaatcggcctgcagtggtaagtacctgaagggtccgttgggatggccatgcccgacgccaccttcatgtggtgagaggttatttattagtaatcaacatatataagcagcaactagcagaatggccaaatctaaaatatataaactacgagcttacctttattgataagttcttgaaaggaatatgcagctcacatggtgtccgctgagtgatgtcatcaacggggcaggtggattcgtcctgggtttgcatggcgtccatgctctgtgatcctacttgccccgttgaggcgcagctgctacggtttcctgacgggctcaccattgtaggaggaatggtcggctggggatcatgggaccgatgtgcggccatacgttcatcaaccttccttgccacctcctcttgcatgctgcactcgtagctcgataccctgaactctagatctgcaatcttcgcctcggtatctctcttgctcctcatctgactcctgtatgtgtggatgtcctccttgaacccaatcttccaaggaatcacccctttccctcgtgttcgtcctggatgctctggagtctgcagggcgagtgacagctcgtccctctctctgtccggtcggaacgtgccctgagaagaggcttccacttcgtctgttagtcgacgcgcagcctctcatatctgatcgccgaagaccagtaagccatcagctgggttgagcattccaccgtgagcatagtaccagaacttcgatcgttccggccaattagcggtggccggttcgatacccctctcaagcaagctagcctccatctcctcccacttcggcatcgcgacgctatagccgcctgaccccaagtggtgatggtacttcttcttggcggcattttctttgtttctttctatcatcgcctgcccttgttcacctgtcttatatgcaacgaactcgtcccagtgatcccttagctttgggaatgtgtcgaagttcggtgtctgcccattcaggatatatttctggtacagatctcccttgaagctctgaaactgttctgccattttcttcagagtccacctttgcactttgtcctctgtacccgcgggaagggttaatgtctcgagcattgtggttcacagcatctctttctccgaatctgggacaaagctctcatgatctccgcgtgcccttgttcttcgccagtacaccgtactgacaggcacgttatcccgcacaacccaaccgctgtgacgtacatagttcttggcggcttctgccggggcactaggtcgtccatcttcttccacttccgttatgatgtgccgaccctcaagcttcttcggggcacctcgttgcccgcgtgccctcttctgtccaatggagggttgacttccactaacctccttctcctggttcccctccacatccctttccacgtgcccctcctggttcccctctgcatccctctccacgttcccttcctcgttcaaatactggtttggatcctcgttcccctcttcttcattccagtactggctgcttccctccgcgattatatcgtacaatatctgttcctcatcgcgatcagccatttgttcatacaggaaacatctgctaagtcatgagacatttatgttttaacaatcttatattaaaactcaaataatcttatatgctaagactaaaatagtcatgtatgctaagtgtaactgtcgtatattagaaccctacacaatcttacatgctaagtctaattacaaatctaataatcttatactaaaactcaaatagtgatatatgctaagtctaggtgacgtatattataggactctagctagtcaataattatatactaagtctaattacaaatataataatcttatattaaaactcaaataatcttatatgctaagactaaaatagtcatgtatgctaagtgtagctgtcagtatattagaaccacacacaatattacaagctaagtctaattacaaatctaataatcttaattgcattacaaatataacaataatatatataattacgtctcttgcctgcgcgaattccttcgagggctagctctaccactccggcttgagggacgactccgacaacgtcttttctgcaagatacaaaaagatgtattaggataaacgcgaagtaacatatattgcatttgacgttcacgtttcgttcacgatatcgttcacgttcgcgttctcgttaaggtcacgtttcattcacctacgtttgttcgttcacgttcattcacctgcctataattgcatttcacgttcacgttcattcacgttcgttcgctcgttcacgttatcgttcacgttctttcgctcgttctcattcacattcgttggcttgttcacgttcgttcgctcattctcattcacgttcattcaccttgttctcgttcacattcgttcgctcgttcacgttctcggtgtggcggcagcgggacgacggagtggcggcagcggagcggcggcggggcgccgcgcgcggcatcgggccggcgcgtggcgcggcggcgtggcgccgcgcgtggcatcggcgtggcgcggcggcggcgtgcggcgcgcggcgcgatgccgtcgtggcgctacgcccggtggcggcgtttcgcggcagcggcgttgcgcggcggcggcgtggcggcgcgccgccggtggcgcgtggcggcggcgtggcggcgcggcgccggtgccgtggcgcggcgtcgtcgtggcgcggcgtcgtgtcgtgatgaggtaggcgtcagcgtctgaaactcagcggccggcggcaaccgagagggagagagagagatcgagatcggagagagagatcgagggaggcggcggcggctctcaccccagagatgcggcggtggcggaggaggcggaggcggcggcgacgacgacgagcgcgagacgacggcgagatacggcggcggcgtcggcgcggggatgccctaggcagtggcggcgaaggagaagccgagagagattgatcgggcaaaaacttctaagtgtttgtggagaagacgagggcgcgcattgggaatatata

SEQ ID NO: 81675 - DNA, 7237 bp, Oryza sativa
tattaataatgataatcaagcatgattcgttggtttggagtaccaaaaccttgccaagttttagcactagctaattaattagaatttgaattagtgtgagaaaaaaataatagcaaaccaaacatctatttatactatcattaaagttttcgaaattttgatacggcaaaaaaatcagcttcaatgatcattccaaacatacccgcaatctttcaagatcaaattaaccagatttaagagtaaattacatcagcggtacacaaactggctagataagtgtaatctagtgtatgaacttgtaaaatgctcgttttgatgcatgaacttatttggtgcgtgcgtacaagaccaaaaccgtacgacaatgttaatcttgctgattttgttattgattttaatgctatgtaaacaaatatcacgtagataaagatcaatttagcaaaacatataataatgcatattgattgcatgaagaaaaagataaaaaattgagtaacgatgcaagcgatagtaacaaaggaagataaagtagaaaccaaatttatacatataacctttctactatatgtgcaccacgcatgtcatgtaataatttataatgttcaacttgaaaaatcagccttgtcatgccattttggctttgggatgtacgcactaaacaagttcgtacaacaaaataagtgttttacaaatttatgcactagtagactgcatccactaagttgtgtatcgttgatgcaatttactccagatttaatctacagatatgagatatccaccaaggcccagcccattttgggcgctgaagcgagcactttccactacggcccagcccgctttgggatagcgaaagcgagaaccccagaagcccgtggaagcttcggaagcggcgcggcgcggcgctgggcgggggagaagaccagagcggcgaggaaggaggcggcgcccagcggggagagcgagcggctcgacgccgacggccatggcgctgctgatggatcccggggcgggaggccccctgacggagagcgagaaggccgacctggacgccatcgccgccatcaaggagtcggcggcggcagagtacaaggagaagggcaaccggctcgtcaagatgggccggagccactacgccgacgccgtcgactgctacaccaaggccattgcccagatggagccgctgccgccgccgccggtgccatcccccgacgcctccgtcctcttcgccaaccgcgcccacgtcaacctcctcctcggcaaccaccgccgcgccctcgacgacgccgcccgtgccgtccagctctctccctccaacgtcaaggtgccctccttgttctttgttggattcggcaaagaaaccttcgccttcgcgtgatgtgtgagattcttgtagctaggcgtactaccgggcggcgaaagcggcgattgctctcggcttgctgccggaggcggcggccttctgccggcgggggatcgagcaggaccctgctaatgaggagctcaagaaattgctcgcacaagtggacgcccaacagagtgagcaagatcgtcatagggccaaggttgcgcaggccgtgtccgctgcgaaggtctctcctgctccaaatttgggatttcgacattgctgtaattggtttccgatatgtggaattaaccagtgttatatgtatgtaggatattgttgccgctatagagaagagggggttgaagcttgggaaggcagcatatcaagagcttaccggtgtaaagaagccgaagttggatgagcagggtgtgcttcactggccagttcttctgctctacccggaggtcatgtcgagtgacttcatcgaggattttccggagacagatactttcgtgccccaccttgatgtcatatcctttctaaactatataatgttattatcttaagattaagtgcataataagtataggctatgtgatggaatcactgaatttgtgttgaacccttaagtactgtcaaacatgttctcagaaagttctccaccattaccatgggatgataaacacgcttacacacgggatgctgttgagttatattatcaggttcgtgtgtatgaattgaatttccttgaaaccaattacctgcctgctttctaattgttaaaagttggaaaatatgtctaaataacttgggctagacacttcattgttcatatagcattgtaacaatacattaatggcacaatggtgtgattaaacaactattaatgtgttaatttgtatttttggctaccaacagttccctgtgaattcaggtaaacaagtacgtctgtttgtcagcatataggacattatagttaacttgtaaaagctgcacatgtaagttgtctccatatttagccaatacagtttaacacatggtgcgtgattgtggattacacaccgagatggtttgatccctgtttttatatgtaaggtagagttattgtcaatatttcgaaaatcttagcctcacattatttttccaaatttggagtcaaatttggagataacaacgtctgattagaaagggaggcatggacaacacatattttgatgctagcaagttaatcatcattgtcatcatctggttcagtttgtgaagttcagtattgttgtggattgcttgtttttacagcttgctatacacagttgtttggcagattatctttaggatgtatgaatttcctatatcgatcgtccatcttctgtttgttgttgtgtaactgattctttactttgtgacattaggctggcgttggcacagttctgtccaaaagtgaaatattgaaaattcttttggaaggcactatggactcaaagtcacttcctgaaagcctgcttgatgaggaagatggagaaaatgatgatggcaagagcagcacaattacatcatcaggtttgtcgatgaacatattctttagcttgtcatactaaaagaaggcaatgtggtggtgatatatcttccacctgcacacccactccatctacattacatttttgttaattgtcttcttattatttgttcttctaaaatataaatttagattcgaaaggtgtaagacagccaaattgtcagatacatgtgtacatgctaatttccaattaaaactgtatcaacaatgccaagtgcgctgtaacaaaaatgcaaagggtggtgttcaatgcaaaataagtatcaacaatgccaagtgcgctgtaacaaaaatgcaaagggtggtattcaatgcaaaataaaaagttttgaacatgtatgattcatttttattggtagcaaatgtgcggttatttagcaagtaaaagaaatcaacatgttattataaccagccttcttgtacagctaggcaactcatgtacccttctcaaataaatactgttactgttcaacttttaggaagctgcttcggagctctccagtcttttgcacgaatcacatgtattacagtaaatggcattcattactatagtatttttctttaatgtgtagataagggttctgtgaagtggatcaatgtaaaagagggaaaaactcttcaagaagtgctgcagcataaagacttcatcatccctgcaattcctggtctggttcctctctccttgaacgatttcacatattacatataaatccggagtatttaatgaccccatctctttgcttgcagtgttctttgttgtttcaagaaaatccaccttttacagaaagttcaaggcaggaaactggtctttgccgtaatgcttagcgtgattcagtttggcacatttggaagatgattagtgcggtacgcgtatgatcagagaagaaaagctggccacctagtcattcttgtatggttttatatgttgctttatagaatgatgaggtgtgttctttcctgtatttggtacaattctcaagtattttcctatcctttgcttgagatgctcagtatgccgtttctggagaaacacactgagaatgtacttatgtatggacagctttgggcctgatttagcgcttggcacagtgatggtatcttgtacgccatatctaccaaccaattttagcaccaaacttttcttgtcaaataccttgtgtgaactgtaagattcaacctccaattccttggtgtgaaatccggcaacgttgatgtgttttctcactgcggtgatattcggattggaaccatcgacgatgttctcagttgacttgtgtgggagtgaaatctctcattcaggccgatcgagtttagtttcaaaatttttcttcaaacttccaatttttctttcacatcaaaactttcttacacacacaaactttcaactttttcgtcgcatcgtttcaattttaactaaactttcaatttcaattttggtgtgaactatacacaccctcgctgccttgtaaatcctttattcagcactatctcctccttggatacagctacaagcacgcatcatgcatgcagattggagtgccaagaactcaaacctgtgccacggtgatctgaacaaacgcaacacacatccagaaaactaaatcagcaggtagccttgtcccttaccagctcaacgcaacaactgatgcagagatgctgccggtgcggtggcaactggcaagatgtatatgtgtttgtacgccctggcacgcatgcggcacgcatggcgccggtgcagcgaaaccgggggcagctgtccggatcgcacatcctgggagggagggatagggatgaatgcttaccatgcggggggaagccagatgagacgaacgcaaaggtgcaaacgcgcgcaggagaaggggagaaagcgagaaacgtgtcgccccaagtagcgaacaaaaacggccgcccccgcgcgtggcggtgggtgggttccggccggtcatctctatcccgcgccgtccacgcgacaaaacaggggacgacgcaaccccggcgccttctgtggctgtgcgcgtatatatatagagcacgggacacgggagtgtgtgtgtgatcgatcatctggtggtagtgaaccgtgaacacacggcgcgacaggtaaactagtgagagagcgactgcgagatggaggagaagggcgcgtctcccgcggcggcggcggcgacgagcggggagccgggagcggcggcggggacgatgaaggtggtggtggccgtggacgcgagcgaggagagcctgaacgcgctgtcgtgggcgctggacaacgtcatcgggcgccgcgccggcgccgtttcggtcgtcgtcgtccacgcgcagcacggccccgaccacttcgtctaccccgtcgccgcgcacggtatcggatgtcagcacaccggctagaccatatatacaaactagtgttaacttttaccagttcacttcgcatttcacgagactgacacggcgtgtacatgtgcgtgtgtcacggaagcagccatagcctacgcccccgcctcggcgatcgagtccatgaggaaggcgcaggaggagatctccaggaaggtcgtgtcgcgcgcgctcgacgtctgcaagcagagagaggcaagcacgcctagccagcgctagtgttcacgtatagcgatctgaaaattctaaccgatagcgatgcatgcaggtgagcgcgacgggcgccatcgtggagggcgacgccaaggaggccatctgccaggccgtggaggagatgcacgccgacatgctcgtcctgggaagccgcggcctaggcaagatcaagaggtaaaaactgcgctcaaatcaatccacatgtacacacgcccacgccgcgaaatcgaacgaacggttgtgacattttttgctttcttcgttgtgcagggcgttcttgggcagcgtcagcgactacctcgtccatcacgcgtgctgccccgtgctggtcgtgaagcccaccaaggcgcacgacaagtgaactcgatctgctgctcctttgctgcctgatggatgtcctgtgaagtgaagacttggctatcttttgctactgattactcatggagccggtggctgctgttattacttgtgttgaaaataaaaggatatgttaagcttctgaggctggcagttcttatgtagatgcaacgtgcaaactgaaactaatacatggaactgccgttgaagcttctgagctcctgtgtagatgtaatgtgcaaaactgcaaactgaagcaaatacatgagtagtacttgtggatatagaactgcaatgtttccttcttgttcagtgtgaaaccactcattcagaaaagacgccctcaaaatattcggttcttgtgatgaagttgttaccctaaacacggcttacatgccccaaatcactgctttcgaaggccgaacattgcaagaaaccacaaatcctttaagcacaatcatgaaactaaaaggggtacattgtgtaaagtttaatccaacaaacacatcacaacggacagattcagggattcagtaaaacattgccgagattcctactgatgctattgcttcagtgacctacaaacaaaaatgcaggaactgtgaaagcatgaatccatccctaggcatcaagacttgaacatttgaaacagctaaacggtagcgccatcattttgctcccaaccgccaagtctatcttcgggatcataatttgtgaacaagcggaattcatttcctagcttgtttgaatgctgaggcttgaatccacagggacgcacatttaggagctcaaatgccctgtccctctgaacttcccctggcaaaacacgagaaacttgttacagaaaaataacttgatttgaactatgcatttcagagtttaaaaccagaaataccagaagacaaggcatgtgatccaccatatcacaatactgaacataaaaacagggatactaaatttacgtaaactagtgcacatcagatgacaatgatatgcagactaagctactgtagtacagtacgttgatttcatacaagaagagcagacgatgttttgctttgaaaacaacaagaaggtcatgatgttatagagaataccccagtagctactacaagccttcaactgaatatgccactctcgcgccctagtttacacacacttatagcctaatcagtagtgcatatcaaatcatttcaagcagttccagttaatgggcacttaacctcccggcaacaatttgctctagtttgatacacttgattgcagaaacatgatccaatcatcaagactaatcaatttacaatcatcacgaaagaaatcttggagaccaatggcattaaccagacacgaaattatca

SEQ ID NO: 81676 - DNA, 5421 bp, Oryza sativa
atgtgactttttgtttgatacagcaataagatttgtataacaagtctgcaagaatgattcggagaagtaattgaaaatatgaaactgaattcaaaccaaaccttggatggttttacgttatgaaataaataatacaagttaatcaacaaaccccaaggtggagagtgacttattgatattggtagcttccttcaagcgttccccttcagcacctgagctcttttgcctgcaaggcatatatatcattcatgctgaataggagactcgaaactgtatgaaaagcaaggagacaaactacctctctgagcctgcaaggtcaactaggttaagccgagaaaaccggtgatggttgataccttgagattcccactgtatggtcaaaaaaattatttataatagcatgtgtatacatatgcaagcattaggttagccacaaatataaaccagtatatccatcaacatcaccatccttgaaactaatgacaggtaatatcactcttattacacaaaaaatacataaacaagttgaagcagttcagttcatataccttactctcgataaggcaagtgaaaacactatgagagcgactgcttgctctattcatattggtagccgccacctttctgtttgctgccccctgaaaagaaacatgtagtgtttggctaaagagatctagctagtgaaactagcattttatatgtgagagatcctttaataaatcaacttttccaagcataatgggcaactaaaaaagtacaatgtggcaacaatcacaagtaaaggcaaagtttggttttactgtttaaaactaaaatgctgaatttgatcgatttagcattactcaaggttataagaatcagtaaatggtattcgtttggtgaaccaccttgtcctatatttctgtataaaactgccttttaagttttaaccattttcctataaaaaatttcagactatatatattagatagcatgtgaacactatcgagtactgtgttttatctatattgccttgtgaacttcgcagtcatcaaaatagttgctagaagggcaaaacagaagtacctaaagtcaaagattggagattcagtcaacataattatattgttacatacctaataaatggccattgtatattggagtattggactacttatctacacattcttggaaagtatggaataattctcttttcatatatatatagtgttacgaatttgcaatgaacaatagcagcagagcatcaccacaacaggttttctttatgacagggacacagtgcatcaaataactgatcttgtaaccagttattgcctggctaaacatgtttccttattctttttgcaatggaacagtcctagtcattttgttcagaaaaatagcagtcctcttaagccagtcttaaagcacaaacctcaacaagttgttgcattgcttctcgagcattggaaacctcatgttctgtcaagttctcaacatggacaccctttttagcatcctctcttatctgcaaatatagctaataatatcactttttgaaacattgagatgtcaaaactgtgaacatctcctaacagcttcttaaaacacaactagcaaacatccgaggacacacaaataagccatgctttttagtactctacctgcaaatttactgaattcggatttagcaaatcaaggatctgctcattgtatatctccaaaaaagagcatttgcaagtaaacctgagtttttcttctttccttatttccttttcctggaacagcaatgttaaaatattttggctgagaagagtacaccactgtaccgcacaagaatcaacaaataatcaaaacttgccttctggattcttaaaaacagatgttcaaacacccgaggcgtcataccacaattcacattgtttcttcgtgtgccattttctatatcaccaagcattgtgtgtgtcttgccactgccggtctaccaaaattggacacccttgtaagcactaagcacagacattgaaatgcaaatttacaacagtatgcagactgctaccctggaaacctaagtatcttgaaatgtcaagtagaatcagtagcttacctgaccataagcaaacatacagctgttatagccagccatgcagttgtccaccatgggcaccccagcaaccttgaacagattctcctatacatccagatgaacatcattcacacatctcgcaagacaagtagataaacagatcgaaatgacacggagaaacaagggcgtgaagagtgtacctgcgtgacatactcgtccgcaacgagatcgaacttgaaccgcgactccgggtggcccgtccaggtgatgctctggcagctatcctgcctgacgcatctcttctgtccctgcaccgatatctcgccgctgctcagcggccgaacacggatcacaacctgttgttgcacccgcggaacaattagtggagctcgaacaaggctaactaggtgctcggcgaaatgctccgatgggcacatcgcgggcggcttgggcctgagctacctagatcgagaggcactactcgaaggataagcttgcgactaggcgagagagggaggcgaaccgaaccctaacctgcacgttggtgtccttccagaaggagggatcctcctggagctcgaaccccgcgggggcggagccgccgccgtggtcgtcgtcgccgcagtcggatggcatcgcggcgacgggatcccggtggaggcggcgatggcgcggcggcggcggcggcggtggaggtggaggtggaggtggaggtggatggggagacgagatgggggggatttgaaatggggagcggagacgaggagagacgctgctcgatttcgaattttggggttcagtccgcgcagcgcggggcacccaaaagcgaagcaatttgcggctggtgagtgggacccctttccaggtcaccaaattgaagtatcgtgacagttggatattcgtgaaagacttgcctcgagtttcaaatttcaccaaaaacagcgtaagaacagcagtttgaatttcagcgagtactgttggagctgaaatttccagacagacatggattttttttttacacgaacaagaaataccacgcattaccaaaaaaaaaagctgaaaaaatctacgagacatatcaaggtgagcatgcatgttcttttcaaatgcatggagcattggattaacgggcacgcttcgctaactcctaatgctgtggttttttaaaaaagtttctatataagaattttcttacagagttgttttaaaatcattttaaactctacggtatggaaatcatacattttttagtctcgaacaattttcacagatcaattcactattcagtcatctagtttttgtttaccctccctgtttcataaattagctcttatattgaattttatgtttactccctctgtttcaatatattttcccaatttaattaataatggtttttgtttcactactggtatctttaaaagggttgatatatttatattcactgtgtaatgtacttactagattatatggtatatttttagtccttataagtttattaacaaaacacgagtggtcaaactagaatcataacaagtaaaaatgccaagtgttagttttgaagctgcattaccttccatcatctgccttttgcttacaagtcattgccgatattttaattttataatttaattctaaagcttttcatcatagtttatttccaccattacttttaaatcactaagttcactataaaagttttgctatctttacaagccattttacggcctatcagttgtgaccaaatgatggggctggttatattggagtttggtcgcatggagttcaatcgccccatgctaaccatccgcatgcaaaatctgagcctcatcggtaagtaatatgtttggctgataagctagcctcggttatagttaagatggctataaaatttatacatcatgggtgatgataaaaattgcaccctagttagagtagtattgatgtccagtcaacttagaaattagtgcccagtatttctaaacaagcgattctcgatacactgttgacgaaaaaaatcgaacacaccgacctatgagatctgcttagcttctgtgcaggtccaaatcttgatgagatgcgggcgtaccagtcagtttaattcggtaactgacaatatatgcaaatagtatatcaaaacagccgatcggctgataagccgatggagtagttccagccgatagccgatgccgatagcgatagggtttaagtaatcggctatatgtccaatgtagatgatgatataaaggcaatcgactgttggtaataaagtataacaataatatagtccagtagaaaccaatcggctataaacaatatataataagcattgatccgaagattaaagcacacatcggctggaggtccgatatcatgaaatccacaagattagattaaacagtgaaacctttgttgtcatcggctaaatccaacttatatgtatatgcaatccttatgagccgatgcaacatccagataactcaccggctgaaactccgatgaaacccttattggcaatcaaaaagcaggctaaagattatggttctaagcacgacttagtagatcaaacttaactgatgcagcactaagtatgaaaagaaacataatatctaaacaatcaagccgttgactgagttttcagggtggtggatgtttaagctaatctaatctagcaatgcgatttagccaataccggcagaaaccctaaaacgagaagcagccgatagagctaaattgatatgctaagactagattaacagagacatatgataaataggtaggcaaatatatcatccaaaccagagcaatccaagaggtcgaatgtactgatgcagccttgaacgacgccgacgtaaacgatacaattgcctgggatggcggaacattggacttaccccttagtcggagatcgaacatcgatgcagcctcacgtcaggtgccaagtcccgccggacgataaaataaagtagaaaaggtaaaaggtggcgatgcgccaaattgtattgatcgtgaagataaattacatagaccctgggtgtacatatttatacccatgggttgatacaagtccttgtcggacaagaaagaaactttcctaaagataaaaggcaagataaagtccttataggacactaaacacacgttcctaaagataaaaggaaactaataaattattcctaattaatagataacttgtcatgccgtattctctttgaactcggtctcttctggataagcttcctttagtagatcaatttccttaaccgaatatatcaagaatccgacaactgacgacttgacaactctcatcggctaatcttaggacttcgaagccgatgctgactctaagccgatga

SEQ ID NO: 81677 - DNA, 143135 bp, Oryza sativa
ccgctcaccttaaagaaagacctgctatatagccaagctgctcaacagttcgcagctggttgaaggcaggctggctcgcaattaaagcaaacagttgaagtttgatatttgaaagggcatcgtccagatgaacctgaatataaacatgcttagcatcctcacatgcttctttctacataacatcaacattttttacttttcaaacttcaaattattgagacatcacacgacttgtaaaataatagccctcattagaagttaattttcttcccctcaaagaaaaaactgaaaatggggccccaaaaagctagactttacatcttaaactcatcaaaactcacaaattgcatccttgtgctccttttttttatgtcaaattttgtactcacaacccacaaatcgcatcttcaagcatatgccctagttctccaaaaagtatcaatagaacataatcaaacctgtccttctgattcagtccggcaaagccactgaaggaaacaatgtgtcatgtcccttgtgctggttcagtcacaagcaacctacttcttaacttcaatcagtgctaagcgaccaagagtgaagtgtctatgaattctgttaattctataaatttttaatattcttatttcagatttttattaaatttgacagtctgtaagcaacaagattcctgacaaacaatactagaaaaagagtggcaatgattttgttgcagggtatgtttttcaagaatagttaaagagcaaataggagacgatgattcattgagtagagcgatgattatatccatgagtctgaccctcccatttctttcaggggcatatagtaaaaaggagtagcacaaatgacaggagcaaaaccaagtgtcaccacgcacattccatataaaatcacaaacattagttccagcaaaaggaatttaatttaattgacttggatctgaagtggaataaacaaattatatgactatgggcagtacatctgtgaaacagataccttttgactagacaagagatgcccccattgttgctcgtataagctacagttattgacgaattctttttcattctaggcgaaattgttcaggaatttcacactaacagattgttttgatcaagtaattgtactttgaattagttttatggttgaatttgagtacttcatattactttgcatgcaagtacgacatgtaataatatttttagcaattagaagtaggtaactctcaagtctactgaattttaggaacaagttcaacaatttgtaatcaatttggtcaccattagttctgaagttactgatcatggatcagtagttgctttcgttaatagtagttgcattgcatcccttgcactaaagatcaagccacagggacatttacctgaatatattggaccactgatgaattttcattcttctgatttaagccctcaatttggtggtagcattttaactcattttcaagcatgataacccttttaatcagatattgtgatggagacattgatttgaacacagaattaggggtattgaatatagtatcttcaatctcctggacaatagatgttgcctcatttggttcaatgttccctacaaggagaaaagttaatcaataagtatgactggaaattcatcctgttacagtccattgcaaatatatctacatgatgaatcgactaacaagaacttctgcctaaccatgaatatagcattccaaaaatgtcttcgatagcaaatgtggcatgaactttgcaagagaatctggttcaagcttagaaagagcctcaagtttctcagccaaaggccatttctgatcctccaatatcaacgagagatagtatgaagcttgagagtatggttggctgaacttgaaattttggtagtccttgacagcagtttcctgtggtggtaggatgaaataaatcaatgaaacaaaatgacattgtattcaaaagatcctaattggtccatggcagagcctgttatcctatatttatcaacagaccgagaacagagctcattacaaacaagtacaagttatctgactatcttggataattttctggcaggtacaaaacaatacagcatgcagaactgaaaacattaataagattactaaattaggatatggagtaagaactgttatttgtgatgtttgctttcacccgtttgtctagattgctgcgttttttaagaatagatttgtacccaaatcttctgcacggcaagttatacatgtgatgtaaggctgccttgttttcacatcaaatccgtaacacggtaaacaccaagcaacaaacaagaacaaataaatcttaattatgtactcagagtatcatataatcatcctgtgtgttcttggttcccacaatatcatgtccataagttgaaaagtttgacacaactaagctttgattgtctaacaattacaagttgatagataacagttgcctaatgaaagtaaaatccagtgatcgaaaaaaaaattgatgcacacaaagttaaaacaaagagaacaattaaatattgaaacctaaactccaaaataactaaatctacttaccttcaaggcacaaaacctgttcggtttaacttcaaagttagatatatgcttcataatggcatctagcagaatccgcattttgtcattgtaaccacctactgagaccttacatagaaagtaaaaatgtttttagttctaattcaaactgtcctaataaagcaacctcatgatgcatgacaattctatcagacagcataacaattttacaatgaattttttttttggctggaacactccttggaaactaaatgagaacaataaagtagttcactgactaaacctggaatccagcagaagtgcgatatattgaatagaataaaccagcaatttgagcatcatacgctgcaaaaggcacaaacattttgtaaatttatgtttgaacttacagttggtgggagtagtaatacccaaatgggttattaatgtacggataaatatgctaatatttacactatttgtgaagtggtgcttaccatatgcattcaagtaatcagctaacaaatcaacaaagagactcgtagaaatgactgcctcgggggaatggcttgttaacggacagtggaaatcaattataatgtgaacctttggagtggagaacagcatgtcaggcttataccacaaccgtgaaagtggtgtctttctcaatattgctggatatttaacctgcaaacatttattttgtaagagatatttactatattcaagattcagcaattcatttagaactgtgctaatgtggggaaaaaacacagatgaggtgatctgaatccaaccttttcatgcgcttctttgagcgataaatcttttggaatgaaaatgttaggctttgggatacagagcttctcagtaggagctttttgaatccattgctgccaaagtagaacaatcactgacaatatgttctagcatattatctctatggattataacaagtgtccacattctaacagtatgtaatgtgcaataagataagaggaaaactctagttcaaaaaatcaagattattcaaaaaggacaaacctgtatcatggaaggagtaacattttcaacagaatacgctgtactataccatggctcaacagaatcagtagatcctttgaactttttagattcccacagtatcctggagacggagagagagaaatattacataaaaggaagaggaaagtcacaatatttagcttcatatggtatttttaagtgccaaactggatatctgtcagcttgtcagaaaataagtgggcaagtaaatataatgactaattttgggcataactttctaaggtcgcatatctggtagaagttgaaaccagtagggataactttctaaggtcgcatatctggaagaagttgaaaccagtagggatggcaaataatgatgcataattcttaaacctattaccactttttacttcagaaaagaacgaattcagaaatgtttgtgtgttgagatacctaaatagtagatactgtaaatagataggaggaacaaacaatgctgccatgtgaactgcataaatgtaccttactctttcagctgacaactcatcaagtatcatatttattctatttggagcatacttggacggtagtgatgctccaaccagccattcttctggtgggaataactgcaagcagtccaaaagatctttcatattgaagatagctaatggactacagatgaaaggtgcatttctccaacatatgtcagtccaacagagaaaatttagacgatagaatagttggtaatcggtgttatcacataatgctttgctggaggtgtatcagtaatgaatagaattgatcatatggaatagcaaacgatacattatgtacttaatgaggtattgagaagtatacccgcatggttgagacagtatctgtcacatagctgattggatggactttgtcctgatagtggaattccgtttcatttatcgccacaagctaacacatccaaaaacatgttaccatcacatttagtttatctatttaaatcatcccaatatgcttaaggcatgcagaaaaagattgatactataaataagtgaagttgatgatgagatgataaattgaaacataatgaggtcttgctaaaagaaagtacgactcatgcaaatgtttctttttttttggagcgtgactcgtatacaaatggttgtagtgtatcattaattgatagagtctattgtccagaattagaaggacatctgtcctgaaccctcataagttttcaaaactaacaggtccaattcaaatggaaaatataccatttgttaaccaaaatttatattcgttatagaattcactgaatgattaaaaccagtaaaatattccccaaaaaagtcaactgacgttgctaaagaaaacttttcctatcaaagatatgcaaagataagaaactcaattatgtggaataactcttgtttgggtaattttggatctctcaaggaaaatatcagaatgtcatacaagtatcagaacttctaaccataaaacatggatttacacattgcgtaagtccatgttcttttcaattacctcatcaaagatccactcatggatcccattttcttttagtagaagaatatatttgaaaaccaagccaatgatgtcttccatgtgttctgaaatcattgcatgtgcacgcaagaggcttaaataataacaacatgtgcttaaaacaaaatagccatgttagttctaattaaagatagaagctgaccatgaccagcatcggtgagcctcatgctaattgaaaaaaaggagtattgagcactgtcactgccctccccggccgacaaattcatagcccatcctaaagtagtcaaaattgagcatatgtcacatgtagaaagaataaactagagtgactatgagtagataaggaaggcaaaagtgtggtacagcaatcaactggtgaatgtacttgcctagttcctttataatatggaagatggatccctcgccttcatgcccaattaagtgactcagataacgggaaggaccttctttgtaaaagtggatgttgggtgtaacgggccatgatatttttaggtaatcgccttcagatatcgggattgctttgataacaagctgcacggcaaatttcatgttatttaccatcaattttttttcccgaaccatcgcatatattttatttttagtgattgttgcaagtattccaacttctccatctaccacaattggtgttgcttcaagtttctacctgcatatgctgctctgaaagaggttgacttgggcatttgaagcttctctgatcagtgttttttatgtcactaaacaagcgctcaacaaagctttggatgcaatccaggctctctacccaaaaaaaaaaaaaaacctcagtaacagataagtttgtgtgagaatggactaaccagtaatatttaccctttccataaacaacaaggtgcatcaggtttgctgaataattctcatagaacttcagaagctcctgtctaatgtccaatcccctctcttttggttttgtttctagcgtttcccaactccctgatgaattaaatgacaaattaggaataagaaagcaacaaaacatttaacttgtttcctaaattcaaatagtatttcatgcaaacaagatatgatcaccataagagagtagctaattacgatgcacagcaattgataggacaactgaccattatctgatatgaatttagattttagacttgtcatctctattttcatgaataaatgtatcatatttcaatgtgacctgaagaaaattgggatttgcaaagctaatataatggctagattttagcctgtttgaatcttcactatgtttctcacaagaaatgcaacccattaatcataaaggctgactggtcagaagttcacaatttctgaacacaactgtttgcataccagtactgaatttatgataggggtgatcctttgaagccagatgtttttggagctgcatggggaaaagtggaaaattaggtaatagtgaagcatgtgctatgagattcaaagcaaaggaatggaaagtactgtacatgctattttttactttctttttttattggaggaccattaacgtgtgtatagtctcaccaattgtttatatatatatttatataaggaaacatgccttgtaaataaagaatatatacatattctgtgagtgaaaaggatacataatcctatgctttaatggttgtagcttctgatacagtcatacagatttcacagtgttgcaaggaagaatacatgacacatcaactaccaaatttgaaatgttgcagtacctgatacattctccagccatcagacaacaagtttttcttgtgttctaggacgaaacaaagcaaagttagccaaaatatatgcttattgctactccaaattaaacaactgtgagttttgaagcgatttttatagggttgtagttatgtcatgttaactacccacattataagaagcataatacgatgttagatacaaatagcatcaccaatcaccatgtgcaaagcgaataatcagaacttaccagaatcaacagccttaatctctctaagaacagcatcttgcgacatcaatggcttaataaaaaactgagcaaatctgcacaaccgagccaccaatttgttattttccaataaaaagcatgacaatcttcagaacaaacccccaccatattcaacacagacacacacgcacacacatatacaataaatgaactaaaagcactaccaaaaaaatcttacctgtctaatgcttcttcaaaattggccacattgacatcaaaatagaaatttgttgtctccgaacttgtgtaggcattgcaagagccaccatgctgatatttttcacatcaaacaattgtcaaaaatatagtctaggtatgtgatttccaagcattaaaatattttttgatgttcgagaaattgtgcaaggtgtagctcttaaacaacttgcgacagatgacaagatgaggattaaaatgttattgctaatcaggacactgcccctcctcttaaacgtcaccacgacataatgccacgctggcaagcatgggatttcacttcaacagagcacgatgggatataacctgactttaggggaacaaccaaatattaaatagcagttggtctgcagtttgcacacatacaaaccagtttccctttctcgtcatctcttatattgtctcgttgtttgctacatttctactgatctgacatctaaatatgatgtaggtaaccctgaaactgggctgatctcatacaaatctgatgtggttgtgtcagcatatcatgatattgtgtgaataatactttaccccaaaatacaatgaaatgaaatgaagaccagtgtttctttatatttagagttgattaattgaaagtacctctgtgatatacttcgtgtaatcttgttccccagggtatttctcactggcataaaatagcatatgctctgcaaacaagaccacgacaataaatcaagacaagaaaacagataaaagactttaagtcaatccaggaattttcttaattcctgcaggaactgaactgaattgtgtgagaatactatataattactgtgaaatctatgtgttccaaagaatacttttattccttcttaatacaaagatgtgcccctcgcgtattcccaaaaaaaaaatctatgtgttccaaaggatgcctgaatgattactgaattttaaagtccagggtccgggctaacatttgtcatgctaatcattttctccatagtccattccagtacagtttgctttcatcaaacattttgcctttagatgataaacaaaatatttagaaaactatgcaactctctagggtagaatttcaatttaactttacatggtttcatctgcagtataccttcacataggggtgtaagtgggtcagccgcgaacccacttatagatcaaaataagcgggttcgcgcttattttagcctataagtgggtttcgcgggttagccacttacaccgctaccttcacatacatagggttggtactgtcacgaatgtgcagaaagtacccccccccccaagtacttgcaatgaattggtacagtaccccatgtgtaggtgactaggtgtagcgcaggacttacgataaccagtgagccaatgaattggtgcacccctgcgagtgtagctgactgatcctttatcactaaaaggtggaatttactcaccagtcaaaatcaatgcgttggttctgtacatatatagacaaaggtaaagggacatttttgtgagcaagctgacaaaaatcctactaggcaacaacgtgcaggagcagagcaagataaattatttgaagaatgacccgctctatttcctacagtctggccagctgaccatccgtgaataacattgtgccgactaaacgaaataaaaaggcaatatagaagggcgtctgctcgtacatcctgttaataaaagggcgtctgctcgtacatcagaagccacagcataggccgatcatgtgcgtcccgtacgatcaatcacggatgccctcaatggatcacgctgaagaacagagatgacagttccttcatcagaccatcaatgatctgaaccgtcagctgcatgatccgacggccaaaacaagtctgcatttccttcgcagaaaagaattgtacattcaactttatacctatgaaaacgtcattgacccacaaaagtagcagtggggaaaggtcgccgaggaatgagcatcccgattccatgggagacaattcgagaccccggccggatcccaaaaggggattcatccaccatgcggcgcaagcgaatcgcagagaaagggaagcgccaggtgtcctgtcgaaccgaacacgcaagtacccccccccatactgcctactctgattccccactacacgaatccggtggcggattgcgcacacgaaacgaatcgagaaaatcgaagcgaagtgagcggagacgagggacgagaagggagggagggagcggaagcgaacggtggactgaccgaggaagtgggcgaggccctcgagcccctccgggtcgctgaacgagcccacgccaacctccatacacgccgccgcctgcaacgccgaggaattaggggttagttaaacacacgcacacacgcatacgcaccacaccaccaaatcacgcgagaaatcgccgatgaaccgacgagcattctgcaagcgagagcgatcggggagggagagaccttgtcggtttcggagtcgctgatgaggaggcactcgagcgcgttggggagcaccacccggcggtactcccgcttgtcgctccgcgcgcggatgaactccacattgctctccgccggcgccggtgccgccgccgccgccatgtccgctcgctctccgctctccgcctccacagcctctgctctctcttccgctctccgcgcgatactccagtagttctccggggttagattggaggctaagcaagtggggtcttttgctcctcttatctcatctaatctattaaataaatattgacggagtagtacactagcagtgcagactaggccggggtggattggcttgcgcgggtttggtttggacgacgaattaaaaggacgatgaactcgttcgtgtcaccatcgggcttgtgcttttcgaccgccgaatgacgcgcccgcgcctggacgacggagagggtgacgtgacgtggctttagcggtcttgctcccagtgcggattccacgttagtaatcgcgcaccaggacagtcccaacccatagtgtctataagtaatgcctataattctatgtcagtaagacatcacaatataaactacactctacaatctatggttttttaaagtggaccattaataaatacatcatctctcttctctacctatcatatttattcttcatctattataaagacattattctctcccaatacaaaacttgatagtgtataatgcataggttctcttgttgaagctgtgtcttgcatgagacccagtttcttcctctcttcactctctctcttaattaatataatgccatataagctaaaagttctacgtagcaatgtagttaatgccatagacactatcctaggtggaaggttgggactgcacttagagccttcgtttctcccaaatgcagcacccacaccgtccgttctgtgtagctgcgtgcgttttgacgtggccttcggggaaattcacgcttgacgtgacgcggtcgtctcggctgatcggctctctccgagcgaagagattttctaagcgggcgaacgtgcgaagaagatcgtttattgccagaatgcagatagactttgtgattgggtggagagccgtgtcgagtcgacactcgagtctcgagcgtcatatgcgagtgcttccaagcgagcacgacgtggaggtgaagttttacacgatgaccctgcttcttccgtggttcacaaatcacaaagttcacatcgtaattagcacggtgtgttagctaaatgagaaaatatgtatggcatcgacgttcactccttttcatttttctaaagaaaactgctagcttaccgaatagcgtagacttataggcgaagttttgtcaatgagcaattgctaccgttcgcctttcagcaatttcggatgaagtgcattatgagaaagttgtagacacgtcacagctactactatatccaatgacttgcctcctagcattatatatatatactcttattagtaaacatttttttatgaaagtccacgtagtctagtggttatagtgacttaagtagtacccaaagtcctgagttcaaatctcctatggaacaaatttcagattgggttgtttgtggggctaagttccctatttcaattccctatttcaatggccatatatatccggttggatgtagaggccaggtaaaaaataccctttctttaaaaaaattagtataaacatttatgtttgcaatgcaatacttaggccatgtttagttcacactaaacttcccccaactcccaactttccatcacatcacatccaaaatttttctacacacataaactctcaactttttttcaactttccccaaacatctcccaatttcacaaactaaacacaaccttatgtttaatcccacctccttcgaagaacaatcacacataaactcttaacttttttttcaaactaccaattttccccaaacttctcccaatttcaaaaactaaacataaggtccaatttcagaaactaaacacaaacttatgtttgatcccacctccttcgaagaacaatcggaagtactagtgtgataggcaacacaaaggtcatttctattgttatttttaccttttgacgtcgacaaaggccgtagttgcatacttgcacgcgcctatgttcgcattgctcctctaaaaatatgtccgcattgctgaggtgtaatcgcactgtaactgaaggtgtgtgcttttctcacatatcagaggctgatcataatgtaataaatgaacatatatagctaacgcaaatgttataacgtgaaggattatgttgcaacgcgctaaacacaggtccaacactgtatcaaaactcaaaagtttcattcgcagagtatgcgtagccgaaatagtctactattccattatattctagccggcaccagttgcaaatctgcattttacagtgaattgaacaatgaaagtatagctgtcgaatcctctcaagctttctaaagtatttccaaaacagaaagaaaaaggcaccagtgatacacctcactaatgcaaccgttcttcataaacaattcctaaaaggttcatccgtgttgacgtctaaagaatagcagcctaacttgttctcctcgaggaacagccaatccagggctcaatggcaaaaggttgcagccatcacttgggcaagttaatgaagcccgtatatttgctcactgaacagatgaataactacaaataccaacttagtaccggtacttgatatcatctgcaagggctttggccaggagtataatctcatgaggagaatatttgcaacttgcagctgaataaacaccacaagttgcaatatttagttagttttagactgactctggggcgaggaatcagtaataagctccatctctatatcctgctgttttttgagatattcttgagctgttgatgtgacgatcttaatgaagaagttcacaagcacaagccacaccacagtgttccagaccaatgtaaaagagaaattccactgtgtatcctggatatataacataagtggacaaaaaaatgagccaagaaatgggatacatagagaagaaattaatatttgaaactcaatccacgggaccaatgttttgaactgatgacagtaaaataccaacctccatttttgaggatgatgtggccgatgttggtgttgataaatacttatccttcgcactgtggagctttgcaatcacagatggcaaggaggcagaaaacccaggaatgtgaccaaatatccagattaattccttttccataagatacaagagttgattgttgcacaaggagataataaataatgtctgcaaaagagagaaggcaaaatgcatgtgtcagcagcaacttttgggatcatcgacaagacaattcaagtggaatacagtagtaattaattcagttcaatcaggcttggaagttcaaatactgtagactccctgcaaaagtttactgtggcggcaggaatgaaaagagtgcaacgagaaaaatagcactggcttttaacatactttgtatggcaaaattatatatcctgactagaagcaggaactatttatgcggctaagggagaaaaaggaagttatgaaacagataaacaacagaatttctagaatttgactaatgcatggtctggccttttgtttgagagggcttgcaaaattttggtttattttctgaatgggcaaggttgagatagttttgaaattatgatttcaactgaataggactcaggaaaacatgctgacacataatgcaactaagaacgatttgccctgttaagatcattcacattgatgaaaagcgcacccccccccccaaccccccggcgaaaaaaaaagggccccaaagttacgaaacatataaatataagcattaacagaagattagacagacagcaaacctgaatatgggtcttgatgatggccttcccaatcaaagtagcaaagaagaactcccagaagggaatgccaaattgcccacacattataccagcaaggtcaaacagtgggtttggaacctagtaagcacaaagaaaattcattgtatggtaaattatttatccatcagatgttagtacaaaagaaccaagattctccatatcaccaccatctgttagctatggcattgatacggagaatgtccgcttcaactttttttagcaccattagcatcatgcatgcattgcagcagatcataactaatatactataagtctaaaaatataaaatgcataaaaaataattatcctctctaaaacttgtatacaatatacataattatatgagcaaagatgcaaacacacatgacacacgcctacacatatttgcagttacagaagatccggagttggatgggtgtagaacctaccatcaactccagctccctcttttaaagatgcatgagctatctatgttcagagcagtaggcatgactcgagaaagaggcccaaatgaatagtagcttgcatgtttgctagagaatccttatatgtagtttttgcaagaaaatccttactgctacaaataaattggcatgacaagatgggaaaaggacatagactaaccgaagcaagaatcaagatagtaatgaagttgagatgctgagagtgggaaaggagccagcgttttgttcgattgagagtggatgctattggaccatgttcatccgaagcagcagcatccagctccttcacagcttctggttcacttcctgacaaacgagctgcaacacgacacatcatttacttggtgtggttgaatatgacaaaagagacaggaaccaaattcagaaattaatgcatgggccaacacaatcgatcttctagaatttatcacaacactaaccgaagtttccaccacagccctaatttatggctaaaaaataacaagcaaaatcaagggattcataagatgtcaagatacaaagttaataaaattgtatggttaaattcattattaagcccacaaaaggacaaagtaggcaacctgaactttaaaaatgtggtgacaattgttctcaaacacaaaaggtggtcaaagatgacaaacagaaatggagggagcattattgaagttgaagaactatatacagtaatggtggaccatatattttagttgtgtggtactaaaattgatgagatgcagttatatagtgtgcaaggaaagtcaattcataaaaaaaaataatagaaagcagagtaaatcatgtgtacaattacataggttcaccagtactgagacgtgagaaagtgtaaagcatatagctaagcttctttacttaagaaataagcgttatgccatattaccagctcgtgatataaaataaggagggagctccccaagcgctgtgccaatgccccaaagaacagcttccagctgaacctgagggagtaattcaaagactgggatccggacagaatgagccgatgcttggtacactggtggtccaaaatctgaacacttcttgtccagccatgatggcccttgcttaagctgtatggtatcgtatggagcagttttcaaatcaatccgaccacattgaacagccttaatagtgaagagggcaatatgagggcccagatacagaacaaatgtatgcaaacctgaacctgaatttcaaagatattaatcttagttagtaaaaaaaaggatgagctcattttcatccgaagttcaaaatttccaaatttgaaagtcattaaaccagaagagcatccattgcaacaagcctcaagccaataaaaactaaaaaagcatcacttaatatttgctggtggtatatgcttttacacctctaagcccctaaaagttaaccaaagaaatttccagtagctggtcaaaatgatactacagaattatctggaattctgaatatccacaaattctgctcaaaagaacgctgagatacctttctctagattggaaagtaaaaggctaattgcagcagtagccctgtaattgcgaaactttatcccaatgcattaaatctcaaagtaactttagtgtgtaatttggcgatggtgtgccttttgctcttctagcccaatacgagtttttagaagattttttaaaggttcaatgaagtcatagtacataaatttaatgtgattttgttgttaaaattttcctgatatgatagagtttctaggtaagtaataactaataaaatgaaaacaatcattgttttttttcttatgttcatctcttcctaactaaatcatggttagcatgtgctttagtcactttcaacagtgtataagaaacatcagctaaaaatattatagaactagaaaggatataaaataaagtacagtggcacattatttacttccatatatataatggtatgtcataaatttgacagatgctagtaacacttgcctagtccaattgacgaagccacgcctagtgaaacccaccacaacacaaatctagcataattcaggaactcctgcacatgctgcatcagaaaacaaaatcagtattcaagcacaccacaagaagctaacataataaatcagtgcccttattgtcatgtctactcttatcagcacaagcactgcgatcgtaatcaaattacagtgaagtaacacacctttttatgcagaccatctgtaaccgcaagtaaaattccaggagctagcaccaacacaatgaggacaacaaacaaagcacccttactcaggatatatgttgctaatcttttcaagtattgcaacatagctaacatgaaaaaacgtaatgtcctgaatggatgctttgttagtgtcaaattctccagttccaatttgtgtttctcacggatttctgcaaaacgaaaaaaaaaaggtaaggattgaaaatggaacgccaaacatcgactggtccaatatagcaccttagtctacagctctgataataggcaaacctaactacatcaacatgtataatgtagataatattcaaatgactaagtcctgaaccaaagagatcatacaaagcacagatgttggggtccttaactagagaggatttttactgtcttgccagccattgctcatcagctaaataaaaatcaaagtagtaacacaagaaccctactaggatccctagttatcaagggagattggaactgccatcagcaagtgaaccagtccaatgttaaactgccaagttcattgctccaggatgggagaagattcaggaactggcgcacgcagtgcggcaattttacaagactctaaatggtaaaagtatatacatgcaaccaaacaaaattggagatttgattagctttcctctgatttgagttgtaacatatatactttgcagttcaaccagtagattaatgaatagctattcatcgattcgctgtatcagtaagcaccattacattgaagaatgaacagttgtcaatacattggccacaacaatgacctcaagtattctcttatatatatcctaatttaatgtattgcctcaaatacagacttggtgtagcacattccaaaggaaaccaatatcagttcagaatatactaactttccatagacagcatgcatttcttggtgatgtgcatgcaacatgatatagcatataaaacacagaaataacacctctcaattacatagtacacgtgcacaaccagctaggcgtatagcttaaagctgagacggtataggtccccatcgtttggcttatttcctaataagccaaaacggcttattagaaaataaaaatgaatttataggtaaaacttttataaatgtgttattcgtgacttaaagccaatgttgtaaaagaaactacgttgaaaatatctcaaaatcaatctcaaaattaagcttgaaaatttaaattttggctttttctttggctgattaggccatccgatgggagccatatttttgcggggaaagctgagactttgcacgcattaaacactgagagaacaaaaccatgacgcaacatatacacgctacgtcacagtcagctagctgatccaccactgaatccgatcaaatacactgcgtctcatgcttcggatttataggtattccaaatcccacaaaactaaagcgccattcgaaatcgcactcccatcgtatagttccgatcccaacctcacagagcatcccagtagcagcaagctccgatctaaaaaagcccgcaatgccttgacactaccgccaccgcacgcatcgaaaccgaaggcgaaggcgaggatctcaccggatatgacgccgcccccggccttcgacgagccacgcggcggcgtcgcagccgccgccgcggcgaccttccgacgccccatcgctccctccccacccccgaggcgccgaaaaccctagatctcgctgccgcggctgccgccctgcggtaccgaccccaccatgggccgcccagatcgcggggggggggggggggtcgaagctcctaggtctccggccagtcagccggatcgcacgccggaccgggatgagccgccgtccgcgacgccggcggcgagcttgtggtgggtggtggacgcggcgcggcggttccccgtcgagcggctcgtatttatgtccgccccggccgagacgggaggaggaggcgatgggggagggtggggtgttggaaattttctcttcgattttggaggagcaaagcgaggccgttgttttccgttgtggcagaggttgtgggggaatattactcggactcgcgcgctgaccctgcttgcgggacccacgcctcgcctgtcatggtgggccccaccccaccagtgacacgagctcgggataagagccgtgcgcgtggcggagtactggagcgtgtgtgcgcagcgcaggtgaagtgcgcgcgaggtggaagaagcgatccggagaactaactgcaggtgggcccgctgtgtcagtgtgtgcggcgagtggagtacagtacagttgagtgggaagttgggtcttgggtgtaggagtagtcgtttggcgttgcttgcaaggcgctccaatagatactctacactcctcatcgctacacgagtagagaaaaaatactccaatttgataccctgcggaatataaaaggaaggaagatgctgtaccgatctcgatctcccatggaagattagggtgcttcaccatttttgtaagggctcaccagcctctcaggtcactccaatccatgtccacaagaacatgcgtacgtagtggtagttaatactaccagggccatggctagcgacagtactagtgtgtggccctgcagagatctggagattttatattccaatgtcatgtaatgtgacaagaggggacaaaaaggcagttagcaaatgtccaacgtagctgagaatatcgagcgttttggcggttgttttcagctcttgatgcaaagctggagtatatgtctatcatgaaggaaaggatcgattgtatgctatgctttgtacgaatttattttgtcttggaatttttcacttcgcaccattctgtgcttttctgtgtgcacttgctatagttgagtaagggattgggtttgattataaattcgtcattttgagaacgggacgatggatttaaaagagcaataaaggatcagttggagtgccgaactattgatgactggagaagaaattaagaaaagaagctgtagctcatcgatctagtattgatgagcacatgtgctggagtttgttggcctgttgcttgtgttttttccaagtatgcaatgaatgggaactgtctcttccagtattaacatgtgggggccttttagatggacatgcgggggccctggtacgacgatgatttttgatcttctaatcaggagataaatgatttcttaattattatgcttccagaaaataattgtcaattcatgatatacatatggagaaaagggaaaaaggcacaacgcgatgagtttggaacattagcttgtggaagatgttaatagatgtggagaaactcccggaaatcatatatgtgaaatcatatacttgtacaattaaagaaacaacttctatgtgcgaatatgaacaattgtctagattcgcccttataagttattcttttccttagagatagagtacagcaaaatttggtaagtaatattgttggaatttgctagcgatctagtagtaacttttttcatcaaaaacaatattttcatcttattaaatttgaattcgagccaaatattgtaccaattataattgttattgaattagacctagggttcatctttttaatgagtgccggaacccaacctaagctgtgtttagtttccttcaaacttccaatttttccatcacattaaatatttggacacatgcatggagcattaaatgtggacgaaaaaaaccaattgcacggtttgcattgaaattgcgagacgaatcttttgagcctaattatgctatgatttgacaatgtggtgctacagtaaacatttgctaatgatgtattaattaggcttaatagattcgtctcgcagtttacaggcggaatctacaattcgttttgttattagtctatgtttaatacttcaaatgtgtgtccgtatacgtcatttttttttgccaaaacaactaaacacggcactagtggtatgacatttttttaacaaactttcattaaattttagtcaaaacttttactgtttcaatttaaattctcaaaaactatttaaaatttcactcaaaatctacttccgttccacatcgaaacctcaaaatttcgtggttttccacaaccctgattggacctccatgtccacaccaacccaattcaactctgacatccaagcgtaacctaataaaagcccatgctagaatctctgaacggacattgatagcttagctactggttatactaataaaatcacattttgcatatcgtgatgggccttgagttgacactacaccacctgatcgcatcgcatcgcttcaaagaatcccaaaatacaggtccaccctaatcacgcttagttgataaacaaagcgccctgacataagcaaagccccacagtttgatcacgctcgttttttggcgattgcaaactgcggtgctacattcatcctaaattttttactacctccgtcataataaacggttattatcttttaaaaagttatcataataaagtagtaattgttccatcaatcatttcttatttatttttttttcaattttatcctcaaccaccctctcatttttggctatacatcatttttttcccatagcatttctccacagctatgtttgagaaatgaggaataaagaagattaagaagatatgcaaaactagataagctattagtacatagtacctccgttttaggttacaagactttctagcattgcccacattcatatatatgttaatgattctagacatatatgtgtgtctagattcattaatatctatatgaatatggacaatgctagaaagtcttataacctgaaacgaacgaagtaataaattaagtattgattattttttaacttgaaaaggataaatatgatttttaaagcaaattttccatagaatttttttttcaaaaaatacaccatttaataatttgtgaagcgtgaacacaaaaagcaatgatcttttcttctctttgttcaagtctcaaacacaatctaaacatagaaatataattataattattttgaaatagaggtagtatatagctatttttttatcggtgtcttgtcctaaaatagaactatttctctacttaccacatcctctcaaacaatcacaaattatttaagttattatcttcagccactttctcttattaactaatcgtaattttcttcccatcatttaaactagctgggtggcccgcgcaattgcgcggctagcacccaaataaaatcatatatttttttagtatgattttacttaaaatttattaaatagctatctcatgtcttaagagtttgaaagattaaaccttatcatccccgtgtttctaattatatatattttaaaagtcacaccagttgctaccccttatgacatctccttctttatttgcttgctcgatctaccactatttctattcattctccttgaaacctttaaaaattggatcttatagtttttagagtttattgtcacgttgggtttcgtttttataatttctagacgtcccgtcaaacgttgccattatattcctctatggcccgtccactgtctcttttctttattgtcattgagattttaaaaatcgaacataattatcgttttggttcatttttactttctagaaatcccgccaaaccgtcaacggctttgccattgtacttctctacggctcgctcgctgcgtcccttctttattttcattgagattttaaaatcgaacatgattatcattgtttttttttactttttcgaagttcggaacctttaaaaattgaaccttatagtttttagagtttattgtcttgttgggtttcattttttatatttttttagaagtctcgtcaaacgatgccactatgctcctttatggcccgtccgccgcctactctttctttattatcattgtgattctaaaaattgagcataactatcgttggaattcattttttattttctagaagtcacgtcaaacatcagcggctctgaaactatactactatacaccccgcccactgcttctcctttttattgtcattgagattttaaaaattgaatatgattatcaatggggtttttttttactttctagtagtcccggcaatcgcattgctcatttgcttcatggcctgcctatcgtccctccttttaatcgtcattaggattctatttggtgttttattaatagtttttatatgtcgtatcaaccgccaccactctactcctttataggcctgttacttaatttatctcgtcatgtgttttagatggtctttctttcaatagtctttatttttatcacaaattttagttatttataaattgtattcaattaaaatcttatttttctttttctaatttcagaatttatttttttcaaattttaattattatcgtattgtgttcttttagtatttttattttaattttttattttcaatttcagttgtttcaaaattgtattcctacttgaactctcttttaatttttctaaatttgaatattattttattttttattctgaattttaattaatctcgtattgggttattatatggatttttattttaatattgtttatttttaattccaaatttcagctaattttaaattgtattcctacttgaactcttcttttttttgctaatttcggattttatttttttattcccaaatttaattaatctcgtaattgggttcttatatggactctttttttaatattccttattttaattccgattttcagctattttaaaattgtattcctacttggactatccttttattttctaatttttattttattttagttttattttgaattttgattaatcttgtattgggttcttatatggaaacttctttcaatattacttatttttaatttcgaatttcagctattttaaaaaaaatttctacttgggtctctttttttctttctaattttggattttattttatttttattttgaattttgattaattttgtattgggttcttatatagaaacttctttcagtattgcttatttttaattctgaatttcagctatttttagattgtatttctacttggactctccttttcgtttttttctttttctccgattaatgtgggaatttctagcctccacagcgaacgtggtgccttctttcaaagctgtattttattataaattaaattttagttgttaaaaataatatcattggatattcatttaaatttaattttatatgattatgattttttttgctacaatgaaaattttaaagttaaagtttagtttttaagaccgtactaaatttgaacactccttagcgagttggacggagtgatgtatctctaccaatgcataagttttctggtctatttactctttttttcatccataggtaaaaaaatcacattttaattctaattataccggctctaaaatatatatgcacgcattgtgtttgaatcctaatcacctgatctgttgattgatccttagtatccatctaggataaggaaagaatcaaagcaggagtacgtccacctatttggacttgtattctaatacttgatcagtgttgtccgtttgatctagcagttgttttctattcagacttctattatcaaagttaatctacaccatcaaagtctagtcccagtataatctaacggtctagatttttcttttttctccgattaacgtgggaatttctagcccccacagcgaacgtggtgcctcctttcaaagctgttttaataatataatagatagatagatagatggatagatttattttcttaattcctctatcttaactaattaaaaaattcgtaattttccgatcatcacatctttttgtccgcgttttcgtccgtcatcactctatttaccaatcgtgtacgatggaaaaggcataaaatcaaatcaaagatcggtatgaaattcaattgggcagctccataaaaatttaatcgggtaaatctacatgaaaaaaaaatcaatcaatcggagatatacacatcgagaaccctagaaaaaagaaaaaaaggagaggaaaaaatcgcataaatgggcgagcttaatgtcaccgaatccgattgatccgagctcgttgccatagccgtccatcgcactcatgtcgtggctgcgcccgccgggcacggtcacactcgccgccttcccaaccacactggcaccccctccctctaaccccccatcctcaggtgctctcctcctgctcggaggcagaggagagaaagagagaaggatggcccgcaccgtagccccaccatcgaggccgacggggagaggggaagagaggacggtcgtcgtcgccgctgtacccccgtcgagcactcgccgacgcggtgccatgccggcgatacgggagggagagggggagatggagcggcgccgccggtaggggagggagaaggggagtggcgccatcacagcggagggggagaggcgccacctacgctgtcgttttgagagagaggggaggggaaatgatttaaggctagggtttaggttgcagaacttttatataagtacagatcaatcgggattgtcgatcagatcggacggctccaacttcttccgtgtcgagccaccattcccaggccaccacacaattgggccgcttcataggccacgtgtaagcgcacggaatatgttcagtttaggtcccttaaggctgagttattttcttttcacctctctcattttttacgtgcacgcctttcaaactattaaacggtacattttttgcaaaaaatatatagtatatactaaagttgctttaaaaaaaatcatattaatatatttttcaaattatttttagctaatacttaattaattatatattaataaactaccacctcccgaacacattgtccccaaatctgaaattcgtccctaaaccacaacaccatatatgacatgtctatcaactcctaaaaccagtgcaaataagatcctaagacggtttggatggtgatttgagctaatgtggcgttgacatgacatgaaaagtaagaaaaaaaagagtatctaattaaaaataaaaaatatatataatgggatcacgtcaacactcatcgcccctctcttttccctcttctctcccttcctcctctatctcccaaggtagtcgcataacaaactgaaaaaacatagtggctccaggtggaccatacaacaggtgtacggccgcaaacccacacgaagaactcctttctcacgtggctcatgcgtcgcgcgagacctcctttttcacggggccggggacggtgagaagcgtcggcggctcatcatcggctttcatcgcctcgcctcttcgttttcggttgcacgctcgcttgtctggttgttgatcgatcgatgccgtgcgaattaccctgcgtttgcgttcgttcatctgcctgcgttttccacgcctctctctgcaactggtctacacaggcatcatttccacgcttgactaaagaggccggagctagcggcttgtgagacaagtgttcactgcgattctgcgagggcctgtccaggactccaggtgtcctttactcccggtttcttaattgtttcttaaccgcaggaaccggagctttaatccacagctgaacggcacatatagcagaaaccatgcctagtagtaactgtcgattataccaatttaccatgacttgttactaccagtagtattttaactgcagttgatcgagggcataatttacacctgcttctgcgatcgagcaacggcgcgagaggggggtcgccgtacgcgagagatttgctacaacgacttaccaccagaaagagatcggccgcagcgcgcgctgccgcggtcgctcgaggctcatgcgtcgcgtaacgcgtatgattgagcccgccgcaagggagtctggcgtgtcagcgagagagatggagaggagatgcgtcgcccgcggcggccaagagagaaactatcgatcgaagagcagagcagtgtgcgagactttacccaagtgtaaagcaaagccaaaaaggctactagacctttttatctgattcacacatacgcagtttacgacgacgcaccatacattccaccaccaacctgcctctctctcgtcttctcgatgtgcagcagcagcggcagtagcagcggttgttcacatggtcgtcgtcggggctcgtcacggctcctccgctcctgcttcggtataaatgtgaggtgcagacgacgggcgaggaggttcgtcaggaggatggggtggctccggtcgctcctgtccccgctgaggaggctctggtgccacatgaacgccgtgcagcgaaagagtacgtcccaaaatcatccactcctcgatctcgctctgttgtttcctctgattctgcttctgcctgcacttatctgacggtatgtatcaatggctgtttggctgcagagagagggatctacatcctgtacgacgatgtcaagtcgtgcccgtgcgaggacgtgcacgtgctgtggtcgatcctcgtggagtcccacggcctgccgccgccaaccccgatgacgacgccggcgccggcgccggcgctgaggccgacgcggtgagtgaggacaaccgggcagaaacaagcagcgcccgcattaatggcacccgcggctaataaggagatcgaggtcgtcgtggcccatcggagatgaagtggtagaatcattgtgggtgtaccgtgtagataggatttaggacagtgtttggtgctgtcatttgatttggcggccttccgtttcatcggcatctctcttggagcatgttgatcggatgggttggccggcggcagaatgcagctgccgcagtggggggctccggcctgatgagtgtggtgatgggcttcttcctccctggagcgcacccctcttccgccgtgtcgtctctgttgatttggatgcgattgtttcgtccctctttggatgagtggcgaagaagaagatgaacaggagttgaatctcgcgagatttatgcgaaattgacgtcgcaaccaactgtcagcgttctccccattgccgctttctttgcgcgcgcgcacgcaacagagaattgatcgtgttcgtaccgaacgctcgagcaggaaaacgctccattggctttcccctttatttggggagtggattctaatccctcgagggacatcccctcgtatacctttttcttttaaatttaatataaatagttgtgaaaaattttaaaaaaaattaacaatgtagagtataatgatacctactagtccaccaaaattcatgttcaaattcgatctacacatcgagaaaaaaaagacaaatttagatataaacagtacgctactattcatacgctaaatttgtcttttttatatctcgatgtgtgagttgagtttggacttaagattttgtgaagttgtatatatgtgttgtatgaatgttgtcaaattttttcagaatttttcataaccatttaaatgatttttgagcaaacgagggaacatcccctcgagggattagaatagtttccctgtacttgtttctctctgtttcagtacggttctgggccgaacgctctgagcctctgattaggaggatctggcctacccaaccctgcggaaaatgggcctggatcatcggattgggctgcatcagaattcgcttgtagaccatggacgcaagcccccgtaaccagtagacagcgcggcacggcagaggagttgtcatctcaacgccaattcaccatgtgccttgccgcgccgcgccgcgagcgcaatcaattattccgccgctctccagcgacgcaattgcgggccccgggccggcgccaacgaccccatcccgcgccgggcggactccctcccaccacgatgaactgaaccagctggtggcgccgagccgccaagccaaccaatcgattccaggcgcgcgacagcccgcccggccgctcgatcgtcagcttatattaagctagctagccaggccgcctgaaagctgtaacacaacgcaccgcgcgtagctcagcttgtatataagcagcgcaccatctccaatctctcgcacacacacccaccgaaaccagcagaactcgtgtcttgttgcagtctcccccagccctcccttctccaacccagctcgtacgagatccgatggcggggcagctgaagtccaagatcgtcgccgtggcggtggccgccgtggtcgtcgtcgcctcgtcgctggtcggcacggcctccgcggccgatgcgcccgccccggcgcccacgtcgggcgccaccgccaccgccgccgcagcgccagccttcgccgccgtgtcggtcgccgccgcggctttgggaggttacctattctgttaggctggttgtgatgcagagagagcatatgcgtcgacacatatcacgtatgctttgagatttgttgttgagatgcgtgggtgcaatttgtttcttgatcctggggttgtaattgctcatgtactctcatgtgtataccgaaacgtgattgattaattacatatgcattgattatttttgggtcgcaatttggaagtgcaaatcttcgtcgtgcattcttttacgatcgcaatttggaggaataacgtggacacgtctaaggaggtggttggcagtagttctgctaaactagaaactgccagccagaaaaacaactccagaaccaaattggaggctgatttggatgcgatgagttagttgaaattttttgatagaatgaacgctccgggtagcagacgagcaattcgaaaaattgatggtgaaatgaagcgaaaaccgctcctttcgaaaattaaagcagagaccgagaacaaggattttaattcaattcacgaaagctctgaatatgaacgacgcttttgtacgccagccaagaggatttggcgatcatcatagccatgtgcatgtgacaagagtcactgttggatcttcgaacatctatttaggaaaaaaatcctcctttgttcctgtaaataattaactatgcaagaagacgcaaaaagagtataactagagttagtttacttctaagctaattcattctgacaatcgagctgctactgtaaccagaaggccattgatcatgcatccatacaccatactgataaaaaaaatgatacagactgtttttatctgtcggtaggcacgattgggtgcaccgtgtacagattgtttttcccccatactataataagggttttttattttttttaaaaaaaactagcggaccaggcgggtgcaatggtgcatgggcagaagtcagagcaccattcaggcatccactaatcagaattgaacggtcaattgtgtttgaggtgatcgattcattcccgtaataatttattcagatttgcaacgtggaatgtgtctcaggtgatcaaattatttccccattaaaatttacatgaatcagaaattgacagtggagaaggtgatgatcgatcaacaatgaacaaaattatatatattacttcatgaaatactgtgtacacgagctgaacgaatacatcaatctatcagcttacattatatatatccaacaacaacagacacaattgcaaaagaaaaaaaaaagagaaaaagaaaaacatttatcaattaatgcatataacctccgcggcgagagcgcaaccggtccagaccgaactgacgcgctcgcgagctcagcagaagaggtacccaacggcggcggcggcgagcgtgccgagggcgacggccggggcggcgttcgtcgcggcggcgccggcggaagctccggacgggccaggagccggggcctcggtcgcggtggccacgccgaccaaggacgacgccacgacggcggcggtggcagccgcggcgaggatcctgagcttgagggtggccgccatttcgatcgctagctatgaatcgactggagatgctggcaacggagaattaacgagaaagctagcgagggcttgggggggggggggggtgcttaatttgggatgaaaagaagagcgagaggtgtcgtgtttatatagctgcgatcggggaggcttttaggctgtttttgcgttgcatgtgtgctttgtttaggcagggcagggtcgccttggaataaggaatggattgcttggctgggagttcctttcacaggctggggcattgttaggtttgctatgattagcagcagctggtatagctggggtgattggccggctctgaacgatcagcagttgttgtttctggtttgttaagggaaaactaacatgcgcaggttcaagtgccaactggatgatggccccgcgaaattcgcagatcaacttatttgctattgttaaacaatgaatgaaatgaaatcgcagaaataatatatctaacggccggccggttataatggttgttcgtttcgcagaaaatttgatttgttcgccgaacacgttccgtcttggcacgtggatgatccgcgtgcatgtttgatgtggtccaattctaccatgcatccgtgccggtcgatgcaaattggtgtgttccgaatagcatgttccgatctattagcgcgtgattaattaagtattagctaattttttaaaaaaatagatcaatatgattttttaagcaactttcgtatagaattttttttttgcaaaaaacatatcgtttaacagtttaaaaagtgtgcgcgcggaatacgatagagaggggttgagaacccaaggttccaaacacaaatcaagtttcgtttcagatttcagctcatggttggtcacgcgcgcggtcgaaaacgcctttcgattgtttccctgttatttctatcgtgaacgtgagcagtaatcgagatcgagtcagccaactcgcacgcacagagttgtcctccgagtataataggtaggggtgggcaaaataagaccgaaccgaagaaccgaaccgaaaagatcgagaccaagaaattcggttagtagttcggtcttagccatcaaaagaccgaatttattttgggtatttcggtcattgggctcggttaaccgaattttaaccgagaaaaccaaattgtggcccaataggactagaaggcccaataaacccaataaattgcaaaaccctagaagtccccactacctcagtccctcacctaccagcgctgcctccatccatccccaccccatccatcacgccgccttccgcctcggcgccgcctcccgcctccgccgaccgccatggtcccgagtcccgacgagcgtcgccgtctgcctcggcgctgcctcccgcctctgccgcgtccccgacgagcatcgccgtccgcctccaacctccgccgcggccacaaggactgccgcctccagcctctgccgtgaccacaaggagcgccgccgtccacgtcggcgctgcctctagcctccgccgcggccacgacgagcgctgccatccgtggtgctcctggctagcagtggcgtggcgccgttgcgacagccatagccatggcctcgccaccagctcttgctgcccacctgcgctgtccaagaattcggttagactgagactgaaaccgaaaaaaccgagatcgaatttgccggtcctgagtttatttggatgaaattcgatcctgagttttcaaagaccgaaatgacagaaagatcgaagaccgagaccgaatttttcggtcagaccgaacgcccaccctagtaatagggatcctgactctatttggagaggcctctaaccttcgtaccaactatgtcaagtgttccgcaattccgatcaactgctcggagaaagaggtcgcagtcctcggtgactctctcctctgcccggttgaggcgttatcgtgcaagtatttagttgaggagttatcgtgcaagtatttgggtttgtctctctccatcagaaaaccgcaccacgaggaccttcagcctttggccgacaagattgcacaacgatagccgctgtggagatctgattggatccatccagccgggcgcctagcgcttgtcaaagttatgctgagcgcgatcctggttttatctgctcattgtaatccccccaccccttgaaatgggtgctgaaagccatcaacgagatccggcacggcttcctttggtgtggttgtgcaagcgcacaaggtggccattgccggctaacttggtcctatatctgcgcgcgcactggaatatgaggggttgggcatccacaacctagagctcatggggatagcgctccatactaggtggttcaaagttctgagggagcgtcgtcgtgggttcgacatgattgtgacccttggcgcttggtccatttggaaagaaaggaacaactgtgtgtttaacaactatttccgatcctagcctgaggttgtcgcaggcatggcacaagaggccgccctttggcggcttgcccatccctcaccaccaaagcttcttggttagcgtgcttggtcgtttggttgtcacactgtaaacgcgagaataggcttaagtacttgttttcatttttttcttcctttttctcctcgaccccccttacttctttgtttgccgtctatgtaaattttattccttttaatataataaaggtgcacaattcttttcttttgcgtattcctgaaaaaaaaccatttggcgtagctaggattcaattaggagcagtatcatggcatgatctataagttttgacccaaaggagatcaatgtacagtatcctagataagctgttaaatattatgcacgccatataagcgtgtgctgcaaaattcacaaacgaactccaaggtcgatcgaaatgatcatcagatcatgagtccctgaggaggagcacggcggacggtcggtccgaggtgtcgccgggggcggcggcggcggcggcggcgcccttgcttctcgtcctccggtgttcgggcctcgcggcggcggaggtccggcccctgtcgacgctgacccgggagctggtgctgctcctcatcttctccctgaagaccctgcacgactgcatgtgcgagtgcagctcctgcggcttgaactccttcccgcactgcctgcagaagtgtgttacaacatttcacaagtcagttcttaaacaggttataaacgatcaatggaaaagaaagtgattgttcagaaaaaaaaaaaagcagagtcgtgtggatgctgatagcttgtttggggtttcaaagtagacgtaaatctgcacttgatgggccggcccatgaaatttctattcagactgctcgataacgagagcctttgttatcttgatgggccggcccatgaggtttatagccgtactggtctagcacattgcgcacagcgagcctgaataggtggcaactgcaacaacccaaccgaaaagctgccacgcaaggttcttggacgagcagaagaaatggtcaagaacgagaaacagatggacagcgtacgtgcaggcggtagcaaaatcagttgagaggaaacggggctggctagtcaagagtactcacgagcaacgcggcaaactcgccggcttgtgcgaatcgccgccgtctcgcttcggcttcgccttgtctttcctgcctcttcgcaccttcaccttcttgcccaccctgtcacgccagataatcctatttgagcactgtgtaatcggatgatcgaattgtgtggggtttccgtactcaccggaggccgcagccgtcgatgccggggcacaccggcgtaggaggccagtcgccgccgtcgtcgtcggcgccgtgccgcaggacggggcggagcgcggtgtcgtcggcgtcggccgcgccgcacgtcaggaggttgtggagcagctgcgccaggtgcatcctccgcgcgctgcccaccgccggcggcgtgtggctgctgatcctgccgctcgccgctcctttcaccttctgctccggcgccggcgccggcaccaccaccgccttggagaccactttcaccacctctcgctgctgcttcttccgctcctcgcgaaggcctcgtggcaggtctttcttcaacggcgccgtactacggctcgccggctcgccgggcgagtcctcgtcgaccggcggcagcgtcttcggcgatctctcgtcggaatctggcgccgtcgtcgtcgtcacctcctcgacttgcttctgatcgcacgcgaccttcacttcctgactgtccagtttctttggctcttcagctatcacaaacaaattttgtgaatttgttaatcacgagccatcgtcatcgtcgaacgagaaaaagaagaccagaaaaaaatatcaccgcacctaaagaagacgacttctcctttggcgattcggtggctcgccggacgtcgcagcccttgagcacgtactcgttgtcggagatgggggtgatgaggtcgtcgtccatcatcaggtcctgccatatatacccagccttgtacttcctaatcaagaatcaattataaacattcctaaattgctaaatctatcgggtaagcaagaacatgctaaaaatgatttaggaattaacgcaaaaagaaacaccgaacaatataaccacgcgtgatcatcatcatggacgatgacgataaggcgggcaagattgatgaatcgccttcctgttatgaaattatcggtaccttttgtaggaccaggagaaattgtccgccatgtcctggccgcgcagctccgacagccacctcttaacatctgaaaccaatgacaacacgataaacaccatgaagaagaagaagacgaagaagaagagccgcgtgaatgcgagagatcgatcgaacgaaagggcgaaacgggacgaacttaccgcggaggcgcacgccggcgcggtggtggttgacgcggaagaggtgcgggtggtccgtcctgccgccgcggctcaagaaatacaccacgttgatcctcctcgcctcgccgccgccgccgccaccacccttctgcgatcccccgcctttctccatggagaaagtatgcacgtcctcgtcgacggcgacaaaaggacaagggccaaggaaggcgatgatatcgacaccaccaaagctatcgaaaaccgcgagaaatcaaaacacgcatgcacacgaggttaacctgcagaaattgttatgtgcaagaaaagagagagatgatgtgcgaggccggcaaagacgcacgcgacgattaattcggtgcaaggaccagccaggcacaggccgagctcgcgtggctcaaggtgttagcctgggattggatgctgttagaataaggttgaggttgcctagcttcctcacttctcagccctattgcatttgcaggcctgatagatagttttagcctgtgtgggaatctctcggcgacgggaaggattacaatatgatcattgctcggtgtgttcggatgggggaaaccagtatttatattggtggaggttttttgggtgatcgatgtgatggcccacctcgtagaaaagggaggaataatcgccgatcgagatcgaaagttccttgttttgctccgtttattttaccctcttccatttatgtgatgatgtaaatccttcctgtaatatatgttctttgatccaccgtttcggttttattacctgttaatactataaagcaagctgtttctcctactccattcaatgaaaaggtactatctcgtgccgttttccgttcaaaaaagaaaagaaaacgagctgtttattttccttcttataaaaaaagagggggaataacttatctgtatgtgtggccgcggtcaataataaatagaaaaagatgaaatggagtgagttcgttgtttgcagctggtccttaggggccggccgttatgtacactcgctgttccttgactgagaactcaaaagtatgccaaacctcgtaggttccatcaagaacactgaccctgttgtttcttattactagcagagtccataaagaacaatggcattagcattctgcatttggcagcattattaacactttttcgtgtacttcaatataacttgatcacgaatgattaattgattattcgttatcattaagtaactttttttgcggggatcattaagtaactttacaggtcatgtatgctaaaagggttgtagtgatctgagtagtaccccaaggttctgagttcaaatttcctatggagcgaatttcagattggattgtttgcggggctaagttccctatttcaatggccgtatatatccggttaaatgtagaggccggttaaaaaatatccttctctaaaaaaaaatgctaaaagggttgtatagagcccaaattacaagagcagtattgaactgagaaaggaagacatgactctgctacggattgctgctgtgtcacagtttgagaagaaagactgtaacctggacgtaagcctgccatttgagtgtactacttcaccagcagggaactcgggatggggtccaaccgtccagggatgcttttcggagaaaaaagaaaactgctttggtcccttctcgccggacagtctcctttcttaatccatcgcaagctttggtacggtacgcattcccagcacataagaaatttattggttttttttttactttggatgttttatttttctgaattaatgttcgcctgacgtaccgtgttggttcgtgaatgttgatgccggaagttaattagcatcgctttcaagttcttctcattcttttctttctctctctctctctcttttgagctggaggtcttctcaatttgactgcaaagaaaatatctgctatagcatgaacacgatgaaatgctgccacggtgttcactgcattgactgcctttcagtttctgctcttcttcataaaccgccccaagtcaaccgagactacgcgtcgagagaccaagagagtacgtttatcgggctggcgtgaagcggcagtgtgcacggggtcggagtttaaatctccgacccactctaggatctcagctcgctgttaacgtgatgcattgcggtgattaggccattagatctcatcgctctgatgcactctgcgcggctgcgcgcgcctgtgttgcggtttaatttgcatctatatccaatttgtttagtgcaatatattggaaccttcaatgctgcatctttgcaataatgagaccataaaattctgctccaacaagatcatcgatgcggagtatggtttggagtagtttgttcctgtctctgacatcacatttctattatctccaacaactcttctgtgaattagagagttaaaatctgcatgtcattcagcttatcatatactccaatcctgggtttaaatctgaagacagtgtatgtccagatttaaatctaggattgggttttttttctgaacggagggagtactccattccagagttcgaggcccatgaaaggtgcgtgcatgcgcgggcgacggcgagagcacctcgacgaccagatcgtccacaacattggaatatctgacaggctagctagctgcataccgtcagggatgaatggagccaacagccaaggttgacaaaaccgacagtaaccgtcaaattgctgtacttacttaccgttagggtaccataaaaataaaaccacggtaatctcattaaatttaaacaaattttaaaaataatttaattttttaataaattttatacagtttactgcagttaccacgcggtaatcgtgtttatcgctaaggtgcgataaactcgacaccgacggtaagggaaacctgcttagagcttgggtgcatcctcttctcatgtggatctggctagcgaagggtggacaggacgcggcggcggtccggcgaggcttggcacgagggccaaggtggtgttctttgctgagtaggagtacaaaatagtgggagtgggagtcatcgttttgaactccgaaccccgtggaatatcttatgactattcgatcaagcttgcacgactaagatgagtggaataatttgtggctgcgtagtctttcgacttgacgagaggcctctctgtgtcagcctattgcgctgaattggcccacagaggcccattggaagggtccagagtttaaaactccaagccccattggaatctctgttgtccgttcgattatgcatatgcggtctagatgagcagctgctcgcaacgatggatggagactccctcccagtcgcttcggcgtcgacgacgggcgcttgcccctgtccgaccccttcttcaatcctctgccctgcttgccgccatgctgccggaactctagctaggctaaccggtgccaccgaggcacgagactacctacctctccatggtactttgattgcttcgcaatacaaattactactaccatatttgattgttgtatacaatgctatggtttttaggctgcattcttcagttaagcttccaacctcactctcttatttaccgcacgtacgcttcccaaactactaaatggtgcgtggtttgaaaaaattctatagataagttatattaatctatttttgaagttttttaagctaataattaattaatcacgtactaattcattgctctgtttttcatgtcggaggtgaatggggtcacattcgtagttctttcctgtctctctgacatcacgtcacatggcattgattgaactcttctttgaattggactttagaatcggagtgtttgctattcagcttattggtatattctctataggcatgtttagattccaacttttttctttaaacttttaactttttcgtcacatcaaacttttctacacacataaacttccaactttttcatcatatcgttccaatttcttcaaacttctatatttggcgtggaactaaacacaacctataccgtctctaccttcttcttgattccaaggatcgaagatgcgtgcgtgtgcatccgtgcgctggcgccggtgagatcgtccacagcaatgggaatatgggatatctgacagactagctgctagctgccgccgggggacgaacggcacatcgacctagagtcccagacaccattggcacgtactgcgaactcgggtgcgtcgtcttttgcatctgcatccgccattccgcctagcggggcacgggcaggatgcgccattgccgtgcgtcgtcgtttcaaaccccgacgtcctattgggcctattcgccgcgtgaaccttagtccttgggcctgttgggaggctccatctcggcctatcgcgctgaagcgcccccccccccccccccccaggcccgttggtggggttggagttcaaaactccaaacccctttggaatcttttcccgccgtctgattagatatgtgcggctcagatgagcagcaggtgccgcacagccgcagtgagcccaggaggaggatgcactggtgcatggggtcggagtactccgaccccctctgggatttcagctagcggttaacgtgtcgtgttgcggtgattaggactatgtactctgcgcggcagtgttgcaacaacaacagctggaaccttttatgctgcatcgaacttgccctttgcaacattatggccatgcatgaaattctgctccagtaagttcatcaatgcagatgaagaagagtgagaccttctatggttttagctcgttcttttctctgaggctagctgccacggggacaaatggcacattgacccagacgccatcggcgtactggaagtctggaacttgggcactcgggtgcgtcctctttgcctctggggacgggtattacgcggcggcgctccggcgaggcctggcgcctcattcttgccacccgaatacagggccacgggggttcgttgtttccaactccgagctccctggaatacccgacgaccgttcgatcaagcccgtgcggcctagatgagtggaattattcgcgacgctccgtgatccttgggcctgatgggaggctccgcctcgggctctcggcctatggcgctgaacgggctcgtgaaggcccattgatgggattcggagttgaaaactccgaaccccatcggaatctctgccaaccgttcgattaggaatgtgcaatgccattgcagaagaaattcaggggggcgcaaaatatatattgcagatttgaggaccatgcacagtataacttcactttaccttcgtttattctttatagtcgatcatgcagacatacacatagaaacgtatacgtcctttggttaatcgagcaaccagtgcatgcaatataaatatttccactgcaggtggatcacgcatgcatctgatacttgaagaacctgaacttaacggaggacttgtactgtaatctagctatagaccgatacaattatcaacatttaacaaaaggcaagcacgtgtacagtgtatatctcaactcagactgttcgtcctcgtcaaccagtcgagacgccactgtgaccgtaattaggtcacaaatatgaccgatgggtcgcagcagcactcgtcgatgaggcagcagcagcagagagcagcaaggctgtattattcagacaaattagcaccatgattagcagagagaatgcaaaggacagagacagtattctgacgatcgtatgctcgcatatggctttgtcgttcttaccatccttcgaggaagctcggctccggccgcctcggcggcggagccgcgtactgcggcggcgccatcaccggcggcccattgtagtaccctgcacgcacgcattgcaagcccaaattaatcaagcaagtaaaatcaacgaggagatagatcatgaatgtaactctgcaagtgatcataatgcttattaccttggggtggtggatacgagtagccgtacctacgatcatctggggtggtcgatcactggattctgtttcagatgagtaccctttggtagtttgctcaatggagaactatactgggtgagagtaagaagagagcctgtcctggagctatatttatagaccacggtgcttcaggttgcagctgagtgatgatgcttctcgcggtgtttggagcttccaagttccaacccggccaccatcctgcgtgcgccgctgtcagcagctgatccatcggcgagtgcgtgtgatggatcggagggaaacgaataaagctcgatatatattcgtcacctttttaccttttcggattgttcctgcccttaacttcaaggcacgcaatgcctaatacaaccgtaacaaaagttcaatagtagaagtgttcagaattcagaaaaaaaaaaggccgtaaaagagagaacaatgttgatgccaacgttgaagctggtgaaagtcagaaaccgatggtcgtagggagtggattctaaattctcgagggatcacccctcgttgtttgcatgtcattcattgggagtatgacttacgtatattcatcttacatgtttgtagagtgacttatcacatattaatatatcttgtaaaaaaataaccatttaaataatatgtataaaaggaaaggatgtcctctcgagttaaatattttcccacctctaaatgcaatgtgaacggcgatcctagttaagcacttttatcttgaattcttcatcaaagatgaggcgatgagagattcgaccgcgacgtgacgccgagaatcgtccggcaggccggcgaaggaagctgattgcgagctcgttccaagatctcgaatcgaagcactacaaaccaaggtagctcgctggttctcgcggacactaagcatcgatcggagatcagcagatgctggtcgggttcttgtttctttcacaccgtcgaaaaaagtacagaccagattgatcgaccgccattgtcgtgagctttcggtggccttgctagctaggccaatttgccctccttttgggcaaatggaaatgatccggaggtgcagattgcagaaggcgatgtgctgctttaatttggcgatccggttaaggagagaacgtaaagaactcgctcgagctcaagcgtctgactttccgtctactaacccggttaattagcagaatttttgagagagagaacgaagatcaaacacgttttaaaagggaatcaaattcgagaatcagtactacttgctagaactagaagaccacacgctgtctcacttgttgcaaaatccagaaggattcttgtcttgaggaaaagtcacagtattgcacacataagttgaacggattcccctgcaagaaaaattccaaatacggtcttgtgggcaaaggccatcctggtcggagaaagagaggaatagtgctctgagattcgtgccgggacacgtgtcacgcagggaagtgaagtccttcggataaccgaaggaccggagtcccgtggaactttcttcgcaccggttcgggggcatggaggcggcggcggcggcggaggaggaggaggaggaggcggtgtgggcgtggagttggggcgcgggaacggacgggcagctcgggaacggcggcttccaggaccaccatctcccgcagccgctcctcctgccacctcgctgccgcggtctggtttccttcgtcgccggcggtggcgcccacgctatcgccctcacaagtaagccccggtcccgttcaaagccgccacatttttttttctagtaaacgatcgttgtagtaatgattggttctcgcatttgccggaacttgaactcagttagatacctagattgacaatggatttgtgcacggcgatgtagttttgctcaccatagcaacagatgttcagagacttcagtttgcaccagttctagtgtctagaataatcacttccatccaaacaccactgaagtgttgctgtgttgggcttgatgattaatcagaacagttttctatttcacaaatttaaaacttttcggttttcgctagttcctttgttctgaatatttgaacttagtgccattaagtggagagacatctctctgttgtatacttgtattctaacaaggggctgagtgttttccttttcagttcaaattccgctttccagtaattagtgattggatatgtttcacagatttgttctatccttggccattttttcaaagcattcttgttccattatcaagatatattgctcgctgaagcttgatcatttaccaggaagaaaattctctcattggcaacctaagcatttttgccttctttcctcttgggtgttttgagatgggcttgtaaatctgaatctttttgtgcctatattagtgcaatggcacgcagaaattttgtatgtgccctaaattggcaaccttgtcccatttccgtcagtcctcaagaatttagtctctgcatcagatgccttcacgtgagcaatatgcatcagttctttgaacagctactcaacatttcaggtgatggtgaagtatttacttggggaagaggtacacatggtcagcttggtcatggggacgtggagaacatccctcatccaaagcttgtaaagttctttgagaactacatgataacctgtgtgtctgctggatggaaccattctggatttgctacaggtgtccaattctgaaaccaccttatttccttgtactttcttttgatcctttatgctttatgttcaaaaaatctactttatactctatatcacatatagtctgtgcatttcaggtgtttattttgtttcaaaaataaaaccattactgatgagcttagctgtgatgtttctagttcttattttcagattctggacagcttttcatgtgtggagatggttcatttggacagctcggtgctggtgataaccacccaagaaacttaccttttgaagtggcatactttaccacaaagcatgttgtgaggcttgcacttgggatgcgtcattctcttgtccttttgaaaggtatgcaacatcatgtgttgcgatgttagcttaatttttaagaaattgcatagtacatgaacctacccagatttactctgttacctcttctgaaaccacttgctcagaaatcttccattgtctgggcaatacccaacttttaaatgacccaatcatattccgtaatgcattttctaaagttaaacagcctttgaaagaaacaattaatcaatattttttcttttcaattgaggataggcatcgctatagcagggcaagaccatactgataatttttattgaaagcgaaaatcaagaacaagatgacctatacacagttatacacttctttgaagccaaacataccggcaacttagggttgttgattccttgaagaagggctgagtgagcattctttgatttttttccaactatggcaatatggcatacaaagcattcatgtggatgcagaaccatcccttctgcactagtgattcgggagacgtgggagggtcatcaatccacaaccatataatatttcctatcagtcatctgagaattttaaggccactgctttctctgatgatgtggaatctatgaaggtgtacctttgagccatcctttagcattcttttcagagggatgctgcaccatcattgtgttctaatgatgaatatgcatgagatgttgcaggttttagctcatcagtcatatatctttcctattggacgtcctgagaattatatggacacctcttctacttgatgtattgacaaactaattgttatatatgttacaaacggatgacactgctagtccttgttcttgcagataattctgtctatggatttggctcaacaagacggggacaaattggtagatgcactaggaaccaaaagttctatgatgttccaagaataattgatggttttccagactgtaagatagggaatatatatgccaatggagatcacagtgctgcattggatggtaagccttgtaaatttgttgtgcaaacactcttcttctctttggtacttggacatgattgtactttcattgcatggaacagaatctggtcagttgtacatctggggaagagcattaattggtgaacatgatgatgatcaacctcggccagtctttccttctttgggtatttctcaagtggcattaggatggcatcatgcattagttttatctggtatgtggtgcgttgttccttttcaattgaaatatgttttctggaactgctgtcaaatgagtaagcattccgcagttacagcaggtgaattgtacacaattggcgcttaccgtcatcgtaagcttgatccccatgtgttgccaagtgcagagccagtgcagagactaaatcccgccacaacaagccatagtcatgatggtagccccttttcaattttggttatattatgtcacgtagttgtattaagtttttattaggaaccagtagctggactggaaaatatctttacatatagatgaatactcattctatgtgttagcctagtaattattgcccaaccgttgtgctttctgttaatttcttttgtaataacaatctgcttagttcatacaagattagttgaaataaactcatagcatagggtaaatcggacgtcgaacaatttttttcttcaataagaggttggcattcttttctttgccatttgatctgcatgctgcattttttttccctatcaccatataaaatttgtctttgtgatttgcagaatcatcctcatcatcaacactggtgaaggttccctgtgttgatggagaacaggtggtgcacatagctgctggcactgaacattctgcttcggtaacaggtaagttactcaaaggctgaaaatgagcacataatccctgggtggtacaaactaattgctcttgcatctttttgtcagataaaggaacagtcttcacctggggttggggagagcatggacagcttggtttgggagatacttgtgatcaagtgactccacagagagttaatataggtgataagaggccatgttcttctgcttcagttaacgtctattgtgggagtggatttaccattgcggtgaattctggcttagagtctgattagttagtatcatgctggattcccctttatggctagtacagaagcaaaacatcagatccattcttgtgttgtcattggagtaaaaattaagtgtgcaacatgatttggtcaatttcttttgtgataactttaccaatcccgggctatatttaccttatttggactccacattcgacctctccattatagatgaatttaaaataaattcagtaatcagtatgccataccaatataccatcggaggctattcgtcgtagcgtagaaccatattctggattgaatatatataatactgtagtgacgcatctggttcttcaaagaacaatattctcagatgctgtcttcctaaagatcaaactgctgaccttttgaaagcagactctagagagtagagacacacaaagcagacactactataataagtgtcggctagttacacgcagtagatgactctccagtaaatcaaatggtcttcagtgctccagttcgatcaaaacttacacaatcaaatattctatcagttgtgttaaatacaaaaattctatccttgccttatatatatatatatatatatatatatatatatatatatatatatatatatatatatatatatatataaaggatcagacgtaattgtatttgtccatagccgaaaacaatcatttctggagtttgaacgtggaagcaaaggttcccataattcttggattatgtggcgcgtagcacaaagatttggtcagataatctcgcatgagcctccaaaatcattttttgggatattccagttggatgttcctgctacgtgctacgatctcgacgtcgacgccgacgggaacaccaattggattagatcacgggtcaatttcgcctaatctcagggtgctcttctgatgggagcatttgcctggatattccatggtatgactgaatgttcttcaaaatattcctgcttgggtcttccatttttggttttttttttatttctgaatcatctgaaagggaggatttggagatgtaatactgatttttggggcaaatatttgacagctgaaaatttggtgattgattccctaaacatttctgattagcactttcagacccaaaggacatctgataggtgtacctcaccttttgtgggatgtgatctcgcgcgcgcgcgcgtcactgacaggaattcgtccaagatctggttctgtaaaatgtatttcctccgtttcatattataaaactttctaccattgctcatattcatatatatatatatatatatgttaatgaatttaaatacacatgtatgtctagattcattaacatctatataaatatgggtaatgctagaaaatcttgtaacctgaaacggaggtagtacaacattttgtcacctacttctattattttctattttgcgattaagtgcctgtggttagagaacatcaattataaaagtacacaaatttggacaatttgacccttttcgaaaactaattttacaaatgaaccgcggccaaaacttatttaaaaaatgatccttttgttcagcgccaaatcgtatggcgctgaatttagacacctcagtatcaaatagcacggtgttgaatgcatgttggcacgccgactcagcctctcatccgcggtggcacgacattcagcgccagctgacatgacgctgaggtgtctaagtttagcgccatacgatttgcgctgaacaaaagagtcatttctgaaataagttttggccgcagtttatttgtaaaattaattttcggaaaaggtcaaattatcaaaatttgtgataaaaatacatgtgtttatttgtcaaggcccactgtagaagaaggccagcatgagtggatgcctagaagatttttttttctttttcctttttgcatgacatggctgactaacgtcaagtgcctccataagctgatggaacattttgctgggtcttgcaagaaacatttgcttgctcatataaaaatttgcctatacatttcttggtcagtctcctaaataaatctagcctttctttttaaagtagcaataatattttataagactatatatataaaatgagatacagtatgcatctttcgaaagaccattcaatcttaaatttccttcctgagcgacgtaatccatgggcgccttcaccacactccagtgtgacgaagtatgaagtattttttattactattgtaattgaaaagaaaatatgcaaatatagtgacatataagtacaccgtaagtcatacatatttaatatctactatctctgtcccaaaatatatctatttgtagcatagtaacttgtccaaaataaagtaatttcttcacctactttctgtttaccaatcacaatcctcttttaatcatctctacttagtttcttaatatccgtgtctacttaaaaaatatttaaattctaggatggaggaagtagataaaattcaattaaagttttaaaactttgacattcaattaaagttttaaaactttgactatcacaactggtcataagaagaaaaaaaaacataggaggaaccaattgctaccttacaaagtgttgggagtatctgactgagaaaatgaaaccgaacaaactaatgaaatactaggtgcacccattcccatgcacatgtagttgtattttattttctaaacgtactacggctaatatacacatgcatattcacgtacattatatctctatatcttataagcacattaaaaaaaactggaccgacatattttaattaattatgaaatcactctagacattccgttgtggattgactacaactaaagcaaacatgagttcataccatgcgttgctcaaaagcagtatcgattttgtttttctatttattttcttccatatgacaaaaagaaaagaaaaaacacctaatccaaaagcattcgccaagttgcagtactatcgatgctctaagaaactttgacagccaaaaaacgtagtcctttggggcccgtttagttccccaaaattttttctcaaaaacatcacatcgaatctttggacacatacataaagcattaaatatagataaaaaactaattacgcagttatgggggaaatcgcgagacgaatcttttaagcctaattagtccgtgattagctataagtgctacagtaacccacatgtgctaatgacggcttaattagtctcaaaagattcgtctcgcggtttccaggcgagttctgaaattagtttttttattcgtgtccgaaaaccccttccgacatccggtcaaatattcaatgtgacacttaaaaatttccttttccccaactaaacacaccctaaattgtcctaaattgtgcttgtgttgctactagactcatcatgtattgtcagaaacctcgaatgtgtggtcgtgcttgcaagtaaaccaaaacttgccgtgtgcccgtagcaataagccaactaactaccgtatctcctaatttcttgctgaacagaagtggagaaactgaaaaagagaagagtcatgttgactgctgagcacataaacaaaagtaaaagcaatgaaaaggaggttctttccgagcaaatccgagataaactagcatgggaagagattcagaataactagcatggggagagacgcagagagctgctcattgtagacttgtagtccttgaaaaataaagggggaaaaaggaagaaaagtttatccttgcacagtgcactctcctcacataccctcttcgtccctccctgccctcctccataaaaagcttcaatcttggaatccttgtggggggtgcgaaatgtcctaagaaacagaccctccctttcccgttgtaatctcttctttcccggagaacagaaaggggtagcgaggggatggagcggcggaatgatggctgtgacggtggaggcaagatcaagattggtgtctgcgtcatggagaagaaggtgtgattttttatccatttttttcagttgtgttcttgggttggctccaatgcggaggtggccatgttgattactttttgttattctttttctcccatgttggttgcaggtgtggtgttcccccatggagcagattcttgagaggctgcgggcgttcggggagttcgaggtatggttcggaaaaggtcattctggtcttcaggcagattccagcccgtgtttcttttgttaattagtttgacgtttctccttaagagcaaattttgatatcaaatggagaggaaaaatggagtctttttgtaggatgagaagcattcagagattcaattaggattattgatgcccgcgaactgtctgaagaaacatgctagaggtctatgacaacatcaactgaaaaaagcatatgatccttgtgtctctgtttccatatgcaggagtaaactgtgtaactgaacccattagcaccctattttctgactgctgtacaagttaaggcgtggcgattacatattgcccgggttccacggctcaatcaatccttcattatttggccgggtacccggaaaacaagaatatgtaggaggaacaaacaacaaccatgcaaaacgccattcttgtattatttcctacaaaagtctatgtgtggcctgcacaacttcaagtttggtagtcataaaaactagataaatatctataaaatgttatggaagaagaaccttgtaattatactctctcttctgttatcagttgccaaatacagtcagttgtagctatgaatcctgcagaagatacgtatatgccaccatggtgtattggcatagtaaagtgttttgcttctgatcaatacaacatatgagcatctctggctctttagtaaagcaactacattgtgctgaatgttaataactacatgcatgctttatggatgcagattataatttttggtgacaaaatcattcttgaagatcctattgaaaggtatgcctgatagctgtgaagggagagccttctatgagcttgaattctttagttctcaatttgttgttattggcaaaatagaaaagcaaattatgcaggtcaaaatatctgtacagatgtacagacatgaatgatggatcatgctgtcttacttgaaggataagacctaggataaatatagtcagttcacaaatgattgctgtagcataaccatatttaatccttgatagagtgattatgaatatctgtctaggaaatataactgatatgttttaaaattttgtgctgctaaataaatccattgtccatatgtgatgatgcacctcttagcagatgtcaacttaatattcctagaatactaaagatttccttctatctgatgatatcagactttacatgatattacctctggtcacaaaaaaatgcctttttggacagttacacggtcttcaaaatgcagtattgaccactaatttctattgtaaaatctttgaatacctgatgtattacaacaatactttttgaggcaaatctacgcatatgattttcatacattcaatctagtaatacattgatgttcaactttttaaagtttgacttgaaacatgtccaaaacatctaattatctgcacatatgttttcgtgattggatggagtataatgaggttaattcagtgatttatttttcttcatatattgtgtttactatgaaatcatctttgttctgtttttttgttgacagctggcctctatgtgactgtctgattgccttttactcggctgggtatccactagaaaaggcagagaaatatgctgctttacgcaggttaaatgcttttcctgacacatgaaattttcagagcacatctttgtgctggatctgcaagtatctttagtttcacaacaggcttccctgacatatagaacatttctagtactactagcagctggactaagataattatcaacaataaaattgtggacattgatgacccatgtgttgtttctgtatagttgccctttttggcttcaacatttgcaccacttttaaagttactttgatatagttgctactgaatgtgcccatggctaattaatgtatctaaagcaactctattcataatagcatcacctaagctcttattgatatcactgtttcattcatgtatgtatatatgagtttgcctatgccttttttctgtagctgaagaaaatgaagagaactttagaaatcataagtataggttatcatttgagctagcctttttttaacactggtcagctgcaatttgaacatattattaatgtgtatattatttttcttgggaaatacacaggcagtgttgattatgggcctaagaaattcacatgtttattattagctagatacctatataagttcatcaacttgatgcaataacattatgtaaatatctttatgcaggccatttttggtcaatgagttggatccccaatacctcctccatgatcgcagcaaagtatatgaggtattaatatcggtataataaaaaatgatgcttcgtacatttgagatatccttttttcatgttttgactgagttgcttgttctgtaatagattctttaaagatgtgttatttcttgctagttatcatgggatgcaaattaacctcctttaaactagaagaaataacttctcttgaagaaggtagtagtactcaacagtatataaaccaaaagatggcagcaagatcatctatgaatatctggtaatgaacctttgtttagttcgtttgaaatatctagtttttgcttctgcagtctattgttgaccatgttaatctcaagactctactgtaatatctgttacattctcttttgaaactgccaatacaaacaggcctttttatcctaataaatgcagaagttggtactgatctctctctctctctctctctctctggaaactgataccaatgagataatctcctgtgagcaaatgttcttcttagatatagcatttccagtttgaaaagaaatttcttttaagttcatatgcctacaatatgttcctctgtgtaaatgtgtcctatggaacctgcaaaaggatatgcataattttggatggaaagataagtactgtaaaaaaaactagatgttatgtctgttccttatattatgtgactgatgtggtcctagtctgcaagaacagtatagtttgttttatttgttatatcattatgtatatccaacaaaatgcttggcctataagtattcttgttttgttttcctgacacagcaactattaccgtcaacaaaatttataggatggataagatagtcaacagatggttttatccaactatacttatagagaaacacaaccctccactccagtttgcaaccttttacataatagcttattctcttttcgcaaatgttgatacttcccttttgcctgtttagcaccttaaattgttcggagttcctgttccaacttatgctgttgtcagaagagaataccctaaccaagagttaaagtactttgttgagcaagatgattttattgagatccatggaaagcgattttacaagccttttgtggagaaaccaatcgatggtatgttagtatcagctcttgatagaaaaaatattttcttaatggtttttccttctactagttcatgcctgttcttctgtctcccactagaataccaactatcattttatatctgcggaatacatgtacgccaaaacaaaaaaaaagaaagaaaaagaaaacctgcactaggtctgattgattaagcttctcatggaaggctgcttcctagtatcaactatgagaagtggcaggttacaaaagaaaattgcgagccttccaaaaactggcaaaatccattccgtattgtagggtacaactcaaaacacaaattaatggtacgattgggtggtgataatacatctttaatggacataattaaaacaaaccatgcaaagctaactcattagagcccaccttgcatccactctctaggattaggaaaaactatgtatttggcaaaatatcatgagtcaattgatatttgggcctgaccttgctgtgatatggatctaatttcaatagaatgcatgagtgctttggaaacatatgttgactgtcgaagcatcaacaagccgaagccttggcagtctaaataatgtcaaacactaaacattgcttatcttgctcctaaaatacataaatgagatattcttcatggcatggtatgaaacaaatttacatattagtactgatgggtaagaaacttaaaattgttcattcattcttattattggtttagtagtagacaatttattttagctaaagtatgcattttgttcccctgtggtctgtgccttgtactttcatttattgtggaaaacctatccttaataactgccaattgttctgcaataagttctacatttttttatatgcaaatcatgaatcagtcttatcaatgcatccatgcatattccaatttgtgcggtactgcaaatttaatttgtcagattgtctattttaaacattaactttgccgcattgtaaagaagtgttagaacaaatctttgctgctgctgactaattctgttgtacataggagatgaccataacataatgatatattatcctagctccgctggtggaggaatgaaagaactgttccgcaaggtgggcacttgttaccttcaattcacacacatttcttggtagaaaaattgtaattagtctctttcttgttaagaaaatactaatcatttcttaactgaggaagtacttagcatctagagtagatggtgttagcgctgtcgatagggagctgcttcagttctaatctgctttccttttcattttcttcttccaagcttgttccttgtttagcacagagtgtctataatcctatctatttttcttttacacacacaattatgtgtgatgtctttcttgttgctaagaaaaattacttgataataaacactgtcacagtataactcagtaacctagcagatgatcatctgctttatgttctaacatgctgttttatctattttgtgtcctctctgacgtgcttgcgctgtgtccgcctttgtattactttttttttttacctttgaaggttaatatattcaggccggcctccttaaaaaataactggctatctttgctctagttggtattttcttgctgaggttaaacttctttgatataaatgaatgagttaatgtgcattctgatttctgaatctgcttgtcatatcatgttcttccagtcgactttcatctgttcaaaactccccaaattcactcaccagatgtattcttcaaaatatttatgcataggttggcaatcgatctagtgaattttatccagacattaggaaggtgaggcgagatggatcttacatttatgaagaattcatgccaacaggaggaacagatgtcaaggtgacagaacttgcgcctagtgctatttttttttcctcccaacttatactctccagatatgttaaaaaggaactttttacagctttcttcttggtaatgagtaaacataaaataattatattttatacagttgatgcctacatgcattgttgccataacatgcaacatatgccacaagcttcccttttttttatttgggcattaagaaatgcaccatggtaaggacttgaatctctagggataccaaaagggaatcacattctcttggaaatctgggtttgagggaaaattatcttcatcaggacagtttcccaattggtccagggttgctttgtcctataaaagactaaccatcatgttgtaggtttatacagttgggccaggatatgcacatgctgaagcccgcaaatctccagttgtagatggggttgttatgaggaattctgatggaaaagaggtaacctttgttgcctatttgccataggattcaccagtgctatcaatatgcctcagtatttgacactttgatggatatttaacccgtttatgttctttagttaccattctgtgtagatatatagtaacacttgttgtataatttgtatctaacacttgttgtataatttgtatctttcttgaaggtgcgctatcctgttttactaacccctactgagaaacaaattgcaaggaatatttgccaagccttcggacaagcggtacagaattcttttagttattatttaattcctactatgtcggaagcttacactatttcagaacttaggatgtatcttatattgtgtatttatgggctgtcacctgtcaataccactagacataatggatacagttagtgaaaccatcatcgtgttaagtcatctacagcatataagtagaatttgtttccttcaagattaattagcacaaggtcaagtagtgtggaagatcaagaaggtattgagcatccaactccatagtgatctctgttgcttggattctgtggaacgagaattttcaataggatcaatgctgcagtggttcaagtttggttgatcaaggagtgcatgaaatggcaccttgctggagcaaaatgcttttaagagcttatatatgtagcttaaattttcctttgttggtcattcttgaccttattctgctggcgcatctgtactaaatgagttccttgattttctttttttgttttgttttttcctttagggacctgatctctggctgaatatcttgtgattactgagtttgactttttttaactaaaatactttcgatcctctagcttaatgaaatggcatgcaatgctctttcctgccattgagcaaaatggatcaattagatagattggagatgaattggacacacctctattccatgaccagaagccatacatgcagaaaacaaatatacagagagctaatttatatgtgcttagttatatttttattatataatggaattagattaattccggcatttgcttcaacagaatctacagccaattattacaaagaacgaagcacataagactgcggataacaatttgatatatgtcaggattccaaaaccaaaagaccatacaggtagttgtattagctcagtagttgttccttctttgtgtaggtgtgtggttttgatcttctaaggtgtgatttgggggaggcaaggtcttatgtatgtgatgtcaatggctggagttttgtgaaaagctcacacaagtaaatctttctcactctgttggaacaattactgtaacagtttaatgcatttgtagttttctatggtcaaattcctcgttatatcttgtttatttggtgaatgccttcataactccaggtactacgatgatgctgcatgcattctgaggaaaatgtttctcgatgataaagctccacatatttcatccaccattcctgctaatcttccatggaaagtcagtgagccagtccaaccatttgatgctgtaagagatcgagaaaggggaactgttggcatatctaggcaatcagaagagctgcgctgtgtcatagctgttatacgccagtaaggataatcttatgatctctaaattgtatcatcatcaaacttgtttttgacactacaaaaaatgatatgcaagtggggatcgcacgccaaagcaaaaggtgaagctgaaggtaactgaagaaaagcttttaaaattaatgttgaaatacaatggaggaaaggcccatgcagaggtacgaaaactaactcaatttcgatttagatttattcatgagctttatatttttgcttcctgaaaactgatcatgttgtcaaattgtgcaggcaaaacttaaaagtgccttgcagctgcaagatctattagatgcaacaagaatccttgttccacgtgctaggtaatttctggagcctcaaattttctatggttttatggtttatggtttgtgtatgtgcagctggatgtcactagtaacatacaacaaaacaaaatattaatccgtatcaaatatgtcttccaatttattgtttgttctcaagggtttcaaaatatgtgcatttttgctagtttacaaaatgctaaaaatctatgagatcatgtttaatatccccatataatattttaccttttgatgtcagaaattatgtttttatgtaatatgtgtatcttggttagagttctgacttctaacaatacatagtagacatccacacggatcttaattgtgagcatgttctctcccttgtatgttgcattgttgatttgttgctaacaaagaggaaaaaaatttctaacttcaggtctggccgtgaaagtgatagtgatgctgaaattgagcatgcagagaagctacgccaagttagagcagttctagaagaggtaaaatagtgttcaagtattaatagggctatatgtttggcatggcacctaggatgaatatacaagcataagaatggtagttgtacataaaccttgaagagccatgcacaccaactgggttaaccctgtaaaatgaagtgaggattaaagcctaaagtgttggttttggttggacgtactttggagtggcacgaaaaggtgttcactggtgcctggtatttaggtcagctaatttctactacaacgatagcagcatgcttcttgtgatcttgtcagtgcataatgaaagcattcccttcatgttgataactgtatatttcccgtggatctccatcatgcttattgttgttctacctgttcttcaaaaatcatttttccatctataaatgttaaaaaaaacataaaattgttaacagtttgtatatacataaatagcttatgtggttcagcagttactgtttacatatctatggagctccatgcctccattgcagagttcttgtagattttcgtgaagtataatcaaataccacatcactatttacaaaatgttttctgtttaattaaatactacatataagattgtttatttatgtacttgttcttgctgagacaattgtgttgcatgaatagaaatgcgatacaaaggcgctgtctagacatttccttttgtttactgccatatataatctgcatttgtcctcattgtcaattttagttgcaaatacaatagattcttaggcattaagtattagtttccctatggcctgtagggtggacatttttcaggtatttataggaaagtgcagttaaagccatccaattgggtccatattcctaaaagtaacggcaacgggaaggaggagtatccaattgaagcactgatggttctcaagtacggtggagttctaactcatgctgggagaaagcaggttgctttcatttcacctattgaagattttattatctgtcattattataatgagcactgcgttgccaatgaagctcatttagtttgatgtcggtatgattttttggggtttatggatattttatgttaattcaacaatctccaatttcaatgtccaaatattcaacttattagtactatggacataatctaagtaaacatgattaatgatcagtctgttcatttcatttaagttcttatcgtgtcccccctttgtgtctctcagatgcttttgtttgatcatgcaggcagaagagttgggaagatacttcagaaataatatgtatccaagtatgccttatcctaaacttttccgcttcccgtttagaactttctatgtgtggcatcaagctgtgggtctccaacgtgatattttgctgaaactctggttttaactaaattattgtatgaactgcatcactaaacaccacaatagtctaatccatttcagaccttcggtgaagtcttcactaaatgtttatattcagtttcactgtgccactttgggtaccaatttgaaataaaaaacttaactaaacaaaataatcgtagtgaatttttcaataaaatgtaacttggtcaggttcagctatttcagttcagttggtttactgaaatggtatctcaatctttacttttagtgaaattactccagcaatcatttcacaaaatggtttattatccttcacgttgatattttgtgccctacttatgtcctttctttcctttccctttgttaatttggctgccatttctgtctagatgtcagttagatagcctcccattctttagatagcctcccattcttttctctaactgtctgaaaacagcaccatttatttggcttttgtgtctcatgtactattttggtgtgacttcggtttatttaggtgaaggaccaggattgcttcgtctgcacagtacatataggcatgatctgaaaatatacagttcagatgaaggtcgtgtccaggtaaatggcagtatttcttcttacaggcttgggttattgaatgtaaaagaaaatgaaaaccagccattttttgggtacatcatgtccatatcagggttaggattttagagtcgggactcaggattgaaccgcctgctctgttcctctgaaaaccagccattttttggcagctatctgaaaaactggtcttttcacatgattacacatgatttgatgcatcacaccttcaagtgggcaaaaacccagtattaagcagaactggtagcagatttctggaccctggtccatataatcaatagtaacgtaatgtaataacttattcttcttcgtagtaattctctaactaccagaaactatttagttccattctggattcactgaaatgtttatgttttttgtacatttatgccttctgtgacatgccattaaattttttaggcaagggatatttcattaagtaatggaattacatcaggcagggatgcacacagacaacagagaaaataaaggagaaaatccaaagacaacatgaacataatgacatgccatcaaataattttgcatttaatatgtaaaaaaagtaatgattgctggggtttcctgaccttactatcctatgtcatttttcttgtactgggtaacggtcctaacggatggttgcttacattttttttcttgttgttacctaatagatgtctgcagcagcttttgcgaaaggtcttcttgatttggagggggagttaactccaattctggtttgttcctattacggaaatatatccagttgaagacttgacagagctgcaattcattggatttactgtctccaggtttcacttgtcagtaaggactcttctatgcttgatggacttcaggatggctctattgagatagatgaagcgaaggtcgccttcagataccaatgccataactcatacttatgaaaaaaaatatttgtttgaaacttcaaaagtttctgtcataaaatgtcagatctctgcaggctcgtttgcacaatattatcctttcttcaaaaattgcaaatggtgagactatggagttcccatggatggttgatggagctggagtgcctccaaatgctgctaaccttctcacaaatttggtatatgcattagatgtatttatttcctttcccctttgctttctataccgtatacttgtgagttgtttctgcagaaacttgcacatctaaaacaaccaaacgttaagataattacatctataatggtgacaaataagttgcccttatctcaactgtccaatcaggctcaattgaccaaggaaataactgcacaagtgaagctgctttctgacaatgaagatgaagaggctgtgacagatagtgactcaccaagtcatccttatgatcaagcaaaggcactagggaaaacagcaattgatatggaccgcattgcttctggattgccttgtggcagcgagagcttccttttgatgtttgcccgttggaagaaactagagagggatctctacaacgaaagaaaaaagtatgtttccaagcttttaatattcttgttgattaaattctcagaaggagttgcagcttgtgtaaccattgctaaaactctcattatgatgcagacgttttgacactacgcaaatacctgatatatatgactcttgcaagtgggtaaccatgttaccatctccagatgcttctatttctcttcacaaaatagctgggccctggatgcctattatatgattgtatcatgctcttccataagatctttgtcaattgtcaacttcattcgaatttgcttttctgaatgaacatgcaaattagcataccaaattgtgcctcgaaacttggccatgagagggcctgaccttgatttgcccagctgctttccatgctgtttaggccttaggggctgtgacctagggaatcaacaagaatgttcagcgaaacagcccagccgtaggaaaataaatttcttattttcataagaaaaccatgactattggtttcaaaaaaaaaaaaacatgactatcaaagtctcaaatatttcctaaagcttacctgaaagtttgctagtggatcactggaaagttcacaatgttgacgatctcaaagacagataaaatttgcccaaaataacttcattttgctttttttgcaagtgttcatctgctctctcttttttgcaattcaaggcttcttgcaattattttaaaaatcacgtgatgcttttgttcgaaacaaaagcattttctcaagtttcaaaaacatttctttgttccagcatatctcttcacctcatctatttctaacagtatacttgacaggtatgacctccttcataactcacatctcaaacttaatggtttgagtgatctcttcagagtttctcaggtaaattaaatatgtatcgcactcttaaaatgtaccttgcacttaaatgtgtgtagaaccacggatatacagctgctcctgtgtatttgtgaaatatttgcacatgaagacatcatttcatagcactcaggtcctaaatgaaatcctttgatccctgttttacattatgaatacaactagtagagtggtgaatgattattgctttactgttactaaattaacactgagagaactcaatatgctatgcactattagaaacatgtactgctatactacctattactccctccatcccataatataagggattattcccttttgggaaaggttaaggatgaaaagaaaagactacaatacccctattaaatgtgattttggttgtggtgagtgggtagttggaggctaaaataggtagaaatttgaattagagatgatggatgtgacaagtagtatagcaaaatctcttatattgtgggtctagtgagagggataaaatcccttatattatgggatggagggagtacgttactagtaagagtggcgtgcttatgttgaattctgaattttatgattggtcattctaatgctctttttctatccattttctgcctgctatctaactatttataatgtttctttttcattcagtcactagctgatggtgtaattccaaatgagtatggaataaatgcgaagcagaaactcaaaattggttcaaaggtactggtgtgtaaatatatttgaaaactggaaaagaaactgttatgagttgcgtcctgtatattcattgttttcattatgtagtgtttatccgaaaaactaacataaatgagattttgtttctagaaatgaaggatgctaaaggaatttgttgcagaaaatatgtagtacccaattttctcctagaggctagcccttttatttggcactgttttgttttttagtcacaagcaacttatgatgtttctcatgtccttttcttcagattgcacgccgtttgttgggcaagattctgattgacctgcataacaccagacgagaggttgctgctgctggtggtgaatctaatgcatgccatgatccaacaatagtgccttcttcaaaacggaaggataggggttactatggggatgttaagaatgagggttttgatagacctaactcaaacaagaagtcaattgatcttgatgattcgcacaaagaaaccaaatactgcttggatccaaagtaagtacgaaattccagttaggaatcttgactatgaagaatacaattgatattcaaataattttgttgtagatatgccaatgtgatggaacctgaacgacgtgttcgaacaaggctctattttacatcagtaagacaaattacattgagttttcatattccccttgcaaattgttaagtttatgctttcttgatttatggtaatatatcaatataactatagaagtatacagaaatttcaaaaaaaaaaaaccctaaaaactaaggctctaaaaagcatacatcatcatggaaacgacaatttcctatatgacatttctttggagtttttttttaactgaaattctttgtttttgttttcttctccctgataagaatgactaaggattattttgttgtcaggaatcacatatacattctctaatgaatgtacttcgatactgcaattttgatgaatctatggatggagaagaaagtcttgtttgcaaaaatgctctagataatctgtttaaaacaagggaacttgactacatgagttacattgtattgcgtatgttcgagaatacagaggtattaaaaaattatagtgtaatcataagcttttactttactaatactaccggtgagaagtgatattgatcttgtcattggacaactattgcaggtttctttggaagacccaaaaaggtttcgcatagaaatgacatatagtcgtggtgcagatataagttccttacaggtgagtttggtccccttcaaatgaaatgtaagatgtttgttttcaacatttctggttattaactcaacagttcttgaaaaatgtatccatacagagcgaacatggaaaagattcattgctacctgatgatcacactatgaaaattatggagccagaaagattgcaggaagttggatcatatctcaccttggacaaatttgataaaatggttcgtccatttgcaatgccagctgaagatttccccccagctgccccttctcaatctttggcagtccgtttctgcaaggataatggattgcaaggcgcaagattggtaccctatcctgttctttatcatagaatgattctgcccttctattttagagaaaatagcatctaatacttccaatgttttgtcagtgccaaaaaataccaccaaaacattcttctccaatcttataccacagagtgagcctgaaggtttaagaaatgtcacaacattgtatgaaccagctaagagaggggatcaatgctggaactatcgtcactgcacgagtatataacgctaatgaattaaaaattgactagtgccaatggatactccattaatcagatagcgttatgaggctgtctgcttctgcaatcaatcagaaatcattagaagactgcttacgtctgggaacaatcagcttaactagtcatattgacacaatgctatgaataatcatcaacaaaccagtcagatgtcactgtacagccttttcctctttgtatacatgattgatttggctatatctttttaacctttggcgataatgacctaaaatttcttattttattacctcctcctgttatattaactacatattttcctttttgaaatttgacagcaagataagtcagacatggtgagtggtatgccaaaaaggaagacaaaaaagcttcaagaatagcatgttcaacacgcaggccagcaagataagtcagacatggtttgatatttctgttaacaaaagtctcaggtaaatggtttaccaatagaatgttgataaagcacttgccttgaagagaggttaatagtgagtctgcaaaatgctgcatgagtgccaagcactgaagatcatgcagctggaacaattttgtcagttctgagaatgtaacctgatagagctgttttgcagacagtgtaattgcgtaaataataggttacacgtgtatctggataaaattttccgtatatatacaaggtggtcatattatgtgcctttaaaattatagtgtttccgtcttcagaataatttcactagaaaattctgctactttaggcgtttgctaagagcgttatttttagagctttacaggttggagcgttttaatcgaacatgtttaacaaaaagtactcgctgaacattcccggaataataccttgtatatttgtgacatgccagtgtgatatattcgatttacttttgctctatttttactggtatagactgatgtgatacgaagcacaactcccagattccttttttttcacctctttgatcagacggttcttctgccttttatgaaacggtgtcaaatattgaatcgatcaaaacacttttgatctttttttttttgctaaatctttttcaaatgttttcaaagtagccacgaataatagtcgaatgcacttgaatagaaattttgagaagatggtaaggcactgtcaatattaacaatctaacatacataaattctcatgttttgatgataacttccacaatacatgctgaatacaagaaacacctacccatctgaaggtaccttcacacactaaaaaatacccatagcttactcacctaaagaccctagcagtgtacaagaacaaacctgaatggttgtctcacctcctccctaaagaaggctggttattagaagttcagaacagatcatcgtaggcgactatttctctagctttgtaggttccttctggagccgctttcgtgctcgagaacgctgaagattcgcttgcattcctcttcgtcgcatcatgcgtattctcccccactgggttggcttgagctgtacttctcaagtcattcggcgcctcgcttgcctgtacaactaaaacctgcaacccatgaaagaaccagcaatctgagtatcgaagagcaagagtaccaaatggctcaaaacatgtgtagcatgctatagcttcccctgaatctgttagaaattttgttctgtttattttgtgcctgctgcacaaccaaagtgcagatgcatttcgactaaaataaagtgcaaaataagtttattgtttattttttctaaactaaatctgtattctacttggttttaaacgaccgttaacatgaacaaattgtgacagcgaagataccagcacagtctggatgtaaacaagatcaatattgaatataatttactatcttatagacttgtaccagataaaatggttgactgtaaccttggactgaatttaaggtagccagttcatcacggaattgagtaggttttgtagagcccagcaaatgtgtaagttaattgaataactagcacattaattaaatccaaaatgctagaatgaaacagcaaatgcagagtataaaatgagatgaaaaataattaaaaaaagcattcttttcctctcacggatttttgattattgcgggcgcacttcccaaactcccaaacggtatgatttttgcataaactttcttcatcggcatttcttagagaactttttaaagtcaacctttcaactttctaatactaaattctctcgtctgtgccctcaaataattttcataaactctgtttgatccataatccatcatccatcagaactttaaagtcgagataaaaggccggatgtgatgccaatctataaaattctcaaatctagcagcgccttcaaacaattctcagcaaagcttgaccctgtacaggctgtactgcattcctctacacgcacagcaagttgaaatcgagctcatccaactgcagcacgcagatctccttaccttcttggatccgacggtgacgccaccgtcggggtcgagggaggcagcaatggcggccatggcggccgcggcggagcggaaggtgacgtacccggtggccgaggcggcgtctatgcgggtgcgcgcgatggggccgtacgccccgagccgcgacttgagctccatcacgccgcacccgggcggcagccccgcgaccatcactagcaacggctccgaagccgccgccgccgccgccgatggagcctgtaccggcgccggaggagcctccagctcgtcggcctctaactccggcgggccagggccgtggccgtggccgcggccgcggcggcggcgcttcgccggagggtcggggctcgcgcgcccgcgcttgcctctgcggtgacgggtcatgatgatgtccaccgaagtgtactccctggccgggatagtaggggaatctgcacggctgattgcgcggagattcgtgcagtatcttcaattgttatatggagtatatttcaatggataagtaagaaattgaatattaattactccctccgtcccataatataagggattttgagcttttgcttacgaccacctgtcttattaaaaaaatttatgcaaatataaaaaacgaaaagttgtgcttaaaggaaattttttttgaaaataatacgattttaatgaaaaatcgcaaaaatatagatcggttaggcgaaatcgcatgtttagcaccctgtcgaacaaccgtggttcgacagaggtatctgtcgaacaaccgtagttcgacagccacctgtagccgcaacctgtcgaactttgaaagttcgatatgtcctgtagcggcactgttcacgtgaccctatctaactttgtcagttcgacatgttcctgctgatttctgactgttcacgtgaccctatctaactttgtcagttcgacatgttcctgctgattcctgtagccgtacttttttatatttttttagaccaactacccagttcgacagatggctgtcgaaccacggttgttcgacagggtgctaaacatgcgatttcgcctaatcgacctatatttttacaatttttcattaaaatcgtattatttccaaaaaaattcgtgtttaaaatactttgaataataaagtaagtcaaaaaaaataaataataattccaaacatttttaaataagacgagtcatcaaagcaaacaaaaactcaaaatcccttatattatgggacggagggaatactttgaaaactatatagtatcgttttttttttcattccatgtttgcattagcttcatttcggttgtaatcccagagtttggccaccgttattttaagactagccactggaattttagattggaaaagaacaccggtccattttgcaactattgtgaagtttgccggtttaaagtgaaaatctgcaaactagataaaaatttgttcccaatatgcaatttactcttattataatctttcagaaagactggtagaatgctggcaagtgcttaaacagccggtttcaaagtctttccaacatcttgatcaatagttgacaagagtaatgctatctgaattctgaaggaatgctcacacttgtataagaatgaacatacagcagtatcttctcaaaaaggaacaatacaacagtatcctcatttgcggcttaaatagcatcgcaaattcgactgctgttcatacaagaacctcattggacaaggcaaaaacgagcacatacatttggctcgcaaaatgccacataattggctctggaaaccgagaagataaagcacttcccttcagaacatgtgtgcttctgattgcgcagatacggatgagctctgaagtctgaactgataagccctgcagctagtagtagtgaatggcagctacctcagccgtgcttgcactttgggcaaaatggaatgcacttttattgagagcatttgttgctggatgattctgttgaactcagatcatgaacgcagacagaaggcatacgcaaatccaaacatgctcagataaggaagctggcaggtgcatccacaattttgtgagaatcagctccgagaggttcgtctagctgcttttagtgctgcacctgaaaacttgctcccatctgaacgtctgacggcgcttttcatgggtttatattcgaatgtgctaatatcaggagggctgtccgcagtgcacatagctttgcgcgtgttttcactctgatcaaaacggctggtggtagatcttgttggtgcataagcaaatgttctcaggtcaggaggtccagcagcagcatctgtagctttgcttgtgatcttcccctgatcagaatgagcagaagcagttgtaggcctgtatgcaaatgtgctcagatcaggaacgtcagtgctgtttgtagcatcacttgagaatctgctttgtagaggcactctagtagtcttcttagccgtacaaccgaatctctgttctggaggtctgagaacagatctgcaattaatgttataaaatatatcaactcattgggacaactgtgtccccctcttaagttctgataagtaaattgtgtgaacttggtgcaattgaaattttctgaagctgcagacctgacaggaagagtgttcttcacatcctttaaaggagcgcgaagaccactggcacgagagcctgcgtatctgaaagatgatatcagcgcagcaaacttatccattgatttctctgcaatgccactgtatttatttacatgggcgacattgcatccaaattttccttcagaatttgtgttgataccgtcgtgggaatcagagtcacagcctgcattagtatcagacattcagaagatttccctcagcaacaaaaaaaaagggaactacgcacactcaaacattggcagaaccttctgttgtttttggaaaaactgaatttcttgtaatcgtcacaagtttatctatagagaaatggaacaaggaaaggtgcacattctcacagagaataagaacagacaactaggtggaactattacctttatcagcaaccggtggactttcatgaggactagtgggttgaaacattccctgcacaaatagtacattcaagaccagatagtagaatgatacagacagttcactgcgatatgatgatagaataacaactcaaaaaaaaattgcttacatcttcaaaattttggggatcactaaattttcttctcttcaatatacctccagagcttctttgttgatctccaggaagagtgtaattaccagtctcgcagttatcttcatcatggcactcatcttctccttgatttgtgcaaactcttttatttactgttttgaaatatgaactcctcacagtaatatttctattggcagagaccacattgcttttttcagcataacgtggtgcagctctggatggctctgtgttgtgtgaatctaaaaatggatctgatatcccaggcaaagtccctagaaaacgaaaataaatgcatacaaaacagaaaccaagattattttcattttaattagatataccagtacatgatttgcagatcaagtcatgcatcaactacaaaaaggtagagctcttaccctctaagaaagagcctgtcggtattgtacttctgttgcagaagttgactttcacctgtatagcagaagtaaaactataagaatgacggaaatacgatattgttgtagaaaggtaggactacgagaacactgaaaataaggcaataaagaaacgtgaaataccttgttgccttcaatgtctgggtcctcagcaggatcactaccaatatcatgagaacactggggtgaaacactggctgaatcatcccgagggatgtcacagcggacacgctcagaactacattgagaggcggtattgattgaatcatctagaggggttcctgagctaaaatgctcagaactacactgataaacttgaatgttatttgatggcaagctagtatcttcaattaaatcaggggtaccagagtcttcaattctgggactgggcaaagacccattaagtacttgttgcttaggtgtaaccttaggtgctctgaacttccgttttgcctcaagcgatgctaagccttctaaaagtcaaggattcatccaatggacagttgaagtattgtttacaaaacaagcaaaataccatgctaagaatcgcacatcaccttagacttcgtaaataagtttatggggaaattattagttcttcatttgatcctaaacatgtttgggaacgagaaagcacaataactgaactatcttatccaaggcattcccataatataagctgcaacaagtagttcatataataaagttgattggtatatatattgttctctcaattaaattaaaatgtgttgagaggatacagaagtaatttgtcaatacgtttctttggacaggtagatcaagctttttctttccatttgaaggagcactggactctctgttcagatgcactttatcaaaagcgagtgcgctactctctgttttgccctgcaagtcacatatacaaataaaacatatataacttcttagtaagacaatccacaaaagataaaattgaatgttggtattcgcatgtcagcaaagcaaatgcttgcatactggtgatctttaataaaacagagtacatcagtaaaaccatgatcacttacaatgtactttcttatttcagtgaggaccctacatttttttcttacaaaatattttatggatttttatctgtttttctctaatgagcttctgtaatgctctgtagcctctgattggatatttcagtgagcttacaaccattttcaagagcccctcgtttgtatttgcatattgatgcttgggtatgtttatacatatgcagtgcacagaatcagagtaggatgaaattacattcaaggaaacaaagcaccaagaaaccaaaacaaccgagggaagatcggtagtacctcaaatggttccttggtaatcggatcgatattcccttgggcaatgcctttagcaacagtctgtggtagccatgtataaaccaattaaggaaaagatccaatgcatgcaagttgagattttcttcaagtaacacaattcggtattactgagaaatggtggcattgaaaggccgttagcttactttctaacgcaacttgtataatggccattagacatgaccaaacaaaagtggaaattcatccttatggacttatggtggataaaacaacaggttatcatatgaatgagctttagcatctattgtacaaatataagtttggcaaggatatgggcccaaaaagtccaagtcttcactactgccatggggaatgcctgacaaatgaacaatatcttccgtcacagggtcataaactctttggaactgaaatgcccagatcgcctttctgaagttttcttcatattgaggtggaacagaaacagcactgtacctcaggtgcttgattacctgaaattatacgcatcatttgctcattatttttttttctaatttgctaagcaagaaagtgattgcacatcgttgccctacaagctcagtagtaactcaaatcatgtcctgcatgtatgacaggctatggattggctaatgacctaagtacaagacggtggcctcataaaagttgaagcaatcaattttgtgttgaggccttgccttctgtagttatgtctaagtagaactgcattctggttctactatccagccttttcttaccatgctttgtaggtcttgaacactatctcaggcatcgttcatgttagttcatgaatcagttctttccaattccaactaggcctaaagttagtatttgatacaacagatacagggtttaccttttcatgacccttgagcttttggataagtgcatgagctcgtttcacacccattccaggcaatgatggaagataatcacagccacttaaaatacacatctctagtagcatttgcatagtgaatccattaagatcaagctccctgcatcgctgcaatcgtgtaatatgaaattcaacaccttgtccaaacttgtccatcttgaaaataatctgcacaatggaataagatgcattttaattagagaagttacaacaaactatgaacactaatctagctgagcagcaaaatactatggggtacgtggaggacaaagataaagcgttttaacactgtgcttactctagaacagccaaatggtatcagatcagaatcctctgtgataacggcatcaacaagtttgttcacagacaagaatgtcatttgtgcatctgcttcataaggcgcaacaatataatcaaccttttcttgcttcaatacctgcattgcaagttttggaacaataatcagttaagacaagccaaatgttcctactcctgactagaactgcttcaaataggtggtaaatatttggtaaaaatacatggaatttgctcctttacctggatcagttcaaaagcaatcctaggtgtaatgtcaacagctttctgataacactcaaaagcagcacgtgaattcccagcagattcatgctccttggcacgctcaagattttcctttcgtgacctacaggatgtcatgcttacttgcttagcatccaatgactcaagaaacatcacatagcaaagaatggctggaggcctttagcttatccactagtctgtactaataatgcgactgctctatatcagcctaaagccacagttgtccataactatagccgtatgtaaaatgtcaaatcacaattttttttaatgttctgtaagggtaatgtagatgttccttggcaactgaaacatgttaggctctttctggagccctaagaaagaacatacctttcacgtttagtctcttgatcacccttcatcggcagatgacctccgtcaaatacaaggattggtttcacgccatggtgccgcaacatgttaaccctatgcatgcaatactcaatatgcctggttcagattcaggaggggaaacacaaggtgtaagttatggtgctcaactacaacggtgataaatgatgataaaaactggagttgcaaatctatggccctccgcattatgagttcacgacatcaaaaatgcagcaatgttagaagatatcccatacagtaaaaagatactactaacaatgctaagctattgttaacgtttattgaactattcatgtctaagctatttccaataaaaattccacaaactaaaatggtgaattctctgaactaaagcggcaccagatgccaagcagcggatctctcccaagtgtgtattttattcaatgcaacctagacatacaagaatctgggcactgaggcggataacaaatttcagtaaatgtactgcccctggaagggggcgaaaacaaatgccgcacatttattaccttaatcctgagagagactgaacaaacaagaaatccccccccccttcctacacccacctaaaaaatgcggaaatctctcatccgaagcaagacgtgccttttacccctcctccgaaatggatttcaccagtcgggaccaagaaaacaaaatcggaagaaacccctggtaggaccagcagctgtcaatacgctcgtggggaagaagtagatttcccggatccgtcgatttaggtctcaccaatcggcgaaatggattaagaaaccctgggttccaagaaaaggggggaggtcaccggagccgaacctggtggtgggtaggcccttgcagaggcggtcgccgcaggagagggcgcccttgtggagccaggagtaggtgtcgacggccaccgtctggcccttgagcgcctccaccccgatgggcgccatgatcgacttcagctgcggcagcaatccctggatccccattgccgcctctctctctctctctctctctctctctctctctcctctctctctcgctctctctctctacttgtaggttttttcttggaaggggagaagtgaagggcgggaagcgaggggttggagggagggagccgagtgaaattggcggacggcctctcgttttttctcttccggcggtccccaccataaatctatccgaaccgtcggtctcgccatccaacggctgtgctacagtgttttgctccgtgcgagtaggccacagcctgagtgggttccagatccgcgattgtgagtgtccaacattagttgggccctaacggggttccttacagctacgtgcggcctgtccgtgttaggccggaacggaattcccatgggcttgcagcccatttaagttgggccgtaacaggatttccgccaacgtgcgggccgttggttttgggccgtaacgggatttccgccaacgtgtgggggaggggggtgggggcggactaattcgagaaaattaatttttcatttgaattttaatacctttaactcaaatttcaaacttttcatctaaaaattgaatactttcatatcaaatttcaaattttcaaatcaaatttcaaaaacttcccgacataaattttagcgataatttataattttcagacccacctataagtgataaaggtggggtgcagtcgactgcaaagatcctgacagccgcctgccccgccactctgaccgccagagacggcgcccaccaaaaccagacagttacatcgtcatcccaatacggaaaaatataccgtgaaaattccacgtgtggtgtaaatccagaaactaccggtagtacaaaagaatggacatataagatttataactttttactaatgctaacgtgaacaaatctcaaaaatcaatttgtatatgctacgatatatggagattgcacgacatttttcccttccaacgtgtaggtgtgagacagtgagagcgacaaaaaagaggctgctccatgagcaatgaactcttgacatttcatttttttttctccttttccctatctgtatgtacagtaagaatgggtcatgctcattcgctcgtgggggggaaccggacgcctgaatgcaccaacaaagaatggaatcacaatgtcacatgtcgggagatcgatatcggttagcccgtctgctatctacgtgagaagccgccaaaaatgagcgcgacggcgaccgctacggcaggtaccaggccgctgtacggcggccgcggcgacgctccgttcacgtcgaactggcccgtgttcacgtactggttcttccccgacgacgtcgtcacgttcaccgacgtcgaacctaccaaaagaaagaaaaacaggcattcgttagttgttcacttgtttgtcacaacgacgacgaagaagaagaatcggaaaacgtgatgaatccatggacaaaatctgaaaattcgggtgagcttacagtcgtagtcagtccagcccatgcgcatgttcgccaagtcatacacaaaaatcttgtccttcaaaactagatctgcgtcaaagtgggaccaaatagttagcaacaaagcatcaacatggagaaatgtgtgcttcaatcatcagcataggactaatagatcgactgttttttttttatggaaattgaagtgttcagggtcaaggaaaaacatatggggtcaaaacgtaggattaatctgtcaaggcctcaatacccttgaaagaacttgcagattaatgtgcatcgatgtgattattgagaatgttgttaatcattgaaatttttcagacatcagtggtgtgatgtgatggttgtctcaagtcttaatagtagttgcgggttagacttagacgtgcaaccataattagctaattcaatcagagctagttaactaacctccgagtatggttatttgttgaccctggttcctttgccaaccaatacaccacaatacattgttgtcctgaaaagcatgatatggtattaatatgggcaggaacaagtcttttcagaaacggttaggcagatatacaactgttaccaaggccagaaaccaaatatattaaaaaaaatgcaggcttacaatagaagcctgctgcaaaagatagttctctggcttcaccgtcattgcaacaccacccataaaatatagtgacacggtaggaaacgacgagtcaacgctggttgaaaagcgaaaatatctgtaagtaatttgacatactgaagaacatgagctgctaatttccttcactgaaacaagaagctaacctgctggaagttacaaagcattggttccccttgctgacaagagagcgcacagatggagagactgcagcagttatctgcaaaaacaaaatatgaggactaacaatcatgtaacaagattaattactatcgtaggcttatcatatatggggaattccagaaaatagaactataagtgggccctatgaagctcaccgcattaacaaatggatcatatgccccatctgcaagatatgctaaagttgttcctgagtccacaattgttccttgtgtatttgatgtcgtaaacaaggaggaatcaattggcagcttctgtccattgacaacgatactttccagattcaaattgtaatgaggcctatatttcattgaaaaataaatcataaactgacgtccatagaaagaaattaggaggaagaatatcaagttactcatgcagcaatattgttagcctctcacgcaaggttaatgaatgtgcatacacttattggttgaaaacttttctacaaacaaaaaatcagcagaattctgaagttatacaataagtaattctagtaagagactcactgtgatgggacgagtggagtatagactaatcctggctcgacaatttcaccaagaacgagaataccaccaccattatctgaacctttcaggcaatgagagaacacctttggggataccccaagagaattcagttgtgagacaacagacagctgatgctgtccaaacccaaaaatcccatcaactgccctgtctgtctttgtcaagtctcctgactgtgagttgctacatctgtttcaaaagaattaacatattcatcagacaatgaataatactgatcatgcgaagcaacaaagttcactgttagggtaatgaaaataaaaaaatgcacagttaaactttacagcaaagtgtcaccaggcttctactgctaaaagatccacataaggctaagcttttgttaacataacaacaaggccattaacaggatgaagcatgcatgccagaggatagtagtctagaagcatgctgaatttcttttgctccagaatggcatggaaagcaaaatataaatataattttattcaggttgaccattaaggatattgacaactttttctggtggcaactgttttcagggatgacaagaactttattcagattgactattaaggatattgaaaggaagtttgcttgcaaaagtaacaagaagactgttggtttaaggacattgggagtttgttgccattaggtccatcatttgtaccaactcaatcagcaaaaagagccaactttgtcacacatgtgcaacaaactgtcaacatgtaaatggaccacatcactaacaaggtttctaatggtatcttactatccttaaagcacagtttagttgtcgattgcagtttaaaattaactaatgtaaaatttagaaagatacagggcttcaagggaactgtacccaaaaacaatagaggctgaagaattggcagtttgctcatttcccatgacagtgtcaaaatacattgtgtcagacacgtaataacctgatgtgccacttccatcaccatacgtgaaagtgtaaccacatgggctgttgtctgaagtctggcagactgcttcgcttgtttgaagggcagctgtacacctatcatctgagcatggtattttggatgatgttgatgaagtgtcaggattgaagaactccaactggatctgaaaaacatataaagtaataatccaatcagaatgaatctcaactgataggtaagtccatctcaagggataacaatgctgttgtatgcatgtcatagagataaggataagagcgcaaagaatgagatgtctcacattgagcccacttgaagatgggcaaccggtgcaagggctgcacgctacccataagatgtcactgccagtgtcaatctggacaaaatattcttttggtgggcttcccaatttcacacgcgtaaaatagagcctgcaaattcaaacactaggaattaggataaagtagttgcaaaaaggtctcctaatttcaaataacaagccaaattgcaaaatgaaaaatggcatcagtcctacaattcttctgattggaacccactaactgcaattgataactctatgtattatccaaggttgagtcacgtcatcttcaaaattatatccatcagctgacaatcccccaacccaacaaaaggacatgtatcctttcagtccttccatccctgctgaacgtcccctttttgctatctgcattggcgagcatgcttccctaatcatgatatgatatcatctttacattagcatgacactaatccaccctgcccatcagtagtaactagttatagtcatgtttgtcatttttaacaaaaccattgttaatacatgtatagatgttatattatatccataattatggaaaaattgcatccctcaaattccctctacaaagtagtatccactactagttgaaggatagttccaaaacggaggttgggcaatcacataacatttctaaatttggaaacaaactgaaacgttcatcctaacaaattcaaggattcacttaaagatgagcatgtttacaaattgccgcccatcagtaaaggtttaaacacatgatactccaatacctcaagggagttcatcaacaccacagattgcagatggtaactaactaactatagcctatggcacaaaaccatgaagtggaattcagcatgatggaaggtgtgatagcatataaagcctacaggtattggtgaaacataattgctccccttttaaggctcgcaaggggcaattaaaaagttccgtctagcagtccataatatatcgctccctattgctaagatatctctaaataaccctgtcactaagcttacaactggtgttgcacaaatttgaattgattacacaaacaaaagttaaatcatagctgagggtgacaaattcctaaccgcagctaagacaaataaatatcttttttttcctaagaggaattgaccttaagtaaaagcaatcgaggaaaatgaaagaaagcaggtattgcggccaagtgaaactgtgacgggcaaccaaatctctgtaaacactcgatccagtagaagcaaggtacgggctaataaatgaattctttcttctttcagaaaggaaaaatgaactctttctttacatatgaatgcatttattttattttaattggagcaagcaaacgcatcactgcatcagaattgggctcccgaatgaacaagcaattgagcatcgacattgaaacaagagaagcaattgaatgcatataaagaaagagcgaagtcagaatcgtcgcatcgaaaaagggacaaaaacgaatctaagaatccgaaagaaaacaagccgccgccatctacgacgaacaattcggccaaaaaaaaaaaaaagaaagccaaaacttcgaacaaaacagaacgagaagatacttttcagaatgcacacaaaaaaacatcagcaagaaaccgtcgagtaagggcataaacacttcatcagggttgaaccttcatccgagaaacagaaagaactgaagcaacaaaagcccacgaacaacccagccatccaccaccctgaaaacgaactaccattgtcgatacgtgagaccaatctaccttagcagaagcaacaacctcagatcaacgccgagacgaacaaacccagaagaagaaaagaactcccaaatttctcgatcacacacaaccacacccatacaaaacacagggaaaagaaagcgagaggcagctcacccacccgaccatgaacgggttggcggagccctccacggggaagtccaccacgccggcgacccctcctcctcctcccccgagcagccccctcctcccgtgccgcgccctgtcccgctccctcaggtgctccaccgccacccccttgtgcggcagcgcgcgctccagcctcagcgccgccggcaacggcgccgcgcccgccccagccgccagcaccagcgcggcgacgaccgccaccgccgccaccgccgcgaactccggcggcctcctcatccggcacgccgccttgcagtcgccgacgcggcgaggcggaggggtggcgcggaggctgcgccgctgcgcgtgtgcgcgtagcagcaactttttttttgcgtttagggactcgaaataaccaggatttagcttgccagcatatatacccccctccaacttgtcctggattgtaaataaagaaagtttcaggggtgagaggtgaaaacgcggggggacgggcaaaggattacgtgtgggctctgcggttgccactcttctgctccgccgctttatagcgtgtccagcattttttcctccttttctctcctcctcttggggttttcctttcttggttttcctttgcttctttgctgcctttgacccaaagtgatgggtttggtttggcttagtttattcaaacagaggctgccatgccaaattccacatgaattttggggaaataagttcaactcctgcataaaccatggcaaaagaaaaatagaattccaattgtcccctaatttgatgatgatgtcagtagtgagagctcttttgttcttccttgtgtgttccattttcttgattggatatgatggatgatgatatattgagatatctaagaaaattcttgttgcacatactatgggtcccactgctagtctaatgatgcttttcattagtacaattgtgcaaaaattgcatttggggaaagagccaaagaggggaataagattactagatactccacctagtttataaaagtattctcttgcatctttgcctttagcatttctcctgcgtccaatagtagcagctaaattggcgttcaaaaaaaaatactagcagccaaatctgccattcaatttgtcaagtttcaacaacgatctacaaagaaagaaacaaatcaacaatggacttctataaatacaatattttgataataatttcttttttcttagaaaatggagtaaaacccattctatgcatccaaagcggatttacgcagccaaatttgatgtaatttaatgggtgtatttagttcacgctaaaattagaaatttggttaaattggaacgatgtcacggaaaagtttaaagtttatgtgtgtaagaaagttttgatgtgatggaaaagttggaagtttgaaaaaaaaaagtttagaactaaggccctgtttagttcacaccaaacttcccccaaactttcaacttttcatcacatcacatcacatccaaaactttcctacacacataaactcctaactttttttccaaactaccaactttccccaaacttcccaccaatttcaggaactaaacacaacctaaggccttgtttagttccaaactttttcttcaaacttccagcttttctatcacataaaaatttttctacacacataaacttccaacttttccatcacattgttccaatttcaaccaaactttcaattttagtgtgaaataaacacaccctaaactcggcctctatcgtggacaatcacagtaagaagaacatcagaaaacagtagagcactgccacctgacatgggacattcattttgtgaattctgaacatgctaatctatctatactgtacctaacaactacagtaagcttcatggatacagtatatgccctgcatctcgctaaattatactccagttgcaagtatgcaacctctaatgtaatgtagagtactcctacctaacaatctggatgggaccaatcattttctctagaccgtttgacaagccatatcttgaaaacaatttctgaatctttcaacgtgtgctcatcagcaggaactatacagcagcaataatagaaaaacgtgcatgagtgagtgggagagaaacttctcccctgagctacgaatgttcctacccaatgatcataacatatcagaaagaaaaccttcatgtctgaacaatgactcgatcaagggcatcttttccttctccattgatggggcaggtagaaatcttcatccagttaggtggcatgcctttgttgggaagctactcccccttgctggatgatcaagtggttcaggctgaataaatttgggaaaatgcttttcccatgctactgatgtaattggtgctttgcaaagggagtgtcagtgtcatccttgatattgcacgcgcattggtatgatcttgtccaaaaatatttcctgcaccaaatgtgtaggtacgccattgattttgatatgaataaagggaaattaattatgtggcccagtcctggctcaggtacatagatttggcgtttcatatatcactggtttctctatagttgtaaacttttttttttgcttaagttcagttttgcgtgaggtatttggcgtcactgtccttggtagcacaaatgcaatgattttcatagtgtatttatgaaattcaacaggaattttcttgggagcataattcaatgcatccaaaatacgagtactacttttggagaagcctgtctgtctgctttctggcacggccacatgtgattagcaaaaaacaagcagataatggtggtatcaatgtcaagaattcccttatcaaaagatgccaaatgactccccccaaggttcacatttcttgtgtcatgtgccttactaatcggagcaaagaacaacaacctcatcagaagattggccagataagtaggtcaagcaatcagctaatccagctttgctgcctacacggcacctagctagtgcctgttgccttgcgtcgtcgccaacacagatctctcctgcaattgcctaatgccaatgcgacatcctattaaaatctttaatattgtgatagcacaaagcctctggttcattggggtagttgattagattggttaggataaagagttgacaaaaagatccaatcttttgatctctctctgcctttagcacagatgttgtttattgtgtgtggtacagcatgacaaattcccttcagagattccctttaggcctttactagtattgtactgtttgttttataatgatataatgattatgatgatcaagtaaagtactggttcaatgtcattactgttcggttgaactgtatactgtactatttatattgcttggtctaccaattggttttgagttttgacgcattcagataccgtgcttgaacaagctaaggtgtctagcaacaacgagcttgactagttaatcaacatgaatgtctgttcagttcagctgtttactaggaccatcttgtcgcgaggaatctaactggtaataatgaaatgaatcttaagccattcaactcaaaacttggaacagacaacagagtatcactgtccagcagcccctagaatagttgtgcccactaatgttgcttgttgaactttttatgtaaacaaaaaagtgtgttgcttgctcaatctgtcgttctccacttaatttttttccatgaacatattttcaaggcaggtttaaaatactattatctccctcaaatgtaaggcaacttgttctggtccaatatgctgtaaatttgttttgtttttttcttgatgcctctcattttatctacttgttgtcctatcacccacagtcaaaaaagttcgaattttaatatttagttttggagttagtttagaggatttcgttcatcaaaatttactttccagcattagtttttaaacatgaaataaattatatctacgaatatatttttggttgcttaatttattttaacgagctatagatcaaacaatcaatctttatctgaagggaatgtatcatgttgtaccacgcacaataaacaacatttttagtacacaaacacacacacacacactcttaaagagtgattttactgccttgatccttaaggaggtatgggtgttatataagtactgcattcgtcccaaagaaaacttaacctagttcctagtacaatgaatcttgtctgtgatatgggcccggggtatgtgaagcgtgggggagttaccttcccatttagccacgtggccctacagcctggtcctcctcccacacctcggaagttgcggaagcagctaggaggcctcggggtgccaagtcacacccctcgggccctcgcgctgcctcgccccgaggccctcgggcagccgccatgtggcgaggggagcgagcggggaggaggcccaggctgagccgccatcaatgcgcaacaccctaaccgtctaaatgcggtaggggcggacgtgtggtgcggtccgattgacccacgtcaatcgggcgtaaccagactgtgaccggcctgttgccggtcacgtctgatcggacgggcgaccgtgcccccacgttcgcccctgtacccagcggagtggaggcaggtatgccccgtcccatcaaaccatcatctgcagctccctccatgcgagatgaaccgccgaaagcctctactcatttaagagggaatgacagggctgtcccccatgttgagtggggggcggcgttgggtcccactcaaggacggactgctgcttgacttccgggcgaaggcaaggatcgtggtccggtcaaggtaaagtgggtccccctcccgtgaaagagtaggtagaagcggtgcatgtggtatccccttgaactataaaaggaggaccttgcccaccgagaaaagggacgactctcagttagcctaagccccaggggaagaagagggaattcctcctagagcttaggaacctttgtaaccctcaatcttaaatcccacacacaggagtatggtattacgctcgatagtggcccgaacctgtataatcccagcttccacgtgcgatctagaagcactcagggcggatacacgatctcgacacgcgagccttttcccccggccgaactcacaaaagggggatctcacgatctcccgctagagagggtcattcctcgacaaatctggactatcctttgtccagattcattgtatgagtttttttgacagaggaagtattgtataatttggtacctagaatagatagctgctctttcttttacaactattttgtctgcgctgcttttcctcaaaccatatcgtcatctaatataaagcgtattataaggaaaaaaaacacacacactataagactatactccctcaattccaaaatataaggcataaccacctttaacccaaagatcaagaaacaattattatcatctctttgtttgaatcaatccaattaatacaatacatgcacccaatagaattaaacatctagtgagtgtatgatttaaaaaataataatttaggagagaagagatgctaattaattgccatgcatgcatgcatgccttatattatgaaacacctttaaaaagtagttgtgctatatatttttagaatggatggagtatttcagtagataagactaacctcaagttaaacaattagctttgcccttaagtaacctgaggggggacaatggtttggaaaaaggaaagatcccagaaagggagcacccacaagagaaaaaaaaaactaaaacctggccagagatgtagacctatcactaccgccttttaacacaaacaagaacccatcagagcgcctgcagccaatcacccaacaaaaggtgtcccctcacactctcacgctgcataccccacagggagaggggaagaaaaaaaaagaggtaaaaatcaaaaggtacggagaggtatagcagcggtactttggtacggctgtgtgttgcaaagatgtgttacgaattcggagaccggcaaggatcggcagcacatgttcaatgctagatcttgtggtgtagaaggaggagagatgtgtgtatcgtgtactataaaatgcatcacgtgtggtggcatgaatatgtatcatgatgtatacttggagagagattctatgtccttgtgagaagatgctgggatatgatagctttaggggatattaattaacattagagaggtgttagttctcaaattcacacttaaaaatagagtatcattggtaaggtgtcataatttgatatatcgtaattttagatcttaaccctatagaggtattaggagataccaaatttatatttaaaaatagtttaaccgtggtatctcctcgatggcatagatatagtatattaagactcatgctaaatatgatggattatcgtggcttgctcaagctcctaaacaatgagtgtgttcggaaagacgagtttgtggctgcggcggcaataaccatagttcctctactacttgtggcactattgatgttggttgcgccgcaaccgcaaccacgattgctgaacaaacccaatgttttttctaaaaaaaaaataatcaacatttttttagatttttttcatcatttttttggctttctaatatctaacttatttgtttgtgccctcagaaaattattataccctcaatttcatccatcatcagtgagcactttagaactggaccagtgatgtttcaaatgtaggaaagttcaattctcatgataattagaataacttcgatgattatccacgacactgttatggtgcataaaacgatagcaacaggagataaacaaaggtacatgccatacgcgagtggcataacactcacccaatagcccataggttaagatccccagcctagtagcagctctcctaggtcctagctactccacactctacttgcaccctcttcaccctcttttggctcttcaaaaagagttcattcgtgcgcttccctttttgaagttttgtttggacagcaacttgcactccctccctccactagctctcaaaccgaatagccaggaggcccgaactcactgcatccactcgtgaggcaggcaaccgaccaccgacccaacccaaagatttattttaccagaacaagaggttgccactctccgacaataagcacattcatctcagtaaatagtaaaaaaaaaacaaacaaaatttattttggaaatattcttttgaattttgttgggaatgctacgaatcgggatgccgacgtttcagacgaaccctctccgaaaatattgtttcttctccttaaatattttttctactaaactacttatctgaccaaaccattatatccgttgtaattaaatctttatgacaagatatcatatgattatattatgtcaagagaaaaacatgtgtttcaagttgttaaaactcaatgttttatatgtgatagtaatatgtttcaatgcatgtcttgagtgtatttcataaaatttcaaactacctgccaccactctctctccacctttattcatgcatgcatgcatacatttaatgaccttcaaaacgttttttcgctaaaactatttatctaatacgtgatccgatcacaccattatattcgttgcaattaaatttttacaataagataacatatgattatattctgataaaagaaaaacataagtttcagtccgttaacacgcaatgttttatacgtgataatgacatgtttcaatgtatgtctttaccgtatttcacaaaaatgttactaaatgtttcaacgattgatttttttatcatatataactcaatgttttattggtggtcaattataatatttgaccgaccgaatttttttaaaaaaaagatcgggcgcccgattcaaatattcttccgaattttgtcggtcatcaagttcttaccattaccgtatcctatcactatcggtaccgcccggtaatcgtgatagttccaacttcatatatgacagggtcatcgcgtagtcaagtcaattaaataacactcctaccgaacatttttttctgtttccaccagtggagaaacagaagagccctccgagtctgcggaaacggcgcccgcgctttccccgctttccccctcctttcaacggccgtcgcacatggtgaacgcagcagccgggtcggggtcgcgtacgcagccgcattcgcatccgcatcggcagccgcagccgcagccgcagcccggtaaacgcacgggtgggtcgtgggtggaacgccgcggacgtccgcgattcttccgtccacgcggttgcagtacacacactctctctctctctctctccccccggctcccgcggaatgccgcgatacgagtttgggagcgtgcgtggcgtgggcgcggttgcgttcgcgtgcgtgcgtcctggcgggggagatggcggcggggcgatgtagtcgaggcgaggcacggcacgtaaaaggttcgtctagaagcagaagcagctgaaagtcatggtagcccacgcaagagaatcaacaacgtgaggacgagacccgggggctccgttcgctggatgggaatatatcatttcgggtttggtacgacgtgatgcttgatgaggtgatcagggagtaaaataatggatcttcttgaatcttgattgaaaatggttaaaaaaaacaatcgactgagctcctgtctagactctagaggcatcttggtggtgtaaattttggggagaattctaacaggagattaatcgatatacattcgactaaccggtagtgactcaaacgtgggtattcgctcgttttcgaaacagttggggcgagtggttcgcggttcgctatcattgtgtgccatggtccatggatcaccgcacacaccaggtaaagggcaaactctttccgatccaaagacttcgccgtccttgacaacggcccatgtcaggcgagaccatcgcgcacttattattacgagtaacatctcatcctcctcaaaaaaggttttgtaacatgaacatctcagccaccatatcaacgcaatgatgctgagcacacttcatttctgacgctggctgcactgcatttttcttcatggtcctacgtaccgtattagcatgatccttctgccttttagttcaattaggtacagtacacagaatcagtaaccgtgtgatgtacagaaagaagtttggggttaccatgtagacaggcacagaaaatggaacgctaaacatctgtggtttaagggaaaagatacacgctttattgatattttcaagtgtacagatgtgtgaatttaccctcaagctttgaaagccatgatcgctgcggttcaggactgttcaaatctaaaacatcttccaaacctccgagccaaaaaaaaaaaagagaaattaagaaaaagaatgaatggactccaaaattcttttgcacgaatacatgtggcctatccacaacttgatcgagcccccacaaagagcgtactaacatcagtagtaagttgcacttgcttcccctatataccctgtaaaactgcaatcatgaagcacaccaaaactgcaccttaatctccaaatcgcgacaacttccatatctgtagtgtacataggcagaactagcgagtcgccaattgagcttcaccattgaagatcaatcacgtaaaatgttaaggggcgctgtaggtcgagccaagttatgcagtcccaggttcccagctgtggcatacttctgtaagcaacagatatccaatggcgcagatcatgttgtccctcgacagtttagccattcacgcatgtcaatttgtattaacatataggatggggtgaagatcaaggattaaacagtgactatggatcatatcgagccccagatgtgaaagatgagaagaacccagctgctggtccaggaagaatgtcgctgagtttgccaacctgcccatcagagattatggacccccatcttgaagtgttctccccaaatttgctcccaacctgataaatgatgcaacatggagctgagcattgctactgaattagggaaaaaaacgcatcacaaagctgctcaatgaaggactataaagaaacaaatagagtatatatgttttcagtgccacctgctcaatgaaagactataacaaaaatcaaacttctagataaccgataaggatttggttgacttgaaacaaatgttatgcagtagtgataagtgatactaatcaagacatggaaccacctatattcagtccatagttattttttctgtgttaaaatgaagtaaagtcttattttttctgtgttaaattgaagtaaacttttgagtacttcctaccaataccatgcttatgccaaaaaaaaaaagatgttcagccaatcaagaattaatatatagaatccatatttagaaatatccacatgaaaggtctatattttgtttcagtaatctaaaaaaagtaaatgtgaatttctgatttaatgtgatactgcaatccaccatttgattttggtactaggcatgctaaaaacctgccataattgacagtacattgcctatacaagcttatgcagatatgctggagatggaatgaatatattggaagagaaataggcaagggccttatcagatggcttttggctttaagattctctatgaggagggtcaaggagattttgttcttttatttaacattgatcgacctttggttgatatatatcctaatttcatgtactccataggcacaacaaaaaaggacatccatatatgcgggattatttctttacttttagtttttactattttttactatgattactggtcactggtcaaacaagggtaaaggcatatatttgcatagtataaacctattagatatactcaacttagtgtatgcaagggtaaaggaatggaacagatctgattatgaataggatatccatttttcttgtctaggaatttgagtgtttaccttttaattaccaagggttaaatgctcccagctggtagctgcagagccactggtgaattgatagtattttggtgattttctcctcacttgcctcacagtgtaactgtctaaattaaaatcttcgaattttggtatgggttgatccaaggacaaatatattctccaaagagatgaactttttttagatacagaaggtattttattctgaagcacaagatgtgctagatccccaacctctgcccaggggcacacgaccaaaatgcattccatgatgttctagaatttcagcacatgttttttttatgttggaattgatctgggattatcctagccattcttacaagctgctaataggcgttccttttccttctttgcaccgaccacaggtttggaggatggaattaggcaatgtgacacacatgactacagtggaacaagttaatcgtgattgcaggtttggatatggcattggtaaggtgatgcacatgacgtaagtggagcaagttaatcacaattgcaggtttggaggacgccattacttaagcatatttttctgtcataataatatttggcatccatatgtttgtacacctataacatcccaaaattatctacctgaatgttctggtttgccacatgcacaccacagtactattgactatttatgaattatctgaaattcacattttacttgtgtatgctgatggttccctctgcccaatctcaattcaaagggttataagtcattttccttataatctactgctaagttcctacagaatatttgcctttatatgtataaaaaaagtctaaattgttgctgtacagatttcacacacatgatttattcaatagtttgaacatggataatgtgctttgttcaatttcctttttaaaaatctaagatttgcccattggattgtatctcagatttttgcatggtcttagagacttcaactacagtctggaaataatgtaatggtaaattggtaatgtctacatatttacagattgcgtgaactctctgttctatttttccactgacaagtacataaccatatttagatttgcaatatatgctacatgtaataaaaagtgacaatgaccatatctgaaccatatgaactttgcattctaaataagtacattgatcgttccctctgctagatcatacttatcagaaatacatgtcttttttaaaaaaataattattgttataatttactactgtcatacccaactatgctgttgctccaacaaaagaccatgtctgccactgaaccaattactgtatcaagttcatcttgcctgctatctgaagatctacctagccatgtttgctgttgctctaaccaaaatgaggctctacggttgttgtgtggcatacaacttttgtatttgatttgaatttagttttacatggcttgaacttgggctcgcattgcgtaagaacttggttgacaacttactgaaaatagaatttggtcttgcattatgtgcaaacctgtgtaatgtaatgtactgtttctattcagaacataaacatgcatattttccttgtgagttattggtaaggtaccgagttaataattcctgacagcctttagaattgtaatttttttattttggttttgttgctggttgactgccaaatgtttataatttctgtacaaatttcctgggagcaaaaaatagccaaacatatctcatgttgtgtggtccaaaaatcaaaagaaattatgttatgcttttctgccgtgctgatgacaagtactattttttttatacaaaggagatctcaaacctggtatacatgttatgtatggtgtcttaacttgtccttgcaatatgtgtgaaccatagatgtctgaacatttgccagattagtgtttgaacatttcctatattattgtctgagcatttggcacattagtttctggcttgcccttgtggtgtaggagtatctgaattcagaatctgaacttggacaagcatctaaatgatgttcaatgttttaataatgctgtgagctgattaatgttatggattcttgtagctcaagtattataacttcacaaattcaccaaaggatgcagaggttttcctgagtttagtgtctgaccatggtcattgcaatttgtgtaaacaatatactcctattaccattcatggttaggattggatatctgcaagttcatactgaattcatattatataagttcatacttaaccggcttggattgccaggtaagatccatattattgtctgaacgtggatatggaatgcatctgaatttagtgttggacatacccttgccatgtttctgaactcagtgtatgtatgaacatgcccttgcaagaatgtgccttgcacgtgcactattactagtaaactaaaaatatgcagtaggttactcacctgggtaacaaatgacttgagcaatggagcagcacctccaaggctaacattatcatcaaattctgatgccgtagatctttctccatttgaatatgatttccaagggcttctagatgtggaatcatcggatgttgactgtaatgatgatttgtgtgctcttgatgatagagctggggcactacaagtgaaacatatgaacatgagacctattagatctacaaactagtgtaatttttcatcagaaccagccaacgctacttacaaaggtttctttgaaaatcaactttcacaccaggctaaaaaacatcacatatggctgtccaataatatcatctcatcaagtattttaagcatgaatttaaacactatagctgtctaaaactaatgaccttaatggattaattacagaaatatgcattatacgacgataaaatgtatgtgtactcagtctgaagaattatttacctgatcggtaggtatttgaatcttgggacttgggagcacctcataatgtttgaatctgtatttgatttagtcggtaacttttgcacagttccagtatacatgtgattcagttgaaccaagaagccgaaaagaacaacatagcgcttgtaagattgcttctcattctcccacagataaggttcgtacctgtttcaaaataagcaaatgcttcatcatggacaaatatggagcatgggtttttgtctataaagactattgatcatgcattcagctattgaattatgtggtgatatgtataacaaagtaaaacagaggatagtgcttacgtagcccagtctatcggatccaatctctgtgagaacttattgatcagcttgtttataggctctatggtagctgaatctgcctgcaattgtgactgttttctcctgaaggaagtcttagcaatggcgcttggcgaagagtcatgtgttctctgtgtttcagtagttttggtggaagaacttttgcctcctgacagaacatcgccaatgaagcgcaaatcgagcagtatttgcagaacccccttttctgaaaccagagatttaccagactcgattgataccaaaaagctttcatagatatcaataacctgcacgaatttaagtagctgttaggttcagtgattatattggcttttaaatcatacactgaacattttctcctaatcttcatcaatgcaggtagacaaaacagataattgttaataaagcaacacatacaacagctagttcctcggaggttctcaaaattgaaatattgatgacagttggaagggcgaggcattcaggttaataaggtccatgacattatattattagggcacggtattaatttttgtaggcgtgtgcaggtaaactgaagactatagtgcccagcttaatcaatgcttgattataagaaaaacaacaaaagctgaaaagcttgattaacttataactctataattactatcaatcatagtagtaatgaattgtagaacagtcattacattttgccaatagcaactattgcacatataacataaacaaatggttccctcgtagtatctattgttgatcatcattacggtatggtcaaatttatacaaaggcaaaaacacatgaaagtgaactatagctagttgtgtttcatgcagatagcatgataaaacattctttggttcttccattctttgctagaagttccaggccaatgttttagcctataacatgcaccacaattacttctcgtcaccccctcaaagaagaaaaggttgtcatgaaagaacattaccttctgtaacaagtcccatgcaaagttttgcaatatagatttgtccaggatgtgccctccaattttatgaatctccaaacatgcttgataaagaaaggatataatgtacagtgaaggcattgatggaagtgctatttgcatctccaaggggccctcagtggattcctcttgtttgatgactgtgacttcccatccctgacaaggcacatatatcatgtctatgacaatcagcatgccatgtttattttggcattaaaatagcatgataggactagaaatcaacgttgaaacacatagtcagaatttaatatttgaatatagacaaaaatcgaagcacaaaaactagaatcaaaacttggggttagctgcttggtcaaccctagaaaaggtgagccagtaagtatagctctatcgaatatcctataatagataacttcaaaattggcattccaataggcaaaaacaaactctacaggcccacgattttattcaacaagttctttgtaaatcataagggcacttaataaaagagaaatgtcttctagctgctcagtcatgtccaacatgatccaaaattattacagatttcatcattatgttactaatattgctgtatatagcagatgtctttgttacctagcaaacaaaagcatccccgattgatagtatgaataacatggacagaatcagaaacagcagtaagaaatatacttagaatgccttttacccgtaaaggggttggaaagataacaattggaaagataagagggacatggagcgtacccgtaaaggggttgataaggacaatgaatcatctttgttgaggtcatatgagagaagctgtgataattcagtggacaaccatgctatccacaatccatgggctgcaatgcagagtgcctgtaaggtcttgtttagttcatcaagtctgggattggagctatcatcagcaccaaatagggaagcagcagcagcaatagtttgtcttctggggttgtcagaaaattgccttccaggactccttgggcttgactgtgtgtgcctcctgggggtaaaaggcatcgctgtatcaaacgatgctcttgaatgtcttggtgagggcgacgataatctcataaatgctgcaccaccagcctcctttacccactgccttggggatcctaggatcaagggtacatgactcgagtggtatctcaatgcaaacatgaggcggccaatgaagagagatctctccacgataacagatgctgcaagcatattgctctccccttttttggttctcaaggaagcagacaattttccaagctcagcttccaatccattcagtatcccagagatggtcttatagcatttctcttggaggtatggcaccagctccttcaatctgggagcagaattgtgcgagtccacaaaacttaacagatcctcaaggatagtcttgcatttgctgtcaattgcattcctgatgcgactaacttctggcccaaaatatgaggtaaggcagctgtggaaatcattttcatcagcaatcggtttcaaatgtgccaaaattccacctttcttgatcttagactcagagaaccagacaccacctccagttgaaactttccgcaaatacaccatgaaatcaccggcatcctttggatcagcattggcaccaataccatcaattgatttcttaatatttacactatcatccaagctgccgaattccaagtgcacaatgtctttcatccgttgcacaaaggcttcttccatccaatcctcaaaaatgtccttcccttccttcaagatgaggccacggatctgatcccatggtgattcaatctctgatccaaacacactcttcagccattgctccagagtcccttccagtccttccctcccatctaatgcctcccgcacaagtctttgcactgatccaagcccttccccactctcaatggcatcaactagtctttgccctccagcaatcacaccaaaaatctcatcacagcatcccttcagccaatctgtacaagtccttgcaacagcatctggctcaagtagcaccatggtggcctcaagttgatcccagtgttctttccacaaccgtgtctcttccacagggtctggaatgccaccgaacagctgtgaagggggcggcaaatcgagcaccgtcttgaaaaacagtggcaaatcattgagcgcaagcacaaacaactgcccgacatggcccagcgtgacacgcacgatcttggcgacatcgcacagcacggaggagtaggaggtcagatcggaggcaagggtggttagggcttgggagatccaggcgcggcgggaggagaggaagagttggagtgcctgggtcggggtgagcgacggtgcgtcgattgaggcagcggccgcgagcgcgtcggcgtgggcggcgacggagaggcggcggtcggcgaggcgctcgcgagcgcgctgcgcgatctggggccggaacgcctccaccagctgcgcctggtgcgcgagcagcgggaaccgcgcggccgccgcggcgtcgcgggagagcacgccgtgcaccacctgcgcccgcacgtaccgccccgcggcctccaggagcaggccctcgtcgagccgcccccagatgtgctcgggggtgtcgacgaggtacttggcgcgcgccgccgacgcgtagagccggacccgcccgccggacggggagggcgatgcggcggggggagcctcggggggcggcgcgagcgacgcgagggagtcggagatgcgggagaggttgccggagacggcgtcggaggactgcttgatgaggagtatcgagtccgcggagtcgaggaggtcgcggtagctgcggccgacgagctggcggagctcctcctccttggcggagatctcgcggcgcgtggcgccctccgccgcgcggatctccgggatgcgtctcgtgcggaacagctcctcggcgtcggccgcgccgccgccggagactgccgcggcaggcatcgccgcctagaccttggagctcgcggcgagatccaggaaggaagcgatcgggattgaggaggaggtagggaggagactgtgtgtactaggagatgcacgttcgtttgagttgggtagaggaggtgactgagagcggtgggtgcaggtggaccgaggggtcgtcagagggtgggcccagtaagtcagagacccgacaaacagtacaccgggttctgggagtgatcttgtgagataattgttgcgagttgtggcccgtgggtttaggttgtatttaggggttgtttggttgatgcgtaagcttatcataactaagcttaggtaagttgtggcatgtggcaaaagtatggccaagaaatagttaatcacaagtgtggcaatgttagctctagttatctgaatatgacatgtgggacctaagggtaggaaagtgtggcatgacacaattgtggcattaaaacaaacacacgcctagaaactgtggcatgactgaagtgtggcatggcaaagtgaagcaatcaaccaaacacccccttaacgttaaaattggaagtttgattgaaattagaacgatgtaacggaaaagttaaaagtttatgtatgtatgaaagtttttatgtgatgaagaagtttgaagtttgaagaaatattttggaactaaacacggcgttagcaaagttgctaaatgtccatattttcttggcttaaattaaacaaatctagaacaagatgtatcacgtcccatattatatttgtttattttttaggatggaggtacatagttagactgttgtgaatgcttgatgcatagtagtccataggtctatttgaaatattcttgtaatgttgatagtttaagtcactttggttgacaacttaagacttaagcaccttcattgttaagtgatacctctgcatgatcattatctacatactcagtggtagaagaagtagtagtacatggtatccatgcaatacttgcattaggcagttgtgcttgacagccttgactcatgcatggggggtgacaaatagacaaagcatgtcctaaccagaaaaaagcctgattcacttctgactaagcccaggtcaaaactcttattgggcccagtctgaggtctaatcaaccaaacgatgccggccttgtcaagtggggataaaatatgaaatggccatgtgtcttatttacttttttttattatcacaggttatttgctttatacttctaataaaaatatgctttattaaaaatattttatatagtgtatttgtttagaccacttattctaatctatttgtgagtttcatttctaaataaaatataaatgtttcgtgttaatgaagtggacaatccatctgaataatctgcgcaaaaaattgtttcaaacatggcccaccaaacaactaaacaagacccgtatatggcaatgttaactaaacaagtccaatagtttgcatggcaatgtttgccgcatagtatgattgcaagtctgtaaccttgcattgaacgaatattactcctggtcagacaaaataaagatcaattgccgttatatcgtctattgtctatacagtagttctttttttttttagaaaagtttatatgctgtgtttgatacaggagttcccaactcctccctttcgttttccgcacgcacgcttttcaaattagtaaacggtgtgttttttttcaaaaatattatatacgaaagttgcttaaaaaaatcatatatatacaattttttttaaaaaagctaatatttaaataattaggcactaatagatcgctccgttttccgtgtgtgtgatgggttcccaacacccaccaccgaacacacccatatagcagttggtatgcataggataggaaatgcttggtaggtcaaatatcattggtcctttaggctgagttctttccttgaggttcctaactcacctcattctttttcacgcatacatatcccaaagcagtatagaatctgtctactcccttcgtctcgaaaaaaacgaatctagtactggatatgacatattctagtacaacgaatctggacagaggtatgtctagattcattgtattaggatatgtcacatccagtattaggttggtttttcatggacaaagggagtacatgatttttaattaaataagacaatagtacgatgaatcatgaaatcaagcaaatcaaatcatagtataataaaatgctaaaaagggaatgtctgagcttgtaaaatagagataaacaagtgactatggggtaggcatgaaaacggatcggaaacggacggaaactagctttatcatattcgttttcatattttttttcggaatcagaatcggaatcgaaaactcggatacggaaatgaaatcgaatattatcgaatatagatacggagcgaatatgagacggaacgaatacggtaacgaatatttaccggtatataaaaaacccctcaaattgagtttcttgatcaaggaagagatatctcttattattttagttcaacatctccaacatttatatcgtcaattttgtagacggtctcacacccgtatgtgaaaatcgattttcatggctattcctctaagagatccatatgcaaatatgattatcattttctattccccaagaccttttactagatatataacttatttaccctttataaattggagatgttatttattttacttcacatcttcgaaacttgtaatatttgttttatactttaaatgctttcaaatacaaatgttataaactacaaagtagtagatcccgttgagctctataactttgatatggaacacatctccatcagatgtcgtttgaattgtagatctgagattttgtaaaaattaatatggtatattataatgaatatttagacccttaaatgacctcaaataataaaatagtcaataagaaagttgtagatctcatcgagctctacaatgttgatataaagtttgtcttcatctgatttcgtatgaaaaagttatttatatatatatatatacacttattttttctaaaatttgctcaatgtgtgcggatatccgaaaaaaaatacggatagtttccgaccgttttccgattccgacggatagtacccttaccgtattcgttttcgtttccgagaaaaaaaatccgaattcgtttccgaatccgagaatttccggatagttccgaccgaaactgtccgaatccgaaaaaaggtccgggcggacggaaactatccgaaccagtttcaaccctactatggggtgcttagatccagggtataaagttttggcatgtcacattagatatacggatacacatttgaagtatcaaacgttgtctaataacaaaacaaattatagaatccgcatgtaaactatgagacgaatttattaagcctaattaatccgtcattagcgaatgtttgctgtagcaccatatttgtcaaatcatggagcaattaagcttagaagatttgtctcgcaaattagtcgtaatatgtgcaattagttattttttagcctatatttaatacttcatgcaggtgttcaaacgttccatatgacagggtgaaaaaatttggggtgggatttaaaccagtgttgtggaagacggtatacggatatcggacggagagggtaccgccaaacgattaatcggaatttggcggaaatataacgttttgaaaatatatgtacatagttgataatagttttccctttttgataaacaaatgcatataactaaatatattccttctatatatccttaaatagaataaccatgtatgacatttaaataagttcataatggatagctgttactgtatatctcaattctcacgtagtaatgggttttgttcataatgcttgaaatgataatcaagagaatgttacatagcatagatgaccgtaatcaaggtcccaaataacatatgtatcggttacctcgaagagcttcatcaaatacaaactccaataacgtgattatcatcaaaatcaaggaacccatgttcaaactttagaggaagtcagttccttgtcattttacatcttgttgccttgtgaaaatttcggaagagcttgtagtcagtagtagtaaagggcacagctaacaaccatcatcacgccgacgattatacggttgattagacggagatggacgatttaatcggtaatgatcggatttatgcgttcgttaccgactaattatgaccgcatcgacgtgatgtgacggtctgatctccgtattcgtattatcggacgtattaacggccattaacaccgttttccacaacactgatttaaacaaggcctatgggggtgtttagatcccatcctaaaattttacacctcatcacattgaacgtttgaacacctgtatgaagtattaaatataggataaaaaataactaattgcacggtttgtgactaatttgcgagacaaattttttaagcctaattgtttcatgatttgacaatgtggtgctacaataaacatttgctaatgacggattaattaggcttaataaattcgtcttctggtttactgatggattatgtaattagtttttttattagactacgtttaatatttcaaatgtgtgtccatatatctgatgtgacacggcaaaaaattttaccctagatctaaacacaccctatcttaacttttctgcgggaattgacaactagtactagtaaaacccatatttcccctttcagatcaaatacaagcagcctcaacactttgaccactcaacagctctactagctgagatataggcacacaagttcaatcataaataaagtacgtatgtccgcatgttgcaagctacaccctccagataattgttttacacaatggccgtgtttagttagggtgtgtttggtttgggaccaagtgggatgggctagacccatcccagttttttgggatgggatggttccaattgtgtgtttggtttgtggtatgggatggttatagttttttgtttggtagaagggattgaggtgggatgggatggacaatttttcacggacgttagggccgtctgctcccagcggctagcttccaggctgctggtgagattggggacgaaggagctcgtcggcgcaagttgaggagctcgttggcgcgagcggaggagaggcggaggcgggtcgcggacgagcggcgacggtcgcgaaggtggcggcgggcgtggacgagcggcggcggtcgcggagacgaggcgaacgcggacgagcggcggcggttggttgcggaggcggaggtcggacacggacgaggcggcgaggcgaggcgtgggcgagcggaggccggtctcggaggcgaggcgaggcgcggacgagcggcggccggtcccggaggcgaggcgaggtgcaaaggagcggcggcggccggtcgcggaggcggaggtcggacacgaacgaggcggcggcggtcgcggatgagcggcggcagtcgcgcggaggaggacggagcggcgctgggggagggagcaggcggatgagggacgagcggccgtggcggcgccgcggcagagccgagcgggaggctgcgggagttgacgccgttctgtccgtcgaagtgggatggattggtccggccgatttcggcggaccatctcgtcacggatctaagaggaatattcctctccagggaccatcccatcccactcacctctcaacaaaacacctctaaaagtgggttcatcccatcccatcccatccttgcaaccaaacacttacttacttttaaactttcaaaaattccgtcacatcaaatatttggacacatgcacagagcattaaatgtggacgaaaaaaaaaacaattgcacagtttacatgtaaattgcgagacgaatcttttgagcctaattatgccatgatttgacaatgtggtgctacagtaaacatttgctaatgacggattaattagacttaatagattcgtctcgcattttataggcggatgattatgtaatttgttttattattagactacgtttaatatttcaaatgtgtgtccgtataaaaaaaattgggcgtgaaactaaacacggccaattttcataaatcaacaagctcaagttgcatcatctgacacgcttctttgtcctggccaatttaagagctaatttccagttcattaagtgcttcgcctgtgactgcaccaaagaaaatcaacaagaaacagcaataattgcatttttcaatcaacaagaacaagtcatgattgtcagtaactagcacaaagaaagacaggcgtttaaagcaagaaacaattactagtatccaggttgctttcgtcgaatatattattattgaagttaaaatccagacggactttttctatcataaacgcaaaaccccaatatcatgtaccataaaatgccgcttatggcaagaacacgctgaacacaatttcttggctgcgtatcttctgccactaaaatgttgagccaagcttgcaattcactcaatcaacgagcatttgttttgaaagtactgttcactaccaacttgacagaattccaccacaataaaagaaaactaagctgtggaattatctaatagtaccataatagttttgctgtcattttaaaggatgggttgcgcacaaacacagattcagctcaacacaattcacaaacttatttctattgaattgccatgatttgtttaattaactgatatataactttgacaacaatgtacaaaacaactgatatcaatagtcttccatgcatcacactgtcatcaaggcgacaaggcatgcctcctgaatttagctctagaccctaccgaaacaagaaaggtacaaaaacaataattccctagatcttaaaaatggcaagcattgcattcatacatatggtcacatgtaaaaacacaaggtgatgaattgccagtgtagagaagttacctgtaatattcctcagatacctgcaaatctcactggtgcataaggtgaccatgcaaacggagttctgcggctggacatcaagcttggttaatccttgcagcgtcctcttcctcacatcaatagcaaacaccaaatgcaacttgtccatgggactgggactggttctagaaagcaagaaaacaacatcatcatccatgcttatggtggggtttaccattggaagttccttgaacatttccacgatctcgctgaagctcaagttagaacgacatgggttgctggcacccaaggtgatgtctttaacaccaacctcacagtcacggtgccagtgctcgcacgaagaaccaatcaccggcattggcatgctccatgttgtggccttccagtcgtcacggattacctgggatttccttgtgttattgagcacgcaatccacataagaaacaggagtgctggtggtattcatcggctcttttggtgaccacatttccatctcaatatacttgatagagtctctgtttcggctgatggtcacatcccggaaatagctggggtcatattgtatcaggaagagatccctgttgctcctcgctgggcacggcagagggatgtcccggagcgcagggaactcatcgagcacgtcgcagaggaagatgccacgccagaggtccacccaggcgacggtgccaccctcgccgccgaccgtgatggtcttccctgtctcgtggtacagcctgtcgacagaggcaggtatagggataaacttgtctctgatgaactcggtcaccgataaccgcttggaggtccaacctttggaactggaggtggatctgtagaggtggaggtagaaatcccagctaacgggcgcaccgcctttgtacaccggggggccaagacccagggcggcgactgcataccaggcgccgtcttggcggctgaggagggcagtcatagagtcgtggaggtacacggggtgcgggttcgggagcagatctagccgatgggcgcgcggcctgtagacaaagtagtccaaacctcgtgcgttggcgatgctgtcggggttgacggggacgcagaggaggacgagatcggcgtcggaggcgatgatcttaggcaccacgcggcggaagtcgaggccggggcagtggacgcagaagcgggagagaagcggcgggcgggcggggtggaaggtcgcctggatgcgcaagccggtgctcgtggtgcccacgccggtgctggcgttgggcaggtcagcgatgaggcaccacctgtcgaggaggaccatgccccctgatgagccgtcttcatggccgtcggactctggaaggggaggagccgtggtcctgtagggaacagtcggggcagccatgtccatggacaagcgaaggataacagatccaatcgcagggaggaaccgaatgtgggacggggtttttgacttaaaaaaaactaattttataactcatctgaaaaccacgagacgaatttattaaacctaatttattcatcattaacacttataggtttctataatatttagctattcatcattaacactaattctgatttctatgcaaactatgcaattagtttttttatctatatttaatgctccatgcatatgtccaaagatttgatgtgaccttttaggaaaaaattagcaactaaacaaggacataggagaactaaattattgtgcaacccctcctctaccaagttagtctaagagagattgcataattctaccagaattggagacacaaagatgtagaggtaagactcttcttatttattcattaacttgtgcaatacaatagcacctcctcccctcaatatataggcatagccatgagtgcttttcatatttagtgacggacctaattagtgggtaaccgggctggaccttcatgggccggtggtttccttaaacaaatcaatcagatccaatttaacttttggggacaagagtctagggttcacgaaggacatttttctccacgtcactcgtgtgcggttaccatcaacagcacgtacaacaaagacgctactacatgtggtctcgagtcttcacatgggctaaaaccacaacattgttatagctcacacaataggaataagtttactttgagtgcctaactagtagccgaatcttattcatctcgtttaaccacgatataagatatgttgactttccaactattaaaacatgtacaatttttctcccggtggttctgaacgtggcgactacgtggaggtgtttgacatgatcttcatcctacgtgatacttatgagcgcagtttgagatctaatcaaccaagcgatgccggccttgtcaagtgggaataaattatgaaatggccatgtgtcttatttactttttttattaccatggattatttgctttatacttctaaaaatatgttttattaaaaatattttatcttgtttagaccacttattctaaaccatttgtgagtttcatttctaaataaaatataaatttatcatgttaatgaagtggacaatccatctcaataatctgcgcaaaaaaaatgtttcaaacatggcctaccaaacaactaaacaagacccgtatatggcaatgttaactaaacaagtccaatagtttgcatggcaatgtttgccgcatagtatgattgcaagtctgtaaccttccagtgattgaatattactcccggtcagagaaaataaagatcaattgccgttatatcgtctattttctatacaagggttctttttttttttgagaaaagtttatatagtagttggtatgcataggatagaaaatgcttggtaggtcaagttcattggtcctataggctgagttctttgcttgaggttcccaacccacctcattttttttcatacgtatgcatcccacactactaaatgatactttttttaaaaaaaaaatcctacaagaaagttgttttaaaaaaatatatattaatattttttaaaaatagataatatttaattaatcatacgctaatgagtcgttccgttcttgcgtgcgcgagagattagttcctaacttcaacatcaggtatgcctataaaacaaaaggctacgatagttttataatgttcgggggtggaaacaaatttaatatgatcttttgccatgccattgttttttttaccatttgttataattaccggaaacaagctaataagtcaaaagcaacttccattaaaaatgattaattttaaatttataggaaatcaaggttattagaggaaaaaaattaaacccccacatgagcaccgaatttacaccgtgtcccctcaccctattattcatcaatagcactatacaacccgtccacgtgatttttaattaaataagacaatagtacggtgaatcatgaaatcaagcaaattaaatcattgtataataaaatgctaaaaagagaatgtctgagctcgtaaaatagagataaacaagtggctatcttaacttttctacgggaattgacaactgctagtaaaacccatatttccccctttcagatcaaatacaagcagcctcaaccaccctcggctcacctttctggattaagaaacatatgccttatttagttcccataaactttttgtaaaaacatcacatcgaatatttaacacatatataaagcattaaatataaataaaaagaaaaattaattgctcaatttgtatgtaaatcacgagacgaatcttttgagtctaattagtccaggattagccataattgctacaataacccgtatgtgctaatgatggtttaattaggctcgaaagattcatcctgcgtttccagacgaattatgaaattagttttttcattcgtatctgaaacccctaccaacatccggtcaaacgtatgatgtgacatttaaaaatttttatttcatccactaaacagtcccatagccgtcttgacatcccattggttaactcggacacgcaaagccaacttcgaactcttcaactaaaacgtgcgtcgcatcccccggccccacacgtcagccaccccaaacagcccatcgccacgccaccgaaccccaccccaccccacccgccgcgccacgccatctctctctctccccccttcccagaaccaaccaaccacgcgcgcacgccccgcgtctcgtcgcgtcggctcggactcgaaccgaaccgacgcggcgagacccaacccgacccaacccaaaccccccgaataaaagatccctcgccccgcggcctcccgtccctcgtctcgcctccccacacgcgagcccaacacgcaaacggagctgcctcctccacacccccttatcctctcctccgggcgagcaatcctcgacgaacgatggcgtcgctcaccaccaccaccgccgccgcgtcctccccggccgcgctgccggcggcctcgaccaccgccccggcgtcgtccgtgtcgccggccgccgcggccgccaagcggcctcacctcgccggggacgacgcgccgtggcgggccgcggcgaccggcgccgcggggatccgccccgtcccgcgcatccaccacgcccccgtcctccgcgtcgcgcaggacgattattccgcctacgccctcgccgtcatgaaggtgcgttcccttttctcggttcggtttggttggtgggggaagggggtaattctaattctgggcttgctctgcagcatccggatccgataggggaggggttggccatggaggctatggtggaggcggccgggccggagtgcatcgtgcccgggcagcaggcgccgctgcggctgctgggcctcaaggtacgaaccgatctctcgatcgcagtgtatttttgcaatccaatcgttacgcacatgtgatcgatatagcccttagttaaattgaacgttattagatgttacttgtgaggggatgtatgcctgattttgggttaatcatgtatcttggttggatagttttgttatggttggtaattcggtgcttggtgcctgaggctcgctcaattatgctttatggttggtaattcggtgcgcggtgcctgtgattggtttgagcttttcttgatcattaaatattcattgggctatgcttgttaattgccaggtttagtgggttggttttgtcaatttcgtagtcatacaaattacagaaaacaaaattttatccatgggattagggatagtcgattaaacagttacgcaattgcgcagcaatgatttgtattatatttttcgtgttgtccaatagtgtttcagctttatcttttgtcaaaaaataggaaatacaagggatactaggttaaggttgagcctttgaggctactctgatgctgtggtactattcatttcgtgctctcgtggtattcattatgaaagtttgccattgctaggcataatatagctcaaaactttttcctttgtttaagtagaatatcatgaattgcttaaaagcttgagaataaattatgtaccttgcacattatggtgtttgagtacttcaataaatcatgtcttttcaatctctgtatttacttgcagtaattgatttctgtgcatgtatgcgttgcggtctttgcatgctcactatttggacacagcaccactagattgaattactacaatagtaaatgatatcacaaattgtcaactgaagtgaatgaaaaccccagccaattaacatggctagtatgaaatattgtgaactgtgaaacacccaaatttttcagtcttaaatttatcctttttgtcatttctatgtaggtttggccccttgatatagagatgaagttcctggagccatttggacgggaactacattccatgaaaaaggtaatgcaagcttgaggctttccatctgttgttctgttgcagctgcacgattggtttgaagtataaagtacttgaaaccaactcaagccttgtgtgctagtaatacttaatcagtctttagccatccttaagacctgtttggaaattacaatgtcccggagaaagataggcgttgtgtttgctatcctatccgtaggacttcctgtagacactcttaaagtcatccaagcctgttgccttttttcactttcaacattagtgctgctgggtaacatgcacttgcttccaatgacctgtatattgtgaccagaagagtccacccatgtatgccctgggattcctaacatttcaatggcaggttgaaggcaatagacccaaataaagtcatgatagaacgttcttcatgctttctagtgatcatggttaataacaccacatatatgttcacttctttctttctttctttctttcagtagtggtctgttgtcatttcctacaaactaaatggtggtctcctgaaccataattgccagagcagatacataacatttttgtacaactatctgctagtcgaaatgcaaatgtaaaatatggttttgtctcctaagatctgtttaggactacattggcattagtttataattaccttctactgctccattagaatgataacttatcacgcctagtttgtttagaacagacatgatttttatggtgtagttactatatcgtacattccttgtgcagttcatggacaagtcatgcagcgttatggactcatctatgtcaaataagtaggcgcatggctgattagttccctccattactagccaatgctgtatccacggctcttgctgaagttacaggaccagaaaggtacaaaacttgaagagcccatggagagaaaccacattcttgcttatcttgagtcgcatcacttgatggaacaagatatagcgccgagaacacagtaacgattagctagtactactatgtatggatccagggctgcctccaccgagttagtctacgtgttatgcgtttattgtattcatgtaacggttgtgacttgagaatataatgctgagttgcaaggaaaacgaagaaaaaaaatcatacaaaataccattctttttgtttctgtattgggttattctcggctgcaggccacatgcgaatatctgatggtgaattctcatcaaaatttcttgtgcgcgccccaggccctcatttatactactatttgttaacccgtaaagtactgtatttgtataacctgtgtttcggggtactcacgtatggtgaagcgtgctgttcattgcctggtccggattggcgattactgttgtcaccgtgaggattctattgatagagcgcgctcctccgattggagctctatcatccgtatgcgagatttcggatcgcgacatctgcaagatgccaagccgccaagcgtggattctcgattgcttaacgaaacagtggagtctccatcaaggactcatgggcacgccgcacgcctggtcgcccacaccacacaacggtgtcaatgagagaggctcctctcttcctggagcgcacggcaaaaccgctcgcccgtcccggtgcctgaagccgccaccacgcgcgacgagacacttcacgcacggcgattcggccttgcattgcaacacggagagggcgtgtgtacaggagggagggaggagggcttcagtcagtagtccccgctcgtccaaactcaagcaagagcaagagcagtgagctagctcgggcgcgcgcatgcatgtcattcgcatagcgtggtaatggccggcgtgccactggccactattgcagtcctggacgatttgtctatgcggatatatggtccatcccttgcaagaaacggtggcttctgcgcacgccggcgtcaatgcggcatggtcccatactccacaggaccatagccgcaatggccacaaggccgcaatcttgcgtcctcgtcgtggatggaagcgctcgaaacgtccgagtctgttttactgttctaccccgtatgggggggggggggggggtctgccgcatatgcatgtggcggctctagccacttgcagagttgcagcgcaggaaggggcagggcagtcagtgggtggggccaccgatggagcgtggaaactgcgtgcgcgtcgtagcgtaagctactcctacccaagcagagcaccccggctgaatcgcatattcgaatcagctcgtgggagggattcggatcaggtgcagtaacagtagtgactgtaactttggtaatacccaatcatccagccatccagcacacaagggatggcccagatttaactgtgtcatgcatcattttagctatttgaataagcatagaacagcttcagttcagattttgcctgaaatttctctccttttgatctgaattttcttgaacgttaagaaaacccaaatattgttaaagaaaactagacacatacttcatttcattatattgaacttcataatatcttgcacgcataattgacaaaatgagctagagtttaagcccttgtttagttcccaaaatattttttccaaaaacatcacatcgaatctttgtaaacatgtatggagcattaaatatagataaataaaaaaactaattgcacaatttgcatagaaaatgtgagacgaatcttttgagcctaattagtactccctccggtttcattttaatgacacggtatacaaaatatatctttgaccttatttttctattataacatataaaataaataaatgcatatttacttttattatagtgctttgaaagacaaatatatatatacgttgtcctttaaactaaatatttttaaaattattgatggtcaaagttataaaagtttggcctcggccttatctaaaacgtaaaataatatggaaccggatggagtacatgatagctataaagtgctacagtaacccatatgtgctaatcacggattaattaggcttaataaatccgtctcgcggtttccaggtgagttataaaattagttttttcattcgtgtccgaaaactccttccgacatctggtcaaacgtccgatatgacacccaaaaattttcttttcgcgaactaaacacaccctaactattttcgctgaaattgggtatcatgcatccactggcacaaaagctttcaaaatcaactagctatgctactgctagattaaccccgttacaaaagctttcatgatacaaaagtagatcatcatctgcttccaaaatcagcacgatgccttctaagttctattgacctcttcaaatgaacttttaagataagatgatatcttcaacattaatagaaccctagggaaaaaagataatatccaaattaatttcatgtgatgtgcagcagtaggaggtaaagtatgcttcccatggtagaattggcgccaattcttacctccctctcagatttttccctccaaaacacatctgctggaatcagagagtaggtgaaaagctgggggaaattaagcaacgaatctagaccatcccttatgtactcgatggttggatgatggatactgttaaagttgcagtcactactgatttgaatcctcgtgagagatgatgtgattacattacagacgcaaaatccagatttcttaatcgcgaatcatcaaaccgaaaccaactccaaaactctaatttcggccaaagagattccgcagaacagttcgagttgaccaatattatatagtttatttccccccttttttgttattactattccaactcgattatccaaacaaagtccatgttggatggatccagatcgccacaacactcccttgtcagttgtctgatcgactgatcgtctcatccctccctaacccgtctacttggccgataacccgtctcaccgccaaatcgccaatctcccacctcgtcacgcatgcgtgttcaaacgtgaactaatcaactctccgcgactccgcctccggccgtcccgtccccgtctccgggattttaatttcttggcacctcgcctcagcatattccatgtcccctctccatccgccccacgcgcccactttgaccgacccatcgatcgatcacgatatttagtagtagtagtagtattacaaatccagcaagcgatcccaatatcccattcccaaaaccccaatccatcctcggagcacgccaccttcacgaggaagagagaatcgaggaagcagagcgctcggaccagaggaggaggaggaggtgccagccatggtggaccggatcggcgccgcgtggtggtgcgcgtgcgccgtggggatgctggtggtgggggcgtgcctcgccggggagaccagcgagtaccggcgccagctcggctccgccgtcgacatgccgctcgacgccgacgtcttccgcgccccgcccggccgcaatgcgccccagcaggtaacccgctgcactctgcactgcatgttcttttctgcatcgcggaaggaaggcatcgatactcgatagactcctccgagggtatcgggtttcgaagccctcgatttgttttcagcatctgtgcagcttcggaggaatcaaatgttcctcttgttccttttgtgatcgatgcttgagatagtagcgtcctgcatctgttcgtgattcgtcactcgtgagccgcacttcgattactgtagattgtataatatactagtactagtactacggagtattttgctgttcgttttgtactcgcgctggtcctgctgagtgctgagtggtggtcatccatttgcatatgcttgtctcatggtgtctccatgctgatgaaacaagcaaggaattttcggtttcgatggtcccgaagttgactgcttgtctctcttcagaaattgtctcctctttaatcacactgtttgtgtttaattcgatcgtttcaatcggataaactgttgtgtttctggttggtagacctgaatttagcgtggcataaatgtttctagctacttgtgttacagggtttctgtcattagtctatcgatgagcatttggcttattcagagtcgtcacctggggtgctttttgcacttagcttaatcccagtccacaaacttggtgtgttcatgaattaaaatactgcttccgtaccaccgcttgctctgcttcactcatttctaaagttaacaccaacttttagggaagtgttccaacttctatcatacactatctgcttgaccatttactagtactaattggttgcagggcccttttacgaacccttttgttgtcttttggaactttcttattcttagggcacccgcaatggttatctataggctctctacaagagatccatgtcagcatatttttctacttggaagaattaaatgtagagagagagcaaagctatctactaacctgaagatagtctatagagaaaaacgaggcaatggattagagagctatagatacccatgtagacataccattaaagtggtttactattaatctagtctattgctgagatgtacatgttttatagatagcaccttactttaccattgcgggtgctcttatagagtcttactcccttgaattaagtattaggatgccttttactgagattgatgtccattcctttttcaatatgccgttagcataaaaaattatatgcaagatgtgctggggtatggtcattggtgtattctccactctgatgcttattgatattgttctctgaaaggttcatatcacacaaggaaatcatgatggcactgccatgataatctcatgggtgacaacaattgagccaggctcaagcactgtgctctatgggacttcggaggataatcttaatttctctgcagatggaaaacacactcagtatacgttctacaactacacctcaggatacattcatcactgtacaataaaaaagttggaggtattagttctttgcaaaagtcgtctttagtgtttggactgtaaattaaagattgactattggctttgttgcagtttgacacaaaatactactatgctgttgggattggacaaaccgtgaggaagttttggttcagaacccctccaaaaagtggcccagatgttccatatacatttggtctcataggtagtattcaatattcctaaattcatttttgctatgtcaggatacacattcaccaaatctataaacgatctatatcactgaaaacaacatctgtattcaggtgatcttggtcagagctacgactcgaatattacgctggcccattatgagtccaattcaaaggcgcaagcagtacttttcgttggggatctgtgttatgcagataactacccataccatgacaatgtgaggtgggatacatgggcaagatttgtagagaggaatgttgcctaccagccttggatctggacagctggaaatcatgagatagattttgccccagaacttgtaagtgtagtactccatttaactttatttgtgtaatgatcttcagtggatgcatatacagttcagtactagataatcagtggagcttatgttataagcatttacattctgttgaacatttgcagggtgaaacgaagccattcaagccatacagctataggtaccccacaccttataaggcttccggtagcacggcacctttctggtattctgtcaaaagagcatctgcttatattattgtcttggcatcatattcatcatatggtatgtaatatgatctagttgcgttttcttttgcatctgtattcaaagtacttagtaacaagcttcacaagtaaaattaaacacccacatgagcaacattgtgaataagtagtcagtcttacatgctttgggcaaacagaaacacacactgtacataacaatgaacttattaacttatactccatttgttgattgctaatagatggaataagataatttatcagttcttctgtttctttcccaggaaagtatactcctcagtacaagtggcttgaagctgagtttcccaaggttaacaggagtgaaacgccatggttgatagtgctattgcatgctccgtggtacaacagctataactatcactacatggaaggtgaaagcatgagagttatgtatgagccgtggttcgtcaagtacaaagttgacctcgtgtttgcaggacatgttcatgcctatgaacggacagtaagcacttacagttttttttcccctgaaaaatagttaaaactttgcatggggaatcaaatggaaatttcttgcaacttcattaggaactttagcacgcacttctttgtcgtctttatatttattagtatatacttgcatctagtaaaattaagttcaacgtgcttgtcgttttctttaaacaaaggagtgcttggttttactacttttttttaaactggtacggagcatgtatagctttactactgatactctgcttagagtagtactagtaccttaatcttgagctgctgacatagacttattttctctgattgcagcacaggatatcaaatgtcgcgtacaacattgtgaatggccagtgcactccagtccatgatcagtctgctccagtctacataaccatcggagatggaggaaaccaggaaggactggccaccaagtaagaatccttttttcgcttccaccaaccgttttcagttcctgaacgctgacaagatatcatgtgcaattgctgggaaaaaaaaacaaatataatgcagcatgacggcgccgcagcctggctactcggccttcagggagtcgagcttcgggcacgccatcctggacatcaagaacaggacgcacgcgtactacacgtggcaccgcaaccaggacggcaacgctgtggcggctgactccatgtggttcaccaacagatactggcagccgacggatgaatctttggacgactcccagtgatctgagtcgttcgtacatggtttactcacacctgctcctcctccctagtttgtgttgtggttcttctacgtgaataagcactggctcgatttgaacacacaggacggactcacggacgcctccggttcaggcgtcgtgatctaggtggttctttctccgctccagctccctcgtggccgtgtgctgcttgtgtatagaagaagcgcagctcacgtgcagcgagaggaaaagaaagctgagaaattgcgagttgatacttgataggcttgtgtacgttcgtactcgtctagatgttgaataaacacattggtttcgtggcgttgcgacttgcatttgacaatccgagtgggagtaacatgggcttctggcaagctgtggcttgtgccaaatcctaggaatccgttattatcagtcttttcgaatacttcaaatgtcgacaacaaactgataataacatcaattcagacttatcagtaaatcccctgaataatactactctaaatatgactgtatctagttctaaatcccctaaattgtaaatataacgatgcaaacattcagtagtaggtggcgtctatcccagccctatctagattggtttttttttttaaggacggagggagtacggagaagcactgggtcgacagcagctcactaatgttgagagattaaatacaccttaataagattagtaagcaaaggctctggtaactgccgtttgggccagagattagatagcctcaagttaagcaacgcagcagtccacagcaccaaaatgaacatttgtacatacatataaattgtcaagacaagcacaagtcgtcagattcccttgccaagacataaacatagcaattcaaaatggcagaaccaagcatatgacttcttgtacaggttaagtagcaaattttcaacgaaacagaactaagccctaacacatgtacttgaacttctgtccattgtagtatccgtatttgtggcgagtccgggtttcattacggggcagatcgtccggatgacaccaaaatggcttgggcacgggccagctgttataaaaaaaatgtatagggtacaataatgctatcaacaaacaaatcaacaaccaaatgcaaaacattgtaatttaactgcgatatgaggtgcaccagaatacctatttggccgaacactacgatctccagtcatagtccaatcaagcacaccagatgaagtgtcaccattgccaactttattgatagtcctgccaagcacaccaatggatagttttaacacatttgtgcttcggactgaagtaccgaaccagattcatcaagacgagcgcacaaacacatgcacatacgaacacaaattctaggagtacctttcttcatcaaaacgtgacagaacgtggaggataacggtgcatgataggaatggggttcctactatgtcatcaaagaagttgataccaacatatctcccatcaaaatcaataagaggccctccaatcccagcctaaccaggttacatggacaagttaatcatagtaccaacaaatgagactacatgcaactatttacttccaccatgtaaaagtaggcaacaaaaagtctcctcccataccttggtgattttaaaattggcgtaccgaagcattctgcaatcaagtgtgcctgaccagccaaccaaatgaccacttgcagccattaatatgtctgattcgaagcagcgccccacagctaatacatcctcacatacactttcctgctcatgatgaagatttgcagggcaaagagcacggaaatccttcacactgacaatagcaacattgtaatgtaaattacagtgctctagtgtcccttctgtacgttttttgtttggaagcaacacttcaatctgcaaatgacaaagtaagacttaagaagtaccttagaagaacaaggatcacagaataatatgagcacaacgttagctaccctcaaattttcaacaatcttgctacgatcgccagattttctaactaagctcgctgaagtcagaatagatgtacatccgttccattcaataaaaaaacctgtgcatgcaaaatatcttgtttctcctgcatataccgtaattttgattattagtgaaacaaatacaaatatgaaagtgaatagcaaatgtaaacttaccattgaatgaagcaagcgagacaacatttcgagatattcttgaagaaacatttttgctgagctcactccagacaccttcatcatacaagtcgccaaaagtctcttcaaaagtgttgaccaaaaccatgccatctggttatagatacacaaccatcagagggtagctaatgttgtgctcatattatgtaggaaagatctgcagattaatttacaagcaccgattcaccgttggccatacttattgatggcatgggataacccatggagtctagacactcaaattgatcctcatcacaaacatctgcaacaaaggtaaagttagcattggcatatggatgaatgacattcacgtaaaattatgcacataataatcaaatgttagattatataatgagaacttgggcaacaactcatattagaatggctcagtttgcatgcccatgagcataatctaagactaactgattagcactaaaactaggatagtgcaactgcaagacactatagcatatagtatgtattgtgaatatcaaatgagagctaaatttgcacttgtgaggataaaataaaaaatgatgatgaattgcatacaagagaaatatttgggggtggctttgtgctcaccttctagaagggacttaggcatctcaattgagagtcttcctccaaccctgcgaaagagcatcaacatgagtacttctccaaaggaaaaaatggatcaaaaccagtgcatcaatatgcaacatctgcatttacacaaaatgtaggaataaatatgacctgagtacaatggatatgattattttaataaaacaaaagataattgaaaggatgtttatacagaacctcagtgccacgaaacaacacaatcttttttaatgtgcacgtctatctattaacttattaaaggaatagaaaacgaaggctccacgttcgctctaatagcctagaaattctcatattaatcggagaaaaagaaaaaaacggagtccacaaaggaatacaatttaaaatagctgaaattcggaattaaaaataacgaatataggaagagaagactagagtccatcctggtatacaatttagaactaattgaatttcggaattaaaaataagaaaattaaaagcagagattctgtccatatagaaatatttataattaaaatttgaaattagaaaataaggaatattgaaagaaaagtgtagaatccatatagatatacaatttagaaacaataaaaattcaaaatttttaaaaataaggaatattacaagaatagtctagagtccacatagtaatttagaactaattgaaattcagaataaaaataataaattaaaagttgagtttagagtccatatagaaattcaatttataaataattaaaatccaaaattttaaaaaaagaaatattggaagaatattatagagtccatatgggaatacaatttagaaataactaaaattcggattaaaaaaaaggaatattgaaagacgagtttagattccatgtagacatataataataaatatcagaaattcggaatttaaaaataaaaaatattgaaagaagggtttaaagtatatataggtgtaagatttataaataatgaaaaatttagaattaaaaaaaataaaagaatattgaaagaagagtcatgatcatataaaaatacaaaataactaaagtttagaattaaacaaataattaataactattgcgtatatagaatacaatatgaatattacacattggttagtttggtcaagttagtacacaatttaaaataaaattatattataattttaatatattttaataatgaaatgtaaaatatatatgctattatgtgagaaaaaaatataaggatgctagccgcgcaatctgcgcgcgccatcatgctagttctaatatgaacaaaatgccttttaattagaaaaatatattgccttcaacaattgattcaagaaatataagaatgaattcatagtcacaattgcaaatctagtttgctatagagaaaccgtgaaacatgctaataggacaactagtgtaaccctaatatcttggtagaggtagcaaagaatcaagttgttattattcaatacctacatgccttataagtggttgaaaagttcaaaatagattttttttttcggaaaatgtataaagcatacctgattgccttcaattttgttgccaatgcaaaaaatttcctccttcggtaggatgtccgaaaatactccaaccgttcaataattatactgatcggcaggaaaagggatcttcccacaagaaataaaaggttcatgccaataaggttcccatcagaatcaaacagtgccccaccttcccaaccctagcatgtaaacaaaatggcaggcaacaagggttacataggaactaatcaacaaaatagagttatacagaacacgggttgcatacaaatgatgcctacaagtgcatttagtaatagagatagatcgaagaacttctgtttaaagtatacctcagagattttacatgtggacaacataaactcttcagcatcttcagatccatttgaatcgctaattagcatcccatctgtggtgattaatttgccagagatatcacgtcctacagctactaccttactcccggacagatatttcatcacgtgattgggaagcacctcgtgaacattaaggaaggtcatgactttgacaaaagcaatttcgtgatctaaatcatattcatccaaacaccctacgacaaaattgccttcacagcgcacttcgatctataattatactgcgatgttatcgaatgatcgcaattatatcttatgtaaacagcaaaaaatagtaaaggatggttagcaacaccacctttaagttatcacggtcttttgttttatcattgaaagctttaaccaaacttgctgaagtcaaaaaccttgtgaagttacgcttgtgttctatagttatgcctgagcatgcaaacaacacagagtgtcctacacaagaagagtaacttagatcatttatacctagcaacgttaataaatatatatttggcaaaccaagaagagtataacaacgtaatcaccatcagataaagcaagtgatacgacattactaaaattggatgggacctcttcaatgagttcacctaattaaacaaacatagcacaactgagtactcaaatagagctacaagaaacatgaacacacacgcgtgtgcgcgcacacacacagagagagcaaaccagatatctcctctccattgcaagatcttttactcgtacttgggcttatggtgatatcatcaagaccccttttcaatgtcagcatctttccaacactgacacagaaacaataaaaaaaatgccaaatgtgggtcaataaccagtaaaaaccgttgtaaaaccatcacagtttcatagccctatatgtgcctttaagcagttgcggaggacgaaaaaaaaaaagtgtgcctcatgaaacattatctccatgcaaagagttagcatcaattacacaatcacaaatttgtacatttttaaatttgcaatgctctggaattctaaaccatcgaacaaatatatcacctcttcgtgatgccaagaccttcctctgcctctctctttctaaccattttcttgttttgttgccttgctccttagctccttggcttccccttctgcctaggcctgcggcgcagactgccggcctcccgcgccgtcgagccgtcgagccgtccgtcgccgctcgccagccgccacgagatgacagagttggaagaggctagggaatttttatctagggttcagtgaagaagcccaatgggccttttacgaagtgtcggggggatcatcagaagatgggccttttatgaagacgtcaggagactcaggacgagaaccggacacaagtcgtcacggggaaaagaaaaagggaaaaaaaagagaaagaaacggtgacttttgccaactaattctcccgtacgcccgagatccgaagcggctcgcgcggccgccacatcttccgatcctctcgccggcgggcgcgcgcgcgcggcggcggcggggcaaaaatggaggcaacggccggcggctccaccgcctccgcggcggcgtgcccgcccgccccatcccggccgacggacccggacttcctcagctgcgtgctccagcccccgacaccctcctcctcctcctcccgccccgacgacgactacgccgccctccgccgcctcctcctccgccgcaagcccccctcggcgctccaacaccgtatggtacgcccttcctctcgttcttctcagatccctcattggcgcgcgtagtgttttttttttggccatggggaatgaatgaattgggttggattgggtgggtgggtggtgatgcaggagtggcggtgcaacgggaagggctacgtcgcctaccgcaacttcctcctccgccgcatcgacggtggcgccgcctccagctgcgccagcacgtccagcaacaggtgcgtcttgattttgtttcgttttttttttcttccgcacctcgtcgccctgcccttacctaacgaaacgagaacaaaaaaaatgtagccaggctcgctacctttgtgtgtctctgagcttttcttatgctcatccactagttttctcttaagattaatcatttgaatatgtagtatgattttggaggtgaattctaacactgtggatattgcaatttaccagtggaaggtgggctccttctcctgcctatgctgcattctccgaggcggatagctggagttctagcaaggttggtatcttttattgtttgctgcattagccacattgtaaattatcgttgatacaccattacatttgtgcggatacctttgtggagtgatcacaacttgttgtgaattgtcatgtacttgtttgctgcaggacttgagaaggaacagcggaccattgctccgcaatcttagtatcagctcaaagcagagtgatcctgagcgtcatgtcagatttgccgagcctgcatactcatttgttggaatgcattgcatctttgacgactgcaaagcatcaggtttgttgccttatagtcatggtgcacaatttcaaaatttcatctctgacggtaataaattattgttgttttagtgatctggataatatattaacgaaagtttgattttactcccggcagttacaatattgaaatttggtcgtgcaagttcagatctacttacatatggtgcttctgatggcagtttaacagtctgccaggtttctgacccaccaactgttcttcaaaaattaatagggcattctaaagatattacaggttagagtacaatcattacttgtttatatggttttatttatgtacctacgtggctcaggaaaagtgcttagcttctagtacaagggtgttactagggatgatcaaattgcatatgaagctaagtgcaaaaatcagcattgcaatgtaccctcaatgttactgggatcttattcgatgcttatcttaataatatagaatgatagttcagttaattgtgacttcccaatattttaaatgcctatcatgctgtttgtaacatcaatagtatctcctagtgctgagcatttacaattgctgcacatgtagtttttgtttgttatagccacaaaaaagttgcatgaataatttatggatttggatggatgctaattaaaacagaataattgagttgtacttatctattatttcaatgtttagtatttagtgagcttcgaattctaactgcattacagattttgatttttcatctaataaccagtacatagcttcgtgctccatggataaaactatgagagtatgggagatctcaaaaggcacttgtatcagggttgtatatggggtttcttcccagctatgtatctgctttcatcctgtaagtcccgcctttgcagaatgcatacttatcccattcgcttgttggcaccaatcttatttgcacttcgcattcataaaaattatttgtgtagtaaccaggatggatggtctactttatcatatgtttactgggttttctttcttctttttttttttgcaggtgaataataatttactgttagttggcaatgcaaacagggaaatcaatgtacgattcctgaccttttgctcccagcaattcatatactccaatattttgcctgctgattaatctgcgccttcccttgaatgttctgttttgtgatagtaatggaaaaatgaatgtgttattcttattctggttatttattcactaaagatgattttcttctgattaaattagaaaatatatcacctaatgactaccatttcccctttacattcttttgcttgtaccttttaatgtcgatggttgtgatccatatctctatctattataggccattaattttagcactgggagaatagtcagcaagcttacctttgatgatgcggttacagctttggatgttgatcacactggacaacttatttttgctggggacgctcaggtatccattgatttggtttgtttttactgctaaaatgaatatacgatgttcataattttcaattggtaattgaaatgtgtagggttgcatatatactgttagtgtgaattcacacacgggttcattatctagaactcataagaacaagagcaataaaagcaaatctcctgttacaaccatccaataccgcaccttctctctggtggcacgttgcccagtcctcctttcttgtgttcaaaatggaaacttgtttttcttcaggtgcgtgatcattactgtatgttatgctgttaactctacttttttgtaactatttgtgttgttggtcatttcagcattgcaacagattccaagggatacttgaccctaatatgctccctaaaattggcgtcaccggtgcagagcatccgtgcttctttctgtccactcctttccctcgaaaaaggagaattcattggtgagtaaaaataaaacctttttttttccttttcagttgttgcttgttggttacctcaatcttaaagctgttgataatccaaactctcatttctgatactgttcatgtcagccagcactcaattgctactgcaaattttgtgtattgcctgccctcacatgttgtgttagcattatcctttgtaaacttgtcttttagttcaatgaagtagcaagccgacaatgacacttgacacaagttatcattacaaattttgttaattaattattttacaattttaattgaacttagtgagacaatgtatgatgactggctttggcaaataggtggaccattttgtaccctatgttctgttctttgtaatgcatagctgggtttttgtttaaatctgattcctttttcctcctgaatgtaaagtcacgggcagtgaggatgcaaatgtttacttctacgatttgacacggccaaagaactcgtgtgtaaataaacttcaggtatgttcagtgcttcttctatttttggaatcttaaactttggttccatggcaaaggtaccgatgaaactattttcattcgtgaagggacatggttctccagtaattggagtggcctggagtcatggggaaaatttgcttgcctcatctgattcagatggtacagttattgtatggaagcgggcataaactaattagagcggattccacaaaacgaaagttgcttgtataatgaaggcatttttggcgcatgttgtacctcccatcatatattgtttgtaagacacagaagatgaatcagccttcaattgtatttctacaaaagtatagttctccatagagtgtacagcggttcttcaggtacatcttacatatatttttgttcaatactaaaggggtaggaggtacagtataattctctttttgtaaactaaatttcatgagtttaaatggagtagttgcaccctgggtcagattctgtaaggtgaagaaggtttgtgtttgttataatccttcgttttttccgtctacgaatgagccattactgacttttgtattagacttcctgtcttgagaattggcgttttaccggttgaccgaagatctgccaaagaactttttctgcctttctcagctgtatgtgttttacagcggcaatgcgggaaaccatgtattgcaaacctaaaaaccactgtagtataaaaagaatgagcgtctgagatttatcgacactgtaagtaaaattcggggatgacatggacaaatctcatatgtttacttttcgttcctacagtaatttctaagtgtttacattacatacgtggtttgcgccatatattttccccagcaatgcaatggaacacatagctctatctagttcccgaggtgacaatatggcatatattcagctagctgagcatagcattgcaaatcacaaagaagcacacaaccggctagaatagtgtcactgaaagcactagaaacatggtactactaagttgctaacatcaggcaaccattctacccccccagacagacattatttctaccactccaagcaccatgactccatcaagctgctatagcgatggttactgcaaattgaacgtgaatgacaggattattcctagtgctactccgaaggcgagggctaacagcttgcaagtcccatcacaggtgtctgacgtccgaggcgctggcgaagaagtcatgtcgaaacgcaggacgcagtcgtcgctcaccacgacgccgacgccctctccctgctcctcccgacgtgcctcccggaagcatctcggtatctctcgcgccgcgccctccaggcactgcacgcagtccgccggcgcgacgcccgcggcgcactgcgccaccacgcgcccggccagccccgtcctcgtcgtggctgctccgacgtcgatcgccagcatccgcgccgccacgccgttgctcatgtcgaggaacgtcgcgtacaggttgtcgctgaacggcaggacgtctccggtgacgacccaccggtggaactcgccccccgctgggctgggcgacatcgtcgtgttggtgtcggcggcgtaggcggcgaggtagctgcggtagcacccgtcgagccaggcgccggcgcgggcgccgcagcccgcgacgacgtccgcgacggcggcggcgaggctctcgcggtacagcgccggcgtagagtcgccgaggcagacgctgagagcgagcgcgcggtcgccgccgccggcctgcgtggaggcgaacctcgtcgcggcggcctgggcggggaggtcgtcggtgggcagcgcgaggaggttcgcgcggaacgccgtgccgttgctgctgttggacgtcggcgccggcgaacagtcgatctgtgggaagtacctggctccggtggccgtcgacgtcacgcagacgagaaggaggcaagaaagcttggtgagcgccatgagcgatggattgcacgacaccaaggtcgccaggccggatacgaactgcatgccgtagctcgaagctacaccgctctttatgaaggcgatcgagtgagctcaatgccaccacactgtgcagctattaggcctttcacagcgctccaccctggaccggtgctatggggcgacacattggatttttgctgccgtggcgctcgaacccgcgtctcaagttggaacctcatctccatgttgagcgacgcaggacttcgtcaaaacgatgccgcgagcagaggagaagactggaggcgcgcgcgctgtgagcgttgtggcttcgcccacgcgtgccctcgtggcgaaatccaagggcgaaatccccgatacgccctccaaatccactcccaccacagcaaaatccagggcggcctcgccatctcgtcggacggcgccgcagttgccaccggggtgtccgacgagcagggaggcgcctagcacacttccagctgcatcaacccaaatcaaaatcaaaaccaaatcagaacaatgaaacaaatcaaagaacacaaatcgagggcaaggaaacaaaaatcaaacataaatcaacaaatctgaacacaccaccaacacacataccacgtcaccggcgagctcccaagaaacaaaaatggcggcggcggcgagatagatggacatacgtgtcgccggaggcagaagcgatcgaagcaagggagtgggggagggagaggggaggggcgggggacagatccaccgccgccgctgtcgccacgacgacctccatggcgacgacggcctcctgcgccgcagaggtgtagaagccgtccgctcctgccgccgaccgcccgtcggcgccgtctcgtccactcccgctgctcccaccgtcggcggcgcgccgtccactacagccgcccccacagctcctgagtccgagcgggaggaggagcgagcggcgtaggcagcgcgggcggagcgggcggcgcggtcgatggcgaggcgaggcgcacggcggcggtgtccccggcgtccgccgcgagggaggagagggaggagaaggcgaggcgaaggaggagacgtgctgagggggactcagcttgggtgacattgtaaaggcaagtcacagcgtgacattgggaagatctggaccatccgaaacaaatccaacggacatggcgcttggacccgcctgcaggtcgaaatttcgctgcccatccagcccctatccagcgcgggagacggcgcccgcccccgatccttcccgcgcgctcgcatcgtcgtttcgcctcgcccgcccgcgtccggccatcgctgtgagcacgaatcaactgggaggctcgccgccgtcgtgcctgcgcaggcctccgtgctcgccgcgagtgcggactgaaccgggccagccgccgcgcgaggccaactccctgccctgccgcgacctgtggaggccgccgaggcactgccctgccgagcgcgtggaggcggacggccgctgggcctgacggcgcggtggtgtagacggccggccgcccagcctgagcccggcgcgtggaggaggggacatcctggaggaggctgcgctgctaccagtcattggctgctgtcttgctaatcctacagatgacaacttctattgttacttgccaagtttttgccggctaattctaacatttgcatcagtcaggctctggaatggcacagctatcataaatgtgaaattcttttgtatggaggtgatcaatgctgaaactctgaactattcaggatttttaggtcctcaactgagaagagcagaggatagcacacaggacaacacagtaacttgaaaaaggagaaaaaaaaacccaatcaacacacattcacgcgctgagctgggcgcaccactgcaccagggcttgtctcaggtacttcatgaagccattaggctcgtctcctccacgcgccgagctgggcccaccagcgcgacgtctggaccggcagctggccgcgggccgcctccacgctcctccggccgtggcggcacggcagggcctggccccggcctagcgcggagatcgcctagtcccctccccactcacggtgagcccggcggtctggcgcctttccagtcacggcggcgacgagcctcccagctggctcccggcgacggccggacgcgggtgaggcgagcgtcgggcgcctcgcgcggtggtcaccccgtcccctccccactcgcggcgagcccggcgctccagtaacggcggcggcgcgtgctcccagttggctcgtggcggcggccgaacgagcgcactgctccacgcgttcaatggatggattggggctgggggagccgtctcccgtcgggatggatggattggggaataatttcgacctgcaggcgggcccaagcgccatctccgttggatttattttggatggtccagatcttcccaatgtcacgctgtgacttgccttcgcaatgtcacccaagctgagtcctgctaagggtgaggggtaggtgaggaaaataaatttggggtcgcgtcctgtgtcctcctgtagggtatcgcttcgtttccttcacggcttcacctctctctctctatccaattaagccacacatatatgggtgctttcactgtggggtgagtgtctttgagttgtgactttggactagggatatgggccccatagcttgcactgctattgcccttagctatagccgctgcctctctgcgcggttggaccagggttcataatttcagctcgaaatttcggttctatcagaccacgatacaataatatttcggctgaattttttttcatttttttcataaatttggtaatattttgttcaaatttaaccaaattttattcaaaaattcatatgatttcggatcaaaatttcagaattttgaaaatttcggtatttcgaccaccaccaagtcaaaacactaaaccgaaaaattaaaccctcggctggacacgcacgcgccacaactcgaaatggcacgggaggttagcacgcgtcattgcagtagctgcaagtaagcactgtgaatggccaacgggtaattgcggcgaaaagctccgccgaattcgctaatcaagagggcgtcactccgaacttactcagccgaaagttgtttccctagctagttcacccgttgctcgaattggctggacttctctccctttactcgcttattaagcgctatgctcttctattttcgtgagcttacggtcttaagcgttgtcattcctggcaggtctgttcggcacgaaactccggtgcaattaagtcctatggcggcaactaaatcctagccaatggcggcaaacttcaacggtgctagattggtgggaggctaccgcaaacatgcaagagacacctaagaagatactccgcactttgatgttgttggtcgcctgggagatatggaacaaaaggaatcgcagaaccttccaacagaaggagctttcagctacctctcttttagccaagatcaaggaagaggtcaaaacttgggccttagcaggagcgagaagtcttaatagctggctttcttttagttaactcggaccaaaggtcctaactcctttcctttttttctttcgctttgtaaaattctccttctctattcaataaaattggcgctcgtcgattcgttcaaaaagaaaagtcctatggactatggtgtgtgctaccagtttaacaatttctcatgggtcaatgagttggggttgttgaaacttggccggcgcaaaacacgttgcaagattgttgtcatggggagtaagatggactaacgtgtaagcatgtttgctgtcagtaatatacattttttttcctttttgttctacctcttgctatgtgcataaactccttttattaatataacgccaagcaggccattccaaaaaccttttcccatgggtcattaactactgcaccttcccgtaccaagcattgctagcaattaatagcttgcaacgccatgtctagggatgaaacgattggaaaacaacatgcatcagccgtttaagtaatcatatatttctcggaaacgaaccgataacgatgaggctgaaaacaaaatgatatcaaaaatactgaaaacgtgactacatgaacaaaaccatgtcaatatcgatcggaaaccagtaatgaatatcgaaaacattaaactcgatgtttaacttaacatgactatataatattgtctctcctctagccttgtactcaaattagaaatttgataaatatttatgggtctcaaaactacgggtcacgggtcacatagatacatggacgataaatattgagatatttaaaaatacggtgattaccgtattataaatgtagcatttttcatgagactttggtaaattaaagaaacggttggtagaacaataaaatcgtttttttatttttaccatttctatttttagttattgttttcactcctgtgatggcaaaggcaaactggtcaccattgcttcctacgcatccgagttagccgcaggctatttcataacgtatagttgtgaattgtgagattttcttttagtttcacagtgtatggtggcgcaccggcagtccggcacatcccggccttgccccgataccacgactggccctcaaaagccttatcttttcacttatgcttatacttatcagctaaaacttaaattttctatcttagatttaaatttaattttgaggggtttttttatcgaaatttatttttcagtctttgcttttagatcggtaaaaacatgtatataaaagttttattcacaattttttttttttgcaaatatgcccgcgtcgcggtcacggtcgcgtagtcgcgcgcgcgcggcgaacgcgtgtgcgtcgtgcggggtgattctgttcaccgccccatgggccgcacaaaggggtccaatctttcaccctgcagaatgggttggcggtggacgctcgtaacgctagcggctagctgggcatagcattttgcaaacaaaacacacatgataagctactgttatcctaacacataatccctagtactacatatgaccatttatttctactactcgatcgagcaccatgactccatgaaagcttatctacaggtggttatattactgcaaattgtcttcactcgattcgaacatgacgactactactactacatgattattgctagcgctgctgctccaacggcgagggcaaacggacggagagctcctccaccaaggcttgccgccggagaggccaggtgcatggtgaacttggagcacgcagtcgtagctcagcgcgacagcgacgctctctcccagcccccatgcgttccagcagcatctcggcatcgctcgcgccgagtcctgcaggcactgcacgcagtccgccggcgcgcggcccgccgcgcactgcgccagcacgctccccgccagccccgtgttggcgccgtcgtcgaactcctgcgtcgccgccagcatcgtccgccccgaccccgaccggttcgcggcggcggcggcgagcgccgacacggcgccgttggccaggtcgaggaacgtcgggtccaggttgtcgctgaacggcaggatgtcgccgtcgaagaaccaccggtggaacgcgctctcgcggggcgaggtcgcgtcggtgtcggcgtaggcgaggtagcacccgctgagccacgcgccggcgcggcgggtgtccgcgccgcagccttcggcgacgtcgatgacggcggcagcgaggcagtcgcggcactgcgacggcgtggagtcgccgaggcaggagccgcgagcgaacgcgcggtcgtcgtcgtcgccgccaggcgcccgtccgccggcgccggcctgcatggaggcgaaacccgtcggcgcggcctggtcggggaggctggcgagcagcgtgaggaggttggcgcggaacgcggtgccgttgctgccagtggacgtcgccatcggtgccggggagcagtcgatctgagggaagtagccggtcgtgtagagctgagtaccgcgggctacaatggcgctcgcgccgccgacgacgacgaggaggagctgggcgacgaggaggagggaggaaagctttctgagcgccatgagcgatggatggcacgacaccaaaaggtgtgttctatggcaatgggcggatcgaaggagtcaaggaggcgggagcagactacggctgtatttagttcagcccaaagtttaaaatttggttaaaattagagatgatgtgactttaaagttgtctgtgtatgaaaggtttgatgtgatagaaagttgaaagtttggaaaaaaaactttggaactaaggctgtgtttagattcaaactttcaactttttccatcacatcaacatatcatacacataacttttcaatcacatcatactaacttcaacccaaactttcaacttttgaaggaactaaacacacagcctaaacacagcctaccagtgtgagcagtggtcgacagagccgttgcgctactacccgaaatggcacctgagggatgggggtagcacgcgccattgcaccagctgcaagcgagcacagcgtgcgaatggcaaccggcaattgccgcgaaaggctcacgccgattcgagaatcaggagggggcgcgttacgttctactgatccctagctcgctgcagacgacgacgcggccggtcaccacccgttgctcgaattggccctctctccccttactcgcttgtattttggtgagcttatgtttatgctaggtatagcagagaggtgccattcctggttgatctgatccgctcggcacgaaacttcgacgcaagtccatcctctggtggcttagcagagttaccatttcttcatgggccattattggcgcttttcccgttccgagtattgctagcaatagcttgcgttgcacatgtcagtggcaaaaggaaaacttgcctgttgagaggcaatatcgctgaagccacgcctctcgatcgaatcgaaaccatccaaagaacaaggcgattagagattcaaattttaaatagaaattcaaaatttgaaaatccgtttttttcttcaaaattttatactcaaatttgcaaaacccaaatcacaataagaaactttaagcgctctgcattgaaagcttaaaaaaactattcccaaatttaaaacatttaactcaaattttgaaattttcaactaaaaattaaaaaacatctacccggatctgaaaaactttcaaattctgaaatgcccaactaaaaatttaacttttattgaaaaaacaaaaaactctacccaagatttaaaacttccagcacaaattttataactttcaaccctatcatttaggtatttcattatacgcgttggcataaactgaaagaaaagactgttgttaggcttgtattgtgtcgtctagttgcaactctcatgtgtacaagaagggcgaagacgacttctattgctagcccaacggtgccaactagctgctccgcatcagggtttacaaaaccaatgaattcgattggattttgctaaaaaccaacgtttctacgtgactcggcaatagttctcctctaaatcgatgggtttcttccaaattcaaatttggattaaaaaaagtgaaaatatttagaaaaaatactataaatagtatggtataggtagaacctattggcatataattttttttagaaaaatgctgaattccaaatatgtcatccttgttaaaaaaatgttaaaaaaaactaaggaggtgttctgtgctgaactctaaagttgtactaatgggctttaatttagatggtgggcattctatttgggcaacggttggtgaaggatgtcaagatgcatattgaattgtgcgtgaaatgtcatatgtgttctaaattattgccttctatgaatttgtatagcatattgtgtgtatgccaatgtgaagttatcaaatttataggaaatggaccaaaatttttagaaaatttccccatttttttagccttttttttcagtattttctacatttttaggaaaccggcttgcgcggctgcacacgttgcaccactgctcgaaatggcaccggaaggggaaggtgttatcccaagttcgccatgcaaagacgacgaagctgccaccgcccctttctcgaactggccttctctcttcactcgcctgagctgagatgctcgaattggcattctctccaaacaacataggccggtccaccccaaacaacaaaattcatttcggaccttactattcatcacctgtaagttcaagtgtcttaatttagttttggtgattaatgacaaatctaataatatgagactaacgtttttatgagcttctctttaactagtctcgtttagatatgaaaataaaaatgatgagaggtatgtattaaacttcacatattctaacttggtctctcttgtggatccaaaatatagtgtgagctccgtcattaatcttgattgattatgtgcatatgtattcctttatatccatatgtatgcacatcttgagggggagcttattatatattttgtttattataagatctctaccttgatttgaaatcatctttcatcccatctctctatattgtttatatcgggttattatctatcaccaaaaagagaaaagattgaaagatcttggattaaacaatttgtgtaattgttgctttgatgatagatgataaaccgatgtttatgggattaacctctctttttcataagttgttaactaggttatttcccgatgatgagatgtggtagatatgcattctttagtgatggaccttaatcatgataaggatgaaatgcatggagataaaacgatatgtaccacttcttatctcctactttttgataggttcatatatatgatttccatgttattgttatataagtgtgagactaatgtttactcgagtcgtatcttatttagtctcatttacattaagaacatggagatcatgaatgtatatgttttatgttggtctacatctttactacatatgccttctctatgtgtataggataaacccccattggtcattctctaattatgcatacacttgcatctcttgtatatttatttgtatgcatatatttagggggggcaaatcctatacatttattgtgcatgttctagatccatgttattcacctattatttatatcggatctttgcacttaaggttgcatacgagtatatgacacttgtgatgttaatgaatactcaagaaacatatccatatctttcatatgcaaccggttggtcatcaagtgaaggatgacaaccgatttgttgagactaatgttctcctttgagatgtgaaaaggaataggtcccactatgatgaggctgatggatgacaccatgggttaatggtcaccaagccaaggacatcgccatgttggtaagaatgaaatcaagcttgtaatgagaagaaagtcttgacaaatgatggtaaataccttggtataaacatggttgaatcaaatggtcacaagtgttgatctcgactcaagcttgaccccaagatggattttgcaaggcaaaggtataatgtagctaagaatgttttcttagccttttcccggtcttgatgtttggtgtagaccggatttgctagataggcgccgtactatcaagaggggtctatgaagcgagcttgtggatgatcttgtgccttattagttcatatgcatgtaggtgtatttggtgggcttgtctagccaagtgtggtgagttttctcaagtcctaaacaaagagatatgtgggcaaatcctataggtttgggtagcctcatgtggttatgtccggtggagtatcctttggagtgtgagccctttctccctgagaaaatttgtgtttcttggatggattgttcatgggttggatagccctttgaataagctttccataaagtccaagaacgccaaattccgagacccgagtcaagagatatcgtcgttttactaacggtcggttgagctgaaaagtgaattgcggtatgaccgtgggccttaggccggtctgaccggccccacaggtctggtttttggtggcgatacagagccgccagagccgcaaccagtcagaccgagccgacggcggtctgaccgagccgtggacggtctgaccggccactacactgtggtcagaccgaccaggttgagtaggctcaatgattgccctgtaacggctagttttctagccgttacaaagtagtccggtctgaccagcctcacaacagcggtctgaccgacagagcacagagttggggatttcggttccaacggctagttttggtggttgggggtatatatatacccactccccagcagcaagggtaaagttttggcactccattgcattatcttgaacccttgcaagagctctcacacccttgtgcacttagtttttctagtgaggtgttagagagtgagttaagccaatccaagtgcattgcttcattgttatagctagtgtggcacttgatcatcctcggcaagcatcctagacttgttactcttggaggttgccgcctcctagacggcttgtgtaggtgttgcccggtgacctctccgaggagattgtggaggaggcccggcgccgtttgtgagttgtttggagttcaccaccttcggagtgaaggaagaactaccccgagtgatcgaggcttgggtagtcctctccgtgggccagctcccgccttgcccaccccttgacaaaggaggcgtgcggtggcttcgtggttgagcggtggagttgggctcgcctcaacagggattaggaaaccggcgagtttccgaacctcagtgaaaaattccttgtctattgtctcatttatttgttgcatttacatttgtgctatttacattcatagagacatatttgagcctatatcacctaggtttacaaaacttaacttagttgcttagttaaccttgcaccttaccttgcctagcaacttaggttagttttgtttaagtgccattaagttttaaaaccgcctattcaccccccctctagtcggcctccttgatcctacataacccctatgtacgagcaacactaacgcgtactatgattctaaggtcctgtttgatacagctccaacttctaaatttagctccaagagttgagtctggagtggagttg

SEQ ID NO: 81678 - DNA, 1650 bp, Oryza sativa
catgattatgaaattaccattcctcgtgactgcaaggagtagtacttacagagtaatagcgttcgcaaaagagaagcaacaagtatataagtgacttatgacggaaagtgggggattaagtcagtaaataaatttcgtaataccagggaatcttatggaaaacaaacaataaaatagtgaaacactgacatataatgataagtgaaccagagacaaacgaaatagaaaatacttatcttacctgaaaagtccatgcatctggtttgcccttttggtttccactgttttggagactctcagcttaccagattcttctttcaccacttttacttcacctggatagtttagtgataactctcccaatggacccttagcttttataaattgctcctctaatgtaagagtaacatttgatggaacttctatcggtttctttccaattctagattccttgcactcaattgtttttctgacaaaaccaactctgccagcagggataacatgaagacaaatcccttgtctctttccaaggaagcctgttcttgaattgctgattcatatcaaagaaaaatccatcaaaactctcatataacattggtaaaaaaaactcccatataatacccaaaggaaaaaaccattacattaaaaatgcattaatttagttttatacagtaagcgaaaaaaatatgaaaagaatagcataaccaacacaaaacagtttacaaaggccagccggcgaaactgcataatagtaaacttggattataacatgccatgctcaccttgaacatttcaggcaacatatcaaccatgtagttcggagccgctttactcttagtaataacaaggtaaaatcatcagaaaaactaagtttttacaaaggcatataaaattctgcctgaaattaggataacatgtcatgatggatcaatgtactaattcactcaaaactgttgccaagttagatctttagatctgatttttcacacaatttagaggtatggttccccataaaaaaaaagaggtatcgatatttttatcatggccattattttgttcacaaaggcaatcataattaacaagatcaacttcatgattcattattaccatcatgttatgtgaatttataaggttccagatatgaaataataaacacattagcaacctattggaagtaaattatcaaatacggtagcttcttcttttccttttttttttttgccgaggtggccaaaggaataggccgtcccaattttattaggatgagagatggtgttacaaattttacaagatcgacattaaactgttgaggctgggccgagacccaagagcagaggggaggggagaacaactttttttttttgacatgaggggagaacaacttagaaaaagaaaccgccttatggcaggcactcagccgacttctctaaagatgctggcttccctccaaatcaggatctcttctctaatatctctgtaaaatatggtagcactgcattcaaggtattggtgtattgtgctaactgattggacaactatccatgcttccctggaacttagcattcctgtaagatagggcaccacacacacccacacacacacacaaaaaaaaaaaaaaatgatcccttcatcgacagaacaatcccggtt

SEQ ID NO: 81679 - DNA, 627 bp, Oryza sativa
acctcgtagttatagttattagtggtcgttttagtggttggataactcggtacatctcgcgtaggggacttgtggccgtccatcagtgggatcatacggtgcaggacagtgccaattgagcaccaggcgggcacgagtcggcttaaccaccgcacgcgccaggcgtgtgtgggcacatgtttcgcagccagcttaatctaatcagcgcttttaatttctttccacattgagaattcatccttggtctcagtggaaaaagatgcttcgcttggcaaagcgagtggtcattggcgtctctgtgggtgccctctatgtcaccacccacaatagtagtacatgagcatgcgcattagtcagcagacttaaattaacattggttatttgtgatcttgtcctgagtatgctactaccataagtgtccaaacacatggcttgtccagaataataatacttgtagaaaaaaccgtgcatggagcttcgatagcaatttggtggtcatggtgtccgtctaattaaaaaagatcacagcgtgatggatgtgttttcacatagggtcattcatcatccgcactgcattggcatatttgtaggttggatcggccagaaaaagcagtgctcccccgttgc

SEQ ID NO: 81680 - DNA, 8233 bp, Oryza sativa
aaatgcatgtgttggaggatcaagtcgggtgcgatctgattcaggtagataaccgggcagtgcaatccttgctgccttacatgagcaagttcatgaaactgttgacttttgctctgaagatcggggcgcatttcattgtcgggatgggggagatgatacctgacctgagcagggaggtagtgcacttgctggactcgtcagtcatgtatggtgcaaccacatcagccttatcattgggggcattaggcgcagcggcaatgtatggaaaagcgaggaataacggcagccagagtggcacaaatgacatggaggatgatatgaaaacggccagacagtggcttgttgatttcttgaaaggtcaagggattttgacagggatggacatagcacagagatttggtctgtggcgcgttaggtacagagatgacggccacattgcatggatctgcaggaagcacattgttgcgagagcagacgagatctttgaactgccactctgaaccatccagggtgcagttggtttcacggccacaaggtgcctatctgatgtccctgtccttctgtactgatgatgacaactgacgagcttgcaattgtaagggatggtgccattgctgattacaaggatcgcatatggtaggtacctatcatatgctctgttccagtttctatcactctgcttctgtcaatggtgtgtttttacatttttcctctttacttcgttgttgtggattcacgctagtagaaatattaagtttctgacggcatattgtttcctgttcaattgctgatttgaggagttcgtttatctttcttcaattataatactacagtactgcttcatctctgatgattaactactagcagaattctgtttcagcatattcagattgacatgatcttatataaactacctatagtatttccttgcagaaaaaaaatgccacattattacactaaagacacaggaggtgacactataatgactgtatcagttatctgatgccagtatgaattcatggtttttcccaaccctaacccaaatgcttgctacctgagtgcaacttcagtttctatcactctgcttctgtcaatggtgtgcttttacatttttcatctttgctccgtaattgcggattctctgatgattaactaccatcacatctctgtttcagcatattccagaatggcatgatcttatatgaactactagctactatatcatttccttgcaggaagccaatttgttacactcatcacacgggaggtaacagctgacaactattaggactgtatcagttaactgacaccaggctgaattcatggtttttccccaatccaaacccaaattcttgctacctacatacaccaccgtgtgcagctccggccggcgagctcagaacaccgggcatcccttgacggcgatccccggcgcggtggggcaggaggcgagcgggcagtggtcgaccgccgtgccccaccacttgagctcatggtgggcgttctgcagggcgaagaagatgagcacccccatgaaggccgtgccggcgtcgagcgccgccgacagcacgtagttgtacttctgccaccaccccttgcggtacttgaacacgaagtagttgaagatggtgcccgtgacgagccagctcgcgatgttggtcggcgtcgccggcggcatcccggcgaacccgtaggagatgacggggacgttgatgagcgcgatccacttcttctccgggaacgccctgctgagcagccacaccggcacgggcagcacggcgccggcgaggaacagccacaccaggttgcggtacaggccgtggcggccgaacagccgggcggggccgatgagcccccagatcaccgacgcgtcgaacgtgacccggtacttggggcacgtccacgggctgtccgggtgcagcgcctccacgtcgcagatgttgtcgatgctgcccagcatccaccacgccaccgccaggttcaccacgccggcgaccaccgtgcccaccagctgcgccgtgtacatgcaccgcggcgggatcttcatgtagtgccccagcttgaggtccgcgaggaacgacagcgcgtgcaccgtgctgatcctcccgtagatcttgaacagcaggttcgcgatcggcttccccggcagcgcgtacccgatcatgaactgcgcgatgatgtcgtaccccggttgctgcaaccacaacaagtttttttctaacacaatcagagatggacaacgacgaatcgacgatgattcatggtgagatcgatggatggatggatgcgtgcctggttggtggtggcctggatgacgccgatggggagggtgacgacgaaggcgagggcgaaggcgaagagcatcccccaccacggcagctgcacctcctccctgtacacgaacgacatgaccagcgacacggcgacgctgccgacgagcagcacgaggaaccaccactgcggcacctgcttgtaccgccgcatcagcttcgcgtgcacgtccatcttcgccgccgcggagctcatcgccgacctgctctgcctccagatgtccccgccgtggaacagcgccacgtgcacgatcgtcgccgtgaacctcaggaacccggacccgatggagatggcgaacagcgggctcaggtacagcttcccgtagctctcgtacgccgccacgttgaggtcgaactccctcgtgagcaccttggtggtgtcgtacttctgcccggacgccgtgaacagctggttggagaagattgggaacttcctcgcgtcgaacgtgtcgaacttccagtagcagagcggcacgatgaggtagatgaacatgacgaagcccgcggcggtgttggcgatggacgaccacggcgccaccagcgggctcccgtggtacgccgagatgccggcccagtccagtgtgaaggcgccgacgccgaggccgtggtagccggagcccacctgctgcgccgtgatgctgtgcggccacgcccagcacgcccacgagaagaaggtcaggatggggagcaggtagcccggcagcgcgtagtaggcgaagctcgcgaagaagaagatgaggaagaagcgcatccgtgtaggccccctcgacgacgaccccttcccgccatcgccgccctccttctcgtgcaacgcccttcatgtactcacagagatcattagttagcctgcatagttaactggctgatcttgcttaattgagagatttacgacgtgattaattaattacctgaagagtgagacctgggctaaattcgatggccaccacatgtcagccgggtcaaccaggtacctcctcagcatcccggcccaaccatagcccagtatctgcatgcagcaagccaagcatgacgtcacttagctgtgctactacacttatactatctaccacgatatgaattttcatgtctcattgtttgtatatcgtctaaatagttattaaaaaattaataaatatagtttttctagattcatagcgcactcagattaaattgcgtgagaataactcctgttcatgattagttaactatattgttttctttttttactttgggatggattagttaaacgactagtctaatcatgatgcaagaataatctcatactcctatttatgactagtagtagtactgcttagttttgactcgtgcacggaccatccgtcaccatatacccaatcttttttgcatcttagtgccagcaatccgacaggaatgctaaagttgcccactaatacgaaaatttgcaagaggcacatgcagccgcatgctagacgaacaaaatcacgccaattatttgtagggcctcctagtacatggatggattcacggtgacgttatatgccaacatgaggttttctttcaatttcaacttcaacgctgcatgattggtggcaactcgtacgcgagataaagcaacgcaagaacgtctgattggttcagtatttgtcacatcttttggaggaaaacatacaagtcgcaatcgcgcgacaaattcgccaaaaaaaagaagacacgagtcaattcttatttcttagtaccagtcagaaccagtcagaagcaagcaatcgaactgagggaaaaagatatggttgaagtggttttgttgattgtttctttgtgattaattaactaattaagcattcaattaaggtgctacgtaaaatcatggttcaaaattccggaacgtcatttcggacccaatatgatgttatttcgaccgaatttttaaatttaaattttatctttttaaatttggcaatattttatttaaatttgactaaattttgttcaaaacttcggcaatttcggatcaaaatttcagtatatcggcaccctcggaaagaaccgtggaaaccgaaagattaaacccagcgtaaaaccggagtaggtgtggagggagacctgtgtggtgaggacgatgaggagggcgcagaggaagctgagggactgcttgtagtaggccttcatgacggtgatggcgccgatggagtaggcgtcgccgccgccataggagacgccgcagttggcgaagatggtgatgatgacgtgctccttgatgttgaagggccccgggttgaggttgaagctgccgaggcggccgccgaggaggcgcacctcgcggctgggcagcacggcggccatgaactgccccgcggggagcaccaggatctgggccaggatccccgagatggtgagcggctgcgtgcggtaggtgaagaaggtgttgaggaagatgagcacgacgcaggacgcgagccccagcgtccacgcccggaatgtcatcaccggcgtcgtcgggtcgtcggtctccggcaccaccagcgccacctcctccaccgggcacctctccccttcccccttcgccgccgccgccgccgccgtcgccgcctgctcctccgccgccaccggcgacttcaacgacgccatctccctagcctcgatctccttcctcctccgcctcacaagtcgccactacaagcaaagcgagctaagctagctgcgaatgatttgtaaagaaaataatttgccagtatctggagaggaaggtagtaacgctttcggggattcgatttggatggtagcacttgaccgcggcgcgcctctatttatattccaattcgcgtctccattttttttcccacctcgtacttatagttattagctggggttttagtggcttgattactcggtacatctcggctaggggaatcgtggccgtccgtgggtgggatcggacggtggaggagagtgccagctgggcacccggcgggcacgcgtcggcttaacccccgcacgcgcgcggcgcgcgtgggcacatgttacgcagccgcttaatctaatcagcgcttttaatttccttccaaattgtgaattcatccttggtctcagtggaaaaagacgcattgcttggcaaagcgagtggtcagtggtggctttgtgggtgccctctctctgacaaaacacactagtactacatgagcatgcgcattagtcagttgactcaaattaacatggcttatttgtgatcttgtccaaactatgctactaccagaagtgtccaaacacatggcttgtccagaagaaaaatattggaggaaaaaccttggatggagcttcgatgggaatctggtggtcatggtgtccgtctaattaaagaagatcagagcttgatggatgtgttttcatatagactgattcctcatccggattggattggcatatttgtaggtttgctcggccagaaaaagcagtgctcccccgttgccctcacagataacccaagcaaaatcttcttatctgtttatcgtaacgcgtggtaatatattcgtcatccgcgtcactgttcgaaaagatttcgtacttgtgctcgcgcccaacggctggctggctggcttgccggctgccgcgcatccggttcttttttttttaacggaaaaacggcacaagatagtgccttttcattgaatagagtgggagaaaatacaacccctgaggataaaaagaaaagctgttacagtacactatagaaggtatggggcgaactctcgtagacgcttagcccctgctagaacccataggccaacctcatctttgatttttgttagcaggaagctcgttgccatctctttatggtcaaaaatcctccgattcctctctttccaaatctcccaaaccactaacaggatgagggatctaagtcccttctttggaacaccgcgcgtgtttgccatgttttcccaccactactgcactgagtgggcttcctcccaattcaccggatccagcagcagatggcccacccaagtggcgacaaggtgccaaattctcttggtgtatctacaagtggctacaaggtgcaaggccatctcattctcacagcggcatagggggcaatgttcgttgttttgccaacccctggtcgcaagccgatcagatgtccaaactctgttctagataatgagctaagcatggaatttacatttctcgggtgcccacactttccatatcaaggagttgaaatttgtgttaggtgtcccatagcactgcgcttggtaggctgaagatgacgcgtatcgcccgttgctggtgaatttccaagcgatctgatccggttcgccattggctaattgcacattccgaactgcttcccacagggcgactagctgctcaatgaggctgactgtgatcgttgactgcgtatgtatggtcagatcttttatccaagcgtcaccctcttttccttgtcgcagagttttctttctgtttttggaaatcgcatagactagtggcatgaggtctttagggcgacgcccatctatccaggcagagctccagaagcgtgccgtgtttccatcacccactgttatttctgttgaggcggcgaacaggtctctgtcaatttcgtcacaaggtgtatcgagaccaacccatggtttggtcgggtctttccacttgtgccagagccacctcaacctcaaggccctcgtgaacttgtccaaatttagaactccaagtccaccctggctggttggcaagcatgtctttgtccaattgacctaacattttccccggtaataccttccgtgccggcccatagaaagcgtcttcgctgtttgtctatctgctccagagattccttcgtaatttttagagcagttaggaggtaaatcggctgcgacgtaagcacagatttaacgagcgtagttcttccagccgccgccatgtgttttcctctccaggtagctaccttccccgagattttgtcaaagaccggttgcaagtcccccttcctctttttttcctatcaatatatcacctagccactacgagttaatgggtctcgtttgtcatcctctccctacgtgtttactctacattgtaatcattgtggttgtattgcgacatccttttctatctaaacgttctcaggttacatgtccgactcgaactcttatctcttactccctccgtttcaggttataagatattttgattttggtcaaaatcaaactgtttcaaatttaaccaagtttatagaaaaaaatagtaatattttcgatccaagataaatttattataaaaatatatttaattattaatttaataaaattaatttgataatgtaaatattactgtacttatctacaaatttagttaaacttagagtattttgattttaactacctgaaacggagggagtaccatgtattccaaatttaagttcaactataacaaaaataaaactcgatgtttcacacctattttacacacgaagatcggtggtcgcggctgtgtttctcggcgtcggcgcgtggcttcgagatggcagcgttgggagcagcatgcagcgtgtcatgctgccatgtacagttgcagacaacagtattgccattgcagtacactgaggcatgcaggtggtggtgccaaatcacttttgggcatggggatcgggcgatcggttcggtaagccggcagtcagctttatacggtggtggtgtggtggactggtggctcgttggaaatgttctccgatcacgattggctgatgattgacgaatcgaaccatgattaattgccgagttttctgacaaagaaaattcccaacttcgtacgtgtctcagatattcagacgtgcactcgataatatgtaaagaaatgcgcccttcacagttcacagcgaacttacatcggcatcggcacggcatgaatgggggccatctgaa

SEQ ID NO: 81681 - DNA, 604 bp, Oryza sativa
agtactcagcaagctatgggaaataagtgtttaatacaggcttcaaagaaaggctgttgtttttgcaattgattttatttgaactcttttctaaaaacaactaagtgagtgcttctcaaacgacacgggtgagacagtgcgtctcgtccggtcggagtatgtgcaatgtatcagtctttagaattgaaacaaggttggcacccggccaacagcttttcaaacggccacccgggccaacaactttcaaacggccacccgggcctagctgatcccatcagctgcagatttttcaaacatcgaacccctttccacaacagcaatttcacaagcagtagtcaaacaaaactacgctaggaatcacttcacatccgcccatgaccgtgggcacgactgttagaacagtttgttaccctctgcagagggggtacactttacccacacgacattactaacctggatcacccagcccgtggggatcggccacgtcgggagacctcaaagctttcatgacaaggcatttccaaagccgacacaggtttaccatatgccgacgagaggggtctcagcccaacaacaggttaggtcccagaccatactgtgccag

SEQ ID NO: 81682 - DNA, 9715 bp, Oryza sativa
aaaccatggataaatttgttacttatggtgttgggcctattaaagtcattagacaaaatttaaaggcgagaagtccatgtatttttggtattttgggacgagggagtatatagtctaattattacacaaaacttttataaaatcattattaccttcaacccaaaatataagacacaaccttttcttttctaatgtttcataatataatgcgcacatacatgcatgtaattaattagcatctttcttctaaattcattttatttaaaatcatccacctttaagatctctaatcctattaggtgtaaacattatatttattgaagtggtaccagaatgtgataatagtattgtatttatagagggagtacaacacaaacttaaaccaacaaaattaatgacaagcataaattactaccctacctgattggtcttaattttcactggacacaaaattaaaatccattaggaggtccatttcaattcatgatttctacataaaatcaaactagctcatggccttccaaaatttatatactgtagatgagctctaattatgcactgtctataaactaaagcgcgccaaatggcgcgcctattttctagtatatttcttttttttatttcctatatctggtggttgtgtcatgcaggcttcggacatgagcaagttaaggtactctcaattgcattataagctcaatttgtgccatttagttctattgatgtaatctctaaaattttgttagtggagcacttcaagttgcttatgaggaagaccaggtagatggtagttgtaattctactttcacctaaaatcactttttaatgcttttattgatgaggatctcctcttttaataccactaagtgtatagctatttggtagaggttttggtaaaaaaaaaaagttggtccctccaatcaacaattttcgatgttgggagtttttagttcagtactctagaattctaaagttggatacacatatccatgcatactgctttagagatcatagcctctgcttggtagtatgccacaattttttccctaatgtttgttttagttcaaacgttaagtggacatgctcttatttgcagtggttttcacggatgcagagctattggaatttggaacaaactcctttgattatatgttatggacaacaataagaacttcaaaagtaggttttgtggacacatttttgggttgtactcatcattttttgcgatataattgtccaggcgttggcatcagttttttcatactacattggacggttgaattgttgatgcctcggtgcataatgtgtggctcacctgggaggttccaaggtgttctatgttctccacatccttcttttaaaggcaaacctctaaggctgtgttcgcatgcaccttttcccattccctctccttcgttttccgcgcgcacgcttttcaaactattaaacggtgtgttttttgcaaaaagtttctatacgaaagttgcttaaaaaaatcaaattaatccatttttttaaaaaaattagctaatacttaattaatcacgtgttaatggaccgctccgttttccatgcacaggagttaggttcccatctcccccatccgaactcagcctaagtgttcttctacttcttgatgaagctaccgctgatatatatagtcttgttatttctatcaataatagccctgaatttgttgtatacagtggtcatgactttatatggaatgacggaatgaccttgtgggtcttggttttttaaatcactccaacaaacgttatatgtgttgtttggttaattttatgagtgttttgagctaaggatataatctctaataacgaattccatgcgcgttctcggccagatagccccgccacgtggcgtcgtacaattgatggaattggctctcacccgcatccgttggataagaaatcaatggtatagagaaaacaatggatctaactgtaaaatattaattttcaaggggggtaaatggaaaagatggcatcccttctggagaaatcgtgtcctgttgcgatttctcgatttctcctcgcctcttcctcctctgctcctccggcaagtcacgagccatccccgacgccggccgccgccgctccgcatcagcgccgtccctcgccgcccttccgcaccagcgcctaccctcaccgatccggtgatccccatcccctagaaaccctagcccacagcgccgccctcactccacctctcctgtgcgtacgcatctcacgagccgagcgccgctgcctcctactcgccccctttccgtccgtctgcctccttcctttccggtgcgctcgacccggcgggccagcggttgagcttggcgcagcactcgagtgggatggccggccgagcgctggggttggactccgctggcatagtggtcgatcccatccgtcgccgtcaacatagctgcataatcagttgggcgatttttgtttgatgtccatagctaatcctagaattagaattgttcttcggtgattttgttcttcgttgatcctgtgagtctattaatatatgaaaaaccataagtgcggttgataaggaaccttgagaaagcttgatctgttgctcaaaaacatccaggactaccacaagcatgttctgctggtactgtacagtgtacacagaccttggctgtaggtacctacgtttttttttttagagaagggtattttttacccagcctctatattcaaccggatatatacggccattgaaatagggaacttagccccacaaacaacccaatctgaaattcgctccatagaagatttgaactcaggaccttggggtactactcaggtcactgtaaccactaggctgtaggtacctactgatctttcagtatctaatgcagaaagtgaaagtgttcccatccaaagtcatttaccatatggtcattgatttctgtagatggattatttactgccctccttattgctgccctttcttgcttctcgatattatttgttcatatcattgttttgttctatttatttctttttgcagatgttattgaaaaaattattgctgtctccatctccaatgcagcaatgatatctacaagttcatcagattttaggatgagaagattagagcctatattatccaataaaataaggtaataagtatccctatttattttaaatatttctgttagtattgcataatatttaatactttatttttttcatgtagagctcatcttcacaaatggagtcacctcaagatattcggataatgatagttgagccatgtcatttggacacaaccaacatcttaagcaaacaaacctatgaaaacaacaataatctggtacacaactgcacatatttcttttttaaatatactgacgagacaaggaaaatatccatgtaactgtagatatcttttgggaaaggtatactaacatatcatgattcctctttgcttctctattctattacagtgaacattgcagggtgtggtggtctaattatgttcagctaataagtcatggtagacttttataagtatccttaaaatttggaatattcagcgaaagaatcatatatatgacccttataactacacctttatgcaccaggtaattccacacacttactctctttgaatagttctcatatatttaatagcttgatgtttcaagcgtgagaaaaaacttggattttctggacaaaaaaaagctatatacttgtatgcattgtggttgatgttgtctttgacttactaatggcaaacatgattacatgttcttggaactaattttgagtcatgactgagcagggtaatgtatatgctgtagtaagaattgcatttattcgagatagagtatacaggtatatcctagagtaagaattgcattgctgatctaacgaaaaaaaaattatttgacacgttctttgtactttgaatcaatgatgttaagctttttttgtataccacaaatgtgccttgcatgctctctacaattatatgacagtaacaaactagagaagatgtttggggtttgcctgttgtgttcactggaatgattttgtagttgaaagtaaatttgaagctttcatatataagcaagctgtgatgattctttatataatcttagtattatgaaatttaactgtttggcacaaccttgttgtccttgagtcctgaaaactccagcaaaatattgttgtgattagaattaggtacaggcatctgattaagttattgtaaatcacatccaccatctgatttggtgaaggtatccctaaaacaaacaacatggatacaaattaatcaccttacaaaggatgattcctctatcttcacagagaatgattcctcttatctttacaaagttaaaaaaaaaatacatcacttgcagcaaaaagagtttcttctctacatagttcaaatatattatgctgaagaacattattatatagtacaatttatatactttggagtcatatattagttttgtgaaacaatgaagcaaatgtaatccatctaataaaatgttttatgataccatttacttattatttatattattgcttttctcagtatttactattataaaggatgttgattcactgtttcttaactgccttaattttctaggtttttactttagatgttccatgacaaccatataatcattcaatatattacataaatatttatactattattatcccagaaaagtagtagtgaagaagagtagaaaacactgattatcatttgattcaaacaaacagtaaataagcgctctgcctgataacatatccgataaaaactgcatacttttgttatatggattatgcacagcactaacttttggtgtatttatagcagatgcattacatgtccatcgagaaaagcgacgattcaaaacctatactcatctagctagcttaatttattagaaaattgaaatagggctttatcaaaagctttgatcatttcaggtcctgaacaatgtatgtctatataatagacagtttatatttatatattcaataatctacaatatgtctaagtactagactaaagtaatgcaaaattatggttacctactattgagatggctctcataaagttccagtttagatgttcaattatcattgattaatcaattgccggctttatctatttacatgctgaagtactccactgtactcatttcaatgactttgtcatatacatgtaacattttattacaatttgttcctggatctggaattcctgattcgattgggcactatttcatatagtgctggggctgtctcctaaatagttttaccatccataaactgaaatttctatctgttgaaaatggcgattaaacggaaaagaatcatttctgtagaacagcacgatggttaaacatggaactgagagtttttttttttcagaggggaactgaggatttcgggctttgcaatatgagcatatgccaatcagaacatgattagtgccctatttagctgatgatgatgataaggcttaataatacggtgtacactgcgttcaattgggctggcctacgtatacttccgcgcgaagcagcggttactttctagtatatgacgatttagaggtgcaatattagctttaagatctttcttaccattttgtttgtcttacataatcatccatacacatccatacagtttcaacacaagtaatttaactagttgtgtaggatctgtctatacatcactcagacagattttattattattattactagtagtagtatagtgtaacaaacaaaacaaatctttatctttacctattataaaagtttaaggtgtttttgccagtaattttcgtacgtcgtcctgttagcgcacgattttttttccgagtccgttcccgtatagcgaaccaatccagatcgctatcgcccaaatttcccatccgattcccacccagattgctccctcccagatcagttcaaacctattttgctcatatctcaatccaaacatcacaaaaactccaaacataagaacaccccatattacatccaaacaccacaagaagaacactgcatacatctattgtccgtctcactcacaaccgcttcgctcccatcccatacgcacgtacggatcaaacatgccccttgaactagatatcaaatccgatccaaataaatcacaaaatcacaaatccattgaattacaaaatcgcaaatccaacaacaatgaatcaaaatcttccaataaaaattatatcaccggtgccattgttcatcggagccgaggacgccgctgccccgaggccgtggtggcttggcggcgcgccgccgtgcgccccgaggagggtgccgccgtgaagagggtgccacttctgtgccagagaagaggattcctcggacgccacccgccagggaaagggcaccgctggctgggggggcgccgaccgccaaggggagggcgccgcccctcgggggaaaggcgccgctggcctggtggaggatgccacgtctgaggcaccgggcgccgtcggccgggaggtcgccctggctgaggggtaggaagagcggtgccgccggtggggggaggaggagggggactgggggagagggtgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgcgctcgctcgcctcgccaggcagggcaggcggcgcgcgtgcacgacgtacgtgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaaccgacccttctctatataaaccgacttgccgtcttcacgcaacacttgcgaaatcaatctagggtttgtctcctactctgtactgcgccggcgctcgtagactactccatcccgctcgccggcgtgcaccggcgattgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgacctagcaaccggtctttccgtcacctcggtacgtgttcaatatgttgcgcatatttgatctgttcatgttgtactgtgtagtttacatgtatagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctaaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcaaaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttgttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtacc

SEQ ID NO: 81683 - DNA, 1497 bp, Oryza sativa
ggttgagttttttttttttaagaacggagggagtatcagtgtggcaaaatgcagttacttttttttaaacgttacagttacttgttattcacaactcctagtcagaaaatcccacttttaatttaatccaacctttgtaaattattctaattaagcttaagcaacacaacaactaagggttaagcctcgtagaacattgatcttttatcacatggatgttgggtaagccaacaaatacaaatccacatcacatattaccacatttgtatagcttcagatatagtgcatagtaagcaaaccataatatatgtaacaaagaagctagcgcaacgttacggatgaaatctgaaaattttaatcggtaagtatactacatatttatacttgaacgagtttccttgctatgttaatttacctttcttgatctgatttgcttcaaggttctgactacttgactctcaagctgctcaagttcatttgtagccagtggagctaaatcctcacctagaaggttcctgcaacattatcaccagttaaaatattttgcaaaacaaagggagcaatggagtagagccagtgttctttagactaaaatattagacccaacaaaattgaagaacacatgtacatatgagtatgaacataaagaatctattacctttgtgattgttgcagaatctcaacatgtgccttcaagttcacatattcctgatagttgttctacattataaagaaaagcgaattgaaaacaagctaaaattttaaatttagttattcttgtcatacacagcacaaaagcggcactaatgatttactgaaagtgtactgataatatacatttgtaatagtgacagcgtttgacctatattaatctacaaacagttgatctatatatatattgtattgtattattaagatagcttaaatggaagctaccacatttgctctggaggctaaaacctatattaatcggagaaaagggaaaaaaaatgtttggaccattagatcgtggggtctagctcattatagtttagattgatgaatatatctgcatataaaatgcaattgtagctatagaaaaaaaaggtagaaattgtatatgaaatccaattctattttttttaaaaaaaatatattaggtagaaaatacaattgtatcaatcgaatagagttaaagtattgcatatcaaatctaattctacttttgaaatctagcaccatgcaatttgcatgagacaatcgcctagttatattaagtataggccaagttatatttgcagtacgtataataaacaaattaaagatgtgaacatggtaattaaaactaaaatggtccctgtagagagatgcgtagagtttatgatgaatgccaataattgacggagtaactacgaagagatactatatatactctatctagtgcacccagatccccatggatatgttcaataaacatttatcacatttacatcatgtatgcgttgcccatttagctag

SEQ ID NO: 81684 - DNA, 17730 bp, Oryza sativa
  unsure (1)..(17730): unsure at all n locations
cgttttgcttatccatgaaggtctgcctgatgaattcaaatccatgtttgtggaacgaaagaggatttgtgaagatctcatgatctaggggatattgatcagtaaggctgctttcatgtacaccaatgctatactgcttgtaacgcaggcccatttgttccgctgggttgccgaaatcaattcttgatatccagtctagtccaccccatggcacaatctgaatcaatgtagcgttttgtggcaagaacacacagttggtgagtccagcaccatggacacccatcatcacatcaacagagttgacaaccttgccaaaatgggagagatcagagctcacattggcctcttcaaccaccacctcgtaacctatctcctcagccatcgccactatctcgttaagattgagaaacattcttgtcctctgcctggatataatgagcagtcttggcttggctttgggaatctcaccaagcgcagttacaaaatccctaggcagtgagtaggtcctgcgcatgaacctattaaaatccaccattgagtagttatgtggagcttttgatgagtcaattgtgaactccatgtaagcatgaaggccaacaattgcatgcttgaagcaatgcacttgatcgtcattgttgaagtcaatcaaggggtacttggatagcttatcaaacaccaccttatacttccttgtccaccaaatagccatgtctgtgattaggaattgaacttcgccattgaattcgcttgcggttgtgaaaagagggacaagcacgtcggtgaagtcatggaatagatttccagtgtatccagtcagagcaaagaccactgcaggcacattgtgatacttgctacactcaggtgccactttgcttgatttcacggttatctctgtaatatggccgaggcagagctcgtcacctttacgagggtaaggcttaactttccatatctcctctctctttgaactggcaggttccatgtacatgacagaacttgcattgggatgaatcctaatgttgccccgcatctcacagacatttgctctgaagtttgagaaatcacatagtggtttcttgttccactcctcattatcagtttctgcaatagagtatcatcaatgaaagagcagaaacaaaagactgaatgaagcataatcagtctaatttaaggttcaatctagtagttaggaatctgaagtgtatgatgccattggtctaggataccaaaatagggttttgcatctatggccaaaatcactaaattcagatggtccattttcctgtcggcatttattgaaatctaaaatcctaacctggttccacattgtctcccttgtccgcgtccatctcaaattcatatttttcattcggtttgccatctgcagacaaagtagggccatcatacccaccaagaacttgtaagcaccagcttaacaagtaccaaaacagctagtactacaagtaaagtccaagaaacacaagaagaaacagcatctactaccttcttgcttgccattgtcagtgtcttcagcatcacggatggtataattggaaacagtcgggagggtcaccttgctatgctgtgtgtgcccctcttcctcgccgttcttattatcctcttcgcctccaccacctgcacatcccaccaccaaagtactcatacataaagcaagcatcaattgatggcgcccaaatctctcttgacctctcaagaccccgtgaatcaaagcatccagagacagagctagacaaggaaattattgacggattggaaggtgacggctcacctaacacctcagatgcagtggccgcctcctcgttcttgccttgctcgggctcactactgagtagcctcttctcctcctcactagtccctatcatcatatataacgaaaaggtcagtacgctaggcccaagatttgctgactgcagcaaggcggcaattagctctggagcttttcacctttggcggtggcgtcctcggcgccttcgtcttcgtccaccaccttgggatcctcggcggcggggaaggtatcggcggatctcctggagtcggcgtggatccgctggcggatcaggagcgagcgcggcgcatgatccaccgacagccggccgttcactgcgaactcaaagaaacgagtgaggcgcttggtgttaccatcgatccaaggatccaagaagaaaaagaagaagaagatgatgaagaagcggcgacggcatggcgtacggttgaagaggagggcgtcgggcttggagatgacgacgaaggtgagtgtgacgaggaagaagccgatgacgaggacgagcaggcgcagccgccgcgactcctgccggaggctccgcaccagcttggcgcgctcgacgggcttcatctccccctcctaaatctcctcgctcttcttgccggccgctccactcgaccgacctcgcgcccgccgctgactttctcctatcccgcgaggagagaccggccgagagaggcggaatggggtttgggatcagcgtggttgcgagaataagagggatagcaatctgcaatcctgggctggctggatatgtgcgtgctagcttccttcctttccttgcctctttcgtcagctttccagtattcctcttcctctgcgctctcctcccagtcccagcactagcggtctctcagtatgtgtttggcactttgggttaaaacagtgatgatgggaggtggggttttattcttgcatagtttacccgttccaaacaaacggcggcttaggctcagttttacataacttttttccaactcacctcttgcatttttagcgcacacttcccaagctatttttctaaaataaattcctataaaaaattgcttaaaaattatattaatatatttttaagttttgttagctaatacttaatttatcacatgttaatccatccgtatataggggagctccaaaataatagccttaatcagtgtgaacactctcgttgcaggagaccggaaagcagctgagaggacatccattgataaggcaagacattactacaggagtatcatgatatcatgtatgataaagtcataggtctcaaatcagtttttttcatagtgttcagtagttctaaagctgtttcagtttttgcatgtcaacccatattatttcctattttagtcctcatattttacatcaaacatcccgaaaattagaaaaagaaatataaatacaccctcccatcctcgtccggtcatccccgtcacgctttctccaaatgtcggcacgtagctctctctctccccctccgccgctctcctcctaccaccagcacaactctccctttcctcctccgccgttctcctcccaccgttggtgcaaccctccctcttcccttccaccgctctccctccaccttcctcgtcggaatgctagcgccgcctcatccttgccagatctagcccgtggttcgtcgagtctggcctcggacggcggcgatggctgcgactccactccactaagctcgccagatccaacctggggctcgccggatctggccttgggaggcagcgacgacggctcgacgacatcggtgcagcaacttgactacggcggcagaggcaatgggacctcccttcacccgcttcctctacctcgccgaattcggctgaatctcgacagtgaaggcgaggatgttataaaactggcctgaaatcaccatcaacaaccaaacgcggaagaaacgccataggagatccaaacacgatgatgacacgaggcacgatatttgttaacgaggttcagctgaagcctacatacccgggacactgattgtgggtgctcatctgcgatccagcatactacaatgtatcagagttacaatgactcacgcccggacgtcgccggcagccacaccatctcgctgtgctaagtcaccatatgcggttacaacaggttcgtccctctatttaagagagatcctatgataaagtccgactctcactctatttctaatacctattacaactccaattcctaaactgtaatcgacattgtacacatattcaacataaactctaacaaactccacgttgccctccatgctgcttgcctgaccccaaccccgatgcaccccatctccgggagccacatcgtagtgcctggtaacacctctaaccgccaagagctcgaaatctctgctacgactcctgaagaaatcctactcgatctcctccctagccgcacgccaacgagtgtcaacgtggaaaacacgcgctggcctgagagacttgctttactctagtgtaggtccaaagagatcgctttcgggttcagggtgtgccagttggtttgatcctgcaaccaacaagaaacaaagaaaacaaccaacaagaaacaaagaaaacaaagttaaatccgtaaacgataaccgatcggctgggttgccgatggcgtgtcgtttataccgggctgatgcgatacagatcataccggccatgtagtatatggagaagggataattggacgtgctctgtcggctgtagatgtcaataatatataatctatgctttgaagtactcttgaaccaagtgattaggatagatcggtcagcgcgccgagatagtataaaccacttgagtccatgaacactttaaggcagggattatatacgctcacagcatagctgacaggcaaacccaacgtgtatcggctagtaatccgataccactttataccaagatttcggtatagatcaaatatgctaaacaggaatcaatctagtgtcagggtaacctgacagactgatggcaagcttagtatatttggtccaaacgagatcttaaagtaaagggcaggcttagcatatcaagtaaacatatatgaaacgagataactaagtcaggtaagaccggctaaaaccccgatgctatctctattaacaaccatagaacatgctacttaacagatcaaactaaactgatgcaacattaagcacatggagaaacataggatctaaacaagtctaagaaagccttttcgagatggtagatatgctatataatctaatccgacacagctatctagccctatcggctattttcgatgatagagactagccgacacggtaatatagcaagatcgatctagattatatagcatatatgataactcagcggtttgtatagacagggctagagtgtcatgaagatataagcactagccccgagaacgcaagccgccgtaacaagctttacctcttcatcgaagatcaaaaccgatgcagcccaactcgaaagcaagaactcgttgaaaacaaagaaaaggaaaaaagggtggcgatgcgccgagagtgtattgaacttgatgttgtttgtttacatggtctcgggtcatatttatacccaaaatacatgatatgtctttgccagacacgactctatctctattacaactcaaaaatatgaacaagtcccttaggtggactcttaccgaaaatatctataaggaaactatgaaaatatcctaattaatagatacaattgtcttctccgagctccatccacatttggcaatacttgtgtagcacctcaacagatcctgacaacgatcccatgattgtcttgccgggattggctacattggcttctccctatcaggttcagtaccagccgatgcagacgacagccgatgcaacccatagctgatgcgggttctgtttccatgattattgatttcctccaaatccgcctcggttctgacttcggatccaatatacgatttaccaattttagccgttaacacatgctccccaagtccgcgatatttgggatgttgcggatttgatcgatcctgtttccactggtatctagggttcattttccatttcggccataccgcacccttttaaaatagtgatcaccatcctcggatcccacttacaccgtatcgcttccgtttttaccactttcgctcattattccccacgcagcctctactgtagcaatccctaatctcttggcgatctttccagcgatcgcccctcaatcggcaaactcctccgctccgtcaactttgttcggacctatggcgatagtgcacgtggctgagatccccgaggtaagctccttgttactttttagcaattccctcagtcatctttggctctttggtgatccgattccttcttcccttctgccagcattctagggatcatcttttgattcccacctcccagaactccacatgctttttccttgggccgatgggtgatccggatcccaccgagtttatcaatgtgaaacagagaggatccctttcaagtagatcaaactagacttagctcaatggaaatcgactttcaggtcttggctgtctaggttgaaagggtacaagtcatggtacaagaggatggtggctgctaagcgatctcattgggaggaagtaggaatagcgcaatgcctggctttatctatagcaaacctgaaaaaggatgagcccctactttctgctatcggctacttctggtctgatacactgaatgctttcatcttgaggcagggacctatggctcccactttgcttgatgtgaagatgttaataggcctagacatcctttcatccattaatccttttgacgtggacattaaatgctcttatcaactgaacacgaagaagaagaacaatggctggtgaggcttcatcgtcgaccatcggaaaactggtccaatttcggatgaggaacatgctgccttcctctccctatggctcgagaggtttgctttctgtgggtctacttgagcactgactgcgaacttccttcattttgctgaagccctggtgagaaaggaaaaagttcctcttggccgatacctcctaggggcagcttattggatgttacatgtttccttagccaatattcttatagacaagccggtcagttacggggcccttggtggttggttcattcagctgtggttgacaattcacaccaacaccgtggccaacagaccttctctgcttgaatcggccttccccacatatgactccattgatgatcaatcagattcccagccgtgcaagtcttatggggaagcagctttagtttaccctggtgtcaagccatctattgaaggctttaagacatggttcgacatattttacaacaacgatgctgccgatgttctctttgcctatgacgcctacaccgagtttgatcttccaatggatttagatctgagcaagctaaatgatgaagaagacctgttattgaggggcaattacttggcagcaatctctccttgcgttcttcctacagatgtgtctcagggaagaaaatctttctcttatgagttttatcacccaacatcggctgcaagacaactggggcttggccagcttcccatcaatcttcccttactaaaagttgtagactcaagatgtgaagtatcatcagtcgataccatgaagaaattgttagaatgcaaattcccagtctcagccgatatcggcgacttcaccctttatcagtttaagcatgtcaccttctacagttgatagtcggattggtcaaaacatctcttctctgctccatccgactattgtcttaccaagattgataaccgcatcaaggtaggccgcaatttacttctaactagattatgcccccctccccacgacctaacttgttttgctcccttttttctctctgcagatcttaaaaccactggcaccgaaacacagcctgagtgatcggccaatttgctatgcccaggttctcaagcattccagagggactaccaagatattgccctccccgatcatttcttctgctccgtcaattgaaacattcatgaagactcctactggggttttggctaccgatcgcctagattttggcaaacacaaggatccctcttcaggaattaccgggtcatcacccaagagggccaaggctgatggttttgctgggataagtgccgaagcgttagttgacaatattccgccttctctctcgttgtctccaccaaccagagttcattacgccattcgcaaggttgcattgcatattcgcaaaaaaacgtttatctccctcatggcctttttgtaatccgtctctttcccttttgtggtgaaagcgtcatcgttgatagacctatcggcctcagcagcgcaagagctgtccccatcggctcgagctgctccgtctgtcgaagccgttaccgaggaaattgcgtctacttcctctaaggctaaggctaagctgcttccccacttctaagcttgatcatcggctaatctttatccgtgcctaatccatcccttcctacaggacctgtccaacatgttttcctttgacgtcaaataatttttgaatgaagatgaaggaaatagccccggggcaggatgaagttagggccctatcagtggagatcgccgatccgcttaatgcctcttaggacacccttgtaaccaactgtgggccaatcaaacaagcgggctttaggggggaaagcagtttcattcttctctctcaccctcttcccctcaatcccaaaggggtggccagagttgagatcaatgatcgactgtcagggcttggttttgggcggtttcggttgtaacttaaaaaaaaccgtctagtagtagccagtcatatttagcggtgaccgtagaggtggcaatttccccattagggccgggatttggggaaaattctcatgcgtgggtgagcggggtgagggcagggatgggagttgaccgcgggtgacccatggggccctgaaggtattagttataagttaaaagacccatttgacccattaagtgaaggactatataagcgaaaccttaatttttcccaaatccatacctagccgccctctctcctgtctgagtcccacgtctctccaacctagcaccccccagccaacctacctctttgtgcgctatccccagctgtcaccaccccgagccggcgctgctagacggtggtgcatctttgctgccatgcccagctggcgtctcgttttcgccgccgccctcaagcgatgccgcctcactgcagcgcgtcgcccccaaccgccaccgcttcctcacagtccaccgcccctagctggtctcgcctcctcacagcgcgctagccctacccgatgtagcctcttcgttgccacccctggacggtgctgcctcatcaccaccgtcctcagccgtagacaccttgtcgccgcccccaaccgtcaccacgttgcggtgcgccgcctcttgctgccacaataggtgccctgcagttgctatccattcgggtagtggaggaccccgctcacccgttgggtcctctgtgggggtgagggcaagtgaggttttccacccggtggccaatgcggggccgtggacagggaaaaagggaaaaagcaaggagcggtggctggccgggggcattcttgtccaacccaaccccgccccgctgccacccctatgtggtggatttggtgctggcctcttcttggctctgtgtaggtggtgttgttgtgtggtggtggtgccacccctatatgaccgattcggtgctagccttttttttcttggctttgtgtaagtgttgttgttgtgtggcggtggtttttttttctggctattgactttcggggttttagcgttgtagtttttttctgttatattaaataaattatcgcgttgtctggtgctgatggttcagaaggaatcattaaaattgtagtggtcgtgtgacagtataaaataaataagctataccactgcattggcgtaattttattgttgggttggggggttgaggacactgtatttgcgtcaaagctgagctacttcctccgtttcataatgtaggtcattttagtattttctacattcattaacatcaatataaaatgtgagaaatgttagaatgatttgtgaaacggagggagtagatgttaccgacgcaaaggtttgccggaagagacggttgccagcgctacaagaaattaatcggagatgaaacagacaaaaatgtcagcgtgtgttttgtcggtgtgttccgatctgggcaacgggcctacacggtcccatgtttgacgggaggaggatgatagaaaaaggcactgcatgcaaacctgattttgtttgactcttttcttggcttttgctctctttgtttacgtatacgttgcttcacaaatcaagtaggcagactggtcatatttcagttctcatcacaggatcgtttggtaatataaatatatataaataaataaataaataaataaatatatatatatatatatatatatatatatatatatatatatatatatatatatatatatatatacgtcctgcctaactttagtagatctgtaatacataaatgtaatttgttaggctggttatttagctgatgatcaatgtggcatggactcatgtctaagatcgaagtcacaatgctgatgttagggcatgtacaatggtctttattagcggttactttttattgtcatgcaagaatatttggtgacgtgaaagagagaaaaagaaagaaagagaaatatggttgctacgcatgacaacagcatagagttgactcttagcatttattaggaaattttttgttgcattgagtctagtaaaggaaagatgactagtaagaaagtggagtattttggtatattaatggttagagaccgtattgtcttaactattataacgtgatagcctttaattaatgtagaaaccataccgatctctacctttgtacttgcacttactagctggcgaacagcgcggaagaaggaaggaaagttgctttgcctcctagccaagatggaaaaggttggcacatgggaacatcgggacagcgtgaaccgggcggtgcggcggtggttgggtcctctgtcgatcgaggtggtgctgttctcatcatgcgttcttgcatgcatccaagggattagcaggattaggcctgtgggataactaattaacatttctccgtgaattaaatttgcaccctcgatttcgtctctcggggcagacgattgaggagccgtatagccggtccatatgcgttgcaatgtcacctcaggtaatgtttgtccgcgtcgaacttcgctggtgtggacgtgtggtgccatgcggctgaactcgttcaattcggttgcactttagagttggaacaggtagattggatgtttctcaaatctcaacgttgtcccaatgccacaggtgcaagcacagtattacctctatcccattaatctagtacgggatatatataacatataactagtactagattaacttattttaggcagaattagtatgtaaggaatgtattttcattccctgattggcaatcaacggctcaccttatttcttatatattatgtaaataattataaaaatgttaaaaaataaaacggtactactccatgaaaatgcaaattcaaatttgactctataaattataaaagataataaatataagcatgaatgcacatgctagtttgagtataatttgtttttttaattaacttatagaaggtgaatttgactttgcatattctttttaagttactcgtcattttagctttgttttagtcaaacatttttaacttggaccctcaatttcttaaattttatatattttcacatcataatatttgtgtttttaaattcaccatgagaaaaactttcataatatgtaattcacatgtaattaaactatatgtataaagttaataatgtttgagttcaaacaaaactaaaacgataaagtaatttgaaacggatgatgtacactctttgtcactacataactactgtagcatcgatggcaaagggcaccctttcctttcctttctttctttctctttttttcttcctttctataaaggaaaaagtacgaattacccttcgaactatgacgatagtatgaattacccctctgaaccataaaaccggacattttataccctgaactatctataccggacgaataaccccctcgacccaatccaaagcggtattgtcctacgtggcaatgtagtcagcattttttttaaaaatggtggggcccacctttcatactctcccacctctctctctcttcctctcaatctctctgtctcatatgtggagccgcgagttggtggccggcgatgggcgtggcgggggcgcagtgggcgtggtggagagtcgggcggcgtccggcggccggcggccagaaagccactgcgggcggcgggcgccatcgccctcgctcaccactgggagcagctccagctccacgcgccgtcgtgctccagctctacgcgtgccacgggcaccatgggcacggcggggcgcgaggcagcgttggcagcgtcgtcgtccacctccttgcgtggtcgagctccagctccatgcgcgccctcgcggacaccgtctcgaccacctccagcgcgctctccagctccgccacgtcgcccagccgcgcccgccgccgccgctgcagccgcctccgattctcagtccacattatgaagaaagtctgttcactactagaattacattatccattaacttcttcagaatacgaaacacaggtgatttgaagaagtaaatcagtgcaaatctgaagccaataaaatggaaaaacattcagcaaacagtgcaacttttggattcaaatgtgcttttgtttgcacctccactattctactgttctacagcgtttttggctccttgcagggtgaagctgtgtatcagctgcgtcaggctttcatacgaggagcctcctttctccatggctctgcaagctttctccccgtactccttcgccttcctcctcctctcgccgccgtccatcagttgtatcaccacccacgcgacgtcaccccgggtgaccgccatggcctcgtcgccgaacaacagcacaggcgtcatcacgccgacgccgagcacgtcgacggcgaaccgctcgttcaggaactggtcggagaagtgtggccacgtcacgaccagcacgccatgggcgatggactccagcatcgagttccagctgcagtgggtgacgaagcctagccgcgcccgcctccgctcgcctagccacgcccgcagccgcctccactcgcttgagtgagagagagaggaggaagaggagaaataggaggggagagagtaagtgggccccaccattaaaaaaatgctaactagagtgccacgcatacgccgccacgtaggataaaactgccatgtattgagttgagggggggtaattcgtccggtattgaaagtttaggtgagcgatgtctggttttcaggtttagggataattcggtcgaccgcgataatttgaagggtaattcgtactttttccaactttaaaggtggggaagtgcactcaatgttgaacgctcccatggcaattacagaacactagtggttgggctattttattttcaggggcagaaccagacctgattgggctatagcccagaggactataatttctatagtacatggtttatccagcacagcagacttgagctgtttcctggcccatagtaggccgtagctcaagttccccgcgaccagcgtatatgttaggcccaagggcaaggagtcatctactccttctatttcaggatataaaacgttttgactttattcaaggtcaagctattctaagtttgactaattttatagaaaaaaatagtaatatttttaaccaagattattatattataaaaatttattcaattatagatttaatgaaactatgctggtgttgtgaatattaatatttttttctatagagttagtcaaacatagagtagtttgactttggcgaaagtcaaaacgtcttgtaacctgaaacggagagagtagacaaaaggaccctgtcaagccgcaggtaccagataagacaaccgcagcacaagactaaggccctgtttgttgcaagtaaggattattgatttagattacttaaactggattataataagctatagtagaataagctattagttgtttttttctctcgattattagagtatggattattcggtttgaaaagctaatgtttataatggcccagttattgtagaatgggaggaggataagacggcggtggcggcttggggaaggatccggggtatagggtgtgggcttggggaagggtttgcgtgcggctagggagagaggaagcgaatgcacgcgctgccgggggaggcgctggattcacgtacgacctgggagagaggaagcggatgcacgcgcgatcaggggaggcgccggattcacgcgcggctagggagtgaggaaggagatgcgctggatctgttgggtttgatggcagtggtaggtaatttacatacaatttataaaagtagtgggtctttagccacccaataatccttaaaaaacaagtttagaggatattaccagattatattattcttacttatagattataataatatatcataataatctgtctgtttgtttcagattagtaattaaccaaattaaaataattctaagctaaaacaaacatgacctaaatcatctcactagttgcaacaaggtaataaataacgggaaatgaaaatcgagagcgctcccggttttgtgttatcatacgacgtgttcgacagccatccatccatgtcttcgttctatgggagcaacaggcttgactctacagcaatggcattaaagcgagaaacctgcacaccaccaaccatcaaaactaaagattttggtttcactggcctattctttttttaagcaatagaattgatgacttatatattttaaaccactagaaaaaatacccgtgcgttacaacgggtgaagtttattttaatcttattatttttatatggtttagttaagatgaaattcatcgtgggaggtcgcttggatatatatatttttagaaaatcatgagatgcagttaggagtccgatcatcttaagttagcatgcgagcttttttaaataaatttcttatatggttccttctgtattaccaaatgtgaacgatcttaaaaccgactcaaatatggatatgcattttcaaaagtaaacgaacttaaaaaccgactcatacacagataacgtaccaaaataccggtaaaaatattttcaatttttataatagtagagatacgaaatttattgtgagaattcgcttggatatatatttttttgaaaaatcatttaggaatccgatcatctcaagttagcaggcgagtttttttaaaagagatttcttatacgactcatgtatttttaaaagcagacgaacttaaaacctatctcaaatacggatatgtatttccaaaagcaaacgaacttaaaaactgaatcatacactgatgacgtaccaaaataccagcaaaaacatctttaatttttataatagtagagatatattatttctcactttcctttttaccatcaagctgtactcaaaatacacgataaaacgagtccaatattgaatatattcaaacatttaaagtaattaacttaatctaaaagtaatttgcttaaatcgtagaagtaacttagctctgcaatagaagtaactacctatgtagcattggaagtagttatcctatgtagcattggaagtagttatcctgaccaatcagttgatgatgactgagatacgaaaacgtggatattgtacttaccaagatacagagaaacgataccacttgcccttgcccaggaaaagaggaccacatgatttgtagttgtcatctcgattcatgtgcatgttactgaggctaacaacactagtatattttcttttctatagaatctttgatgacctatatattttagacgtatattatttttaagatccatttgaaccgtcagactctacttaaaatatgtgacaaaatgagtcaaatattgaatatattcaaattatattttttctcaactcctccagaagtgtagttacttatagaagtgtagttactactaatgccgtgacgagttaattctccttagctgtacagtcacttctaatacctttaagagttatttctatttttttcatagttacttgtctataggattttatttacttctaatattacgaagagttacttatatttctttaaaagttactttgctccagtaatggagttacttttaatatcgcaaagagttactttctatatgacgcaatattttatttaaaaaacatagtgattactttaaataaagaatatatgtatttacttgaaaatcttctctacactttgcttttcctgtcgatttactccacatagctttcttatttcaattcactcataatgtaactacttctaatgctataaagagttacatctattgcatagctacttttgcaatttaaataaattacttttagattaataaaaattttaaatatattcaacaatgaattcgtttcatcacatattttgagcggagtacaatggtgcaaaaagatcttaaaaataatatacggtttaaaagatataagtcatcgaagaggtttaaaagaaagatacgctagtgaccaatctatataaatggttgttgccatttttagatggtaaaggaggatttatatgtcacatgggataaactggtcgctggtttggatcaaccagcgaccgtgcattgtgtagtcatgtccaataaataagtaaattatccttataccttgaaagctcacacaatatctctcatacctttaaaatttacccgattccttctatactcatgaaatttcaacttatccattccatactccatccatcagttaactgtctaatttgtataaaaatgaccattctacccttacacttgggtgaacaaagaaatttatgaattacattattgaaaatataaaattttttcgcatgagactattatatttatgatttcctgtgcaacacattattttaatttattgcatttggtttatttaaaaaaattatgttaaatttttttattaattatttaatcttattagtttcataaaatgcacatactgtgcacccaaagaattttttttagttttccaagcctatattgaaatttacatcatcaagggcattaaagacatttgtaatcaaatagtgaaatgaaggaaaatgtaacggcaggggcatggaatggatcaaattgaaatttcgggggtatagaagggatcggttaaatttcacgggtatgagacggattgagtgagttttcaaggatatagaaggaatttacttggggtgattatacctgttagtaccagattctaaaaatttgtgcaccaaatgtttttttaagatgattagtaaatagtaagatgaagaaaaaatcgatatactaggtgcaatagtacctaagagtcccgaatgataaccagattcagtattcttcaatgaaacattctatgattgtgattgattgtggttatggtacaaagatactggatatttgcttgaaatacaaggatgagtcttcttacgagatgagtatctggtaccgttcctataaaagtgccagtactaactgacctacatgttttatgattcaagttgtagaaaaccatacatattttcacacttgacacttaagtacatatatattttggtagtttagntnnacaaaaccacactatcnaataatggatttacccgtgtgatgacgtgattgttccatctaggatgatgacgtggcatatcctattaattccgtgcgatggctgataataggatc

SEQ ID NO: 81685 - DNA, 1016 bp, Oryza sativa
aagataaagccaaacaatttttgtttcaccaaaaagggagtggagtagagctgtatcacaaaatgaactagaggagctgtatcacaaaataaactagaaataaactaaacaattttaagctctaccaaaaatgggagcagagttatctcacaaaataaactaaaaaagtggagctggatttaaacagctctaccccagactcaactcctgtacctaaatttagaagttttagctctaccaaacaaacccttgattttagccaaaaggccgagagttgttttgaacaagcccacctgcttatatacatagcgaagcgccctcctccgccttccgttaccgaggtggtactaaaaccaagaaaaaaggcgcaaacatggcatgagtttttgttttagggccgaaatccaagccatatttctcgtgttagtggaaaaaggaccaaaattataactgtctctatctgtcaccacggcacacgatggtaatgggtcggcattgtgagcattaacaacaattcttttgatttttcttttgcctatccaaggtgtttgttagttgcacaaccttaagctctgtgtttggtggatttgatgaaccattcaatactcatagttgcatatcattgttctctatagcctatgcagtttcctgcttttcattactgcccacatggacagtcatcttcctggcaacttcacgaccgaatggtcgacgcgtctcctcctcctcctctcgccctatcgccgggtgccactctggcccaggcgcccaccccctcctccaccgaccagtccggccctagtgtcctcccccgctagcacaggtttcatcctcggctatcctccctttctagagagagtcagcctcggctccctctctggcagctactcggatggggatctgccagatctgcttcgccctcaattcctcctggcaaaactggtcagtgaggcagcggatgcgcgtccccctggtgccagccaagatccagcaggttcccccctgggtaccgagct

SEQ ID NO: 81686 - DNA, 816 bp, Oryza sativa
taatttattttaggagaattctagaatcctatttttctatattttgccagatcaaacaccagattccgaatcagactctgactctcctatcgagtcctggtaaaactgagtccattttgcacttgaaaactgtttgttattaaaataaaatctataggtcttcattattatgccatccttggcaaacaatgttgtttctttacataacgttgagggccatggcggtacttttaatttcagatattaataggtgatacctttcaggccaacatgaggtcttagcttctggaccaattgaagatcttatagcacatcgtgagcataggtgtgttccactccaactttgttgtttatccgtatatctggttctatcattatctcatcatttttcacaaaatggattatattaggtaccgtatatcaggatctcaattgctagcagcaatggatttgagttcaagcgttccacattctgagttactatcagctcgagctagtgaagcgtctccatttttggacaaacaagaacagatgtctgctctattccaaggaaaggaagaagccctctcaaggttagatgataggaatggacgtgctcaacaacagactgttgatgtggctgaaattcttcgccgttggactcatgctttacagcgtattcataaacagtctcttcatttggtacgctattcttacattaattttgatgagtttaatggcattcttatgcatttaatttatttgaagttttgaacgcgtctgctttcatatagaaatatgtgcattcaacctttcacaactactgtcactgtgaaa

SEQ ID NO: 81687 - DNA, 523 bp, Oryza sativa
acagtagttcatcattttttgtggggacttaccccaccttttcataaaccgacggagacttgtatggtggccgtccgaatgaccttctgatgggacggcccatacctacctccacttccgccggaagcaggcgcgacgtggaatcgtggctgtctgctgacgacatgaccggtatcagaccagtcacgtcggtcattcttgtcaccacgtgtcagcttagcaacctacatgctcgcccttcttcacacaacatcttgcctgtaatggttaggatgaagcctggcatatatctgactaggactaacgtgccatctctgggaggtaacacgctagctccagctggggatgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgctcagccaaaccgcaataaatgtggtt

SEQ ID NO: 81688 - DNA, 1424 bp, Oryza sativa
gtcgactctagaggatccccatgcttcccagatagtatcaaggaagtgaaacttaccagatcatggcatctagacaatgggatgccagagtcctcacccatcatgactgcttaaataagcaccagctttctgttggtgaactcctcttccctacctctctccctaattcctgtttccccgcacatggttacatttcttccctgctttagaaacccctaatggtagtcagttagggaagtgaatttgagactgatctcccatatcctcaacagcagcacctgattaaagccttcttccctggcaatacttgttgtctcagtgattggctttctgtggagtgaacagcaggacttagaccaaacctctggcattttggtaataaaatgatgctgtgcaactttcaaggatagatcacaaaaaatgatgcaacttctacgtggatccctgaaactctggactgcatgtgagaagccccactctcctgaggctgccctgctgtggaggaagccaggtcacacagagggggcacatggaggcaatccagcctacagacctgctcaggtcctagctgacagccaacatcaccctctagccatgctgatgaacatgcctccagatgattcttccctctgagtcattccttgcctttgagtcttcccaaatgaggctctagaaaatgtggagcacagacaagattttctttctataccctatccaaaattccaatactaacaatctgtgaacttaataaaatggttgctttacatcaccacatttctgggtgttcaatgcaaaaatagtagctggcatattcagttttctcatatgtaaaataaggataattttacttacctgttgtccaataaagtctctataagtatgctaaattgcattacacagtaaagtttttttaaaaagtcaaatttaggccaagcgcggtggctcatacctgtaatcccagcactttgggaggctgaggcaggtggatcacaaggtcaggagatctagaccatcctggctaacatcgtgaaaccccgtctctactaaaagtacaaaaaattagccaggcatggttgtaggtgcctgtagtcccagctacttgggaggctgaggcaggagaatggtgtgaacctggaaggcggaacttgcagtgagccaagattgcacaactgcactgcagcctgggcaacagagcaagactccgtctcaaaaaaaaggcaaatttaaggcttgttctgtgtcatgaagaatatctttgaaacactttaaaggattttgcatgtatagttgtccctcagtatgtatgaagaattggttccaggtgtccactgaggttactgaagtttgcacatgctcaagtcccttgtatgaaataacactacagctggtcctctgtatctctgggttctgcatttgtgcgggta

SEQ ID NO: 81689 - DNA, 661 bp, Oryza sativa
aaataccctcgatcggctaccatctgctagctctagctctcctcgatcaattcagattctcccctgatcgaggtgaagctagggcaacgcgagagctagcgccgccgacatggccgacgacgacgagatcgctcttgagccaggctacgtcttccacccttccgacgcggcctcatcaccctcttcctccgccccagcatcgccaagatccccttcgaggaccgcctcatcaaccacgccgacgtctactccgccaatccggccgagctcgtcggcgagcacagaccggcgccgggcacccatgggagcagcagcgtctggtacttcttctgctccccgcgcttcaccagcaagcgcaagacctccgggaggcggcagcgcgcggtcggcggcggcggcggcggcgagagcgtgtggaagtcggagggcggcaagaaggccgtgatcggcgccgatggccgccgcgtcgggtacctccagaagttctcctatggcgtctacgagtcgtcgtcgtcggggtcggcgcgcacgttcacgaggctagggtggtgcatgacggagtacggcctcgacgacgacgccatcgacggagcagacaagcaggtgctctgcaaggtctaccgctcgccgcgcgcggtctgcgcggaggcgcgcacggcgg

SEQ ID NO: 81690 - DNA, 4628 bp, Oryza sativa
atacttcttaacagcatatgtatctaagaaacttaaaacttctttaaatttcagtaagcatgtgcattcaaacttataaaatcttgttcaattataatataaaatcagatttttttttaaaaaaaagacgatcagacaagcgcatgcttatatgcttgattcgattttacaactttcacaaacaacagagagacaaccagagggtttctaatcagcaagtggtgcaaataagattgtacatagtgcaaacaataggggcgttaattttatgtcatgaaagtaatcaatgaatcaacttctctatcgacagggagatacagttaagaaaatcagaagataacacctcttctcaaccaatcataacattgcatggcccacctaccttcacttttcctccaaccataacactccctcatttaattgtattaattttcttaataaccgtgtccaacttaattaattaacctgaatgttacaaactatcgataaattaaaacaactaggaaggtagcccgcgcgatgcgcgggtatatgtattagtttgttaaaaatcggtctaacaaattaatttcaaattaaaagtcagatgtttttcatccgactttttctttcagtgagccaagtcaaatgatgtggtgtttttttttcaatttgagttagaatcacgcgtgctctctctcatgaacagaacatatacgtggagtatgtgcggctgaatcatggatggcatcatcaagcaatggtggacggaatcatcttgaagtttttaagtaggttaagattaagattagatctaatgattgaaaatattggaaaagcggtggttagatttttttaatataatttctgtgaattttacacgtgatcataattaaacgtgattataattacatgtcggtttaggggcattggtatgattgccacgtgatgattttaggggcatttaaaggatctaaatttaatatttgtttaatatggggcttaaaaatttgatcttaaacatttatattagaagtttgagctatgtatatggatctcgaattatgtatttaattataaatgacacaataattcaaaaaattgagaaaaaatgtaacttgatatttataatcatttagaaatctgattattagtttttgatagattgagtgttaacttaaaaaatagcaattagcttaagaaataggagagaagaggagagttaggagggtggagggagaactcaactacgtaggtgcgcacgtatggaggtggcggtgaggatgcaggtattagattttctttttagatgaagatctaatggttaagattaatgggtccatcaatttttaaaagaataatcgctaaacatttattagaatttttgtgattttttattaatctattagctagaaaattaaaagaaggaaggaaggaaagaagcaggatgtacgtaccgtgagaggaggcccgggaggaagggggcagtggagatgggttttggatttttttttaaagatagatctaatggtgtataatatttggtccatcgtattaagtgaaaatcgagggccagatgttttttttcctcataattttttttatttctctaatttattaaagcgtcatgtgaaagttaggagtgtttatagaaaatttaatggactttagctaaataataggaaggggaagaggagaggagaaccctgagcttttcggagaggaagggtcgatcgatttaaataaaaccgatgatcatatgtatttttttccctcaaaaataggtttttttaaaaaaaaattattagatgtgaaatgtgaagacatagaggtgttgtaatggacatctcatagatgatgatacgatatatgttgtcaatttttatataacgtttcattgctgtttagttatcacggaaaggatatggattcatgtctaaaattatatttatcatatatcaagaaaggcctatatggatcaaactaaaaactgaatatatttaaaaatataatcatttagctatctattatttatatataatcatttgtactatctgacgattggccaccagctatgcctgtaacaaaggaactcacatcccgtaactatatctcaaacggcttttttttgacccattagatatgagatcattgcagatgacccatcggatgcctagttctatataaaaccatattaaatagagtgaatataggacttagctcattgattaatttaattaaaaaatacaatcattcaagcgtattgtaaaatcaatgtatatattgtccgtaaaaaaaaaatattagtgcttgaacgttgcacagacagctcgatgctccatgcaaggaaagatataactatttacaataataagttatggtgcatatctcataataactaccttaattagaaaaagaagaaaaaataaagagaaaatgaggggaggataggcgcatgtacatataggtaagagggattttattttgatatgatgttttaaattactggtgactattctaaatgaaaatcaatagtttgatatttttttctcataatttctataatttattagagcgtcacatggcggctttagagcatttgtaggagtgccacgtagcggcttagaagcgtttatagaaagtttaatcgacttttagtatacaatagatagatagattttttttcaatgatactacgtaggtatgcttttttttcccctttactttatcgcttttatcacataagtctgtgcttatgtttttcttctcgtccgatgaacagtaggtaattaagcttcatcgtttttctttcaaatgtacgtaacgtacagaatacttttttttcccttttccggcccacaggaggaaagcggaggaaagcattaccttttttaaataatacattaaatctaatggtctaaaatacagggttcaccaatttaagtgaaaatcgatggtgagattaaacagtgccatgtggcgatctaggagtgtttctaggaacgccacgtggcggcttaggagcgtttgtagggagtttaatggacttttagtatataatagtatataatagatagatagatagatagattggaattctcatcacatatgcagagttaataaaaaaaattatttctacatgcttccactgtatagtaaatagattttaaattaaatttattcagatgctatgtggaaagaaatttacaaattgtatactaatcaagttatgtgaagaccttacgatttacaatgtgaacatgctacaatgagcacaccactgttggctgtcagatgaacaacattggtataaaatttgtactttggaaatggtttcattggccttgaatgatctgattgggcaagcaaatgcctcaactctttttgctatagctaatcctatcttgccaacccgaagtgtaaaatccaaggtgtttttaattattattctgtgatgaacaattgggtattggagattattggttttgttatttggaatttattcacgaagtggttttggagatgattggaatttacaggtgaatctacaggatattgctattatttcatgtgaccggtcagaccgggcagtgtgtgccggtcagaccggcggtgatcgcgcggtcggactggccagcccgcggtcttaccggccgacgctgtgtcggtttcggttttgggttgtttgtttagatatctgtgattatttcatgattatgacttctagatggatactatatgtatgtaatactgttgtttgctactaatgagtcaagttggagatagcttctcggaatatggtttctttgtttatttcatgtgtaggtgactcgatgtctcgggagggtatttgcggtgatggaccgggagtcggcttggggataagacgacgtccatggtggtcagagatcatacgggatactaaggctagagttgatgcacatggttaatggagattccatatggcatacgatggaggtattgtgtgcgtatgggatgcggagtcaaatttggaaggagtccaaatttggtacgattggttatgtaaagtttctttcttgtactagagggtttcctaaggtgtttaggactcttagtatgagtttggtttgtggctttaggcttcctacatcgggtataaatatagggggagcgtgaggcttcccggtatcgcttttgagagcaattgagttgagttttgagtttcgagtttagtcgaaatttttgtaaggagtgctgttggtgcactttgtaaacacagagagaatcaataaagtcgtcatccacttgaagagttcttcgatctgtgtttcaccgggtttcggcggtgtaaccggcgatatactggcagtcagactggcggcaagcggcggtcagaacggcggcatacgggcggtccgaccggcggcggtgacaggcgcggcaagcatctcggtggttcgaccgatcgatctacatcactcagaccggcggcatccactcggtcagaccggcagattaatctcggtcagaccgcgatccgttgaattcgagggtaacttttatttccgttaaaagttttcggtttttgggtataccaaccattcacccccctctggttgacttagttattgtgattcgatcctacaagtggtatcagagccttgttt

SEQ ID NO: 81691 - DNA, 4216 bp, Oryza sativa
  unsure (1)..(4216): unsure at all n locations
cgatttagagcttctttggatttttatcgatctatagtttttgccatggctactcctgttaggttttcaactaagcctcatattttcgatggaacggatttttctcattggtgtagtaggatgcaatcttacattatggctgaagatcatgatatttggagaaaagtttctcatacttatgtgattcctgaagctattaatgctgctgctgaaaaaactgcttttgaacaaaattgcaaagctcgcaatattcttttgagtggtatttctcgttcggattatgatcgtgttgcgcattttcgaactgctcatgaaatttagaatgctttgagtaactttcatcaaggaacaaataacattaaagaacttcgtcgtgatattttcaaaaaggagtatattaaatttgagatgaaacctagagaagctttggatgactatctttctaggtttaataaaatttttagtgatcttagatctgttgattcttctcatgatgctaattatccacaatctgagatttctcgtcattttttgaatggtcttaatatgtctatttgggagatgaaagttacatctattcaggagtctgttgacatgtctactttgactttggattcactttatacaaaattgaaaacacatgagatgaatgttccttctcggaaagttgattttaagtcaagtgctttggtttcttcttcttcttctttggatgttgatgcctcttcatctaagccttcttttcttgctgtttttaatgccacatccgataatcaactcgaacaaatcgaggaggaggatttggcttttgttgctaacagaattgctcgagctatgaataatgccaagaataggaaaagaggtggtccaaatcgttgctttgaatgtggttcaattgatcatcttcgttcgcattgtcctaagcttgggagaggcaaaagagaagacaaagatggtgagaagaccaacaacaacaagccaaagggttcatcccaagggaggaagctggagaatctcaggaaggcttttcaacaagtttgcgccgccttcgagccactaagtgatgtagatggtgaaagtggagatgatgataagagaaagaacatctccgatgtttgcttcatggcacgtgttgaatctgacacagagtattaagataatgaggtagtgcttttgaggaagctattaatattttgagtgaaaaatataagaagtgtgagtagatgtatagaaaacaggaatttatcattgaatctcttaaatctgaaattgctagattaaaatatcttattcctaatgatgatgattgctcaaattgtgaggttttaatgaatgagatttcaaaaattagagatgttaatgctgcacatgatttaaatctgctggtatcatgtctaccttgaatgcatcttcttcaaaatccaatattgtgcatgcaaaacctcctgttgttgcttgtgttgctaaatcttctaatgctaccaatgtgtctaatcatcgtgaaaaatatacttgttctttttgtggcaaagatggacatattgttggtttttgtttcagattagctcataaatagaaaaaggagagagagagattgcttttacaaaatcaaagtggcaaaaattgggttttccctcgaggaaaccggttagaccgcagtgggtcccgcggtcagaccggctactgagcatcggtcagaacgggcaccggtcagaccggcggtacagaggcggtcagaccggcccccggtcagaccggccattgtacctcggtcagaccggcctcggaggaatttttctgaaaattctaaaattgattttgcacgtggatatatgcctattggatcttctggtcgtgtgtctcagtactggattcctaaatttttattatgcttgtgtgtaggctttggtgtcaaggaaggagaacgtgtggatcgtggattctggttgttcgtggcacatgaccggtgataaaaattggttctcctcactcaaaaaggcatccaagactgaatcgattatttttggtgatgcttctgcaagtgccgttctcgctacaggtttggttaaggtaaatgaaaattttgaattgaagaatgtagctttggttgaggacttaaagtacaattttctttcggtttcacaaattgttgatgaaaattntgaggttcactttaagaaaactggaagtaaagtttttgattcgtatggtgattctgtgttgaatatttctcgcttgctgattttgaaaatcctgtttcacctgtgataacatgtttggttgctaagtttgataaagatgagatgttttggcatcgtagacttggatatgttggttttgatcatctcactaggttaagtggtttggatcttgttcgtggtttgcctaaacttaagaaagatcttgatttggtttgtacaccgtgtcgtcatgctaagatggtttcttcttcacatgctcctattgtttctgtgatgacggatgcaccgggacagctattacacatggacactgttggtccagctagagtgcaatctgttggaggaaagtggtatgtgttggttattgttgacgatttttctcgatattcttgggttttctttatggcaactaaggacgaagtttttcaacactttcgtggtttgtttctgcaattggatcttgaatttcctggttctttgaaaagaattcgaagtgataatggtggtgagtttaaaaatgcctcatttgaacaattttgcaacgaaagaggtattgaacatgaattttcttctcctcgtgtttctcaacaaaacggtgttgttgaaaggaaaaatcgtgttttggttgagatggctagaacaatgttggatgaatataaaactcctagaaaattttgggctgaggctattaacactgcttgttatatttcaaatcgagttttcttgagatctaaacttggaaaaacttcttatgaacttcgatttggacatcaacccaaagtttcacatttgcgtgtttttggttgtaagtgctttgtcttgaaatctggaaatttggataagtttgaggcacgttctaccgatggattgtttcttggttaccccgcacatacttgttgctatcgtgtacttattttggaaactaacaaaatcgttgagacttgcgaagtttcttttaatgaggctagtccaggtactagacccgatattgcaggtacactatcacaggttcagggggaggatggtcgtatttttgaagacgagagcgacgacaacgacgacgacgaggtcggttcggccggtcagaccggcacaggaggtgcggttagaccggccagggtcgtcggctgagggttctgttaatgctgttcgagatggtcctctggagactacaacttcgaccagtactgatacagaacgtggatcaacttcaaaagtcgctgctcctttgcacattcaacgacgacatccgccggaacaaattattggtaatatagattttgctgagactatgcgcagggaatttgagatgagcatgatgggtgagttatcgtactttttgggattgcaaattaagcaaatacctcaaggtacttttgtgcatcaaacgaagtatacgaaggatcttttgagacggttcaagatggagaattgtaagccaatttcaacaccaattggttctacagctgtgttggatcctgatgaagatggtgaagctgttgatcaaaaagagtatagaagtatgattggatctttgttgtatctaactgcttctaggccagacatacaatttgctgtgtgtttgtgtgcacgctttcaagcttctcctcgtgcttcacatcgtcaagcggtcaagcgaataatgaggtatttgaatcatacacttgagtttggaatttggtattttacttcatcttctatatgcttaagtggatattccgatgctgattttggaggttgtagaattgataggaaaagtactagtggaacatgtcattttcttggtacattattgattgcatggtcttctaggaaacaatctagtgttgctcaatcaactgctgaatctgaatatgttgctgctgctagttgttgttcatagattctttggcttttatctactttgaaagattatggtcttacttttgagaaagtacctctcttttgtgataatactagtgcgatcaatatttctagaaatctcgttccacactcacgcacaaagcacagtgata

SEQ ID NO: 81692 - DNA, 3988 bp, Oryza sativa
gatctttactcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatatattcttagcatatatatgaatgatattattatattggtaaaaactctaattaagatattaatgtacatactgcatgatttaaaattaataaaaattgtaatcatcatatgtacttagcgttggaattatattaaattaaatgctaacaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatatgtggcagttgttccatcgtgtcccatggcatcgacacgaacagcgctgttttggttcgtgctcttcatgtcctgggctctcgtgtagaatgtgtacccattgatctcatatccctagaatgtcgcgatagacccagacggtcccctcgccaggaaggcaagtgttggttgatcgactcgttacccatgagatgttgtcgtagccacgcggggaaagtatcaatgtgatgccgtgtaatccatgcaacggacttaccgatgttcctggcgcgaactagagccaagtgctcctcgatgtaaggagctaccaatgaagagtgttgcagaacagtgaaatgggctttacggaataaattgttgtctaccgtccttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgtgttcatgaatgcacatagctttgttattgttgcccggacattgtctggaaggataccccttattacaactggtagcagttgtgtcatcaacacgtgacagtcatgagactttaggtttatgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgttgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgctttcccgctgcgatgtttaggattcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccaaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaagaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccatagtggtatccaactttttgtgcccctgctcgcaacctgggtacaacgaagttctgcggtcctccaacatcttgtccaatttatgggcctacttttaactttcgcagtcttccctggcgtgctgcaacatctgaccaagatcatccgcaacgtcgttaccatcagcagctatttcctcctcg

SEQ ID NO: 81693 - DNA, 710 bp, Oryza sativa
ggcggcgagcttggcgcgcgtcgcggcggtgctacgaggcacgagagaggacggaagagggggcaaacggaagaggagaacaaggggaagctttatatggcattggatcgaagagatcgaactccaaacgagaggaatcgattcgggaagaaatcaaactcggttttagggataaaatcaaaacgaattcgattcggagagaatactcaacgattcgttttgattcttgggggaaaagaaagaggagaacgagaggaacaaaacccctaaatcaatcggactcgaggagaccggattggagcggatttggagggggaaaacggcggctcgggcggcttgcgcgacggcggccggaggttgaagacggccctgacatgtgggccccacatgtcagcggctggaggaggagggggcgggcggctcggcttgggccggcatgggccggttcggccgcgcggagagagagagagtattgggccgaattcggcccaatgaccaaagaaggggttttttgaacttttttaaataaaacaatttgtgaaatgttgtttcaattattaaaaatacttcccttgctcaaataattcccagaaaattctagaaaatagaggagcaagcatagtatttaataaaattttatctagctcatttttatgatgaaaattttcctagaaaattagggtttagcttgtaggcttttaaaatagttt

SEQ ID NO: 81694 - DNA, 4348 bp, Oryza sativa
ctacggaggcaacgaagaaggggagctagctagctagcgtgatatgcttaattgctgattaaattaccagcagacgatgaagcagaatccggagaaggcgcgccaccggccgggggacagcgcgcggccgcagcagaagcagcgggtgaccaccatgacgacggcctgcccggcgagcagcagcagcagcgccccgatgccgtaccccgtcgccgcgtcggagctgtacacgcagtactgcctgccgctcgtgtcctcgctaaaggtggcctgcatcgttcccaaccagctccctctcgtcagacgacgacgacgacgacgacccatagtatggatttcgctagctatagctcaccgtgctccggcgcttctcggcgccgatggcgaggacgaaggcgagggcgtcgaggacgaacacgaccaccacgaggattatggacgccatggatggattcgaactaatttacgtacctcccttaattaatccaacttggactactgattcgtgcagcgagcgagccaagaggagctctcactttcctcttgttgcagaaagagaggaggattaggacaagcgagctagggaaagatgggggcgtcaaagacgagaggaaagcttagcagcaagtcgagggagatgaggcgatgcaccacgtacactgctgctttggtagccggtgaaggtgacatgtttcactctaaccattctcgcgactttggtggttctgttccactggcacctgcctccggcctctagctgaggctgacgcgtgggcccccccggctcgccaccaaagtattcggcgtggatgattggaaacggtaggccagtgggagtgggatttggatgtgctatcatatgctcatgtactcgcattttggcttttattaaagcaggtgtggaaaatatttttcccctttaatgtgggttagtaattaatttgttttgcaccaaggtcagtaaaggaagcttggtggcgcaggaggaatattttgtttttcctttaactggaccagttatttctaggcacctatgtttttttattatcgaaacctagggtttgttcgctttattaccaaattcagcctgattttattagattttagtagcgttgatgcattttcaaaatttggtagcgtttttataagataatggttttgaaactactagaatttgattatatgggggtggtgaggtagcgtttagtttattaccataccaaatttgaaaaaagtggcgataaagtgaaacggccaatagaattcgttccgatcgtatggcctgcagctgataattgctgtaaaattgcacgtccgaataattttggctgaaaagcaggtacaggaaatatttttcattccatctacgtgggcgagtaattaatttgtgtttcaccaaggtcagtaaaggtagcttagtggggaggaatatttgttttacctttacctgcgatcggacattaaccagttactcctaagcactgcctcctccgttccaaaatacttgtcgctttaagtttttgtttgtaatttttatcatttgtcttattctaaaaaatatgaaattattatttattttgtttatgatttgctttattatctaaagtactttaagtatgacttatcattttttatatttacataaatttttcaaataagacgaatggtcaaacgttacaagaaaaatgttaaagcaaccactaatttgggacggaggcagtagcattgtaggagtacgtttttttttccttaaaaaaaatcgaaaccagtactgtgtgttcgaccgtcacaacgtctaagtccctatcgtctggcttcatagttaaaacttttttatatatgctatttgcagtttaaaagccaattttaaaagataaaccatagtaaaaacctcagatcaacactaatatcaagttttaaaattcagattttaacggtggtcgaaaggcaaatgatgagcttatgctagcaaagcaaaggtagttccaactacacgcataagaaagggtgtaaccacagatgcaaagctgagcgctcctattgctaagaagggcaattaactagtagtgctttgctttcatcgggcaattaactactagtgtttgcgttcatcggccaactaacaagaggttgattgaaaccagggataacataattaaaaagttcatcaccaaaaataaagcgtaattaaagaaagtaagagcaacacagggacagctgaccgcaccggacaaccaaacatccacctcgtttcagcttttcttaccgcgaaaaaaggatgccggtggtagtgcttgctagttgctactatactttgtttccgaccgaagaaaagctcagagcataatgttataattgattgggccttctttgtagcttcttctacttaatgggccagaagagagtctatattctttagattgggctgaaaactcggcccattatctcaggaagcatctagaagatgggctgcatccaaagagccgacccgtcctctttccagtggcatcgatctcgaggtatgtttggtgcagcttcagcttcgtcgctcaaccaaacaattttaacttcatttaaaattggagcggagctgggtgaagatctatcacaaaataaaccagaggtggagctgaatttatacagtttcaaagctccacttcagacccaacttctaaagctaaatttaggagtaggagttttaccaaatgcctatttggtacagctccaactcctaaatttagctccaagagttgagtctggagtggagttctggagctgtctaaacccagctccacaactctagtatattttgtgacaaaaaaggctccaaataggccatacatattggtcttcagtatacagcactacagcacagctagtcagccactgtatacagcctacttacgtatggtcttatccaaatgtacatatatgcaaatgcaattggctttgaagcctatcatgattcagtccaagttgcactaataattggtcatctctgtgcaggttaattatgcgaaagagaatcttaatcccaggggctttggttgcagtattgcacacggaagcaattgtaccagcgcggaagaatcagatgcatccatggatgggattatggaaggagaaagtgatgctagctacttaccagcaggtgatgaagcagaagccggcgaaggcgcgccaccgccccggcgagagcgcgcggccgcagcaaaagcaccgagtcgccaccatgatcatcgcctgccctgccgccagcagcaccagcgccccgatgccgtaccccgtcgccgcgtcggagccgtagacgcagtacggccgcgcgttctggtcgacgttcacgtacgccgcctgcatcatccaatcaacacacacctcctcgatcgtcagcacgcagcagatgatcgatcggcttcgtctccggcgacggcgatggcgacgacacatgtatgcatcaacgcgttcgagagctctcaccgtgttccggcgtttctcggcgccgatggcgaggacgaaggcgaggacgtcgaggacgaacacgacggccaggatgattatggacgccatggacatcgaatcgcagcaagaatcagtcacctagctaagcttcgaatatagttcaatttgcaggttttgtggtgcaagcaaagctcactttcctgtggttaatcggcagcacaaaatgtggattaggacgagagaatcaaatgatcagagctagctggaggcgatgctgctgctactgctaagcagctatccgtgaggttgacatttgaagacgtgacatgtttcacttcaccccgttcccgcggctttgtattttgttaagttttcctcctgtggttgacgagtgggcccctccatgatgaactgatgattaaccctgcgatattcggtgtccatgattggaacttacagatggaccgacgaatactcgaatctcagctttaaaatatggaaataatttatatatcttcattgtggacgaagaatttgattcattttgattaaattgcactgggatgatgtgccatgtaacaacaaagaaaacagagcaacacagtgacatctgaccggacacaagcctgggaaatatattactgggccttgtatgggctgttcatctaccaatatgggccaacctgggaagtgggccgtgctctatactgagctgggccaacaaaccaaccaacatgtagaagtctagaagagggcgagagacatggaaggcgaattttttttatttataattttttttattaaaagttttacaaaaataattttccattttgaaaattgacggaaatagtcgcctaccgccctctgggagggcgatttttaaaaatcg

SEQ ID NO: 81695 - DNA, 1841 bp, Oryza sativa
ggataatccatcgcctatagctagcactagcagatcgtctcgacgtgccttccatatgagcatatacagtcataacatactgctactgcaaattcaatcgacgaccatgaccgggattattcagagtttcagaccaatcgatatcgatacaatgccgggatttgctgagcacaaggtcttcgatccacaaaggagacaagcggcataatcgcataatctcagggaggattattggctattgcagaacgagacgagaggaagtcgtcgttcatcatgtgcgatttactccgtagccgccaacctatgaagattatcataatagtagcttttctgctcgaccacgaccatgcagattggcagatatgcagacagatcgatcctccggtcacgtcagatcgagaccaaaacaaacaagaaaaagcctactgctagtaatttagtgccaggtaaaagaaacatcccggcgtacggccgcatccatgacagtatgcacactacactattctgttctcctccatcttgccggccggccggccgcaactgccgccgttgtcgccggcagaaaaagtactgaattctgtgtaattgtaccaccctcttcttctactactacacatgtgttacctgaagggtgagtagcagcagtagattggattacttaaagggcaaagcgacaatggcttgccggattgtgcagggacaggcaaagatgcggccttccgtggcagggacagccaaggataacatcataaaccaaccctgttttttataactgaacttgagctctgaaacactgaacatagagaggatgtgagaagctttttgttgttgtgcctgacgaacggcgaggccgaaggcatgcaccgaccacatctcggtctcctggctcccgaaccgcacgcagagggctatcctgcgtctgcctcctgctcgcgtcgcggtttcgccataaacaaagctgtggtttcgccgggaggaggcaaagcatggcgagcctgaaagttcttgattccgtacgggtcgaatcgtgttgccggcagagtagtatatgttacgtttacaggtctttgtgtcgcaggatcaacacaacacgatgaagaacagatccagatcagtctctgaattatgaacagaaagtaaggaaaaaaagttaaggtacgtgcgtatgttccgtttctgaattctgacacaagaacagggaaaggattcacaaggctcacaagacaaacaacacatcgatccccaaattacacagaaaaacttcatgtcaatgtggccgatctcacacagaaacttcaggtcaggtggccgatcaattaatgaccatgaacgcactcaactagaataccaaaatacagagacatgagccacgcagttacagatatactccatatactacagatactgagcaatgagaatgaaatgtacagagtagagcaatcgaggtatcaacgcgggcgtcgaagtcaggggggatgcaaatggcaaatggattgagaaccaaggtgctgtctgtcactctgtctacatgcgggtcatgccgatgccgccgacaatgggcgggggcacggcggcggcgtggcgggccttggcgaagaagaggtagtggagctcggcgaagagcgcggtgaggaaggtgaaggcggcgccggcggcgaacacgcccttgcgcagcatcgcgcagcgcggtggcccgctaatcaccagcgtgctgtacttggtgtggtacgcgttccgcaccgaccccgccagcaggcacagctccgcgatcacgaacgtgaacctgtccataaatccacccaccatcatcagctcatcaattcaataaaagcaattttact

SEQ ID NO: 81696 - DNA, 17910 bp, Oryza sativa
  unsure (1)..(17910): unsure at all n locations
tgcagcatcggagtaacttatggtagctctacaggaacgcccgaaccttgactgcagatatggaaatgcattttatttctaatccctggatctgtctatcctgtatttatctttttatggagatttgcgtcaggatggctatgtatcagctctcagaacattcagcttagtatcacagcaattgtactctttacttgttttcacctggtacaagtagcttcagtggatactttgtgatcataagttcagaactgaaagcgtaactgaatgatggatatcagacacgatttcttccctgtggatactctgtgatcataagttcagaactgaaagcgcaactgagtgatggattatacacgatttctctctcctgtgccatgtctacagaagctgttctgttcaattgcccccaaaattaatgtccaacaagcagcgatcttgaattgctctgacgtaaacaagtcaggatcaacctactactatttacaagatctagatgccgcaatttgcacaaggaatggaaagaaacaacacgattcacaattggcacacatctaaacgtgtgccctctatgcactgtcactcaactcaacatgcaaaggtaagacaagaaacatagacccagcatcagcatcaatcagcctggtgatgttttccttccattttcaccttgggctgatctcggacaccgtgggtggcaccaccgtgctgaacatgtcggaggtgtcggacgccgagtgcttgaacctcgagttgctggagttggtggccttggagaccgtgccattgtagtcgtggatgtagcccggcgccgtgagctcgcgctcgttgatgcggatgggcttggacagcatcgtcaccacctgcggcattgacgggcggcgcgccgccgccgcctgcgtgcagaagagggccgtcttgatgtaccggaggacctcctcttcagggtaatctcccatttctgaatccaccagctccttgagcttccctacctcatgtagctcccatgcctgttaattgtgaaagctaggctgagtttggcagcaagagttggtaactcatcccccacacgcacgtaaaacggagcgactcattagtacataattaactaactttttttttttcaaaatatggattaatatgttctttttaaaaacaacttctcttttgcaaaaaaaaaatagcgtttaacagtttaaaagacatgcgcgtggaaaacgatagagatgagttgggaaatatagctgcgtaattaacacggccttaattgatgcagaggctggaattatacttccattctctaataaaagatttagatggagagtccagcgattacggcttaattggaatgtctctagagcaaatgtctgaaggtgaaagcaaatctctgaattttggatagtaaagatgatagtaagactgaccttctctaggagaatcttatcgtcagccaggagactccttgaactactcttgccacttacgatctcaagtacaaggacgccaaaactgtatatatcggctctcttcgtcaattggccatgccatgcatattccggtgcaaggtagcctctgcattgaacaaatagatcagttcagttactgcaactgcaaggttactttctactcaaacaaactgctaaatgctgaaatactcacgtcgttccagcaacacgggtactgatgtgggtgatattatcagggaataacttggctaaaccgaagtccccgatcttggggttgtaaagcttgtcaagaagtatattgctagccttgatatctctgtgcacaatcggtgacgcaatctcttcatgcaggtatgcaagtcctttggcgattcctatgcatatagcagatcttatgctccaagtaaaatttgcaggttcgctattagaacctacagaacacaagataaaaggttaagcaacaaacgaaatcaatgcacttatatagaaaaatagtcattgtaacatatcaatattcatacccaacaatgcacggtcaaggctgctgttttctaaatactcgtataccaaaattcgattgtttccttcaacacaacagccaattaattcaacaaggttgggatgcttcacattggtaataacatcaatttctgtcaaaaattctcgaacgccctgcctggattcagcagaaagaactttcaccgcaacatctcgcccatttctaatagttccctgaaacatcaaagcattggtaagaatgcaaggactgatggcttcagatttgaaagggatataaccctcaatggactcctcccttccacatataaagaaaaacaaacattaccttgtatactgtcccaaagccacctcggccaattttattactgcggttgaagttttctgttgctgatctcaactcagaataagagaaaagccttatgtttttctcaggcggaatacctgaaagttagttacatttagttaagtaaagcatggaatcttaaaatggagcttcagtactggcattctctagcctaatatgatcgaatctgtgatagggacaatatacatgtttctatttcataaactctgttggctgctatgcaaattcagcataaattttgcaagcaaatacagttcgtaccgctaacgccatgagagtaaggattctctcctttcttggattttggaatgcaacaccaccagctcatatcctcagttgttgtggctgtcttgtacacttcaacatgcagaagaggaatcttcaggaataattattctgcaggaattcattgcgaaacaaccacttagagagttgcaaattgagttcatttgtacattttatatattttggatatatagtacagaaaagggaaaataaaaagtaggacatgactctctttagacagaagtctgcgcaaaacttcttgttagaactgataggtagatgcagatccacccacattagcctgtactagagtaggtcaggaactggagtacaattaaatctcctttttgaaaccgagtacaattagatcttaaatccatcattcctcatgattaaagcacaaaagaacctcatactggcaagctttcaatgataactgattaatcggtgccatgattgtgaacttgcgattctcatgatgaaaagaaacatgacccaaaattttggggatgccaggtgcatttggaccacatagctccaatctcaggtgaatataccagatgttccactggatccaatggccatgtatggcacatgtaaatactaggttagcacctcatccactgaacagttcacatgatttgcaaagcaaacggccagatggcatagctgccaagaacaatcaccaaagcaagctgaagtttggtgatttcttctaacaccatggtccactcgcctcaatctgtatgcttgtacatatgcatattttcatgggagtatcagcatgtcttaaaccattatcatccacttcttttccccaatcaattcaaacacctcataagtaacggatcatccaacttgtttattcagaccacaattccaagaattcttttgttcgcatcccagcggatgattcgacggcatcacttattttcagaatctctgtccgaatgatgctttgccactcaagaaaaactcttgacagatcgtcatctgatgaacacaaactcccagagcatcaccacatcacaggtcaggactccagacgcatcatcagaaatcaggtggagaaactctaggctaaaactagtgtgcgagaaagcccaagaactaggaaatcaagaacacgaggggataaaaacaacaagaggcaagaaatgcttcgagaaagcagcagaaaagtaccaaagaaaaacaaaacgttgaacactatggttacctttcttgcttggcgctctcttccgatgagatcgacggcagaggagatcgaagaggacggagaccaaggaagtttaaagggggaagagaaaggtggttggggctcaattatcagcagatatatctgtagcagctggccagttgagcgaacttgctaacgattgcagtgttgcagattggcaggttcagctcagctcagcacgagcaacagcagcagctgctgcaataaagaccaacagcgaaaatggtacgagggaagaaggagctaccagcacgccacaaaacctaaataaaaagttggaacaaaataatactactatcaagaagatgtaggtgagagatagcagccggctgggaatgaggaagaggaggaggaagaagaagaggtcttcttgctgatgctaattgctattcctacctcctactaagtaattgctactcccactgaagtccctttgataaaaaaaattaaaaaaatcactacttactccgttataaaatataataataaattattttagttttcttgttcctgaaaatattctatctatctcctaaaatataatagtttcttcatcagtattctattttcaaccagttaaagcaacttatcttttaatttcttcacctaattaattttctcaactaatcatattcttttttaagctttggtccttcttaattaattttctcaactatttttttcttttaattttgtctgttgttcacactactttttctaacctcaaattttttttatatttcgaaagagagataattctgtggagcttgcctggatgttgccacctgccgccaggcgtggagctgtcacctgtcacaagaacactcaatagctagtatcctgctaattaccagcgcgcgacgcaatcgctgccgccatcagcacagataattagcattaagccctgcccgatcattctccctaattattgcgagaccaagattattttagagtataattaggtgctactactgctggtattgtatcccaaccaacctgccggtgccagccagggacattgctcgctgccctgagcctgtattggcgcctaacctgatgaatcatatccatcagggtcgtcgcgtacgccgcccgcagttcgatagatcgcacgcgggccacttccacactggggattgtctgtggaactagggacttgtttagttaccaaaatatttttcccccaaatatcccatggactctttagacatatacatggacccttatatatatatatatatatatatatatatatatatatatatatatatatatatatatatatatatatatatatatatatatatnanctaattgcacagttaatcgtaatacaatttttttagcctaattagtctataattaactataagtgctacaataactcacctgtgctaatgatagattaattaggcttaataaattagtctcgtggttttcagacgagttatgaaattagttttttattcgtgtccgtaaaccccttctgatactgataaaacgtttgatgtggcacccaaaatttttttttcgtgaactaaaacaccctagcttgatcatctggaccagcggctgccaacgaacgaggagtcagtagaaaaaacttggtgttttcatcgctcttgtcactacgtgtagcctacgtatgttaacagtacacgaaagaggagagatatttacgtgcttgagaaataattttctacggtcctgtcgtttcgctcacgcttatagttattcttattcgtattacttgttagcaatcaaaaaataatttaagtaattattttatgtgtgtacttgatgattcagaattaaatattgtaaaataaactacgatgaacaaatcatgaaatcagcttttaaaatttaaattttgtcttataggtttcactataagtgaaatgataaggttgtacgtatcaaagctagggcatgttgtttttaaggaattgaagaatggaatgcatgagttattagacggtgtagttttcacaaagaaattttctgaaaaaaatggattaatacctgacctctaaatccaaacagttgtacacatgaaaagaaagtaaactgctttaaatttatattttaactctatgtggtcacaaaatcattcatctaacccgaacaaaaatcaagccctaattagagttaattaacgcaagttaattaatactactacatgatttaactcctcgttttaagtgagctcctgtgttttcttgctgttggcttaggtggactggtgacgagtcaacgactgacatccgctgctatttcctgttttggttttggatgattgctgccttcttgtcaaccaattatgctctgttactgttgatgttcacacgtccatctggtgtgatctgatttgttttgaaggagtctacgccacgatcatccaattgccctattgttgttgttactgtataagactaatgtgactcgtcagaagcgaagagctccatatctctgacggcatcgtataaaaatagtattatgtgttctctcctgttgtgtttttgttgtgttgtgccaaactactacttttcagcgtgacctaatcctttcgtcacaggttgtcaccagccacgagcacgaaatgataatgcatgtcattgatccttctcataaatcaatcgtatcttaaagtctgaaattaacgttttttttatttactactactcagtttaagtgagggtgatcactacctttgtcattacatccattggtacagcacgcgcgagagcgaaaacttttacaaaccctcaattaagcctcatctaaaatgaatacaatgggattttgtttatgaaatgaactaatttctataaaaatcctgtaaaattcctatgttcaaaaataactcctaaacatatgaattgttggaaatttagaatgaaaatgctagaagtattgtcaccaattgtttattaaaaaaacatttgatttctgaactgctagattacatcaaaatttggaatgaaattgctagaactctatcgccaattgttcgtcgaaaagattttctatttctagagtatcatattgcatcaaaatttgttcagggagaaggggaaaaaaatgtacgatgcgcatggaaggtgggtatagaatgcacgatctgcaagacacaaacacgtgtctacaggtcaactgtgtcacacgctgtttttataagttaaataaaagttactgtaaccatactatagttatgctctaaagattttcttttttcttaaaaaagaaaactgttgtcagatttggatagccccaatcaataatcatcagtggaatgagacgtataaccaacgaatcatcttgcggtaacgtagccggccggccgccttcccacggaggccggcaatggtgattcgttgaacattttgatcgattccccgctgctgacctcccagcgttgatggcgatccagccatatcttaccatatatccccgagcatccctgctaagagcaaggataatagtgggctataaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagtaagctatatgtttatctgaaagagaaagataaacaaaaaaatagggagtattggctctcatgcaagagttaactgcacacaaactccaagaaatatgcattaaattcatggtgagagaaagagagaggatgaagaaaataatgataaacttatagccaatttactatacatgttagctttagacattgactaatagtaagtagtgagctctactattaaacttgctctaatgctgccaatggcaacactgttagcttccataattactgcgcattatactgcctcatttgaccgtggattttttttctctgcatttctgcctcctgttcgtggccaaaaattcagacaacgctgcatcagacgtgttatagtactcttgttatttagtatttgacttgaaggtcatctaatctaccggtagagaggcacattcgtatgttgctcattatagtggtacacttgttggttagtggtaatgctatccagtgggcaggcagtggcatctccattgcttttcgccattattatcaccgtgactccagctgcttcaccatgtgatttgctgaccgtcatgttggtgcatgcatcaactcttttcccatgtgtttcttttcacataaattgatctgacgatcttcaagttgcttgcagtaatacgtacagttcgtttggtaaaattcagagaggtgtatcaatagtaggagtagaatgaaccttgtgttcagcttccacgcaatgtcctccgacatgacaaatgacagtttatgggactagatcaaacgattatctatttcattatctttaaaaaaatcgacggttcagtcaaaaagtactgcatttcttaggataaattactcgttattgttcgtcgcgatgtgcagatagatgcagtttagtttggttttgcctgcatccacggatgataggtacttgacagaacaacgagcactatgcgactaagttggatgcttcagttttacaggaaaaagagcagaggactgatgttgattcaacctgcagtacctgaggccacaacactttgcctaagtcatgggtcgttgacatttgatatctataattttctttaatctatagcgtcttttactaacgaaataagattttttttctctgcctcaaaaaaaccaagtcaaaaggtttcaaagatgccatcttgcaaccaggtgccattccatgagggcagcggccattcatttttcacgagcttcactatttatgtatagtaccatcaaggacaagttcatttggcgttggaccagcggtgactactcaactctttggcaaagtggcggaccaaccaaatgtaagctttttctttggttggtgattcagcgatgctgctggatgatcgatagtatgctcagttaagggatggagaaccactcgatgtgccccttctgtgcgcaggaagaggagataacaaaccacatccttatctattgcgtctttgctaggtaagtcttgtgcaatctactccctccgtactagtaaaggaaatggtttaggataatgtttaagtcaaacattagaaatataaattatgaataactctcaagttattaagtttgaaaatgtaaaacttatatgaatagatttgtcttgaaaacactttcataaaagtatacatatatcacttttcaataaatatttttatagaaacaataagtcaaagttgtgttttggagaccgtgtcactgtcaaaaacgacttcctttacaagtacggagggagtattgatttttgatggactagctactctctcaccaggccgtcactcagtgctctaagattagtggcaagcttttgcggcatcgccaccataataagagtaggaaatgtctcgactcccttgtcaactatggaaggagaggaatgcccatgtccttgatgatgttctatctcaagtgctgatggtggtggagcagattgtggaagaagggaggcaatgggtggcgacaactgccaatccagttggagagttgttaggcacatagcttagttatgtttagtgtagtttcttcctctctcggtctcagcttaggagctttgttgggtgatcgtctaggcgtgtcactttttttctaatatattaacatgcaagaggtcatagcttaggagctttgctggttgatcgtctcggcgtgtcacttttttttctaatatattaatatgcaaagtttttttacgtgttagcatatatatatatatatatatatatatatatatatatatatatatattatagagagagtaacgtctctgactttttaaaggtgacaagaacagtagatcgcccattggaattatccatagaaagctgatgagtacgatgaattaaagctggtcatgggattggtcaattaatataacactatatgattgccttttttttcctccgcttggtcataacaaaagacagagaattgatacatagggctcggtcattttcttctagatacaagaaaattttgccccgttcttttctaattaagattcatattttatctcagttttcgttagcacacttttcaaactactaaacggtgtgtttcgtacgagaactttctatatagaagttgctttaaaataccaaatatgtggatttgtcaagtttgtaataattaaaacttaattaatcatgtgctaatggcattctcgttttccgtacgccaacttaattttcatcttcatcggttttatgtcaagtcagcatattttactctaccaattactagtggaaggtgcaatgaagctgaaaaaacatgtgaggaaaacctgcagattaaaaatatatttatatagaactgatataaatatatttttaatctttatatagaacatgtgaggaaagcttgtatgcaaaaactttagcatgcatccaagctttgaaattagctaatgatatgggaatgggccacattattgttgaaactgatgctcaagctctgaaagcggctttgttggatgaaacacatgatagaagtgtaaacgctgttatcattagagaggccaaatttttgcttgcaatgaattttaatgtccatcaagtcatgtattgtcctagagaatgtaatcgtgctgcgcatgagcttgctaaaattggtgcttctctgggtccacgaagccaatttgtttggcttgaaggattcccggatgatgtttgcaatttggtagctagtgattcagctggactacctgcttaatggaattgttcttcttcaaaaaaaataaaaatatatttatatagaactggtcaggtgaagaaatgctactacaggccaaaaatactggtgaactattattggacctgagcattattccgacaaaacatattgaagctgaaaacatgggcgaatcacctgtaaattaaaaaatctagaactgggcaggtgaagaattagtgctactataagccaaaaatactggcgaattattgaacctgagcatagaattattcagacaaaaaaaatatactactatatggcatcgtcgaagtgtcgatcgagtcgttgcatatttggtgagctgtgaccctaccatccaatccatggtcgcactcaacgcatcttataaattagttagatatttagtagttttaaatagaccgatacgtgcggaaaagatgcttcttggaatgttgtttgggattcaaatatttaaatgcaggacaagttggataaagtattagcgaccatttctcatctggagaagcagtctctgatggaaatacttaaacgtatgaatggaagcacacgctttcaaagtaaaatctctgatgaggattacttggcttgtctgcatttgatctgaaaaatccatgtagcttttgtggctgttttagtgtgggcggctgcgcacaaaagtctagggtcaaaaggctgggagagatgacaattatttggagagttttcaaccgatacattgtcaaaatcatcccatttctcctctttgaatagttccattttctctctttgactctggaatggagaagaatctttgtctctttcttttgttagtttaccctgataaggtagataaaatcttgcagctgctgttgatttcttcagagagagagagagagagataaaaagaagatttcttaagagcatcttcaacagatgtacaaaattagaaccccaaaaatcccagacaaacgcgagagatcatcttcgattcttgtactggcccagaaatgatgtgtacgcgggtggcccaacttgttcagtccacacggcctgacggcccgcgtgcgagaatagcccagcggcgcaagggagcctgggataacggcctagtacgcggggcgggggatgttccttgatgggccttcgcagcttctcatctcggcctatggcccaccgagcatctaaggccgaaagccgccacagctcacaggtgtgcaatgggcccggcactgcgcttctgcacgatcagatctgcaaaccgtaggtaaagtcgcatcgtcagggtcaagctatgggataagtgccgattcgggtggcttccatttttacgattctcacaaataaatactccgtacagtatcttgccctatctctatgcactgctgctaaatctgacgtactgctactacataggaagaagtcacatccagctacatgaatctggataaaaggtagtacagatttattgtcttagaaaaaatcacatccccagctacatgaatctggataaaagggtagtacagattcattgttttagaagaaatcatatcccctccaccatttttttttgggacgaatgaagtacttgtcacaagcataataaattttatatatctggataagtttttttaagctatttcccttgttttaaaatgtagattcattatattataaaatatcgtatcataataacattttaaaacaggggtaatatataatttgacattaatagtactcttacgtatgaaaaaacttgtctaaatatctctaattttattttgaaacaagccttacttgtgtggacggagatactccctccgtttcgaaatgtttgacacttgatttttagcacatgtttaaccgttcgtcttatttaaaaacttttgtgagatatataaaattatatgcctacataaaaatatatttaacaatgaatcaaatgatataaaaataattaataattacttagacgaatggtcaaatatgtgataaaaagtcaacgacgtcaaacatttcgaaacagagggagtagtacaaagcgagctcatcagtgttcactccaaccgttttaggttgtgtttagtttagcacaaagtttaaattttgattgaaattagagatgatgtaactcgcgagctcatcagtgttcactccaaccgttttaggttgtgtttagttcagcacaaagtttaaattttaattaaaattatagatgatgtaactgaaaagttatgtgtgtatgacaggttgatgcgatggaaaaagactgaaatttaaatccaaactttagatctaaacacagcaattagcaaataagccaaaacgaaccaacccaaaaatgagatgtgcatagccaaacaccatttactatcatgggcaattataagcaacccaaaaaagagaccgaactggattgagtgaagcaaactctttcttattcatcattcatagtatgtaccatgacatgccacccgcgaccgagaatatacattgccgagaggcgagagcccaaagatggacataaaaatttaaaaagaagaggtgaaaattaagtaaaaacaccgcagaaaaatagattggcgcgcttccacgctagctgcaaatatcgctctaataatctgcatgcttcggacggagaagcacatcggatatagagaggaggaagaagaggaggaagagatgagcggcggcggcaaacggcgagaaggccggcggcgagggcaggcgcacggcgacgagacgacggcgtacggagcgccatcatcaggcggcagcgtcgtcccaggtggcggcccagttggtggcgctgccgacgcggggcatggagttgatcttggtgaaggtgtcgaccttgaaggtggcgccgcacatgacgccctcgctgtccacccgcggcatcgccttcagccggttcatcgggtgctcgaagctcttgagccccccctcgctgtggaacatgcaccccaccgggaacggcgcgtacgacttgccgcaccctcccttcacgatctccctctcgtcgcagatcaccaccgacccatccgccgcgatcccccaatacaacggcacctccccatccgtactttgcatcgcgcaaagcgaatgaacgtcaatatataagaaaaagaaaagcagaacaatcagaaactgaagcttaggaactactacggcggctaaacacaactcctaacagcgggaaggggacagggccacgctacactcacaggaagttcaatttgaagcacaaattcatcaattcgattcagaaaaccagtctagtagtggtttaaattaccagggcggcgaagacggcgccggacttgttgtcgaagacgacgaaggcgaaggagccggagagatccttgacgacctggtcggcggggtaggggccgcggtcgcggagggtgcggtaggcctcgatgacgagcagcgcctcgttggtggagcggctgcacagcccgtactgccggatcaggctgctcaggttgtccagcctccccatgaacacgcagtagatgtcatccagcccacagaacatcctgtgtacacacccatttaccattattatcgatcccctacgttttaatcaccttaattattcggattcattgcctcatcgattaaattgatttaatttacctctcgtagccagagaggccattgcgggcgtggccggcgacgcaggcgagggcggcgccgccgccgaaggaggtggagaaggcctcgatggggtggagggcgtggaagtccctgaggatctcgtcggggttcttgggcttcgccgcgctgctccgcgggctgttcagctccgccggcgcgtgcgccacctgcttctggaatatggccaacattttcttcttcctcttgctagctagctccgacgaatcaaactccggcgccgacgaagacgaaagaacacgtagtactttagcttagcttagcttgagctgctgctgctgttcgttgcgtgaagatgagagacgtgtcgggttggcgagtggaatggaatggaggtgaggatagagatgtgcacggctttatagacgggatttaggatggcacgaacgcgaacgaaaatatcctatccatccctcgctcgcgcgcgctgtttgatgagcgtgttattggagtcagtgctgatgtgagaagccaaagcaagcagcgaacgggataaagacggcgagacgacgaggataagatcatcacgtaataccagttgccgctgccgatgtgacaccagtagtagtaaccggccaccttaaccgtgacgtgcggtgccctcaccccctacggtaccctgcacccaaagcctacataagtaattgtttactacttccgttttaaaatataaaaaaaattaaatagatataacacatactactaatctacatagaaaatttgtttaaatttatagtattaaaatttatccatctatataaatcttttatattacaaggcgaaaggagtattacacacctcctcgtgttggttgttgatacggttttcttccgtttctatcgagtcgctgcacgagcactgttttcttgtgaaattcctaccctgcacaagtgaggatgctgtacatggtctacacaaaacgtgattaaaaagaaattcgcaagaaagaaagagcaaagtagaacaaaagacaaactagtaaactgatgtcgtagatctgtagaacttcatgtttttgccgccggggtagccgagtaggatgaccggaggtgagcgaaaaacggaggaaacagcagcgagggacgccttttccgtgggctgccgccgttagtttggcgggagcggtttattatattaccccgtaattattgctcgctgaaccacctgtcggacacgtcatcgcctactcgaactgcgtgctcacgggggccacctctctacggcctccgtggacgcggcgtgccacgtaggctcgcgcaccgccctcacagcctcacccaccgcaactgccacgtgcgcgccgcctccttcccgtgggctggggaggtaaacgccggtgagcgccgagccgtacactgacagggtggggcccacaccgagcgacgacaaaagtgtgggcccggattggggataaggctggcacggtatggtcgctcggtacacgtcacccgcgcgtcggaccggagcgataaggtccgcgcgagcaagcggttgaaccggacgcggcaccaacgtgttgtcacgtgtccgactcggcagcgagtcaccttttttttttctctcttttctctctcttggcagggcggcaacgaacgtgtttatactaatagtaatcccaaggttgtggtcgcttgtacgcgtgttaattatggtgattaaaacctggtcaggtcgatcgagcggcgagcgatgagcagttgagcacatgcattggatcaggaggcgtgactagagtacaggtcgccaggtcggtagcgctgatcttggatggccagtagattggccagacgcttatccaggccagagttgttaataatctctatattgctacttagatgtagcttacggctgacagaatcctgctgatgagatctagtatcctctaccggatcatgacagtccaaactgtgtgtttacataagcagtatggaagatgtcaacagatgctgcatcgcaaggagccaaggaacaactcgcatgaaattgttgtactagtgtaagttactccctctgtgtttcatgttataaggcattttgactttagccaaaatcaaactgatttaagtcaataatttaatatattttcataataaatttgtcttggcttgaaaatattattattatttctataaatttaattaaatttaaagtattttgactttgatcaaattaaaaaaaaatcttatgacttgaaacagagggagtactgctaagggatcgagtgcatgcaggttgccagttgtaatagttaggaattaaaaacatatttattgttatccgatggtattgtagaaattctatatctatagccttttgcacgcttactactgccacacgctcatctcatgctcgacagctccaggaatactagctagtaagtcagaaacggtcgctttcgtcgtcatactttgtaattatgccattttaattttgctccaggagtacatttctttggcatgtttctatcctacgccgttggattcttgatacttgccaactttccgttctgctttactcgacggagacgtgcgtttcacaagctctgattggtccgagcagctgacggagatgtgactcagcagattaattacctttatttacatatatagcaccaataatccaccactagttaagttaaaactaaaaaaaaatcgatgagggtttaaggagtgtgtgggacagagtcgcactgatgaagattaactttttgtttgaaaacttgatcaagattaacttttatattaactgtcacttttcactggagcggtggtgcacacggcttggccagatctagcggcgcgtaaggtgtggtgagactcgtccatcggcgggcgcgtggaccgctgcgtgttcagctgccacatcgccacgtcgactggtttattcaacggcgtaccgcttcttacagttaacggtaagcatcggtacgtaccctgcatgataaacacctagctagagtacttactagtgcgtacttacaaaattcattagcgtactgtgcgtatatcatgttcaatctgcaccaaacgtcccaacatccacgggatctctccccttccatgtgggaccacctcaaacatgtggagcggctaagagcaaccacaatgtggcaaaaaaccaggtaacaagcatttatttcaagcctactacccagtagtaagcattgtgggaagaggtagtagttaatacctgatatttgtgctattgccggtaacaaccaaataa

SEQ ID NO: 81697 - DNA, 2559 bp, Oryza sativa
atagccttcacccgttgtaacacacggacattttttccagtaaaaagaaaaaaagggaaaaataattcttcggattgggcctaacgtatatgagggccatgctttctatagcacctaaattagcccaaaaggaccgatcagttctattacgaacggattagcgaccattaattaagagagcgcgtgacggattaagcgaagcgaaccacgcaaataatactacacacgcgcgtcacggacaccacccagtcccctccccacaccacgcgccgcccaaaacctccgccgcgtttcgcaccaccaccaccgccgccgaccatggcctccttcttcgccgacgacggcgccgacgagctcccccgcaccgcctcccaccccttcgacgccgacgacgacgccgcgcccgatgcatcaggaggcgccgccgccgacgacaccggatacggcggctacgcctccttcgtcgacggcggcgtaaaggatgtggaggaggaggaggaggagatcgccgtggagtccgagggggtcccgatcggccacgtctccggagggttctcgccctcgcccttctcccccgacccggagctggacggcggcgacggccctatcctcccgccgccggcccagatgggggcggaggaggggatcctcctccgcgagtggcgcaggtgagcaccgcatctgatctgtccgggcctttgccgtttcggctactgcttgcttgctttcgctggtgctagggttccgacgcatcgagcgagatctaacgcttagatctgatatttcgcctaattttcagctaggtggggcggaatagagtttgtagtgaggctgtattatcgtattatatgtcgattttagttaggatgaaacttgaacttgttgtttaggaattgcagtgattgattaggctgaggcttcaactggttctgaattcttagctagtggtactgaatttagttagtgcaattgaatctggtttggcaggagctgttgttaaatgcctttgcttgtgaggaaagtttgttagctctggtactggtatatgtacaaaataatcgctagttagcttctactcatagaacaacaagatgcttgatcagtgttgcacacactccaaaggggaattgatgtctttgcatgtgcattaaaaggctcatgtttcttgtttagtgaagttaaaacactttaagtacttgaaccattcttctctatcatcatggtgtggaaatgagcataaggccaatctcattttgcaattcacccatggtctgttacatgtttcaactttcaagataagcctcaggcttaagcaataatgcagtacacgtaacagttttctgagttaatgagcaaatgcttagtttatcttgagctatcttacatgtttcttggtgaatggtgatattaatcctaggtcttaccatgatgatggttcgcacccttactccttttgatgcttgtcttaggatgctttaattgatcttaaaatcagcttgatttgccagaacataaatcaccatttttagtgctatgccacatgggcatggaacgtgctcggcaaaggtgtgtgccaacaggagcaaactggctacttgtttgtgcttctgaaatttgcattttgtctgtcatgatcttatattctgcacttgcacgctcttctgcacctgtcaaatttttagtagtttcatgtatatccattctcagctcaaattttgtaaggtggtaatgttagcagttttactaccagtggtatgtgtttttgtgcctaatttatcctgtgcttggtataatctggtcattacaattgcaacagtatattttgcattagtatatagcgcaggtgagccacatctgatctgtttcggctatgccatttctgctattgtttgtttgcttccgtgggagctagggttccaccccttcaagcgagatccaacgcttagatctgctatcttccctaattttcagctagggagggcgtcatacagttgtagtgaaattgtcgttaaggaaatggcaagtgatcgattagtttgaaggtacaaccaattctgatctggttctcatgcccctgcagtatcgttcttcaagagctgctgtttaactgcctttgcttgtgaggaaagttttctagctctggtatacgtacaaaataatcattacttaacttttaccgatggaacaacaaggtgcttgattcattatgcgcacactccaaagggggctgatgtctttccatgtgcaataaaaggcttatgttgatttgtttagtgaagaaaacctaagtacatgcaccgatttcttttttcagcctggcatggaaattagtgtgaggccagtgtcattttacaatacatgtatggtctattacatgtttcaactctcaagataagcctaaagcttaagcagcactgcagtaggctaacagttttgtgatttatgatcacaggcttgtaaggctagtttgtcttgagctacattatctgttttcttccagttggatatcttggtgaatcctaatatttatccagaacttactcctttggatatttatgt

SEQ ID NO: 81698 - DNA, 1024 bp, Oryza sativa
ggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggtt

SEQ ID NO: 81699 - DNA, 2852 bp, Oryza sativa
ccggatccatgtggcccgccgccgccgccgaagcttccggcattgcgacaccctcccctccggcgaggcggccgcgcgcaaatggggatttatatgtggcgaggaggttttggttttggattatggtgtgggtgtttgtctagttcgtgcggggtgcgacgtcgtcggcgtgcagttggagttgggaagacaacaacgagggcgccatttggatcaacaagtctcctctctcatctccctcgactttggactttgcagacgactcgactcgactcgatgatgatggaggcgccgccgtggcaaaattgctgctgatccctagtatcagggggatcggagggtatatccttgccgggggctggggacaatgacaggtggggcccccggggaggtatcgggccaaaattagccggaccgctcgattagataatgcgaaatgtgcatgcgtcattttgaggcatggaacataggatacatatcctgcctaggatcaagatgtcttggtttatgacattattaattttgtgatgctaataatgtttcatgctaagaatttgttcgtggttaggttaactcttgtgtagtatcaatggagtagtagtatcgctctttgtgtggttgccagtaattttcccctctccaacaaccaatcacatcgtttctactgtgcacttaggcctctcacagtgccgcacgttttgtaccactagcaatttcatttttcagatgaaggtccagtttagataaaaacatcacatcgaatctttggacacatgtatagagcattaaatataaattaaaaaaactaattgtacagttaggaagaaaatcgcgagacggatcttttaagcctaattaatccatgattagccataagtgttagagtaacccacatgttctaatgacggattaaataggctcaaaagattcttcttgcggtttccaaacgagttatgaaattagttttttttattcgtgtccgaaaaccccttccgacatccggtcaaacatttgatgtgatacctaaaaattttcttttcgcgaactaaacacacccgacgggttttgatgggagggttttgtactccccacattaaatgaacttattgggaaaacttcaatcaaatcttatcctaaacgttgatcggaaagagtagcatatttccgtggtggagttgaaaagaaaaaaaaaacttaggtgctgtacctgtgaagattgaaatcagagtttttctttaaaagaaaaatcagagtatatataatagttacagtgaatcagagttatgatactgtagtatggattaggcaaaataattgcattgcgtgcagctagcagcggatgtcggagaaatcgaaggcgcaaaggttcatggtaggggtgttatgttaaggcttgtttatatcccctcgcaaaattttacaccatgttatgtcgaatgtttggacgcatgcataaagtattaaaaataaaaaataaataattaattacacaaattgtatgtaaattgcaagacgaatattttaagcctaattatgccatgatttgacaatgtagtgctccagtacacattattaacgacggattaattaggtttaataaattcgtctagcggattatgtaatttgttttgttattagattatatttaatactttaaatatgtgtccgtatacccgatatgacacaccaaaactttatacccctgtctaaatacagccttaggccatgtttacatcccaccctaaaatttttcaccctatcatatcgaacgtttgaatacatgtatgaaatattaaatatagactaaaaaaataactaattgcacagattgcaactaatttgcaagacaaatcttttaagcctaattcctccatgatttgataatgttgtgttacagtaaacatctgctaataacggattaattaggttaataaattcatctcgtggtttaatgatggactatgtaattagtttttttattagtgcttaaacacctcatacgacaccctatgtaagacaccttaaaactttatatccctatatctaaacacctcctttgttagttttttttttaagaacattatattagctgtatgctgcactccggtgctgtgcccgcacgtaggacgagatcgacggatggaattacgtggagagcagttcacttcacgcgttacctagaaaccagcagagattcagatttcagaggaatcaatcaatcatggtgttggccggagttggagccacgtttgcgacgacgacgatttcaacaagtcaatttgcaactgtgcgatcctcgccggctagccgcgccgaccgcgatgaaccccaatgcacattggatctgagccaatggagaatcaaaaggaaaaaaagggtaaaattaacagagatgattaaagctaagtagctagctagagaccgacctgcagtccagcttgattattctttcgtcagattaattaatcgtgcttagctaatacggagtactagagtaaggcgccgcgtcaggctctttcttcttcttcttcttcctgtgaataaacatgcacattcgtcagtagccaccaccaaccttgcactggattaaagaaacagggactgcacgttctggctaccttagctagctacgattcgatcctctatctgcactctgtttgggttaatatatttcttcattggagagaagaccaccttagttcgcactgattagattccagcctagatcattagcgttcgtgcgtgcgtgcatgcttctgttcttccgtggatcgatcggaggttgggtgggttagttgctagtacttgctactactacttgctgctgaaaaggtggaaggaatccaaagagg

SEQ ID NO: 81700 - DNA, 5266 bp, Oryza sativa
taatgtgtgattaattaagttgtaattattataaacttaaaaaatggtttaatctaatattttagaacaactttcatgtaaaaagtttttacacgaaacgcaccgtttagcagtttgaaaagtattacttttatctaaaaatttatccagctttagttggagattcgaacagggccgtagtagaagatgagcgaacctggctggctgccacgcacgcagacgcaggaatgcgtgacacgggcgtgcccaccgtatagtgtgctgctgaccgatcgagctggctggtcatccagccgggatggatccacgccagccaatcccagtggccaagatcactgtacgatttacactgtattctgcatgactactagaggcaggagcagtacgtccacggtccacgtacttcgtacactaggagcatgcatgcatgctggtagactggtttgttggtacctagtagtacatgtagattgctcgggtgaaaatgatagacgatcaaaatccccaccaatcgtgtatctcgttaagttaaaagtagtactgtaacgttttctttatcgttttgttctagctatgtgtaaattctgtttttttctccagttttttttagtgtcgtattgcgctaaccaatagctaaacgattttgctagatatttatcatcaaatttctccccctaatatttgtcagatgtaattacagtacaattgtagtgtaacttgcatgtaattacagtacaatcgtagtgtaattacactgtacctataatgtaacttcgaagaatctctcgataacatgttatttcagtaaaatagaggtcgtgggaacaaatcctttcacatatgtgtgtgctgtgatttttttcttcctcactagaacaaatcttgtaacagatctaacgattcaaaattacgtgaaacttacatacaagttacactgtagttacatacaagttacagtgtaattacatacaagttacagtgtaattacattacgattgtactataattacatctgtcaaatttttagtagaaaatttgtcgacaaatgtatagttggtcccatagctaaatcggatatgaaaattttcaactgaccgagaattgttgagttttttttcgaacgcgcaaaagaattgcatgccaatatattagtagaaaaaaagagtgctacgcactcaggccccgtttagttctccaatttttttttctaaaaacatcacatcgaatctttggacacatgcataaaacattaaatatggataaatgaaaaaactaattgcacaattaggagaaaaatcgcgagacgaatcttttgagtctaataagtccatgattagctgtaagtgctacagtaacccacatatactaatgacggattaattaggctcaaaagattcgtcttgcggttttcaagcgagttctgaaattaattttttcattcgtgtccgaaaaatccttccaacatccggtcaaatatctgatgtgatacctaaaaattttcttttcacaaactaaacatactcagtcaattgttgagtagaaatgctatccttccgaccgttttcatccctgaacgcatgtacgtctggtgcggtgcgttgctctgctcgtgtggccagaggcaagaggcacgcatcgcgaaccgtgtgtacagggctagctagcttagcgaggtggtacaagttgaggaaagcttaacgcacaaggagagtatatctcgctgcgtcaggcgcgggctccaccggcggccgcccgccaccttccattccttccttcctcgcgcctccgtctatatatagcagctatgccaagctcgctcgcctagcctagccggtccacgacgaaaaccaacacatcaccaactgctcaggcataattgctttgccgccctccaggtcggactgactgctacgtctctgtctacgtataccccagcctcctcgtcgtcgtctcgtactaggatcttgctacaaatagccggctgcttgctagctttagcttcttccttctcccgagagagacgatcgagatcacgcgcccacagaaactgcagattaagcggcagagattgtagatagcgcgaggttattaaggccagcagtctgaccgcgcgcggcatgcccttctgctgctgcaaccgaccaaatggctcctgcgggtgcctcctccccgtcactcgtgctcttcggcggcggcgccaccgacttcaacaagcgcccggccgattccgacgcctcgccgccgcaccaagtcaggtaattactcgggtacatacttaattacacttgcagatgcagttgcatattagctgtggaagtgtgtagggatatacgtgggttttagctagtgttgctgtttctggagatttgttgagaatgtagcgtggctcgctctttctactttctagagtttgtgtttagccgttctctggcataagtcggtctgactgattgtgttgtgtaaccacaatttttttattctaatatactacgtgtaatcttttttgcgtgttcccgaaaaaaatgaagtgcgtagggatcggccagtaatgggaatgtggtttttatttgcaaggagatcgcacggggcaccagtaaaaaaaccaccaccacctggagtgcccgcgctgccgatccaccaaccccaagttctgctactccaacaactccagctcgtcgcagccgcgccacttttccagcgcctgcccccgttactgaacgcacgggggcacgctccccaacgtgccggtggccggcgcctctcaccgcggcggcggcggcaagcgccgcagggtctccgccgacgccgacccttcctcggcgtcgccgccgccacccacgacttccaccagggacgcgtacgccgacctcccagccggcttcccgttcctcagtgacggcgccttcctgccgcagttcggcctcgccggcgttgcgccggccgcgttctcttgggcatcggctgtccctgacttgtacaactgcgggatcgcgccgtgggacgatggaacggcggtcaccggcgcggcgtgggacaacttcgccgacatcgccggccttgatctcagctggccgccgccgggtaactgacgaacagtacacagctggtcgctcgtgttttggggggctccggttttagcaaagcagcctcaagtagtgcgttcttcgatcggtatgcaggtagtgtgttcttcgatcggtatgaagtatattttgctgagctagggattatgatataattattgggaatgtaattaagcagctcaattatccaacgtggtgtttgcagttttcttctctcaccaatttcatacgcttgcacaatgatgtggtgattatcattgggatcagtgaatcgtgatctgtagctggaagatgtgtttacgtatgtgcagtgttaatgacaataataagagtttgttgccatcaagattctagcatgtgctcctagtaattaaatgaactgtagaatgctgaacagtgtagttcaataaaagccatactgggagggaagattgcacaatggattatcatggagttagaaattatcttcatatatcaatcagtgtataaccaagaaacaatatatgaacaaacaaatcgatgtattggttgttaaccatacaattacacaaagccttgtatcaacagagggtaaaaaatagtgtggtgcttagcaagttggattgagctactggggctcccaacctgacagcgaaacagggaaatcttttagctagtaaaagaactaggtgaaatggagaaaaaactaacgatatctatacagtaaacaaacggacatctctgaatattctcacactagctttacacttgaaccgggaagccgaaattctggaacaccctaatttcaccaccccttcctgcagtgacaatcaccaatccccaagctgaccggcgctgaacatccaaagctccaatgcaaaggtcggatgagcagtgaccaggactgctcttggcagacgattgtttctcgtcaggccaggacgttgatactccatccgctggaggattgcttgtgcttgcaacaccttcacaaactgggcgcttggtgcatctattgacagtgccattcagatcatgctcactgttctctacaggggcatcccgacccgtgttcatcactgcatcgtctgaatcactgtttctgctgctacgggacccgaatgagccacgggattcagcgccgggccatgtgatagccacagtgacatcatggcaatggaaatgctcatatgagttggttacatcaactgcactcctgcttctgctcggatgggaagtattgtcatgcctccagacatacacgtgggagtcctcactggcacagaccacatatttcccgtttggagctacagaagcggatatttggctacttgtatttcggaaccctggtgaaaagatcaaataaaatgtaagtgaaacagtataaatactggcctactgagtgagctaatgcaccaatcaagtgcacagttcttgtgattagggcctggtttagttcccaacttttccatcacatcaaaactttcctacacacacaaacttccaacttttccgtcacatcgttccaatttcaatcaaacttccaattttggcgtgaactaaacacacccatcgggggaaattggggaaatggaacctatgatttgatctgtgaacatgttaggaactgaggtaaataggtgggatgtgggggttttccaaagtatgaatcacttgaatttgggttacttactactttaaatcggccaggttccttctaggtgttctacatccgtcaacgtctagaggatacacaagtacagtgaatgaagcattacctttaaatttgtgaacgagttcatcaccattaacaacacggattcttgaatctgcagaggtaatcaggacttccgacgagcttccaggagcaaactgtatgaagtagagatatttagcatgtacaagaggcatcaggctaacatctaactattagagtacagaccactctttcttaacaaatgtccgccacgcaattatgcactacctggaagccagttatcttcttctggccagacttcttcttcctgattcttagttctatctgacttttgtactgaagcttcttttctgaaaagacaaaataaatgtgcaagctcattattgagggaaggcaaactctaaagtctctactcttgtttcctttgagatcatgctattttatagctacacaaataggaactcttagctagaacctaagattagat

SEQ ID NO: 81701 - DNA, 9735 bp, Oryza sativa
cttcttgatcaaaactcaaattctcaatctacaattgtagtagttagcaatcaagtccataaagctcaaaaagaagacaaaattgtctggcttgaatacagcttgagcgacagcatagtaatatcagttcatcagttaccttgtgtaacactgcaatatagattgatcgtccaacaacggcaataactcttcaagcaagagaaactagctgaggatacagaggtccaatctaactctatgaacacaatcgatggcctacaacacaagtataaagggcatataatcacaaaggttcctaaactgttgcatttcatcatcacatttcagtatctttcgaattcctgatccaatgtcaacattgttgtctttcttcagagaagcttcccgcttacactctggcactctgcatgtacaggcatttgacaatctgagccggaaggtgcttgctttggcacgacaacaaacttcaaattttttggagcacatttatgtatgtgtagcttgagaataggacaaacaatctcctgaacctataaacacaagcaaaatgtcagtttcctgaatatattgtaaaacacacaagttttgagaattttgagccccttaaatgcttcatttctttcccatcatgcagtatcacacaaaaaacaagtctaacaatgagttctcaaaaatacaaacaaccagtcttacagtagtcaaagaaacaattgagattgtatatgttggccatgactttttttgggtgtcaaagggatgattcttatgaggtactacgtctatattgcaaggtagaaacttctttttaagtgataattttgaaccacacaatatatatagtacttcctagaagtagacaacatttaagtagtgaaaacaaaattttcaacttaccaaacccactggcttttgtgtgaagccattgcctcaaagcttctggaagggctattattaacaagagtataagttggttgttttgagcttgaggagagggtggaagatagccaaatgtcaactggaccactgtacttgcgaaaaatgttcaagcttacctatccaaataaacaggcataatccaggttagcttcttcaaattaatgtattcacagggaattgtttagaggttaactagcctagtgccaataaaaatcatagaaattagccatcaaatgagatagacacatcaagcaattcaaatctatgcagagaaggcatgtgtagtgttattgttttctgtctttacttccaacgaaaatgatgatatcaatgcatttaagcacgcaattcataaattcaagaaagcaatgcacaggctcttttagactctggaataagtagagtatatggcaacgtgaagaaaataaagctaggatatcagggaagaattttacaagctcccatgcttcaatgtgtccttgcccgttgtcacgcagaagcttgctgttcatagaaaaatagatttattaagactccaaagaaaaatgctagaaacaccctgcagaaatatgctacatatgtgtaatctagactgtcataagtgaaagaaatgtaagcaaatccggcattaaatagatggaataagtgcacatcaccaaccaagagctacaggccatagtcatgacatacatgaattagccaaactgttcaattaaagtgtgaccccaaaacaacttatattatatatgcatgaaagggatgagatcatgggagagaaagagagaacccttacaaaggggtgtggtgatgggaaaggggaggccacagttatgttgaagttaggtaatacactttctttcggcagaacatgttgtgacttgacaagatatgtaacttaacaactatgtagatattatagaagcttgtgcggacaagctaacaatataaaatacatcagtaccagaaaatttttcttacaagagggcatcaaactcaaacagttgttattctaaaaatgctaaacaacaaagttgaactaaccagattccatgatgaacatcgcaatgatttggatggcctgatactcctcgggaatcgaaggcaacaatctaaaatgacaacaaatattgcaggagtaaataggggaatcggaatgaacaaaatgcaaaatttccatattttgaggtctagaaaatcaggacgaaaaaggcatttcacttgcacaatcatatgatgtactcaacctgggtacctgtttgcagcaacaccgcactgagatttggaacagattaactaatacagttttaaatggcatataatacagataggcgcacttgatgctcctgtttcttcactatattttttatttttaaagttgttcagaacagtaaagctcgaagcgaaacataatacaggaaagcaccaaagttgatagagtatagatatgaattattattactgggagatcatctgaatcttgacatggaatcattaccgtgtcgatattccataactgggattgtgccagggtaagttctgctattagtccatgatcccaatttttatgaaatccatcctacaaggtacattgtgtaaacttaagtatatatttggaacagtacctacatacaagcaggtcggcaaaaatgagctcataataaagcacctgcagttctgagtggtccaagactttaacttgctcagctggaatctgtaaatacatgatccatttcaacacatttttcaatggacaaccgaggtcaaaagaccctctccaaggggtataatggagcagagtaggacttattaccttaagagtgacacaggcaaggtagagttcctctttgcggatatttccaaggccatcagcattgcctaatatggggattaaattgacaatcagaacgaccgactcagatgaggtttcttatccaaataatggcgcccttaaagagtagaaatacatatgattgagctgagacatactggaaaagcgaaatacgcacataggatcagagtgtagacgtcttttaccttgagacaagcacaagatatgaatgctgtgaccttttgacttgaggaaaagaatagtcggagcaaaaaacctgtatcagcaacatgacaatcaatcagaatcaaccaaaacaaatactataaacaagatttcccctaaacagttccacaaaataataaaaagttcagctgttcacttagtttcatttctgtaatcatcctgcttttgtaagaactttgtttcatttctgttaaatggaaatggagggagaatgctcccttagctcaaaaaaaaaaaaactgttcacttgttcaggaatttcatcgagcaggtaccgtgcacaggagttagcctattaagcttcattgttagcggttactggaactgtagccccacgatttacacagcgaggctcgcaaacgataagagacatgaggaggaagaagcagtacatggattcgtcgtcggggtgggcgagaacgaggaggacattccggctcatcctgtcgccgcgaggaggggagaggaaggtggagttggcaggcagacacgccggcgaggaggaggagagcacccgccccagagaaaccgcccacaggagcacggcccccgccgccatgagcatccagatccacgccatagccttttccggcggccgcgcgcgccactcttccccgtgcctgtgtggctgcgcggtggtggactggcctctcgtcggtctcctcgagttctcgccgacgcccagctcgccgccttcctcccccgtggcgccaccgctcgccggtgggctcctcgtcccctcgacgtcgacgacttccggcgacgaatacggtgtgacagcgctcatggcgtgagaagtggcttaatgggccagtgctggtcggcccatttaaatgaagaaacgggccggttggattgggtactgggccttgcatccggcctggagcccaccatcctgtttctaattttcgtatggattaattaaggatcgtattaatgtcatttcaaaccatactattttcttaagtaaagttaacaaagatacgcattcatttagttttttaaccaaactttggtaaatataaaataaatcatgtcaaaacttgacaatattatcaaattgccaaaatttggtaaggtttattttggctcccctaaacaagtggttaattacttaatttaggtggacaaatcgataatgtaagcctgtggttttattgcatgatttgtcgggtaaaaaaaaattactaattgtacatcacttgacaggcctctctcactgaaagctgaaaccccctaaaccccgaagaaattaacagttgaaacgaatgggtaaataataaactcagacgaggccgacgagcttctcgctgaggtcccagagcttcctggccttctccgggtcgctggcctcctgcgagagctggttctcgaacgacgccgagtccttgttccagctccagtacacgccggacttggtcaggctcgggtcgcccaccacctgcgccagccgcttcccggactccgcctccgacacgaaccccttcgtcacgaaccgctggaacggcgggaacagcagccggaacagcgggatgtgctcgcggaacaagcccgtcgtcgcgatgcaccccgggtacagcgacgcgaacgtgatcccggtctcctcgtggaatctccggtggaactcctgcatcgtcagcatgttacagatcttgctgtccttgtacgccttggcgccgtcgaagctctccgcgccgtcgatcatcgccgacccgttctgcccgcggagcccgccggcgagcccccggaggtcgcctagcccggccttgggagggacgttgccggcgagggtgttggtgttgccggtgatggagccgaggatgatgagccgccgcgacgggtagtcggatttcttgaggtcgtcgagcatgaggcgggcgaggaggaagtggcccaggtggttcaccccgacgctcatctcgtacccgtcggcggtgaacgtcggctgccgcgccgtcggccggtagatggcggcgttgcacaccagcgcgtcgagcggcatgccggagcgccggaagttgtccacgaactggcggacgctgtcgagggaggcgaggtccaggtgcatgacggtgtagctccccgccgccatccccgccgccttcgccgccgtcgccgccttcaggaagtcgcggcacgccatcaccacgtgccacttccccgtctccgccagcgccttcgccgccgcgagcccgagccccgacgacgcgccggtgatcaccaccaccccctgccgcagcgtcttcttcccgtccgccttcgacgtgcccgcgccggggctcgccaccggcgccgccggcgtcgccaccgccctcaccaccagcgacggcttcttggccttctggctcacgctaaggaaccccggctccttcaccaccgcgctcaagttaccctgatcagtcgtcacacataatccaatcaaaaacttgttcaaaatgcacaaacttcacacaaataaatccatttttgacagaattcaacaatgcagatgatttttgggtgcgcattgttaccttcttggggacagagagagcagagggcaggagtgcggcctgaacttggagagccattggtgtgagtgtttgagtttggagtgagctcaagtgtactatgtttctggtgtccttttgcttcgtgttggtgaccagcaagagtgagttccggagggtatttatacacggacccgaggagcgaggagcgccacgggctaaggataagggggtgggccccccaccacgctggacgcctcccagccaatcgcagctcgtgcctcggattttccgctacgatttttttccttcgagatattgtcctgtgaaagcgacacgtggtgggatattttttcgtaaccgacacgggggacagcgacgtcgcgggatcttctgcgcatggctgcccgtaacatatggtgacgtggcgttgtgtgattgggtcgtggctatcgcgacccgtgtgcggtgtttgggcgtggaggacgggatgggagtcgcaaataatgcagcatgggaggtgtgggccactgatgggtgggaccagatagggcagatctgtcgttttgcgtgggaagatgacgcgagttcgtgcccatgtgaacgtgcggtaaacgactggctgtggcccgagacacgtaggaaaggcccattgggtctgtgctgacttggcaaccgacgtggcacgatatccgttgcacttttcatcgcctcttcttggtgtcagcatcgcagcattggtaagattttcttttcattgacaaatacagtacaaaagtaggtgttcataaggcgcgtagactcatccctataaacacacatatgcacactctatcctataaatatattgaaaaactaagttgggagattgacgaaatcaccaccgacggaataagatttaaatcagctgaggatagtgtagtactccctccattactaaaagaccatctttcaactttaaccagttactggttaatctgaccagtaacttgacccaaatttcaactttttacgctaacgcataaaagaattacacgtcaatatattagcaaggaacaaatttcacttttcaagttgcaacttgcaggtagtacgaaactatttctaatctctgtccaaaatgtcaggtaaagtggtaatggcttgcatgaaatgcgtacaccagtctcagttctgaaatgtcttactagcagttaagccaagtatacttttttctaggtgaagttaagggcatgctcagcttacttggtcacaactgcaaacacaagagagtttttgctgatggttatcgctgttgcatttgtgttgcgctgcagctgcgaccaactcaatcatgcaaggcctagcaagtacttgatgcggttgtgcggaatagtgcattgtctttttggttatgcttatccgcatagtttattaacaaccaaatagtatatattataagtaaaaatttatacatgtgtctatagcaatttaaaagcaaacgccataaaataaaaatacgatgaaaaatcataaaatcatatcaaattaaaaatttaaatttaaattttagcttacaaatataagcataagcaaaaatgataaggctattcgatccagaagctgtctctcggcgaacaaaatgaacacctgagagacaaaatgaacaaaatgaagcaaatcttctaattaagcccaatacgtttcatttccaggaggcccattgctatgggccccatcacttcctcatgcaggccacaaaaacctgggctaattacccacaacaaataaagcccaattgcccatgaggccattcaacccagagattcaaccaagatgcatgacgagttgccctctggtcgttatcgtcctaatcagacggtgcctattttagcttccttctccatcaggatctcgctggaaagtccaacttacctacatcagtatatgacatttttcattcacatcaatcttagcaagcatgacataatttactatatgatattatagaccgtcgtacgctcatactaatgtgattatctgctgatgatggacatcgaccagcacactcgtccttatcgtttgaccaaaatgacctgatccaactaatcatatacatgcgagatcctgtgtactatagtaatgtattgtagcgctaattaaattgagatgatgggcgaagaggcgtgcttggtcgagagaggtaggatgcgtgtgtccacgaacaatagaccagggttcagcttaaaatgtttaactagacgcatgcagatgcagaagcttgcgagttgttcatatgataattattaattcagaatatattacagctgatcgatcgagctggtagctactgtagctagcatgcggccgcgattccgatcgatccatcagctgggcgtcgccgtcgccggtaacattggtcggtaggacaccggattttaaaaatgttgatggtttctgaagcaacacccaagtgttaattattggagtatattgtgtgtaagagtgacaggtgctaccaaaaaaaacgctgttcaatctcccgtaggagcatattactaattgctagctgatgatctatgattaagctctgactgacttctcgggggtcagcaatgctcgaagctactagaatacaattccgttcccagcaacttgtgaacttttagctagcgatcgaggaataaaagctagatgatcgagcaagttctgaacattgttgggttggtgtgtgcatgacatgtgctaatcctaactgatgtaattgggatcggactatgtgcattcgtggccagtagaattggaaggctccacggcgctcgagtcaaggcgcacgcccgggcatggtatggtggtcaggcatcggcaaacgacagacaaggcagccaggcagagcacgttgtgcgtactctatatccaccgaaagctagtgcgtgccgtctatgttctgtattgacacaagtactatctttctattctaaatatatatatttatctttctattttaaatatattgtatatatcgttgttaaattttttataaatgtttaaccatttattatatttatttttcaaaaaatataaaagatatactccctccgtcccaagaaaaggcaaaccctgggtttccatgttcaactttgactgtccgtcttatataaaatttttttataattcgtatttttattcttgttaaatgataaaacatgattaatattttatgcgtgacttgtctttttaattttttttataattttttcaaataagacggacggtcaaacgttgggcacggaaaccagagtttgtctttttttggacggagagagtaagttgcttcatccgttacacaatgtaaattattttagtatttttcatatttatattgatgttaatgaatctaaaaatactggaatgacttagattgtaaaacggaggaagtatgtttgaagagccttcagtatgtaatgaattaagtcataagaacttaaataaaaaatatcagccgcacgcgcacgctcacgcaccaccttgtttcgcgggccgagcgtcatacaagggagagcgtgatgcgtgtctctcgcataacgacatcgttacgttcacacgaataagcagcattcacaataggcgatggcaatcacaggataaaaaacacaattatatatcagtccaattgttcgggctcgtatggagaaaccgcgctctcagtaaacaaaccaagccaaaaaaaaaataagattctaatttgaaactaacatcctctagtaatttactatgggctacatacggcggccgaagtatcaaagtagactcatatcagttgacggggtgttgacaggttaattattttccaagtttagtcgcttcatggttgggggataattgatcaacccacccggtcagaaatcccagccgcagagaattcagattccaatttactgcttttcacgagctacagggcggcagcgcgctgatgacaaaccaaaccacggatgcatgcgccgatccgacgagatgcactgcacgtatgcacgcaccgtggctgcgtcggccgacaggtcgcggtgcgcgtgtgccccgcgcggcgagcagcgggcagcccgagctggggccagcagccgacgcgctgcactgcactgcactgcagagaagcgagcgagcgagcaacgcattcgattcgattcgagagtaggagaagcaatgcaaggcggggggcgacggtgacagcgcaatatttcgcggaggcggggcccgtcc

SEQ ID NO: 81702 - DNA, 3468 bp, Oryza sativa
  unsure (1)..(3468): unsure at all n locations
cttttgctcaacgccaaattgtgtagcgttgaatttagacacctcagcgccaaatagcatgacgctgaatgtacgttggcacgctgacttagtctcccatccgtcgtggcaccgcattcagcgccagctaacgtggcgctgagatgtctaagttcagcgccacatgatttggcattgagcaaaagggtcagatttgaaataagttttggcagcggttcatttgtaaaaatagtttttgcaaaaagtcaaattgtcaaaatttgtatcaggaatctgcccacattttcatggttgtgttattgtgtattcagtagtaaggcttagagtgaaattttggagctgtggtcagtcattttggcatgaacttgcacaattgctgaattgcagagtattaaacttgaggtatcaccttgttctgaatattcactcgagataattgctcttataccatgtggttagatgtcaaacttccatttggcataaaatttcttctatttgctaaaatatcatataactcactggaaattcgctctttttcaatgaatttgaataattcagttcagaatctatttacattcactgtaatggtttcatggatgtgcaagtgtagcttactagcattaccaactgtgactgattgactggcacagtggcaccaacatttacactgtatgattcgttgatgctacagaggattctgaagttggaaaagagtatgagatattttctttcctattagtgctctaaaacaaaacaatttggtttgcaatttgcattcaccgcaacaccagtatctagtaatactgttaaaacccacctaaaaaaatggccaagttcacattgatccatttggtcaataactcaagatcctcatcccttgtgcaccaggtgctcgccgtaacggagctcaacctttccccgcgccgcttcgccgtcgcccgccgccgcgccaaagagcagctcgatctcttcagcgtcttgccgctcgtttncggcacgtaccggtagacgaacacgacggacagggcggatatgacggcgaagacggagaaggcgccggcaaccgagatggcgcggcagacggacaggaaggacatggccacggcgccgctggtcaccctgttcatcaccgcgccgagcgccgccgcctgagaccgcagccggagcgggaagatctccgagctcatcacccagcagatgggccctatcccgacggagaagaacgcgacgtcgccgcacacggtcaggatggcgacggcgatgccagcgctcctggacgccgacccgtgcgcgagcgcggcgagcgtcgccgcgagcacgacgaggcaggccgtcatgccgaccgtgctgacgtacagcagcggcttcctcccgacgcggtcgatgagcacgatggcaagcgcgatgaacgccgtcttgaagaacccgacggcgacggtggcgacgaggagctggctctcggtggtgatcccggcgtcccggaatatcgtcgggctgtagtagacgagcgcgtcgatgccggtgatctgctggaagcactggatgcctagcccggtgatgagcatccgccggatcaccggagacggcctcgtcagctcctgccacaccgtcttgtcgccgtacttgccggcgctcgcgacggcggcggcggcccgctcgatctcggcaagcctctccttcgcctcgtcctcgctgtcggggaccttgagaagcacctcgcgcgcctcgtcggccctgttcttcatgaccagccaccgcggcgactctgggatcaccagcagtgcaaaggcgatggacaccgacgggaggatgccgacggcgagcatgacgcgccagctgacgtggtccgggaggccggagaaggcgtagttggagatgtacccgaggaggatgccgaggttgatgaagatctccgggaaggaggtgaaggagccccgcgacgccgccggggagatctcggcgatgtacaccggcgcgatcatgacgccgaacccgatgccgacgccggccagcagcctcccgaccatgagcacctcgaacgacggggcgagcgtcatgacggccgcgccggcctggaacacgatggcggcgaggccgatcgtccatttccggccgacggcgtccgacgtccttccgccggcgaggctgccgaggagggagatgaagttgaggcacccgacgagcacttcttgctgcacttcattgatgtggaggtctctctggatgaagagaatgcagccgctcatcacaccaacatctgggaacaaaaggtttattaccacacagaaattgaattatatatgcattttgtgtgtaattatcttaaacttaatttttgcccgggtgcaatttcatcttaatgaaatcaattccattatcttaaaagaaaaagttagttctagtcaaatttttagtgtgttgctaaaatgctgtcgaaaaaaaaaaagctactacgagctagctgccgttgactgaaattagcatcgcgatgattccaaataagtggactattcgatatcagtagtgaatagaaatccatctgaacaaaacattgtgatactagttactactgattcttgattatgaagaaactgcattgctaattactaaccagttaactagtaaccgtagtttagactactcaacaactcctactaaacgccacaaggtaacagacatggaataagctggagagtcgccatcaaagaccgaagactaatgaagaagaaatagtcaacgcgattggccaaaacatttcctactccttgtgcaggatcaccaagaacttgccaagatccaagcacgcgtatcgaaattctccatcgattcagccaacacgaacacatatacgtgcgagagagattcatgtggaaacggaggagattagttaccgtagccgaggaggacggagttgagggaggcgaagacagagcaggcgaagacgtagcgcctgctgctgtggctccggcggacgcggacgcctccgcctccgccgccgacgccgtcctcctcctgctcctgcggcagcacgtcgtccatgcggacgtacttgctcttgccgccgaagaatccagggaggccgccgccgctggccgccggcggctcggcgccggggagccccatgccttctgcttatctgatgcgctccctttgctccgtcttcctcctctccggcgagtagagggcggcgcttcgaatggtactaatggtggtatcgcggattgctggatctgaggaggaggaggaggaagaagaagtggaggcagcgagagagattttataagtttctaattctgtccgcttttgagttttgacacgcgatttgctgttcaacgccaaagcggaggaggtcgaattttcaaatgggtcattttgtgttcaagcccttgtactactcgtgatttctgacaagggtactgtgggctcttggggcattgggctgggcagtacttgcacttggggatcctc

SEQ ID NO: 81703 - DNA, 40167 bp, Oryza sativa
tcttcagggtttgaaaatagatgataaggatgcttggggtgatccgtttactatcacaccggatcacgtgtttatttaaggcttgtttggaggactgatatttgggccaaaccaatcatggtctttgatcaattctagcagtgcacccacaatgacaatcctacacagagcttgagaacaaataggaaggcgttcaaatttcactctatagtcctgttataccttgtaattctgggggctcaatattaaatcttcaaacctgttggaaatccccttcttcattgcgttaattttcgttgttgtggccattgcggtgtgctgacccgtcagcggcgcccggggggggggatttagcagctggttttgctgccttccggttgctcgtctcggtggccctcggatcgtcatccaacagtcgtttcggcccctcgtcttgctgcggcgtctggcatccgtccgtcagatcacgatccaaagctaactcattctctgcttgtttccccgttttttgacaaattgacccttttcaaaaacttatttcgaaactaacccctgccaaaaacttcaaccaaaaataggccgtttgctcagcgccaatacgcttggcgctgaggttgggcgtggcagctacctcagcgccaaccgcattggcgctaagatggcgaatctctgcgccaaccgcgtcggcgctgaggtgccaaacttcagcgccaacgggcctggcgctgaggtttggtacttagaggccggccgaagccgcccccaaccagcctctcctctattctcccccaccgcgcgctagggttcgtcgccctctcttctcccctcaccaaatctcccccaaatccactcaaatcgaaggggatttcgtcgggattgatttggggatcgattgagaaggtaaactcctctagaaactctaatttccccccatgttttattggatatttcgcattgttttggttccaaccgtggtttgataattattggctcggattgggatgttaattggataatgtgggtggggatgtagtgcggaagatacatattaatcttgctccatttggttcatgttgatttgtgggtggggatgtagtgcgctgaccttcctagtctcagcgccatttccgctggcgttgaggtcctccccccctcacgcaagccagacagaaggcctgctgggtcgggactcggccgaaaaggctaagtcccacctcagcgccgacgggtgggcgctgaagttagccagctcagcgccgatgtgcttggcgctgaggtagatgccacgtcggcggggggatcggctcggccgccacggtggcacgaggtcagcgccatgacctttggcgctgacacgcccaacctcagcgccaatgagcttggcgtggagccgacagtttattttttgttgaagtttttggtaggggttagtttcgaaataagtttttaaaaaggttcaatttgtcaaaaaaaaaaacggttgtttcccttcctgctccggctcccgcgcaatcccgcgatggcaatgcaaaagccttcgcttctacttccacgagatctacgtgcggcggcacacccaacgcatgcatgacgcgcccctgcatgcatacatatcacctcagtcgtacaggatcggaactcgtacaggccaaataatgttcacggtctactctttaggtactgtttagttgacacccacaacttacttagtgttgtcatatctcttaattaagttagacaagtttaatagatgattgtttagttcataaccatatttatggtaagatttattctccattacatagtccacatatgtcattgagataaaaaagtgtggcaggagtgcctcatgctagctaacgagtggttctaattttattagtcataccttagacaagttagccaaaaatttgtgtcaaacttgggtaaattgaattacccaaccaaaaggccgtttattatgcctaaaacaatgaagagtttcccacgaaatatatccattaagatcggctaatatatggggcccaaattttataagacaaccaacaattttatccagaataacttttattatgctcaagatatgaagagttccacataaaatagacctagttttcatataaagaccatccaataatacatttgtaaattccattacaccagtgaaagcgagcatagaatatgggcgaagcacatttcatccacaagctcctcggcacgtatttctgcgcggcactgcatccggatgaacagctcgtcagccatcgccccgccgatgtgcgtgttgacgagtggcccaaagagggcacgcatgtagttcgctaccatgcgcccgaccacgccgcggttagcgggatcatccacgacgggagggcttcccatcacgagctccaactggttgatcttaaacgagccgtcggcgtccacagcctccttgaactcctctactgtagcagcgtaaagggggacgttaaagttgtccatcttctcgccatcgaccatctcctcttcgatgagatcacgcaatgagtcctcgaacatgctgcaatacacttcatagatgtagccttgctccgtggggccgcgggtggatgataggcggccaaggctgacaatgaaaatggcaccaccaggcttcatctcggcggcacgacagtgtagaaagcgcatcatgtcagaccggaattgtcgttggtatgccgtgcccgtctcctcagaggcaccatgcacgaacactttacctttgttgtatgccggcgattgcttgtcgacgactctcttcggcacctgtgtaataattaaaccaattaaacttcttcacttattgcttacatttaagggtggttgataagctaactcgaaccgtagcttgactccgaaaattggttgagttaatgagccgactcgctcaactcgttaacataacaagttaaaaatgagcccagcttagttcgctaagaaattcgagtagactcattgaaactattaaacttgctacgacgcaatacatctttattattataaaaattgaagacgtttttgccggtactttagtacatcatctgtgtataagtcggttttcaagttcgttcacttttggaaatacatattattatttgagtcgtttattatgtttgcttttggaaacacagaagagtcatataagaaatctttgtaaaaaaaactcgtatgctaacttgaggcgatcggactctaattacagctcatgattttaagcgaattctaatagtgaatttcaccttaattaaactgtataacaataataaaattaaaatagctttcacccgccgcaacgcacgggtattttttctagtgattttaaatttaggatttgctttttataatttgacataaattttgggagaaaattaatattttatattgttcgtcatatccgatgggctttaagatccctgaccgttggatgggttaaaaaccaaagcgtattgcgtgaggtgggcgtcgatcgaactagctcgcaaccaccaatagctcctgcgtgcgtccccctactgagctagtgcaacttttttttttatttacataccgcttacttcctctggttctatattaattgatgtttttgacaaggttgaggttaaacttttataactttaaccatcaataactttaaaaatatttagtttaaagaaactagaaaaacatatatagatttgtcttttcaaaacactataataaaagtaaacatgcatttatttattgtatatattataatagaaaaataaggtcaaaagtatatcttgtagagcgtgtcattgtccaaagcatcaattaaaatgaaactgaagggagtatattctaggtacatgtgtacttacattgttattgtactataatgtatcgtattaatttacattttaaatttttttgggggaatttctatagaacgttagatagatatatatactccctttaaatttacatttggtatgatttataggcctatgtaattggagttatggccgacgtgctatgtatcatgacaatataaggttgtactataataagtggtttgtgagctgcttgtgtcatacgtgacactatctagcatgtggagtggacttttaatttcaacacgtcacaagctaaacgagctacacaagtaactcacaaattagctcaaggtagctgactaagcaaatgatcgaaatattgaacttaatgatcctactcgatcattaactgctcgagtcaaaacctgaattttaccagtcgagtagctcactttgatcccaaccatacttaactacatgtataacgtgcaagaatttttctcagattgaacaacacattgaaatcaatataatccatattcattagtaacacaaacgattttcttttctgtactatcttcctaatttaacacatattttcattagtaacacaaacgtttttttaattttcagtagtacttgtgtgctatcccttctttttttaaaagaaaaaaattgcgttcgcaaaagaaaatgttttttttaatttcactgtgaaaatcttgaatacacacgctcagaatcctacgttcacaccactgattggaaactgaagcaaaaattgtatacatatcaaattctactgaaaagatgtacaatatatttatctccacgcaaaattgggtgagaagatatgctagttagtctgaagatcaacacaaaatggaggattcattggggaaactattttgattcctcaaaggggatgtccctcatttacttcaaaaccatctaaacggttatgaaaaattctggaaaaaattggcaacactcatactatatatctatacaactccacaaaatcttaaatccaaactcaattcacacgttgagatttaaaaaaagacaaatttagtatatgaatagtaatataatgttcatatctgaatttgtctttttttttctcgatatgtaggtcgaatttgaaatttatttttggtggactagtagatatcgctatactctatattgtcaattttttttaaaatttttcacaaccatttgcatcgaatttaaaagaaaaaggtacacgaggggatatctcccctcgacggattagaatctactcccgattcattatgattaatttgatgtactctaaaaaaaacctaaactgtatattatacagcgtacctgtgagagccagtgcaatgagaaggtggaggtgaacacgttgatggatcgctcggggaacaggcgatcatggaaagagccaggtacggcggcggcgaagtagcgccggctctgccgcccatctctgcccgcggcagcagcttgctgtgggaggaggtgaaatagggtgttgaagtcgttgctcgggaggtcggaaaagtagaagcagaattccaggccgtcgtcgtccttgctgccgaaggatttgtcggtcatgtggtcgacgatcacgtccgcgatcaggagagtattttggccgcatgagcatcccaggtcggcggccgtcagtagcggcttgttccccggacggtgacgagggagctggatcttgtccagtgtctcctcaagggcgtacagcatcattttcaggtttcgggactgcaccggcagttttactttgctcgatcaggcgtagcaatcttactaatactctccgtcccaaaatataattacttttaaaataatgctaagtcaaacattttcaactttactattaatcactaaaaataaaaaagatcaatcatttaaaattgatattactagattaatcattaaacaagctatcataatatgcaactctttttatttaaaaaatcttaactttatagatatttgttagttaaaatagcatctcgaaaattatgtcgaagtccaaaaatgcttatatcttgggacagagggaatagtaattaatagccacctctaattgcatatagttatgcttgtattacttagctaattagtcttgcttaatttgttaattacctgagattggctgttgttgatgtaactggactcgccctggccaccctccatacagaagacgttcttgaagtcctgctgctgctcttgcatctttgatcgcgaattcaccgcacgacgggagaatgggggtgtatgtgtataacttgttcctgagtaatttagttggatcgagttggcaaagctgtactgtatcgatcgtatatataacttgcctcgatgataccttcagccttttttttttattgaacacatcagcgctggtttgttgaaccgaatatgatgtcatttttttagtgggatataaagtcattttaattagggcccgtagtacacagaatttgaacgaacccatatggccatatggttgatggtaaaaatcaggagtagagcaaaaaaggaaaagacgactcacgcgtggtaccgacgaggtcgcgcggtggccgatgggcggcacgtgcgccgtgagtccatagatgctacgctagctctcagtggcccagttgactagtaatgttcaggtcgcttcttttaaaaaaaatagagaagggtttgtgtagtatttttaaattatgaacttagtctatgaaacaactcaatctaaaattagtttctataaaaatttaaaatcatgacatttagatgctactcagttcattgcaacaactatgtagatttagattagaaaggcagtgggatgcatgggggcgtcttcagggtttaaaaatgagatgacaaggatacttggggtggtctgtttacgatcacaccggatcacgagtttatttaaggcctgcttggaggactggtatttggtccaaaccagtccctttgatcaattccagtagtgcacccacaatgacaaccttaagaagagcttgagaacaaataggaagacgatcaaattccactctatggtactgctgtaccttgcaattccggggggtcaatcttaaatcttcaaacctgttggaaatccccttcttcattgcgttaattttcgctgttgcggccattgcggtgtgccgacccatcagcggcacgcggggggaattaagcagctggtttttctgccttctggttgctcgtctcggtggccctcggatcgtcatccaacggtcatttcggccccttgtcttgctgcgtctggcgtccgtccgatcacaatccaaagctgtactcattctctgcttgtttcccttcctgctccggctcccggcaaaagcctccgcttctacttccacgagatcgacgtgcggcacacacaacgtatgcatgacgcgcccctgcatgcatacatatcacctcagtcgtagaggatcggaactcgtccttgctccggcaaataagtactcaacccggcgtcgtggttgatcagggagctaggtggtggtattcaggaatgtccgtgcacacgtacgcgtcgaggtggcttcacgtacggcgcgtatatcggcagctcagctctctggccacgctgctgggccgcatccgcacgtttggcccgtcggaacagacatcggcaggcataaatttacaagttcactttatgtccttcaaaactatggatggagcactattgtctcggtgtacacatacgctggccacatgccacgtcaaaggacaaggacaacgagaatcaagaaaattaaatctaaactttaattagtaaataacaaaggcaaatcttatctgaacggaagatcaagcaacaaatgaacattccaacagatacagagagagatgagttacgactaatctcatgtttgatcgatcatgatgcgcgcgggcacaggccggaccagcccttgccgacgactcgctgttgtccacgttcactcacgctcatatatatcgatcacaatacgccccttgcgcgcgtggaacaacgcctatatatggtgacggacccccggcttacgaaccttttgcgaacgtgccgtggctcgacctacatgcacagcgccgaagaccgtcttgcccgcggtagaaccgccgtcatttcctccggtagtcgtccccgtgcgcgtcctgatcctcatcagtattcgtattcccgaccatgcatgcatgacgcatgtgtagagtcctactgtcatagtgcatcccggggcctttcgtgaggtgttgtgtgatctcggcttgatcgaggctctctgagtgctgagattactgatgtacctcctccaaacgaaacgattctgcattattttcttcgtcttttttcctgagaagattcaccagcttgtctagtgtagtattgctagcgctagctgtgtggtgcacatgatcggataccccgagggaagaacacgagctttgggccgccgcgggggactgcaagtctgcaaccaaccaccgcctcacgtcgtgctagctcccgggcagggcatgcagcccacacgggcgtaagcgggttgcttttctcgtctcctctccatccatatgcacgagcgcgcgggcgtcaccgtgacccgtctcgctcgctcacggtcgccgagtgtgcgcgccctcggatcggcgccgtcgcgccgagcgcggcaggttgcagctcgctcacaccaaaagtgtcgggtatatgtggtggggcgtcgcaacggctaaaaatcccaaggtttgccttatctcacaagcaccgatcgccatttccgtttctcccttcttgcatctctctccagaggcgagccgctgagacggcgccactcccctcggcatgaagcaccacgccatgaagtcccagtcccgcgcctcgtcgtcggcaatgggcgcgcgccacgcacaagttctgacaagtcatgcatatatcacgcatatgtactccatctaagcatgaaaataaacattccagaagagggagaagatcataggaacatttggatcttattgaccggcatggttacagaatcatagaaacactatcatataggctaacattagcacaacgagatagactaacgccgtatgggtggttgtatgcgttccaatgtacttcttggatgaagaaatactttccatctttgcacgctcacaagcttcactcctatgacgatcaagcatgatcttctttagggcttcttctcgtggcatagttttcaaatggctacgcacaaagtatgaaatttcagtaaggtggggaactagataaaaaaccctggctttaatccgccgttcccgatacttcttcaaagcatttcgaatagcagcaatcgacacttcgatatttgttttatgttcattatattcttcccaatcgtacatcccttgttcatgtaagattttcatctcattatcaattcttcttccagcaaagcgtagcttcagttcacggaacaaatatgtttgtttgatcataacttgcctagtcatgtcggtaataccatactcatcacggcggcaaaaggtcaatatttttgttcccacgaagaatttatttttctttattgatctcctacgagtagcggcatcgttgataaccgttgttttcataaagaagttggctctatctttcttttgtgttttcctgcgaccatggatcaataagctaggttggagtatataagcacactaatataagtctctctatatatatagctttagaaaatccacgtgacagattttaacacgcacacacatacgtacctgcagcttcggttgttctccatgatatatcgcaatccctaataattgcttcacctggatatatatatcagaggactgtagtatatcatgtataaaagaacatatgggagaccaaattaatctactcctatgagagtatatctctaacaacgactatagcgtggaaagatcagctctctatataccagcactcgggcaggttgatggatggatttaggagggcttgcactgttccgctgtcgtcgagtcgtcctgtttcgaaagtgtacgttgtcttggagagtagatcgaatatatatatacactccatgttggatatatatccatataagaaacgatcttaatttaagcctatatgttattggatcggattaggaacgactggccgcaccaccagttcgatcataagaccatataaaacccttttattactctttttactcctactagcataaatgcctgtgcgttacaatgggtgaagtagtcatatatgtttagattaaaacaaaatcacattgtgtgcatgcaagttatggtccggttcgtttccactacaaagagtggataaaattttagatatttttaccacgcttttcaaactgctaaacagtgtgtttcatgcgaaaactttctatatgaaaattgctctaaaatatcatattaatctatttttcaagtttataataaataaaactcatttaatcatacgttaataccgtatcgttttgcgtaaaacactttatttttatctttatctttagaagaaaagaacaccacctatatctactagcatacttgcacgcatacatactactagtcataaatgcccgtgtacaagttatgcgcagcatatatttttacgtactactaggcatacatgtttagattaaaatcccatggttgtgtacggcagtgtgtgtttctaacccgtctctctcgtgatccgcgtgtacgttttttgaatggttaaacagtacgttttttttacaaaaaatttatgtacgaaagttaatttaaaaattatattgatctattttttaaaaaaatagttactacttaattaattatatgttaacgggccatttcgtttttcatgcacaggagatttgtatccatctccttcaaacgagctcaacataacacccccacacaaaagacataacttcggactcgtcgtacatatcagggggtgtttgggatctcaaaaacataagtcctaaagttcaaacacccctgaactttggactcctcgcacatatctgcctccgtcctaaagcagtcctactccctacccacctggggcgaagatgctgatacattgacagagtagcagacatgcagtggaaagaaaagtatagagaacacaattctggttcaagttccagagatgacaaaattgggaaaaacacttcagttgtatttagttcttgaaattggggagaagtttggaaaaatttgatagtttgaaaaaaaagttagaagtttatgtgagtagaaaagttttagatgtgatagaaagttaggagtacgggggaagtttggtatactaaatagggccttcatgaataaaaacacttccgcggtgagacgcgccccgcaagtcacaaaagtgtatgataagttctctcctctccatcatacacgagcgcgcgggcgtcaccgcgactcgtctcggtcgctcacggtctccgcgagtgtgcgcgctctcggacgagacgactcggatcggcgtcaagcacggcaggttgcacctcggctgcttgcactgcactgcacacatgtctgcagctcactcacaccaaaattgtcgcgtctatgtggtggcgttgcaatggccccgccgcccgcgggcggctttgcgtcaccgttgctgctcgagccaactagccccggccggcgtcacctgctccgctctcacgtggcactgcacgccgggtaattgtgcgaaatatatccgctctccggtggtcgttgccgtggatgtcctgatcctccattatacgtattcccgaccatgcatgacgcatgtgtagagtcttgctgtcctagtgcgccccggggcttttcgtgaggtactgtgttctcggcttgatcgggaaaacccaatccatcccttcaaagggatattctctcatttttgcatatcacttaaagagttatcaattttttaaaaaaaaaactgtaggatagatcaatatgtgatatgccacttcacaaatatgcaaattcaaattcaacttatacaattagaaacaaaaataacaaattttactatggatagaatgagttatttacggtcaaatttgtttttttaaaaattgtataagtcgaattttagatcgcatgtttgcaaaaagatatatcatatattgatctatcttgacaattttttttatttttttataaaaccttttaaacgatatgcataaaacgagatgatgtcactgtagatggccatatggcccgtggcccacggcccggcccaaagcacggctgtttggcccggcccaagcacggcacggcccgactggagtcgtgctcgtgccggctcggcccgacagacgggccgtgcttgggccgcaccttcggcatgctaggccggcacagcacggcccggtcaaataaaaaaaataggaatttaaaatagacttaaataatcatataaggcaaagcctaagataagaggtatacaaaatagacttattttccagccatttaaacacagcccacagagttgagggaccaaaaatagactttttatgtgatgaggtatacaaaatagacttattatccagccatttaaacacagcccacagagttgagggaccaaaaatatactttttctgtgaggaagcacgatgggccatcgtgccttcgggccgacccggcacggcccgagtagtattgggccgtgcttgggccgtagatgccgcccgtggactggcacggcacggcccggtgtgtcggtcgggccgtgccagcccgacaagccttggcccaggcacggccgtgcttgggctgggccgtgccaggcggcccatttgaccatctatagatgtcacctcgagggacaaaagcccacttccgcttgatcgaggctctgttattgatcgggtgctgagattagtccctcctccaaacgaaatgattctgcattatcctgaaaagattcaccagcttgtctagtgtagtattgctcgcgctagctgtgtggtgtacatgatcggataccccgagagaacacgagttttgggccgcagaggactgcaagtctgcaaccaaccaccgcctcacgccctcacgtcgtgctagccgcactgcccgcagggcagggcagtacagcatgcatagctagcccacacgagcgtgagcggattgcttttctcgtctcctctccgtccaagcgcgcacgagcgcgcgggcgtcaccacgacccgtctccgctcgctcgcccacggtcgccttcggatcggcgccaagcgcggcaggttgcatcgcggctgctgcactccaggtctccagctgatcgctcacaccaaaagcgtctgcaggtctgcaggtggggcgtcgccatggctccgcgggcggcttgcgtcaccgtggtacgccgtacgcgggtactgttcgagccaattagcctcggccggcgccctcacctgctcccctctcacgcggcgcgccggatcataattgtgcgaaatatattacgaggaaattagtgacggaaacaaagagatggatcatctatacatgcgcgtgtacatagattttttttttttggaaaagagattgctaacatataaatatatatttatacacatcacacaatgacacaatgcaagatgtagaatcaatcatagaagtaaagatgtcctagtagggaatatcactttaaaataaaaatgataaaatagattatatgaaaaatattactcaataaacatacaagtttaaattcgacttatagaagttataaaaaaagataaattttgctacaggatatctcgacttcatggttttaactatagtacaccacacgaaataatttttggggaatacactatgtaaatatagttatttgcaacaggacactgcatccactaaattagtatttttgtgctgacaaggcgagaggggacccacatttttacacggtgtgaccaaattgctcctcttcctctcttctcttcttccttacctctgtcttctttctctcttctccggcgagccataggacccgcgagcggcgggcaaccaatgggcggagcgcgcgcggcgaagatgggaggggtggcgcagagtactgtgtcacttgcggcccttcccaagtcaccattgcctcgatccacctgcgttgttgttgatgataccggctgtggctgtggcgggtgacctcgcgcgcacaaccggctctatgtcgcagcaaagatgtcaccacgccgccaacctcaggaatcgcctgggaacgttgtcacctccggagccctcagtgtcgactcctccaccggatgccgccatcattgaagtccggcgtcgattcctccacatggaatcgccactgccgccgcaagctcctccacgagctccgaagaatgccgcgccgagcaccacacctccgcgcgccgcctgcaagatcgactcctgcctgatcccaaaccggaaagagagatgggaaagctgacatgtgggccaaagggcatttttgatatttcacgtgatttttttctctgttcaaccagaaattattgttttaatgagcgcggtgtccaccagcaaatatccaacttttgagtgtgtcttcccccaaaagtcacttcacgcagtgtcatacaactaaaaccgtgaagttgcaatgtcctgtagcaaaattcatctacaaaaaatatcaaatatgactatgatggtacgtataagtttaagtttagggcctatttggttcacaggattttcaaatcacaggaataggaaaaacataggaatagtgtaggaatgcacgtgcaaaacaatggattggaacacatgaatttttcctacactgagctaaacaaaagaggttggagtggatgttttcattcctatggaattagtacattttagaggatttttggaggattggcatagtgttcctatggaaaattttcctttgaatcctacaaaccgaatacatgaacagtgtttattccaaaggaattgagatttcctttaggaatccttcaaaacgaataaggccttaacttgtatttttttttataacttgtaggtgttgagttttaatatgtatgtttgtggagcggtatgtccatgttaatttatcttgtcaacattttctaaaatttttcaataactatctattaacttattagaggaatagaaaaagagcctccacgtttgctctcacggactagaaattctaatattaatcgaagaaaaagaaaaacagagtccatatatagaaatacaatttagaaatagttgaaattcggaattaaaaaataaggaatattggaagaggaaactagattctgtcgacgagcgatacccgtagaccggatatagagggtattggggtacgttggtgcaaggatctacgtagtacgacatcaagcaacaaaagataaagattatactggttcaggccccttgataggtaatagccttaatccagttgatatgggattatatgatggaaaaccacagattacaaagggaataatggaactcgatgaaccctgcaggatcgtaatcgagttgattcgactagatccctagcgatgtggctcttgcaagctccgatttcgtaggctgtgggggttgtgttggctatgagattcgatgccttaggtcctcccagggggtcccttttatatcgcagatcaggtggtctccaagtaaaacttggagacatcggaccctacacgatataccgatgaccttgtcttgtctgagtaggacttaaacactgtggaagattttcttagtatatgcagataatgtccgtgtatgcgcgggtatgccatgtcgatatgtggcgtatatcgaagggtaaggggtatacctaacccgtaaccctgacagattccatatagaaatacaatttagaaataactgaaattagaaattaaaaaataaagaatattataagaagagtatagagtccatatagaaatataattaagaaataatagaaattcgaaattaaaaataaggaatattagaactagagtatagagtctatataggaatttaaaacaaactaaaattcgaaataaacataaacataacaaaatttaaagtagagtttagagtccgtataaaaatacaatttacaaataactaaaattaaaaataaaaaaaacatgagaagaagagtctaaagtcaatataggaatacaatttagaagtaactaaaattcgaaattaaaaattaaagaatattgaaagatgagtttagagtgcaaatagaaatacaattaaaaataataaaaattcagaattaaaaataaataatattggaagaagattctatagtctatatagaaatacaatttacagataatgaaatttggaattaaaaaataagaagtattgaaagacgagtctagagtccatatatgaatataatttagaaataactaaaatttgatattaaaaataattaataactaacacgtatataaaatataaatattacacattattagtttcataaagttagtacaaaatttaaaattatgttgtcattttaatatattttaataataaattgagaaaacatatacgctattatatgagagaaaaaaatataatgatgctagccgcgcaatctacgtgggccaccatactcgtttaggtgaaactctaggtatgaaaatccatctctatcatgtcattcaaaaattgaaaatcagatgagctgttccttggaaaaaatattctgaactcctcttttgaaaccataccaattaaaatcatgcttatctttgtaccaccgaaatatatataaaaaaactttttatatatggaccattggatcgcaggctcacctcatccaacggctaaaaatccacaagggttgcctatataagccaaaccctttcggcgtgtgctctggctctgccacctcccgtctgtcacaagcaccgaccgccatttccgtttctcccttctggcatctctctccagaggcgagccgctgagacggcgccactcccctcggcatgaagcaccacgccatgaagtcccagtcccgcgcctcgtcgtcgtcggcgacgcacaagctctcccacgccatcgcgaaggcgccgccgaggaagatcaagatcgtgcacgtcctggcgccggaggtcatcaagacggacgcgaggcacttccgcgacctcgtccagcggctcaccgggaagccggccgccgacgggcccgccgcggcgtcgtcgcagccggacccgtgcgacaccgctggcgacgagggtggctttgtcgccgacggcgccggtgcggcggcggcggcggcggcggcgacgatcaaggcggaaataaaggtggaggaggccgtggcggaggcggaggcggaggcggaggcgtcgggaggattactgcacgcgctcggggaagacgacaggaacgacatgttcttacagtggctacagagtggctcttgcatcgacatggatgctgttggtttctcatgaatccgatcaggtgatccatgcattggagttcatagccttgaattctccagatcattgatccggatccctcgcgtttagatgatttcgcctttcctgacatgattttagatttgattaatatataatggagatctcctattttccttgtttgcgttgatgaagcgtcaaatattatcttcctcagtttctttgcatttttgtcttttgaagactctttgaaatacactacataactgataaagtgaaaatggaatagaaacacccatttcttcttttatttagatgggttttagtagcttccagcttttgtctgacacggcagaatttttctgataaagtgtctggggctaacctgtcgtgcatagaaccaaaattaggacctgcaatgcaatggggagaagcctaatggtttctcattattagaaagtaaacatcatttcttggagaattacccagtgatctctgtagaacattgcccttgactaaaaagaaagaaccctctatgcttgtaaatcgatctcattaacagttggctgtttcaaatgtttgcgtcattgacgtgtggagtggttgctgtagaccccactgatgctgcaagcctgcaactgctgatacgagcagagcaggctttagtttgtgctattggaaatcagaaacagatttgtttgcctgttcatatctgggaggaggcctgctcaaagtggtttgccagtccaatgtttatgtcgagatattcatcttattccatgagctgacagccataacaaatcctgaagagcagtatcagtatgtactctgctcacaagaaaggaggtaagttaatccattcaagtggatgctgttacgcactacagttattatgtatgtgcaagcgtgaaaagtggctgaacagaagaacaaaaaactaatcacgacgttctaattagtgcacccaattaacactagctttcatattctgacagcactgcgtctgatgtgccatcaattgaatttggctgtggcccttccaatcttgttaggacatcaggtgctccagatgcatctctgataatctgcaagagaagatattgtgaagacgatgagttatcattaacattagctgaaacagttaagacttaaaaccatccattgtatgctcaggagacatgattatactacctatattaaaggactcattcaaaccagacttgtaaacgtgcaggatatatgatacagtgtggattatataattgatttcacacttttgtgtacatgagagctaaggcagcctactaattaagtgtaaattgggttttagatcaaagggataaggatcatattttgtttgactctgaatgcacactagtacaaactaaatgtcatacaatatgattgcggtcttcaccggatgtgtgcatagaaacgtaccagtatttcctcatccaagtaagaaatcatgaataggcgctggaacatcccatctgccataagaaaacaaggcatcaactctaagtaactaatccaagtgttttccgcagttatcacgttgaccaatgccagcatgaccagaacaaaaaatatcaaaccgttgtttataccgagcttcagctaagaaaatatggcaagctgtgtcaaacttaaatgagaaaaaaatataaactaaaggtaaagttataactcttttagcataagcgaaatactgcagatggaaatgagaagtgtactccttactaagtggcaatttaatcccctctgaaacagcgtcccttatgggggcagggagttgttgcagagcacctgcagtttgtccaaagaaaccctttagttgatcaggcagtgtttcttctctgatcctagggatctctattaggccctcgacatattcctctttcatcctaataggaccctccacagacaactgagtagtcagcaggaacttgctttgcacctgcatacatcaaaggctgctagttaattgtgacaacatgagtgtgacaaaagagtttgccaaaaacagaaacatacaaatcccagttaacatatatcaattaatcttgcaagattattgaagatattccatgtaatctactacaaataaatgcaacaagaagagtctgtgcaaaatatcaatcctgcatgttgataaattatggtaagtcctgtaaaatgtgtaattgttaaatttaaactgcttcatcttttgaaattaccgtatttaagaacttcacgttggaagaaattttggagtatccatccttgatcaggacatcaagtcctgtaaagtgtgcaacagttgtaggtgacctcctacagatagatgatatttgttatgtagttagatttttatgttattaagaggaagatcatcatggaattatgcattttgatcatcataacataagacaattttatacataatacataactcataatcagaaaaataagtaactggcaacttaatttcagaacattatgtaaatttcaatttgcaaatatcaattgcatccagcaataggacatactcaaacagaagacgggctgcaagtgctccaggactgctgtcaccaaaccattcaaagttccatcgaccttccagaaagggagatctgtgaagtgaaacagacaaattatggaagttctcctggagacatgcaaccaaaagcatggtcatcaaactacaaatgatctgcagaacatgataaattttctgagctggacacttacgttgtgggccgtggagtggggtttagacgctcgagcccaacaatccgctcattgacatcaatcttctgcatccctgtagtctttccactaaccaaggattcaaaccctccagcatctctgaactgaaatttgcaattttacatatcctagttgagaaattaacatgaagctcacaattggctataatattgatacaaactgatattgcacaactcttctgaaaagatgggaatgcacagctcttcttagataactcgagaatgcacaattcatctttagaatgttgagaatgcacaattcaatacatatactcattggtgggtctgtggaatcgaggttttcattagtaagtgtttttttttattttttcataagtacttgttggtacttatacgctattttcttgttggcacttctccaaagacgcttgaacgctgaaggcatgatggcaaattagcaagttgtggaattacaaacatctccaattagacacggcagtggaatgagataagtaaatgcatggatcaatacttgttccgtgtacacactaatcaatcatgttgctagttgaaatggcacttgctaggaaaatggaattgatactcctgcgtgtaccaggtagtacgagcaagggtaggtcagaactagcggattcccaagtagaagacgagggtagagaggagctcacggcgaggaggagggactccttggcggagaggcgctccatctcgcgggcgtagctggcggcgggtcccccctggaacgtcggcgccgaggccctgcagcgcccggcgccggggcggcgaggaggcgaaaggctcaggtggccatcccgccggctgcggaaggagaccagcgggaaaggagtggaggcggcggtgatgagcgccgcggcggcggcggcggccatgcgggacctgagtgagaagagcggcgtggtggtgccgagatgagttgcagatgcacacgcgacgtggaaaccgtgggagaaaatagcggaaaaatcaaatatggggctgacattttattcccgatttcctcaaactcgcaggattcctgaatatttttttggctacttccaagtcatactagtacgcatattcaatcatgctagtttatcttttggcacaggttcagagaagcgtagcatcatccaacaagttgttcaagggtctcagttttgggcaaaatgaactccactgtcctcaactgatgaaactactatagatgaataaagtgagggtgaagatactgaaagagggagctctacactggcatacaccccagaaagactaagttatttgcttcttagacatctatcaaaagctgaaccgaaaacgtaacaatccatatagaaaatcgcaatacaacaggctaatcacctaaagatgcagagatatatatagtcacaaaaggcaatggagaattagtgcgccgcgcccaagatgcgtttcggctctcaagcagcgcccttccgctgctcgttctcgccatgagcgaagtggcatcggtcgccgaacgtgcaggttcccttcacgaagttctcgcacagcttggtcttgtagttgctcctgcccccggggccgcctcggcctgctggtgctgctcctgctgctgaaccagcgggtttcttggctggtgtgctcgggctgattgttgcaatgagctcacccaccatgttgcttgcctgctttatctggtcgaaattgccttcgagctcaatgttcttcaggtttgaatctgattcatggtcacgtattgagagcttgaccccagttactcggcatatctgcttcgtgttgactccacccttcccaattatgccaccagcaagcgaggcatcaacgctgatcttggcagtagcagatgcaccaaagtttcctgctggaggacccatagcggctggtggaggtggttcaggtcggcctccatatcgaccacccataggaggagccatggcactctcatgggacatgtaagctggcttgccaagttccctctcaccatgggcgaaatggcacttgtcaccaaatttgcagccttctgcagtgttatacttggtgcacatgcgtgtcttgccagaagaagctggatgagaattaccaccagcagcatgatccataggagctcttgccggtgcaggcacagctgggttgcctagattgagtgtttttgctactgcttgatacccaccagggacaaagtgcgagaaatgacaaccctcgccaaaagggcatccgatagtgctgcataaatcaaaacataacatgttaatcttctacattccaaaagacaaaattacagtgtagcttcagtccaagttgcataaacacaaagcatcttgagatacataattacatagaaagtcagacattgactagtgccaacaaacttcctaaaaagtaaaataaaaatcagagagaaccaaatcaatcaatcaatcgtggaactgtattgagacacaaaatagtgcatgtggaagcataggacagtaggttggttagaatctgtaacttaaattcaacattccattatatcacagatttagtatttcaccaataagcagcagcatagctttcttatagatacataagctaaacctggaaacagcataactgcataacaagtttagtttaaacttatactaagacgatcaatttcaatgcttgtcctgtgcaatttttataaatacaagtgcatttggaaatgggagtcatcgcctaaaagactccatgtcagtggcaatggccatcacgtttgtaaggcttgttgatgtttaattaaaacaaggattccattccattcaaggtctacacatcaaacttccccaggggctgttctgggagcagatgataataataaccgttttcaatatgcagaaacataactcagaataataaccattttatcatgttagaaattatatctaataatccataagtcattggacatttaataggcaagcaagatctactgaaaatacgattcaatcagcaaaaaactgaatttaaggcacccatgcatctatacactatcttagaaaaggggggaccaatatgtctagtgttagacgtacagcttctgaataaaaaaaaacttgcaagggtaaattaattcgtaactgtaataaatagtgaatattagaagctactattctgatgttatcttggataggttaagattgtaacctgaaaaacttggtgcaaggcttcaatttgcttgatagaccagtttgaaatgactccgtttctgttgcataaaattttgttacatcttctcacttgttagaagttgcattgttaatcttctaatgaagtaaacatataaaatttgcgtccaatgaatgtgatgaataaacaataattttgatatgatattgatgatatttcacagtgatttatcctgcagaaatcattcacatttacattcaaccgcttcgcagatggtaaatatcatttgtccaggtgtttcttcttgtaacctcatttggagcatcctcaggccccattctgattataagagccacaaggtactatgcttttgcagatagtttcgatcaatagtgctacatatttcttgtctatatatgaatagggcctcgctagcactatggtcattagttactacagacaggcccacagctcaaaccatacaccatttcttgtactttattttaagcagtaagggctcacctgttctatctataaactacctttccaaattattaagcagttttcttttgcttcttgaagggaaacaccaatctaactggctgtcctggactatgtaatcatctgagtaatcctacacacttaacatgggtactttccctaactcccctcagaaacgttctgttgtattttgaatgaatttcactcacaaattaaactcaaatagcccatcaaaccatccgaatcagcacaaactgctaggttacgaagtccttgttgacgaaaacacgtgcatactcatgatcacggttcatcatagtaagtccgagcacaagattgactattctaatcttattactggggctcatcagcccggcgcactcgctcgatgctcgcggaacaaaccctaaaattaccaggagagcgtcgaggcttgcagatccagcagcatagcgcacagaagacatcgaaaaatctagtacgcacaagcaaatgcagaaggggataatgaggcgatagagagagaagggtacctctcgagcgcttccctccggcggcgcctccgttggccgtgtccggccgggatctcttgcgggcggcgccggctccctccatggcgagccttcgcgcggagggaggaggagggaagggaggggaagccggtcgggggcgagatcgaaaccctagctcgtggttggcggagggaagcggaaggggaagcgaccagccgcggaatcgagagggttaacgacgagagagaggagagacgtagggaacggctggttcatatggggtagttgggctttgggcctccaccgagtcagatatttattggatctcgaggagagctttgtcttcgtcatgtcgtgtacgtcttgggctttgggccacaattcgtattggacagtgtagatcgaattttggttcgagatttcctcactgcgtagtttctcattgtctgccacttcactgcttgatttcttgaaaaaaaaaacaattcactgcttgtgaattgcgatggtaacaaactacttacaatctgattgataattgttgccttttcgggacagaaattcttgggctatcctaactcgagttttacattaccccaccattaacgcaagtatgccttccagatcgaaaagcaaccctctaaattcaattcagggcacaggctgcaacatgaacttgcccactgctaacactgcatttgtacttgcataatgtcgtcgatcaaattcagaagttacagagagttatttcacaaaaccaagctgtgcagtgaatcctccatggacaaaggaactcacatgctcctggccatcatctcctggtacctccggtacgactcctgcttctccagcaagaacttggcatggcacctcgcgatgaacctctccgcgagcctgtcgatctcgttcaccgcaccattgccgtcgccgtcgccgttgccgttgccgccgtcttctccttctccggcagccggcaatgcaccggccgacgtctcctcctccagccagcacaggtacccgcagtcctccccgtcgtcgccgccgccgccgcgcagctcctccgccgcgccgtcggccggaaccaccacgttccacgtcgagtcgtcgtagtcgtagtagtacgggtggtagtgcagctcgagatccttggcgcgagccggcgtgacggcggcggcggcggcccagttgaagcgcagcagcttcatgaagctggcgatcctcttcttgctcttctccggtctcgagcggtagccgatggcgtacttcttgccgccgccgcctctcgtcggcgccctcttcttgcggacgacgtcgaggagcagcgacttgaacttggcgagggcacggaagacatggccgacctgcgggtagatgtgggagtggagaatggaattgagcttgggagagatcgagctcggaagcagagcttccatgtgaaacaatggagccatggatcggggtggtgaatgcggtggagctagacggcgtgagctcttgggcttataaagcttacatgtatccaaataccaccatagttcaaataaattgcgacaataccattgcatagtctgaaactctgactacagcttacgtcgttttcgttctgtaaaactctgattactgaatacttgtagtcaaaaagaaaagtaaaaaaatgatgcactgcatgcctcatcggatgctttgcctgtctcaagactttggggccaaaaaaccttggctccatgaagcttttgttctgcaacagacaaatggagcactgaacaatgtcaatgattcagataattcagcaggttgttactgtttcatccgagcaatattacagcagtgcttgaggggtttagggaacagaaatcagcaaggctcaggaggtgcctgtcagtaactgagcatgcttccgataagtggaccagcctgctatgctctaggcccgtcgaagaagacatttcatctttgtttctgaatcttgtccccgcaatgtttacgaagatattagtacgttggttgtaattcttcaagtcaaaatattccctgaacatcgtttgttagcctgtcacgtgatagtcatatacattatattcatcttgatgattgatggaaaaaaagtcaaaattaactgaattactctgcccctggaggcatgcagagcagtgacaagtgctgacatgcatggagcgttccaagcagcaacaaagtaggatgaatgttacaaatcatcaattggagaatccgaagaaaacagagagtactggatgtatcatagctagtcatggtcttttcagtgtattcttactattctgacgacttaactgcctaattacttactccagtcatgtccttctcaaaggaaagagaagcgacgaacaactttctgtgagcaagcctgctatagaaattcagaaatacaatcgcagtacctgttggcacaaaaatggaccttaatctgttgtttgattctttctgcacgccactgactagctgcaatatggattagtactggctcacttaattatcagaaccgagctgggaacagctggaaacgaagcaaatattagtacatcaaattgtcatccttgcagatgatagtcctcccacttaggagtggcagaaccaaatcaagaaatcccatagacttctccacgtaaatgttgcgtggtatctcaacctagtcagtttcagtgaaggacagtaggacacagcaggagctccggtctaattctcttcccggttttgttgcgtccaagactcccaagttggtgatccatgagaaagcgcaccacataattggccatgacttacaattgttcagctggataacagacaagagagagatggagcgatgaactgtgtacgcacttgacatggatggtgtggatgatgcattcatgcacctggctgctcatgcattcgccgtgtgcatcccttgcagcagcagtaggagatagagatggtgtgaggcccagttctgtgtcgtcgtaggaatctagttgttgggatactttgcaaattgcaattgcaaaggaacagtgacacaccacgcgttgcatccgtggagaattggagatatgcgaggaagaagacttgaggaaatggcaatggcaatcattcgcagaggctggtgttgtgattgtaaccggaggagatcgcaggagatacacgacgtggactcgtaccggatcaatgtgctcatcagcagatcatgcgatcatgagatgatgcaaagcgctcgatcgctcgctcgcttgccgctggattggagcctgcagcctgtgtctgtgtgcggcatgcgtctgcgtgcgcgtgcgtaagtttgacgtgcccacttgcacggcgaggtgctggggatgagcgaggagaattccttctagaatgtcaataaagccgctgtcaatggtattgttttttttctcctattgccatattgatgtgtaattgcgcgtttatgaaaatttttcctattacgcgaaggagagaatgcaatggaggaaaaaaataggacttggatgcaatccgcttcgattttgctatatatttgtcagataattttttttaaagaattaacatatataaattaaataaagtataatcctactatgattgattttatggctattaagaaggtaccatattttctaatgtaaatttagtatctctagtactatgaggtaccaagttttcactaaaaatgttggtacctcccagttccagtacctctcaaagactgtaaaattactatcctgctatagttacattataacttgtatgcaccttcacatgattttaaactgttagatttgcttcaagatttgtgcacgcgagaaaggaaaaaatcacagtgcacacatgtgaggagagtcagttccacgatgtctgcttaccggaaatagtatgtttcctatgcaagttacaatataactccactataactatatactatagttacatctatcgaaatttttagaagaaatttgtcagtaataaatacataggtagtcctcgggccgtgggcctgcagggacacggagtatctagcccatcacgattcgcgtaggccgtttgggccatacagaattctatagtaatatagcccatctgaaatcagcagcaactgtcgttaggcccaatttgttttttttttttggtttaggagagggggatatgcggcggagcggagccccggtgcgtgggtggccggagttcactcctgttcacgcgcggcgcggcgaactaatcggatgcggcattgacaactgatgtgcattttttgtttctgcagccacaagaaaattactcggagagccgcgtgcgtctagttcagataaacctcgcgtacagtgcattcatcccgacagattggaacaacttggagacaggtgaagtaatcctccaacagaacatcattaactactcacaatttgccaaatcttcgataaaaccagggattaaactacgcccaagatgcagtgccagggattgacacaaacgcattttggctttccatgtcgtttttgaagctgagtcaaggcctaaatccacgggattaaacaaggttcgagccttcgaggagccaatgaggcgagcatgttctgctgccccttcagggtttcagaagacgagcttgcgaattccatccccctccacccacgaagcaccaaccggcgcgcagcaaaagaccagaaaattaaagccaggtatatgtatatcagtatatgtatgtacatacctatccagataagattctttcttaatctttccacgttggcacaccagcatgtccaaatctgcaactgcataagtattgtcgttgatcgaattgacgaatcccattttttatcacctcttttgtcagactcctgtaaaaccctgaccaacttgagcatacagagttcagctacatgtatactgtatatacagataacgattatatgtgtgcgtgcatacagttttgatcgattgacgttacgattgacagtttcacaattgacagtgtccgtgtctgtttttgggtaggatcaggaattcaggatgacagcttcgaccttgatttctcgttcttgtttctgatcagggagattccaaagacaagagtagtccaatgctcatcaaacacctgtatttcttctgaagggatgtgtggacccggtagattccccataacactaaaaaaaatatggttagaagattttattatggtttgactttgtttttagttagggatcggtgcacaactttgctcaagaaaattatttgatctgtcagttgtactagtgcatgtaatttctgatacccctgagaatgtcaaagctgatctccatctattctttcttttcaggagaacttgttatcaggtgaagcggtggtgaaatgccaacgtgtaaattcaacacaccttgaaaattttgattactagaatcttgcttcagtacagcatcctcctaagtcctaacaataaaatgaaaaacatctgattaaaatctgcattgataaagggggcctaaaatgactgacgatgcagatgtgtattgcaacttagaaggagtgagatgatatggacctagaagtcatcacttagatttgaatttacggatgctagtcttttttaaagatgacaggatcaaacgagaaagaaaatggtgccttatacgacaattgaattagatgaaacaaaaaagcatcgatgttatcgtgttaacatgtgatgacttcctatggcatagtgttggtcctatgaagtgcaagcttttcctttagtttgcacttcggtgacgatattggatcaccgatcaaatgtgccgtcacgggatggatagtcactccatgtgccctatgtgtgcacaggagcagaaaacaaccaatcatatcctgttggagtgcgtctttacaaagtaagttttgcacaagttactggccaaggtcggactgcccttatcttcgcccagtcgacagtccaccccccaagtccggtactctggtgggagtgcactcaccggtagctgcctgatcaccttaggagaggattcgactccttcatcctctttgttacctagaatatcatgttggaaaggaatgctcgtgtcttcgatgggttcatctcccaggtggatagagtggttgatcgcatcgtgcaagaataaaggatctgggtggaagcgaagccgagtcctcttggagttcttcttgtccatagtcctttttcctgcctttttgcttgttcggggctggttttgcctagcttaactggtcattgatccccttttctccccgtttaaactccccatgaccgctacggtaggtcacggttgtacaaactttttccttgaggaggtaccatgaggtactattttttctattataaatttggtacctcttggtacctatgtactacgaggtatcatgaggtactaaaattttggtacctcgtggtacctcctcaaggaccgtagaattgctctttctaatatattagcgtacaaggctcttgtgcgttcacaaaaaaaaaagatcagtttattttgctgctgatgaagttactgctctattttgactactttgtctacctcatggtgacacagagagttgtttacttgattatctatggatctaaaatttacccgcttcgtttggccaataaacatcacgtccaagaagattcaaactagaaacattgtatgattcgtcaggttatctacccttgttgggacatcaaaagacaagcaacacacaaattatggagcatagagatgtcccctctgatcctaactgtaatatgtttgaagcttgcaaattatgttcagctagagctggagactaaaaagaaccagataagcaaagaaaatgatagcgagggtgagggcaccaaagtggctatttgtcaccttagccttgtccgacatgcgagataatttatgctctgctatatatatgtagcagttggatttatatacatacacatatatacatctctttgcatatttatattcttgtcagttgtttgctgaggcccccactgtgagaagttcatattccatttgggattatcaggactccttcagattattccaatccttccctgcatacagaaagtgatctagctgaggtgagatcagagagagagagagattgagctggttttaccaggaagtttccagtggtgtttgctttgctgcacatgtgatgcccttcaagttgtaagttcatctcaaccatgtgtgtaataatgcttactttttgccatgcattgcattgcgtcctctccttctccggcggctgctgctgctgcatggtgtgatggtggtggtggtggtcgtcgtcgtcggctgttttgcgattctggagattggttttgtacttttgtgcgtatccggggacatgcaccgccgtcgaattattctcgccgttgttgcgtgccacgcctcccctccttccctccctgcgaatataggccggtgcggattcccaattaattcccattgatctatcgtatgtgccactagcttcccgttcgttcgatcgagagcctatttaagcttcgccgccgcgttaatccctctttcctcctccaaattaatctcatcctaattctgttttaatttctggtgggaatttcgctgtttgatctggcctcttcacgtaaccgtaatgttctatgtgtaaattgaattaatggagttggttgtgaaatcgttgaattgatggtgattcggttgttgttagttcagttaaatgttgcaagatatcatgaacaccaagaagattaagctgcacgactgccacttcggctcgccgctatgtgacccttcgccggcgccgcacctgctgagctccgccgccgccgccgggctgtcgttccacccggggctcgtgagctcggcggcgcagcaccagcagcacggcgcgggcggctggctgcacgaggagtactacgcgccgaggtcgtcgccgccgtcgtcgcttctcgcgcagacctgcgtcggctccaacgcgaccgcgttctacgccgccgagaacctgccgcagttcgacttcccagctctcggtacggcggcggcggcggcggccaaggcgccgttccggtcgtcggagagcgagctgtaccggccggtcgacccgctgctcctccgtgcggaccactcggtgaggacgtactacgtccggccgcagaagcgggattccggcgagaggacaccattgccgccgccgtcgcagcaacagcatcaggacagaatccacgggctcttcgccggcgctcccaccactcggcttctcagcggcgaacccaaaatccactcgtttccacctcaagtaagcatggaacaatcatgaacagaactctactaagaattctactgtttgtctttaattcttttctttgagatgcctgtgaatttttttatcgtaatctgaaaattaactccgatgaaggtggcggcgaagccgattctgccggcgatggatgcgccgagcctgcagaaccagatggagaatcagctgacaaggaactgcatcggcgcggcaactccggtgacccccaccggaaacctcgccggatcaggtgcgccgagcaagacgcggatcaggtggacgcaggacctgcacgagcggttcgtcgactgcgtcaatcagctcggcggcgcagacagtgagtgttcttgatcagcaaaaaacaaaacaaaaaaaacagagaagcttttgtcatgcatgacgatttctcatggcgcatagttctttcttcttcttgcatgcagaggcaactccgaaggggattctgaagctgatgaattcggatggcctgacgatctaccacatcaagagccatctccaggtaactgaaactctgaaactggaaagcagggtcacttgatcaactacacacgaacgattttaaacagatgacatagatgtgtaaccaaacagatatcgtattaatgtcgatttgtagctagggattggttgatctagttgaagtttgtttaataaacgagctgtagttatctaacaattttctctcatcttctttctgtgcagaaatatcgcatagcgaagtacatgccagcgtcatctgaaggtaagccatcacaacttcgttactgttttttttttttttggttgggagggggggggtctaagctgaatcctgaaatagagaagttaatcctccattagtagcagcatttgtaagagataagcataaattccagatcccctgagttcaggaggatctggattcgttcgttcgttgtgttgctttattctaggtcatttcaacgccgtgcttttatcctactactgttgtttggtatgcttcgctatccattcatccactgacacatgtcctcattctgctgctatactgtcgaattttttcagggaagcaactggagaaaagagcaacaggaaatgacatgcagaatctggaccccaaaacgtatctctctttctctctgtctgctagtagtaatagctttgcgaaccagtcccaaatcccaatggagtgcaagtgctgctagctatctactgtcaaatcatgcgtgcatatattaacaagaatcgcctttttgctgtagtggaatgcaaatcacggaagcactgcgtgttcagctcgacgtgcagaggcgcctccatgaacagctagaggtgctagctccatcatttgccaacactttgacactagatactttacaattttcagaaaaggaacggcttaattatatagccatcattgataatcatgtaactaacttctttatgcctgaattttgtgtgcctcgctagattcagagaaatctgcagctgaggatagaggagcaggggaagaggctgcagaagatgttcgaggaccagctgaaggcgagcaggagcgtgatggaaccgcaggagctggacgacgtcgtcgccttcgccgccggcgacggagacgacgacgcgttcgatgacgtcgacgtgcagctgctggccgtcgctggcagcggctatgacgacgccgggttccagtccaaaataagctaggacagccttttttgcgttttgtgttttggcactttgatttgacaaatattgttctggttcttcgacgtatgatacgcacaatgctattttttgcccgtgtagttggcgaaagtttcaaaaagatattttaagaaagagagtgggatccacagattcgcgcttaatttttttttttgtagctagtttgatcagagttgtaaaatttaggctttttcaattggcctgcactgcatttcttaatggttttagttaggtcttagcaggcaaaaaacaggttaagttcaagtggcaatatattgctcatgtcacattcacatatgggcttgggatgctctacgtgtaccaccatgacaccatcctacgcagaaaaaggaaattacaaaatggatatcaaccacagaacgcaataatgctgttgtggattgtctactagataccttgaattaatttgtcaatagttaagaaataagaccttaatgatttgcacttaactttcagcagcaacctggactgatgttcaacagtagaagtatcatcaagaatatggacatggtcctcacgcgcatcttcataatgcaagcaccgaaatgctctccttttccccttctttaccaaaggggaatgtaaagataaatcagcgctggccttaaaagacatacaccaatatagggggcacacattcaataaccaagaggtcgtgaatccattacagctttttaaaaagttcaacctggcactcaaataaaaagcttaactttacatagtcagccaaagacattttgacatttagaaactaacgctacgaattctgtagaggttacaccaaagtactgcggcagtagccactacgtagaattaaaattacaggctaccacaaataatctggttttctctgacaaacttcataatccagagcatagaaaagatacataagctagctgtccatttttttgtcaagaacaccatattgtaaagttaggcctatctggcaccactgcaatcctagatctgcatggacaggtaacagaacagaacgaaacaaatcaaatcaatttagcagataatagataaatctctgatgtactagcatcatactgggaatgtcaaactagtagagaattaatattttatatattgtaacctaacaaagaaaaattttcgccgggtgtaacctaacaaagaattcagtggctatggcacttgacaaaggaaaactaaccagttaatgaggatatgctatgtttccttaatgaagtggtgagcaagcaactctgataatccagaactaggaatgctctcgcagccgaacagctcctgaagttttgagtcacataatattgatccagtaatagcatcctgtgtaaaatcagtaaatgaataaaaagcacatatcagttggccaactttaaggatcacattctcaagattggaacgattacaagggagacagaaagaacacaactttgctaagatacttggcaggttaatctagtaatctaggataaaagaataaaacaagaattacactggtagtgcgtaacagatatccagtaaccgtgttacatatcagataagctctgtaagcagtcagcttcccccccccccccaaaagacagacgtagtaataaaacgttagcactttaacttgacacaaaatacactatttcagttgtctctaacattaacaggaatgtggtgaattacaagccagcagattattcttcagtctctgccataatactactattgcttatggacaattataactatatataatacaatgatgtttcaaaacattgaaagttttccagcgtttgcagccaatacttagctccaacttgcatccatcagaagcaaagagcaaatcgatatcgtgcaacaataaatataaagttaaaacatattcatacctcaagttggtttgcttttatgtaatcccaaaggtacctcaaagcatcatcttgaggcactgtgccttccattccaataaacttggctagtgcatcagaaatcaccacagagggttgattaatcagaggcataggctgagtagctacattggagggcttaaatttctttgcttcccgaatttgatcctctgcagaaccaagaaaacataattaggaacttccatcagaacaaaacattagcagcgacatctagaccaaaagaagcagaagaacgtacttgggtcaagtggagttatatgtttcgccaacaatttattcatcttaaacatgtcagttgtgtcagttccaaaaaccacacgaagttcatcattgcagattatcttccttttgtcatcaggatcttgaagattattctgccgaatatattgccaaagctgcttgacaatctgaatggaggaagcaagttactttgtctcggttgattcattaaagagtttatcacaggattaaattggatgccattttctctaatacaattggggaaagctgagattacctgagttcttgacatgacagtctcaccaacaatagtctgaagttcaggtgagattgcacaaactttatttaaaccaccaggcccacctcgtttccgctttgaagcactagaggaaataatacagatatgataaaccaatcagtttgcatgcatgagtaaattccacaggtttgaatcaatgtacaatccaaggacacatgaatctaatggttaaaccagtatatcttcaagcagaacaaaataacctttatatcagcttcaaaatagattcagcgtgacatttgcatattatccagtgagaataatatcatgcgataatacttatatggcctaagaaatcttaactgattgtgaataagaaaatgtgcaaaaactaagaactataacccatataacattgagctctgttttggtatacaataagtgggaacatatttctttggttcataggggaaatacactacaacaggtcaacagtacaagctatacagtgtacagaatcccatcatgaaaaatagatgtagcatacagatccaatgaatctaatgttaacgatcatgttttttttattacaaatactatgattcatacacatacaagaaaaagaaagcttttcaacatactaccaaaggacaaaccaaaattaattgactgtaccttttgtttgcaggatcaaaatgtcattgtttgaaaaaagagaaaagttcacgctgagcagtctgggcagaaaacagtatccagacaggggggaaaagcaggaagttctatttagtggcttgcaagaaagctgacgattccacaagtccaaactatcagattcactacttaagaaataaagcaagcccaatttagcattttgtacattctaggataacagctgtaatatccttcaagcacttggtaccacaatcaaacaaaatacatataaaacggactattgtgctttttttttaattataaccttctgaagctcaacacagaatacaccagtcaaacaaaacatgcctaaattccactatattcgaccagttaactaaatgagatagaaactaactaacataactacaaatggatggttacacaaccaacatagtatatggtcaaaaagtagataccaccataccggcatcccaagcatgtgtcctaaaagctatagtgtatataaattggtgtacacgagttggaaccaaaatcactttgctaggagactgaaccctaaaccctaaccccactcagctagaggtgccaattcacgagtgcaaacaggtaatctcaagtcaaagtcattattattagcagccctaattaaacgaaacaaccaactaattgtccaaccaaactagatttaagagcgaatcggaaatattctgcccatatatatctcgattcgattgggggaatgaaccctaatttcatccggtggctcacctttccttgttgtcgcccgcggcctgtactgcggcggtgggggaagcagtgccgccggttccaggggctggctgctggaaggagacggtcccaccagtggcgaccccagccaagccgctggtgacgcggaaggccagaggaggcggcgggtagaacgccatggccggcacgggaggctgcggggagaccgccccagcggcgccgcctggtacaccagcggggagctgcggcatggcctggaatatgagctggggctggagcaccgcgagctgctgctgcatctgctgcaactgcgcctgcacctgcacctgcggcatggcaggcgcgggagcggcgaccagaggaggaggattaggagccgccgccgccgccgcctgggccttggcgacgagcggcggctggaggcgcgggccgaagaagaggtccatctggtcgcggatgaaggtcgccttgtgtgcgaggtcgacgccgagcttggcctccgcctgcgacagcacggcggcgagcgaggcctccccggcggcgccccccgacgagcggaggacggactcgacgcagctggcgatctcctggtcggacaccatggcgcgcgggagggtgccaaaactcaaatctcgcccaaaaaaccctcccctccctcgcacgattccccccccccctcccccctctctctctctctctcccctctcctctctgtgtctctgccgcctggtctctctcccctttgtctctctctcctccggcctctctctctctctctctttctctctcctcttggggtctaatctattgttaagcagaggggagcgtttcgtcggggaggggaggaaaagatgggaaaaggacaactcgctaaggttaccttagatttgttaccctaatgatgacgggtggggacatggattggataaggttggctatgggcccacttgtcatgggaggggctaggtacgaggcccgtgcggatggaaagtctgcagacgaggagtcgtggaattacggaagtgcccatggttttggatgcggttgttgagtgggtgagggggtgtgcggtttttctgcgctggtggggtctccatggacgtctcttcggctccggggagtagaagggatcgtggggcagagatatcatgggctcatgggctgatgggccgggctaaataatgtcaggctgcgccttgcctgggagtgacgggccaagaaataaagtgttcttaaaaataaaattccacatatatcgaacatgattttagtttcaaaaaaataactcgtcattttttaaaaaataaccaaaaattttacaggtgattttttaagaaaaaaaacttaagatgaattgaagtttgttacacgaacattggatcttactgattatcattttcatatgccatctatgtcaaactaatatgtggcattgcgactttttttttagattgcattgtgaccttgaaaatgtttttcttatcctaaagccacgaggcataactaggtcaaaccttaatattgaactcatagtcttcaatcccgatgagttgtttattagcgtgtaacacacataaatatgttcattgtctcgcgttatatttgatacctaacttacttttgctgtagtgatggcacatccttgtataaaccatccttacttttttatattcaacatttgacaatctgttttatttgagaaaattttatggttagtatttttatttttagtatatgataaatttgaatagtattttatgtctgacttattttttattttttataatttttttaaataagacgaatataaactcacaaccacatttaaaattggatgggagagcactgagcaacacgattacatttcgcacatggttgttgaagtttaagtgaaaaatgaataaatctgagatataatcgaacctctgaaataactggaaaatagcgtaatatattaaaaagagtaaaatacaccagcggtccttaaacttgtcagtaggtttcacttaggtccacgaacttgcaaaatacatatcgaggtctctaaacttggtttattatatcatctcggtccaaagccgcatttgaccgtggtcttgcctac

SEQ ID NO: 81704 - DNA, 1262 bp, Oryza sativa
  unsure (1)..(1262): unsure at all n locations
cttttttagaagagtatagattagaaaaaatataactcccatcttttattatgtttggtaatataagtagtatttacacttcttctctttataggatccagtaaagctaagacctctctgtgtcttgatgcataatgtaagaactcatgcttattgcaatctggttgaataaacaagcaattgcacttattttcacacttaaattaacaaaatgcataaatagcaaaacacaaaaacagaaataattttctgagattttagttacaaatttaactcatctttaatcttttatcatgctgagcatgaaacaagcaaagatttttctgatataaaacatattatcgtttctacagacagtttttttgtatgtaggaagtgcctccagtaaaaataataatttttttgaattcagataaaatttgttcaaattcaaatttgtcagaaaaaatcattcaatattttttcatttcgaaatgtaaaacctgtatctatctatgtcttcttgattatactggttgtagacaggtaaattgcataatgctaagtgctaattgttcacttccagttaaatgaaaagtttatcattcttctatgcacatcccataacaattacttctattgcagatctatggccatcgtgttagactggcaactcatgccaacttcaaggattttgttgtgacggctggcctggagttttatcccctaagcggagacccaaaacttcttgcaggatgtatgttaaatatcgtgctcaaatccatttttcagtttatagaacctgtttagtattggatctcgcataacagtacagattggtaatatgagcagacatggtgaagaataaagggttcttgcctgcaactccatcagaaatccctatccagcggaaggagattaaagagattatattctccttgcttcctgcttgcaaagatcccgatactgatantggtgctcctttcaatgtaaatgctataatagctaatcctgcagcgtacggtaatagttatttttacaatgtggtttgtcaattatttactttcgttgaatttgtgcttatattatgtctttaggataggacattcatcattgaccagtcagccagtggctattctctcatgctattggcgaaagctctgtggccagctggagaaattgaggaaactagattcttgtttcttcttgtatacctcctgtcatgacatgaaggagagtcctaccatttcattctacgagatgagctgaacaaactaactggc

SEQ ID NO: 81705 - DNA, 592 bp, Oryza sativa
  unsure (1)..(592): unsure at all n locations
ctaatcggctgccttctattgacggatgttggccgattgtaggttagatatcgatattgccaaggattatgtaggatatatgataactcgacgaaatacataaacaagattagagtgtcataaagatggaagcactaatcctgagaacgcaagccgccataacaagttttacctcttgttgaagatcgaaaccgatgcagctcaacccgaaagcaagaactcgtcgaaataaaactaaagcaaaaaggtagcgatgcgccgggattgtattgaacgtgtatgttaaaagtaacataggactcgggtctatttatacccaaaaatcacaagatatgtccataacggatacaactactatctctaacaaactctaagataccataagtctttgcggcagacttttgcccaagcatatctccaaggagattacataaatcatcctaattaatagatacaattggcttctcaagactctatccatgtgcggcaatcaccttaaagcgccttaatttaacccgatatcatacatcagtatgcattggccgaatcggctgcatttgcttacctagctcgactaagacccagncgatct

SEQ ID NO: 81706 - DNA, 1051 bp, Oryza sativa
caagtatgttgttgggaaggaagacaatttgccatggaaattctaaaatatttgttgcatattgatgtttgcacaagctatagggaggatctctattttggcaatgttatttcgtaggccagaaacttccccaaagagctccaggagaacttttaggttttcaatctccgtggagtctggctttacaaagaatgctacatcatccgcaaatagggagattctgaatctcaaatttccaattccaaggggagagattacccttgattgttcagctagtttcatgatattattgagtggctccattgcaatgatgaagagaaaaggggagagagggtcaccccgtcttaggcctcttgcatgtttaatgggctgcccaggaatgccaattacgagcacttttgaactagacttttggaagagtgtcgaaatcccatttctccttctagtgccaaaacctaattgtgtcagaacttcaatgtgatattgctagcttacagaatcaaaagcctttgaaatatctaatttgagaatgagtgttttgaattttttcctatgaagccttttgaccaagttctggacatacatgaaattgtcatggattgatcttttccttatgaaggctctttgattgatgttaatcatctcatgcattgtcggagtgagtccattggccagaatcttagagacaatctttgcaaagctgtgtactaacttattggcctgtaatggttaggtgaagtagcatcttcttttttcgggataaagcaaatatgagcataattcagatcatccaattggtttaggttatgattgatgaaagattggactgcctttaggaggtcaagcttgatgcagtttcaaagaatttaccaataaaaccatcaggtccaggagctttctgtgcctggatagatttgaacgcctgctctaactctgctagagtgatatcttcttcctggtcattaaggtcaaactattgcaagctgatttgggtccaatttaaagttgattgacttatgtgggtttgcccaactctttgatgaaagaaatg

SEQ ID NO: 81707 - DNA, 7720 bp, Oryza sativa
tagtctagatctctgtcgaattttgattttattgagcccaagaattttgtgcttcaagctactgtgcagaatttgttcttcgatagaaaaggttcatgatttctggacaacacctagttggaagataacctcgtttgtgatggccagttgaagtattatgtctcctacctgtttcgctacccatcttcttatatctcgtgccaaacgtttcagtttcatgttaggaattgctaaagggtttgtggagttgattggtctttcccaggagcttgtgaccatttcttgaaaggaatggtagcttaacctaaagctctcgaaacagaaatggcttggcctaggggatccatcactgccctacaaaaggaggggagcatggtctgaacaggagctggataggggcaatagtcaagcaaactcgtagggcaaatctcaatccatgaaatagaaagctctgtcaaattttatatctcaatccatgaaatagaaagctctgtcaaattttatttgagttgggttgcttgaggtccctgcccaagtgaacattcttccctggagagtaagcacttttatttgcaaatgaccaatggcccatataaacctttgcatcatcctcaaatcaattctcgagttgtttttgtcataggttttgtagattggattaaaatctccaattattaaccaagaaggtaaaacgatgctcatgttgtgctcaagctcttgtagaaaagcgagtttctctgcatcactttgtgggccataaacagctatgattggccaaaatgtttgttcttctctcattgtgatggtagcagtgagggagaaaactcccaatgtgacagccgttaaccgaaagaaattctcatcaactgcaaggattatgcctcctcttattccttgggctggaaggaaaacaaaagtattccgaaatctacttcccatagattgaacaatgcagggtgtgttcacctcctgaattttagtttcctacaaacagacaatcgaggcacaatgttggttgatcaggagtctcagagcttccttcttggtcggtgcatttaatcccctaacattctaattaaatattttgcagtgtcgttaagccattaggaaacaaaataaggccactaagagcatccaagcatagcacaagggagaacaaacagacaaggaaaggtttcaagagcaagagcagcttaggtttcttctagcagtattcacagttggagatagcgcgggagaagaaaactgtactcatgtgaagatacagaagtgaaacatgcttagaacaagaataacagctttaaggtctttgcaacaacatccatagatagtgcacttcttaacatagcggggaaggccttatagccttgttggtgcatcaaaactacataacacatcatacaccaaaaacattccaggttcctagaggtttgcatcacacctcctgacttgatcactgggggtttgccgtccattatttatctaggtgcctactaggttggttgcagagtagcttcatgctggcagatcaattgtctacgtcttggcaactttgaccttgatctgtttgcagccatccatctgcgcaacgtgagtgacttcttgaaacattgtaaataaagttttttttgacattctcatcaaaagagtcactctcattcatgataacaaatttcttagaaaggatttcttgagctatggtttcaattttacatccattctttcttttcttttcaaccctttcgctgtgcctttgagtagaattaagggtcacctttgggcgatgggctcggatgcgtccaagcgacagacttgggagtagtgggacctagactggcgtcaagagggatgccaccatatccccaactatatccttttcaatcgtgctggctctcaggatggattcctgccttggttcataggttggcgatgcctcgtcatcagcattcccatccacggagaagttcagttggggtaggtttgcctcaaccagcatcgaatcatcatgaaccaactagttcgctggaacttcctaatggagaaaaaagaactcagttgggggcaaggagactggaataagaagagctagtgacccgtcattgggactcttgctgcggcgtgaagaacgaggcttgtaggggggagccagcagatgggagagagaaggcagagctagtgttttagagctgcgtcatggtgaggtaggataaagagaaggtctcacctctccgtgctctttggatcggcgattgtgacccatggagatcgatggctcccttgctctctgcctgccatgatttttcctggttgtagtagctgtgctcatcacccctatgcactctgccgctcgagcagccagtgatatagccctagagagagcacgagcgtctcctgtggcatggtcttggtcgcccaccgccaccatctgggtcatcctccaggcccctcaccgcgctcagctccggcttgcatggaataggaagtggacacgagtgcgtgcgagaggcatcgtcctagaccacgtaggtccattcataggtcttgtagagcatgggttggaggtcttctagggtgtctaggtggaggatgaccgggtaggtccatcccccttcagtctcggcaatggtgggttgcatagcgggtcgatgtccaggaatggcatgtcaatggggatcagctcttcatctacattggagacgcccagccaagcttcttcttgcatccgcttcagtctcaatgaagttgatggagcacttgggctcgacaagcttcgccgtcaccccctcagtgtgaccatgcatcgggatcccctcaatgcataggcgcacacggtagtgacagctagaaggtctgatgaccctcatggtgtgagtcccaagctcggagatggtaggaacagctagaagagcggtcaagccgtagagtgcacggaataaagtccctatcagcaggcctagccaatgtgaggaaggtagcctcatcaacgcagtcactgtggttgtccaagcaccacgcaatgaaggagcagcacgagaacttttgccgaagcctctcgacctcgtcagttgcagccactgtcaccgtggctgccactagccttctttccaatagttcatccatcgcaaccggggttccacgaggggcggccactcgagaatccggcagggccttcttggtgaccgaaggttggtgggggagaggtgggaactgagagggatttgggagaagaggggggagcaagcaaggtggcaggtgaactttgtcccctactcttcgcttggagcaattaaggacttcatgtccaatccctctacaaaaccagcgtttgaagggctctctgcaatctttaattttgtgatctggagcaaggcatctgaaacactttccttccatatgtttaaagaaacgagctcttccttgcttgtgttggtcctgtggatctgcttgagcactaagggattgctgtcttctccactagtgttttgctttgacttctttccactagggatctgagataatttgggaggatcttttaatctactgagatggaggatgtgacgaggtagagattacacttccgctcttgagtactctaggcgtatcactagcgagaggcaatttgcttcgcctggtagataacctcttgctcacaagcaaactttggggggcagcagctaaaggaagagagtcactggctgcaattgaaacctaactgactggggtcagtggagcattgatgctttcagcaggagtaatcaagacttctttgaacgttttgtagaaccgctgctagggatggttctggatttgctcatcacgtggaggaggcgctaggctttccaggtgtgaaaccagatctagatctgaggggaagagtggcttaccttgtggtggaagacgacattcaagacctgagagaaggtttgagatgttacggggtggagagaagttgggcaggagagaggtctggaggtactggctggccggaggtgggggtggaggtggtggcgacagctagttgctggtgtcgagggtgggtgtctgggctaggggacgacatatttattgctactccctccgtctcagaatataacaacctagcaccggatgggatgtattctagtactatgaatctggacagccccctgtccagattcgtattactatgatgcgtcccatccgatcctagattgctatattctaggacggagggagtaatcacttatcatgtcattagtttggtgggctagggcctctagctatagctcaccacaaatggaatccattttttttcttaggccaagtgctcccttagaaactgttcaagccagtctcctactcaagtatagcaaaccaaacaagtctggatcaaccaaaatccaacaaaccaaactcatcccatatcgaagaagaaaacaaaaagaaaaaggtagcacaagatctgcaactaggaatcacgtgtacaccttgtcgtcatctgcctgctagcactagtagccacaagatagcacattgtatggaaaattaattcaaccgggtaggttaggaggccgatgttttggtgcgtacgtacaaggatgtcaagcttgccgccgaacatggcggcgaccctgccggcgatcgcctccgggtcagcgcgcacctacgcgtcggacggagacggtgacggcgagcttcttggctctccactcctccagacacctgttcagggtagcctcgttccgggcgcacgtgtgcaccgtggcgccgaagctcgccagttcctccacgatggcgcgcctggatgatgcatttatacatgcttaatcagttaatctgctgccatcgatttaactagcatctactaatacgccgaagcaacgattcgatgacttggtgaacttattcatagtataattagatgttaaaagttaattagaatcaataacaatttaacactggctgaagagctagataattaagagcacaatctgaagagatagatctgtttcactcttcaattctgaaaacagatcgatgggaaagcttggattcggcgaaggaagacgaattaattacccgattcctttgctgccaccggtgacgagagctgtggcgccggcaaggctccaccgcccgacctccggcctgctgcttgtggacatatcggcgtgcctccggtttgtgcgtcagacttgtgtgttagtgagacagcttgcagttgcagcacagggtcgagtacttctaaaggcgtaaagcattagccgtctgcactaggtgcttgtctagtccgctggccctgtccgcctccttgtgtccatctcatgaatatctttgacgtgtatttgttcagatttttctttaaaaaatactattttttatgggaaaagagagtatagcatatatcggcttgtcctgagttatccattgactttagacttgtttagttctctgagacaactccgcatccgctgtccactaaagaaacgggatcggttatctgtaatgggtttaaagcatcatctctttcggacagggcacccgtcactaagcaaagatcagtaatgtgagaaaatatcttaatcgggcatccggccatcacgaacgaatgactctcatctctaatgggcctaagctatagcctgtcacggatgactctcatctctaagcacccggaaagaatttttccggtcggtcacccattccgaaattgctctaggccaagcacgcttaatctcatagtttttttttaagattggattccgaaaaagaaattgtaacttgttggcatgagtattctattaatcctattaagccctgggcaaggatgtcacaccctagcattccctattcatatacatttattcatatacctaactatcaatatatttaatacaaccacattcatataacatccattttgatcatatatttcaccagcaaaaccgagttaattgcatcaaatatatatttagcaagtattatcacgagtagggtaaatcagacttctaggcaaaaatgaatttcaaattgaattttatggtactagatgaactcatctgaaaaagttgtaaaaaacaaagttgtagaactaattgagatctaccaattttatttagggcaattgcatatttgactctgttttgaaagccaactactaaattgaccctgttttttttaacttagcttattttaccctgcttttcaaaaacaaacatcaggcctgaccctattctgtcaatccaacgtaacagtgttaacttatggctaaaaagacatttatgcccttgcgtatttgaccgtgatttgttttctattcggtctaatttcatacacttagttgtttaaaaataacattttaacatatttgtgacacaaaaatttgacgaagaatcgataaaactacaactgaagtttaactaaattttggcagcatatattatccatcacaaattacatatactgaagaaaaaactaagagctagctagcctgcggccctggagtgcgtcgcaccaccgccggccgatgcccggagaggtggaagccactggccatagaggcgcaggggtgccgacaccgttcctgtcaccacctcctcaaatctcatcgtcactggctcgccgctgatgcaccgtcgccaatgcgaggaagagaggccaccgtcggcaccagcacagtcgccgcatggatggagagcaggtggaggagcttggcttgcatggtcgccggtgtcgggacattactccgtcgcctggaacagctaagccgccgtggccatcgactgcatgaagcagctgcttcgcgcgtgtgccgccgccgccgccacaaatccctccgcgccccggcactgccgccgctcagctggtgcggatcccctccctccccgccggcgcagatcccatcccgtcgccgctgctgctccctcccaccacgtcgtgctgccgccgctccctccctccagcgtcggcgctgctatttcctcatacgccgccattaccactcgcatttatgatacgagacatccagatagggtttattttggatagggttcctggagggtattttggataataattatattttttatttgttttttaatgaaagcttaacggagtagcgaaaaaagggtcagaccaagtgatcagttttaaaaaatagggtcaaataagaaaaccacaaaaaatagggtcaaattggtagttagcctttcaaacggggccaaataagcaattgtcccattttattttggtcatttttctatccgagtttgattaaactatataaaatttgaattctaaaatataagaaatttaaatatttttttgggtagtaaatgatttcaaatgaaaaaattatcaacaacaaagttgtatatctcctcaagatctataacttttacttttgtctttctcccatataatattttttgaatagtttcaatttgaatttgaaaatatgacaacttcaaacaatattttcaaatactaaatgatttcaactgaaaaagtcatcaacaaaaaagttgtataattcatcaagatctataacttttatttttgtcatttttctatataacatttttttgaacagtttgaatttgaatttgaaaatatgacaacttcaaacaatattttcaaatactaaatgatttcaactgaaaaagtcatcaacaacaaagttgtataactcatcaagatctataacttttatttttgtcatttttatatataacattttttg

SEQ ID NO: 81708 - DNA, 8540 bp, Oryza sativa
tatcatgttcgctaggtggtttcggagctcgtgccactgccgtcattgtcctcttttgctcgccgacgtcaatcggcgggggtgaggcacctcctccccttcctccctctctcccacgcagcttagccgccggccgccgcctagccgcttagccgccgctagcgccgtccgcgtcgccgcgacgtcgccgccctccgcccccagccggtcgccgccggtcgccgacttgcgccgccacggcatcgagccgtgccgccgtgcaccatggccgccgggccggcttgagccgcccgagcgcgccggccgcgtggttccgccgctgagggtagatcggggccgtcggttcagctgcccgcgtggctgccaggtggccgccacgtgtgcgccacgtcggcgccacatcagcgccacgtggtgcgctgccccttccccggtccatggacccagtccaccgcggaccgccacccgagtcactgacatgtgggcccgcatgtcggcgccgccccctctctctccctgggattttaattattgcgcaataaatcaattaaggattttaattattgctccgtttaagcccattcaagtcttagtaaatcaagaaaaatgcatagaatccattaaaaatggttttgttctctgtttcaatagtcttatggcctgtttgtattgtttgttttgtatgtcgcttagattccggttctcccgacgctccggtgtactttgaaatagtcgccgaggttcctccagcagcaaagcaaggcaagtcatgcattacgattgatcatattgtacccaatttacaaatgtcccgtatttctattaaatgttgcattgttttacaatgtcatgtgggatgggtcctactactcggccatatattgtttaccttttgccattgataacttaggtattaaaatgattagatgttggtttagggaatgcttagccatgcttagttcaaccagtacacaaagggggatcactttaatgcctagactttgattattggcatagctttggattagtaccaccgcaatggtgttgattaattaaaatatattaaatggttggctgtgggtgcatgattttgatggtcgcgcccatggcacttaaggaccggttcgcgggatgccctggaagaacttatcgtacttaccacaagccagcgtgggtaacggctgggcttgtagtgtagctttgctctagctgacacatccaggcaagggtgggcgtgatggagcgggacaggccctgcgacggcctctgtcgcttccggatttacgtaggcacgagaggggactgcccgttgcccgctggggacgggggtgaaacctgaggtgtggtgtgcttggctagagggggttatgcgaagggtcctgtcacggcctctttccggtatgttgtggtggcatgtcggcgcacagtaacgtgtcgtggggctctgtcttgtgggtacagttgtacacctctgatcagagtaaaactattcgaatagccgtgcccgcggttacgggtggtccaccagattcactgtgattagtctcaccctagattagcctaatggaattgattagttcaggaggatggttgggccagttgcaacgtggtgtagcgttggacagtggatgattaatattgattaattactacaactgttttactgctttcaactactgtttataaatgctcgctttatgcaaatgacccgctctagctatcctttggttatatcatgcatcatactcctattctggtatgacttgctgagtacggtggtggtacttagtcttgctctattcccctccctaaaccccagagtttgagtacgtgtcagatgatggcttctccgaggtgtaggcttcgtccgtgccatcgaggatgcctgtggagtggtgttcccgctgcagtccaagtcaaggcttagctccagttatcctttaattttccgttgcatttatgtaaaacttttatgatgtttgtaagacgtggatctgtatgtcaactttgtcgtttgtgtaccccggccggtcctggacgggggttttaatgcacattctgcttggaattctattcggaaatttctgggcgtgacacgccgtccgtggggacgtccgagcgaaaccactgagagtgagcgaaaccactgatgccaccaaaggaaatcgttaaggagagagttgccaagtgaaaggaaggcaacagcgaaggggagatggctggcgaagagggagtagagccttcgacttttgaagccgaagttggagctgcgccacccccagcagcggcgccatctcttccaccttcagcactgacgaccttgacagatgcggatacgttgaaagcggcggccacgctccagttcagggacgtgatcctttcgcctcaagtaccgggggcacctcaagctgccgccttcacctagctagccacgacgtcaacagcaatcatcaccttgcaagctgacgccaatctcaaagctcaagccaatgcagacatgggggctatacgtcagaacatggctaaactgcgagacacacttcgccagatgcaagagcagcagcaagcatacggagcagcaagacaagccaggccaacacgcaggagtttccgacgctctacgctcagccccaagtttttcccccacatgctgcaccagccccggcgtactacgccaagcccgtcccggccgtcgctgtacgaccgccataacatgtgatttcggcgccggttcgtccagcggcacaccaagcccagtacccgaagcccactcacactccacaagcaatgatggaggcagcttcgaccttacaagcacagtttcaagccttcttgcaacaactcaatcaaccccacaacaatataccaagagcttcgcctctggcccaggacgagcggagcccaagtcaggggtgcgctagccgggcagccgttgggctagttcatcatgccaagttgttgacgtaaaaacacaaggcctgggagatctgcttaactccagtgcaggtccaaaacttgcctttgggtgtatgagcgtgccagttgatttgatcctgcaatcaacaggaaacaaagacaaagaaaccgcggttaaatccataaacgatagccaatcggctaggtgccgatgacatatcatttacctttgagccgatgtcatatgtgcatcgatcggcaattattaataagtaagaaagaacaaaatctactcgatcggctgtagatgttaacgatatataatccttaggtcgatatatacttaaatcaagtgattgggatagatcggtcgccatgtcgagacagtataaatcacttagatcgaaatatatattaacaacaagaccatatatgttcgtagcatagccgatcagatagatctagcatgtagcggctaatgctccgatacgactctatattaagatattaaagtaagtaaaatataccaaacgaaagcctaatatacttaaatgctacaagatcttagcataaaaggtagaattaacatgtcaatcaagcacataagataaaagtagttaaattaggtaagatcggctgaaactccgatgctaccctaatcggcaaccaaaagcaggctagagattgagattctaatcacgattcataagatcaaactcaactgatgcagctataagtatgaaaagaaggacaatatctagacaatcaagccgttggatgtttcatagagtggtagatatcctatataatctaagtcaacatcggtatttaacctagtcggctgccttctattaacagacgttagccgattgtaggttagatggcgatattgccggagattatataagatatatgataactcgacgaattatagcaacaagattagagtatcatgaagatggaagcactaatcccgagaacgcaagccaccataacaagttttacctcttgttgaagatcgaaatcgatgcagctcaacccaaaagcaagaactcatcgaaacaaaatgaaagtaaaagggtggcgatgccccgagattgtattgaacgtgtgttagtttgattacatggggctcgaggtctatttatacccgagatttacaaaatatgtccacattggacacgactcttatctctaacaaactctaatataccataagtctttacggcagacttttgcccaaacatatctctaaggaaattacataaaatatcctaattaatagatataattgccttctcaggactacccatgcgtggcagtcatcatgaagcttattaactcaacccgacaatgtattcttcgtcatattgtcggattcggctcaataggctaaccctgtccaactcggactttgctgatcctgatcacagctgattcggacttcagccgattcttactctatttccgaaacaatcttggatttagattccgcttcaatctgatctctatctttgatactcagattaccaaatttggtcgttaacacatgcccaccaagtccagaatattggataatgtttcgaatttgccatacgtcgactccgagagaaatccgcacttgccgttttccgaccgttacacagtgctttaaatactaaccgttgtccccgagatatctcacacagtttcctccattttcaccgccgaagccaattccgtcctctctctctccggcaatcccctcggtgcgcaaggcgatttcctctccggccaactttccgcccacggcgatgtcgacctctcccagcccgtccgccgcatcatcagccgagtacgcagaggtaagttctcatcggctagatcctcttctttcgtatcggattggttttccctttccatatcttgttttcttcttctctgttcttttggatccgtagcatctctccaacctgatcgcagttccgagcctatctgacgagaaccattactttctcggcccagtcggcaaccttgatcctactgagttcatcattggcgaaaccaatagaattcctttcagattagccaacctagatctaggtcactggaagaataccttcaaatcatggccatctctcgagaaaacttcacccgagaagagctggattacatggtacaagcgcatgtcgtctaacaagaaagttcactgggacgaaattggaatcggccaagcgcttacccttaccatagccaattcagctaaagatgaacctttaatggccgccgccacctatttctggtccaataccatcaacgcttttctgttcaaccaagggccgatgactccaactttgattgacatcaccatgattaccggattagacgtaacttcattgcctaaccctgtgagtatgaacaccaagaaccaatttgatttcaggaccaaaagcataggtggttggtctggctatgtagcggcatacatgggcaaagggcctgtcactcctcgaaaacatgtggctttcttgttgatgtggctagaaaagttccttttctgtggatccagttgatgtcctacaaccaactggcattttgtagccgaagccctagaatcaaagaaacaatttcccttagacaaaattcttcttggctacctgtaccaagtgttaaataatgcatgggccaaaatagctatcggcttagtggtaggagcaggtggcccatggtggctgctgcagacttggctgaatctgatggtcatgaaagttgtcaatcggccatctgtgatagaagctgaattcctaagattagagccgatcatagaagacgatggagaggaacgcacccatcgcaaatgcacatcctatcgagggtatgcttccacactagccgacacaggggcaaagctatcagctgaactgcttaaggattggttctgcagtttttatgaaggctttcagaaagatgctccaatttggttcccttatgaggactcagcacttctagagctcccatcggactttagatttgaagacatcaaccacgagagatacgaaaagtccagagaagtcttctcggctgcaataagcccatgcatccttcctgtcggcattcatcaagggaggaatattcaagtctcttatgaattttatcatccgatgagttctgctagacagcttgggatgggtcagctaccaatcggcttgttctttgccgataaaattcaatgtcgaggggaaatttcatcaaccttaatgatggatcggttactcaatctcgaaggacctcctttgggcagtattgaaaatatagagctggcaaggttcaggagtaagaactttgacagatggtgggggtgaatggaaacaacatatcttccatcaaccagcttctatgtaaatgacagatctgttccccgatgttgttcctcaggtatatctttgctcttgtcaattctgtttgaacaattattagccgacttgaaacttgactaatttctcttctcgtcttgcagacaacagaatcctctccccctcgcaagagcaatagtggcatagatatcgaatacgctccaggtctcattcccaatggaggtgggtcatctccccctgtcatcaattgtcatgcccccaaaacttcaagtatgctccaagggctcattagagaactagctgatgccggtaaaaagagaaaaaccagagcatcggctatagacccattggctccggctccaaataagaaagccaagtcaaataagaccaagccaaccgatgatctgtctgccgtagatccatccattgaacaagctctggatgaagaggatattggagaagatgttgatcaagctgaagctgggataagcggtactgaaaaaacaccatgggcttcacttaaacaaactcctccgactccttctgctccagttcatttttccagggtaaacaactctccttgatttctttttgcaaccatttcatttatagccgattgcttatagattttataattgcagaaaaagaaaaatactatgagaaagaaatcggtagcaacaactctcaaactggctccaccagtaagatgttcttaaatctttcactagttgatcatcgccgatcttgtctaacaattgtctcttttcagcctcctcctccttctccccatgtacagctatcatcaagtgaccaaactccatcggctatcatcagctagaagcatcatctctagacagtttggtagtagactgtggatcaattaggactcggctacataaagttcaagctttgatcccggaagaacatgcagacgtcctcactccagctgcttatcttgaacaatatcaattcaaactggagaaggccaagctgagattagccgaacgtgggaagcgcagggatattaaagccacaatccagccaatcggcaactcgtgcatgaagagaagtccaagcttgatcagctatctgagggcccgatcaagtctaatattgatcagcttgaagctggtaagattgagctgttggcacaactccaagaatccaatgctgatatgaccaagtccctaaaagtcatctctggaaccgatgctcaagatacccaagctattgaagaagtagaacacattaggcaaagagctatatcggcgatctagcgctacttgtctcagtgatattctataataggatgtagtaaatttttgtaatcggctaagatactctggcacttgtagttaacttgtcttgatttatgccgattaatataactccatgtttttgctcaagaatttgctcaaaaattttgcaacttttgcatatatatgtgcccccctaattttacaatgtcgaaggcattgatgaaattatatcttgaactaagggcaatataacaatatcggccatttgtacatcggcaaaccacaaccgattacaataggaaaataactaagggcgatataaccatatcggccatcccaaggcaatgcaaacacatcggctattatgtatcagtagtaccagccgatcatgcattaacccaaacacttgggtaatatttcttcaagtattttccattgagcgctcgtccataaacttctccatcgagtccttgcaacatataacctcctttagacacaactttatagatttgaaacggtccttcccaattcggcgactacttgccgaatttgctatcccgagtgccaatcggcaaaatcaatttccatacaagttctacctccgaaaaagacttggctaccactttcttgttgtaatgtcgagcaacccgttccttatccttagcaacttttgcaagggctctgaatctagattgaaccaagtcttccctctcatcggccataagattataatactcatcggctgtcaaatcattttgcaactccgttcttcttgagccgattctaacttctcatggcaaaacaacttcatgtccataaacaagtttataaggagggacttgaatcgatccatgacaagccatccaataggaccataatgcttcggccaatcgagtatgccactgccgaggataatcggaaatctctctcttaatcaatttgatcaaactcttgttagacgcctcggcttgcccattagcttgtgcataataaggtgagaattcaacatttt

SEQ ID NO: 81709 - DNA, 1465 bp, Oryza sativa
  unsure (1)..(1465): unsure at all n locations
ttttcaattcagtttattaaaaaatctaattatttttatattattagttaattctcctatacaaagaaatacccttgggattgttttgatttatcatttttttattaattctaattaaccaggaatgatatttttaattattgttctttttatgcagtacgtagcaaataacatctgcattggatactgcatcacatgatgcaacaattatatttgctctgacagaaaagcgtcaaaggatttttaatgatcaatataaacagtagacaatatatttgcatttaatctaagacaggtctgtagacaataacacataaataaaatagtctcagaaggtaagttgatcaaactgattaatctagcaactataataggtctgataacatgatcctagattcctaatctctaaatgcttgcaattcgacattagcacatcctagaaacgccagaggtcatcattctcacaagttcttccacaatgaccagcttgtggcgcttcttcagtagtgttcatcccattctgaaataaaattacaaaataagctacaaagttactgaaaaactataagggtaggtctaagtttgaacttatgaatgatacatagcagtccatttctaaattgaactcactaactggtatcgcaactaaagccataccattggcagaacatttttaaattgatctattgttgtccaagaaccaaatttttcataatgtttgttcaagagaataaataataaggatgtacagtagtaaaaagattgaagtcagtatataccatgagaagtgcatgaaggaactcagggacaacagaagaagatggtccatttgcatcctgtgatttgaaaaataataccagttagtatgttctttctaggaaacaaaaatagctttaatttatacttacatgggaatgagtttctgccttatccttatccactgtctgctctagcctttctatccntgatgctagttcttgatgagcattgttcacagcattagtgactgcctgctgaacaatgtcttgcacttgctgctgtgtgtatagtggctgtgtctccatgctaccagatggtgcacttgctgaattaccaacatggtttctatctataattcctgaaagaccataatacattccacgttttctacctttagtgagctgcacccaaacatgttgtttgttgacttgattgttttctccttccttgacacgatcattatacaccacctaattaagatatgtagtggcaccattgcatggttttagatgatttcactttttttgattgccaaacttgaaactagaaactagaataagcagaacacataccgctaactattcagctttcttgttggcatactgtcccttgccctttgcatgtcgatgtgtgcgttcaaagacatcaatatcatcaacatccgtccctgcattctcaattatctatccaaaagtacatatcatag

SEQ ID NO: 81710 - DNA, 16304 bp, Oryza sativa
  unsure (1)..(16304): unsure at all n locations
tgtctactccacacatggtaattttcagtaaatcctttattgcaaaggtgcatttgaactattcttttgtcatgcagctgcccattcttgcacttcgtacaagggcatctaacccttttcttgcctgaccttgaactttgatacagcgtgtgacataaacctcttaactcctttcaaatactcatctgaaatgtatccattcactacccttttatacatccaactacggtcctcagccattaatctcacactaaacaagctattctgacatgcaaataatggctagccctacacttgaaattatatggtaaggatgcatattttgaaagattatgtaaaggaagtttatcaaaataagaagaggaaagattagatgtagactaatagcaaatcttcttttaaatacaaaaaataattgctcccagataaatcattattagtgataacttgaacatattaagtagtacatatttctctataatttgtttactctgtctacacttcaatacaccaaaagaataaacaacatgtgtcttagcttgtttaatttactgaatttttgcacacatgccaatggtttgctatcagattgcacaattattaacactcaaattccatcgtactttcagaagacctgaattttctaaccacttaaagcaatcctgagattgcacaattattaacattcaaattccaccgtactttcaggagacctgaattttctaaccacttaaaacaatcctgagatcagtaccaatcataaattaaactatgttaataattcctacctgtatattctaatccgaagaactgatgatagaatatatatctactagagatactcgtaatttttgggcaataaaaatatctagtagcgagcaactaaagaattagaaacacaagcatcgtcaggaacttgagtcatacatgtgcaagttagagagcaaattttagtgtgtattacttaaaccataaacaaattaatccaatatccaacatcctggagcaaggagagtagaagaaaccaaaaggatgatgaacattctttcaaaatcattagttgagatgctcatgggatacaatcacaaaagatgaaaatcacaggacatgacaaaattcttacaggggaattccatcgagcagctggtaggcacacattaatcaagatgttacctgaggaggaaggatcggggcacggcagagcggcacactccgacgaggtaggagtgctgggcctgggtgtcaggcaccgggctacaggaggtgccgcacctgatggctcggagtgcgacgggggtgccaacctgcgtcgaggcaagcgcgcggcaggggattgttagcgatcatgcgaggaagaaaacaaatgaagaaaattgggtgctacaaactcacggaggggcaaataaatctctccaatcagatgaggaaatcacaattagaccggcaaacatggggagtgggagagatgggataatgggggtcgatgattttggggggaatgccagaaaatcgcgggaaggaaaaagatggattgggacttgggggtttttttcatgagagctagagagcccttctttttctttttttttttgagttgacggggtttttctagagggctggcaggttttttttttaagtacgggaaaacatcctttttttcagggagtgggatgtggctgggtcaaaacaaactccagatattccctcattaaaaaactaactcaggataaaaaattgcatcaaaaatttatacatggtaatattatttataaaatatatgaaatctcgtgttttctattatacaaaaattatgtaattattttcaaagttacatgagcataagagtaaaatataccgtctttaaatatagattttgcatcctttatttctagataatcaatctagaatttttttaattttttcaatttttataacgatcgttgctacgggagtagagccaccagtaataacataagtgtggtaggcgtgtacaataataccttcgattaagtggcggtcatggagcttgacgacgaagatagaacagtggcaacgctactcaacctgtcaaccatggagacagtgtatataagacctcggcaacgacaacagtggttataataatgtattaattagagggttggcgtgatggcgacaacaagtagtagctactagagtgttaggtagtagtgacaagcatgctagcatgggaaaatatccctttagagtagaggtgccaatgtactgataaatttttatacggcagatacaacggtgggcgccttctctcgtttgcatgacacttgttacatatggctaaaaaaatatatcatggcgttacaccattttattaatgtaatatttaaataaaacctatactaaaatataaccttagatgtgactcggtatctctactattaaaatattcgtgttattaaaagatcatgataattaatttatgtttttctattaatggaagacaaacagttatgcatgtcacacgcacatgccctgtttttatcatttgcaggcccttccgaatagttcatttatatttttttttatagtactggtaatgaggtcgcgtggtcgacattttatattaacacgtttcatacaatttttatcggttagctatactttaattagcaaactaaaacttagtaaatgtaaaagaagtttttgacagtacaggcacaatttcatttgcaattctttaattttgttttttatttagctatttatagagtttttttcacagaaatcaattaaatatatttttatttttagataatgtttaatctatttataaataaaaacaagctcacaagatccatgcatggctagcgtaatactagcaattaactaactgtataatttatattatgtaatttatattacaaagagatgctttatttcatacaatcccaaggaccatcgcatatgccttggggatgacgacattctacaagggtacgttcatgacccttgcaaataaacattattagcaaggaactagagtgatggtagcagataaggatcttctgcaaggctatactattgcaaggggaaatagtcttgacaataattacatttcttatagtggtagtggatatttttagtgtatcaatgatgtattaggcttattttattggtacatatgcaattcactcaacttttaaaacgtaataagtaatagtgagaatagtataatttatatgttactcgttcaaagtgttttttttaattttagagatattcttatcatttaatatcatttgaatagaaatggtgagatacgacttttttatcattgtttttataaaacaatcaataagacgcccgtgcatctgcgcaggctttgttcctagttgatatcaataattcaatattttatgccaacaaagaaaaagaagaaaattacacatcaaattattggtcgaataaaaggggatccacttgggtaatctggtccaacacgcaggacactatttacatgattaaaagggctataagatgtgattgttctaaatgtgatatcttttaacaacaaagataaaatgtggatacatagctgctaattgtatatgctgataacaatgaccatagtcttaaaaagtaactgtgaaaacatgaagcaggtaactattattcagaaaacgtgttcacattaatcacattatgtgtgaaatggaagaattatacagacaacattctgtgatctgcagtctaaataccatggagattttggcatgcacctttttgagaagctggtgatggtcaaatccgagagtaactgatccctcaatcctgttgatagtttgatatggtacgcaaacagagcaacagtagaagctgttacatttatatgctttggcatttatatgaaacttggtcataaacaaactcaaatcaaactatgatcaatgatgctacctagaacatgatagaattacaaaattgttttaggatcaagatatccatattattggtaaagaacatggacctgccgcctgtgttgtcctgcagaaatcaatggcaagagaataagaggtagatatgccagttcggttaaaaataaaaaagagagagatagatatgccatggcaaatgcagatcgagcgagagagtgagagagatactgtgccaacaaatttttggggccatgcatgtatgatgtatggcagcagcaaggcacgtgcatttacccttgatcgctggagtttgttcatagacggtcccacatttgtgcaacaaatcgcatcgggactgtgaaattcaaggcggtacatatactggaaaagatgaacagctacaggagttccatagagaaaataaagtaaaagaactaaaaagacaacacaaaaaggttacttcgtaccactgttatttgacatcgccataacagtgaagcattctctaaatagccaagggcatccacaatataagctactcctaaagtgtcctcactaactaaggacacacgtaggaaaactcaactcgcaatggaggacacccctgaatgggctcctcaaaatcccaacctataaagccacaagtattgttttcctcttctacccctctcttcaaactaaggaatttgaagacatgaagcattcagaatacacgaatatattcaacacagtaattttcaatcaagagtaacctatatattataatctaattaagcaatagaatactagtattttctatcacactctcaagtactacttcaccacatcatctgtactactctatcttatcctcttcgttcatagccattcaccgcatcatctgtactactctatctcatctttttccccaatcttccatcgagagcagcaaaccgatgccaagatcggtggatggcatagcgagctcgcatacgcggccgagctgggtaccgggcggagcaagcaaggcggcagtcggctgacgagctcactcgcgcggccgagctgggtaccgggcgaagcaagcgaggcggagcaatcgaagcggacgcacggcaggagcgagctgccaccatggtcagcacaagctcaagctgcgtggtttgcgactttgccccaccgcgccgccgtttactccgccacacagcgccgcccgtgagctcccttcagctcgagctcgaggggaacgggagagagaggggagaggggtggaaggagaatatggaggtggagcacccgttgcccgaggcacccgtcgccgcagcgcgtgcctcgagcccatcccctggccgaaaaggaggagccgcatcgcccagacgggagtcgcgtggcgtcgttgggggacggtgcgaacgaaaaagtaaacggagatggacggaaggagctagggacacgcccctgaggctacccattgctgatggcctaaacatccataattttttaaaaagtaaaaaattcacgccagcagaatgccaaaacatagagaaggaagttaacttttcaggaaacaaatatcaggcgatgtccaacgtggaagagggaagacctccacgtacgattggatataactactggaaactaatctttgctcggtcgccccaaaaccacaatagtcccggttacaaaaagaaccgggactaaagatgatctttagtcctggtttaaaaccccacagccattctacgatctttagtccctaaagatcatctttagtcccagttcatccctatcagtcccttgtcagaggggcggggatctttagtccctgttggtgtcacaaaccgggcttaaagatcacctagatcaccactttagtccagactaaagatctcctctttactccctataacaaacggaactaacatcacgcgtagtatataatccctattccctatcctctccaccacaaccggcctcaatctcctcaacaaccggcctctcctctcctcagatccatctccctctcctcccatcctagccctctcctcccctcctcccttcctatccgatgcccagcgagggccgcctcctccccctcctgccttcccgtgcccagcgcctcctccccctcctcccttaccgtgccaagtggggccgcacgcggcaggtggccggcgaggccgcatgcagcaggcggctgagcacaggccgagtagcgagcgggcggcgctaccggcatccattctttattttttttacaatttgtgattcactgagatgtataattttgtgatttgttgtatagatttgagatgtataatatgtgatgtatttggtttgtgtgtaatttttttaggatttgtgatgtatttgatttgtgtgtacaagtaacttaagatttgtgatgtgaatgttttggaatattactttgatttcggaatatgcatccaactcgatttgggagaaaatacaggattaaactctggctaaaaaacaatgaaaaaaaaagaaaaagagacctaattggactgccactaccctctctttagtctcagttgatatcacaccaaccgggactaaaatccatctttagttcgggttatttcaatcgggactaaagatgcgccggattgctagtcccggttgaaaaacgccggattgctagtcccggttggaaaaccgccggttgaaaaaccgggactaaatgggttaccaaccgggagtataaatggtttctggttgctgagccgccatcaaacctaggcgagatgaaccatatatatataatatccgatggagttgatgaatcggccggcaaatcacatgatgcattgatacattaatgcatttatatttaatgaagatgaaaataaattaggacattggcagtttatattaagaagatgaatagctatggcgtttcaagcagcagctttcaagttttgctttattgttggactgcaaacatgaatagtcaaggatcctagggggcaccgcccacatcgagctgagccatccaatgggcttgtctaagattttctgcaaatttgagcttcacatgaatgaaagcaaattcatctcagtgccgcggccgcacccgcgctgtccaccacgcctaagccgaggccggggccgcgccgtgcgcacgcacgatgcgccgttccgcgcatccgccgcactgcgtcgtgccaccacggagatgatgccctgccgcgccgcgtgcttgtcaccgggccgaccaccacgcacgaagaacaaagaaaggaagaagaacaagaaaagaaaaatgaaaaaaaaaagagggtgcgccatcggccgtcgccccggcgccgacagcattggcgcccgaccgccgaccgcgcctgcagcaccgccgccgcacggccacgcctgtggcgtccggccgttccccgttacccggcatccgcatatggcaaggaacaatcgggggagaaaaatgaaagaacgaaaaaaaaggggaaaaggcgacgaacagcaccagatggccgagccgccgtcgccggccgcccaccacaaatagcacgccatgccacgccacccttcggctcgccgcgccgcccccctggccgctgcaaccacgcatgaacgaggtcgacgccgctgccgtgcccgcgccggcctaatccggccgcgtcgccttgcccggccacgaccgccgcgacgggcgtgctcgcggcgccggtcgcccgcccgcacccgcgccgccgcttacgtatggccgcgctgtcgccgacctagccgcgccgcgccacgctgcatccgcatggccgctccaccgttccccggccgccgccccgcgccgcccccgccggtcgccgaccgagtcacgccatcggccgcccccacatggaaaggaaccatcggtggaaaggaaaagaaggaaagaagaagaaagggaaagagaagtggaaaggaccgatgctcatgtgattttgcaaatggacccttgcattttttggaaattaagtgcatattcctctgcaaaggaaatttaccttttaaatcctaatgttttaagaaaacacacaaataacctctgcatttgggatatttgtttgaaaagcatttgaaatttgcaaatatcactaaaatcatattcacgcataaaaagggtccatcggacattgcatttcgaccttgactttgtatttaaggtatcttttattgctgatgtttatgattatgaaatttatttatcgcatatatgattattgattatttatgatgcttttattacttttaattgatatcattgcagtaaatatatagaatagcatataatatattgaaattatttgcggcaattttgtgtaccatcgcattgcaacatttgtgtatttgttaacgaccaaatttggtaatatcagcatcggaaaaggagattagatcaaggtggagttgaaggcggagattgatcctagaacagagcaagaatcggctgaagtccagatcggctacgattaggatcggctgggtctgagtcggactaggtgagccgattcagccgattctgatagtataatttggtgtatgacattgggttgaatcgaggtgcttcaagatgattgccgcacattgatagagtcctgagaaggcaattgtatctattaattacgatgttttatgtaactttcttagagatatgtttgggcaaaagtctgccgcaaagacttatggtatcttagagcttgttagagatagtggtcgtgtccggtatggacatatcttgtaattctcgggtataaatagacctcgagccctatgtaattggtaacacacacgttcaatacaatttcggcgcatcgccacttttttgctttagttttgtttcgacgagttcttgctttcgggttgagctgcattggtttcgatcttcaacaagaggtaaaacttgttatgacgacttgcgttctcgagattagtgcttccatctttatgacactctaatcttgtctatataattcgtcaagttatcatatatcctacataatctttggcaatatcgtcatctaacctacaatcggctaatatctgttaatagaaggcagccgattaggttaaatagcgacgttgtcctagattatataagatatctaccactttatgaaacacccagcggcttgattgtctagatattgttcttcttttcatacttaatgctgcatcagttgagtttgatctattaagtcgtgcttagaatatcaatctctagcctgtcctctggttgccgattagggtagcatcggagtttcagccgatattatctgatttaaccatattcaatctatatgcttcaatgacatgttaaatctgccatttatgtcaggatcttattgcatttaagtatattaagcttttgtttggtatattatatttgttttgatatctttatataaagtagtatcggagtattagcggatacatgctagatctatctgattggctatgctataaacatatataatcctgttattaatatatatttcgatcgaagtgatttattctgtctcggcatggtggccgatctaccccaatcacttgatttaagtatatattaatataagaactatatatcgttaatatatacagccgatcgaatagatttagtttcttactatctatttataaccgccgatcgattcacatatgacatcggctcaaagataaatgatgtcatcggcacctagccaatcggctatcatttatagatttaaccacgaattctttgtctctatttcttgttgattacaggatcaaatcaactggcacgctcatacattcgaaggcgagctttggacctgcactggagttaagcagatctcccaggcctcatgttttctatcaacacgcttttggcacgcccggtgggacaaattagaagtcagcaagcaattcttcctcatggccgagaagccaccgctatcgccatcctcggctagcccaagcactgttaaataaaagatccagaagttggggttgactcgtgcccatcgatccagagaaattcacacctgagcagaagaaggattttgaagcaatgttgcagcaagcccaggatcaggtcttgaactcattcatgcagccccgcaagggaacattggttcagaagtataaagtaaaggtagttgcggatgaccctgggaccagttcttccaaaggtgaagacgggaaataagctccaaatggctcggctcaactgagtgacaaaggtgctaccgacggttctctaggaagtcaaggtgacaactctcaaggggtgcatggagttcaaggtgatggtgctcaggggttacaagagggaaatcttaatcagaatagtgatgcggcacaagatttttttaataatttccaagaccgggtcgactatgttgtgcaccatgctttgatcaatcagtctggggtgttagtcaataccttatcaaacatgacgaagtcaatagcagatggatcaatagctgagcatcaggctgcaagcaattcttcctcatggccgagagccaccgcagtcgccatcctcggctagcccaagcactgttaaataaaagatccagaagttggggttgactgatgtcaatgaaggaaacgtcgtgcccatcaatccagagaaattcacacctgagcagaaggattttgaagcagtgttgtagcaagcccgggatcaggtcttgaactcattcatgcagacccgcaagggaacattggttcagaagtataaagtaaaggtagttgccgatgaccctgggaccagttcttccaaaggtgaagacgggaaacaagctccaaatggcttggctcaactgagtgacaaagctgctaccgacggttctctaggaagtcaagctgacaactctcaaggggtgcatggagttcaaggtgatggtgctcaggggttgcaacgtggaaatcttaatcagaatagtgatgcggcacaagattttttcaataatttccaagaccgggtcgactatgttgtgcaccatgctttgatcaatcagtctggggtgttagtcaataccttatcaaacatgacgaagtcaatagccgatggatcaatagctgagcatcaggctgcaggcccagtttatttgcaaggaggtgtctttccaaattatcggcctttgattactgatgcccaaccatctatttaggcagttccccccgtcgcaccatcagctcagccgacggcgacggcatcgactcccttacctgctccgtcagcattggcaccaggccagctggtgaaccctcagttgttaatgagagagcagccacaacatagtgggcaggttgtgaatcggccgacgcaagatcaggttgctgccatgtttctgccgcctcaacctgctgttgatccaatacagcattagccgattcaacagacactcccgagtcagcaggttgtacaaccaatccagcaacaagttgtgtaaccagtccagcaaacgccaccaaggcaacagcctccgcggccgattcagcgaacgccattaagatagcaaatcattcagccgattcagcaccaaggctcaatgagcgcatcggccaggtttgtgacgcctggtggacaacctgtacaacaatttttaaatcaagtcgtcccagaacacttgtttcaccccgtgcagccggatggcacagtaatgcctcaagttgttcccgagcatttggcacgtaatattcagccgaaccttcataattaccagggggcagcttgaattatcaatatcagcctccttccccgcaagcccaatatcagtcagggggactggctcaacctcagtttgcgtctcaatacggtcagttcgagcccatgcaacaatagtcacagggagcagctcagcaacgaccgtgggccgatgtgattgctgatgtaatgagggaacagtttgggcttaaaccaaaagagactggaagcttgtatcggctgccttaccctgagtggtttgagagagttcctctcaacattcagttcaaagttccggacttctccaaatttttgggacaagatggtgtgtcaacttatgagcacattagccgatttttagctcagtgcggtaaagcatcggttgtggacgctctgagggttaggttgttccagttatctttgtttggatcggcttttacttggttttcttctttgccatatgggttcatcaatagttgggccgatttggagaagcaattccacagctatttctacagtggggttcatgagatgaagttatccgacttaacggcgattaagcagcggcatgatgactctgagatagctgcagccgaatgggtgaggagtaaaaaggtcataccgtgccaatgggtgaatagttctagaaaggaagagaagtatgattttgatattactaaagctgacaagatttttgatctgctactccgagagaagcaaattcaactccctgctggtcaaacgattccatcggttgaggaattaagtaaaaagagatatggcaaatggtataattctgggtctcattctactatcgattgcaaggtgtttaggcaacagattcaggtgcccattgaaggaggcaagattaagtttgatgattccaaaaagccgatgagggtcgatggtaacccatttcccgttaacatggtacacacagctagcggaccanttgatacggggcgcatgaggggttatcaagtaagttcggtagaattataaacaaatatcaaaggaaatacgacaagcaacaggaaaagcttcatgaagaagataatggtagctctgatcctcattggggctgtgagttcttcaggttctgttggaatgaaggtatgaggttaccatctatcgaggattgtcctggatgcagtgatgttgcagggggttcaagcccgattgtacgatggaggcaattggccaaaacagacaagagtacttgttcatcatagattgggcccagtaaccaacgtggtgattcgaaagatgatgaaaataagaagactgaatggtgtcctcttagtatttttacgaagaatcagaaaagaagggttcaaagattgaggagtagggaatgcttccagcaggtcgaacaagaaattaatcatcggctgaagaaagcaaaatcgaggcaggagtggtgtgttaagaatcaggctcctgtagccgatgatgttgcagctgatgaggcaaagaggttggcaaaaggaaagagtgttgtgacggcaccagttaacatggtttttaccttgccagccgaattcgggatcgatcaagccgatgtcgacgaggtggaagaggaatcggctaagttggttctatcaccagaacaggcggtgttcgagaagcctgaggggacagagaatcgacatcttaaaccattgtatataaatggctatgtcaatgggaagccgatgtcgaaaatttgatgccttatgctacgttcaggaagttgggtagaaatgccgaggatcttatcaagacaaatatagtgctcaaggactttggtggcaatccatcggaaaccaaaggtgttctaaatgtggagctgacagtcggcagtaagactattcctacaacgtttttttgtcatcgatgggaagggttcttacagcttgttgcttggaagggattggattcacgccaattgttgtattccttcaactatgcatcaatgcttgattcaatggcaagtcgacaaaatagagatcgtactagccgacaggtcagttaatgttgccagtgccgatttagctctttgggagatggatggccttgattgtttatctggaaaagtttggaatggagattttctaaaagtgtccgattctgatatacagccagttgaagttggagaacccaagctattattttgagggcgttgtggagggttcaagtgtctacactaaggatacggtagatgatctcgatgacaagcaaggtgaaggttttatgtcagccgatgatttggaagaaatagatataggtccaggtgatcggccaaggccgacatttattagtaagaatttgtctctagaatttagaaccaagctgatagagctcttaaaagagtttagagattgcttcgcttgggagtattatgagatgcctggactcagccaatcaattgtagaacatcggctacctatcaaaccaggggttaggccgcaccagcagcctccgaggagatgtaaagccaatatgcttgaacctatcaaagctgagattaagagtttatatgatgctggttttattcgtccttgccaatatgctgagtgggtttctagcatagttcctgtcatcaagaagaacggcaaggtgagggtatgcattgattttagagatctgaataaagctacaccgaaagatgaatatccaatgccagtagccgatcagctggttgatgccgtgttagggaacaaaattttgagttttatggatggaaacgcagggtataatcaaatttttatggctgaagaagatatccataagacagcttttagatgttctggtgcaatcggcttatttgaatgggttgttttgactttcggcttgaagagtgctggagctacatatcaacgggccatgaattatatttatcatgatctaatcgactggctggttgaggtctatattgatgatgtggttgttaaatctaaggaaataaaagagcacatagccgatttaagaaaagttttcgagaggcccaggaaatatggcttgaagatgaatccgacaaagtgtgcttttggtgtatcggatgggcagttcttgggatttcttgtccacgagaggggaattgagataactcagagaagtatcaatgcgatcaaaaagattaagcccccggaaaacaagaccgaattggaagaaatgatcggcaagattaattttgttcgaaggtttatttctaatttgtccggaaaattaaaaccttttacaccattgttaagattgaaggccgatcagcattttacttgggggcagagcagcaaaaggctttggataatattaaaggatacctgagttcccctcctattttgattcctccacagaaagggataacttttagattgtatctgtcggtcggtgagaactcaatcggctcaatcttgattcaggagttggatggaaaagaacgagttgtattttatcgcagtcgtcggttcttagatgcagagactagatgttctcctgtggagaagttatgcttatgtttatatttttcaagcacaaggttaaggcattatttactgtccaatgaatgtactattatatgcaaggccaacattgttagatatatgttatcggctccaatattgaaaggaagggttggaaagtggatattttccttaactgagtttgatcttcggtatgagtcaccgaaggcgattaagggacaagctatagccgattttattgtggaacatcgtgatgattcaatcggctcggttgaaatggtgccatggagtttattctttgatggatcggtgtgtaatcatggttgtggtatcggcctagttataatttcccctaggggcatattttgagtttgcttatactattaaaccttatgcgactaataatcaagctgagtgtgaagcagtgcttaaagggttgcaattgctcaaagaagttgaagccgatgctactgaaatcatgggggattctttactggtaatcaatcaattggcaggggagtatgaatgcaggaatgatacgttaatagtttataatgagaagtgccaagaactgatgaaggaactttggctggttactttaaagcatgtatctcgagaacaaaatattgaagctaatgatctggcccaaggggcatcagggtataagccgatgatcaaagatgttaaggttgaaattgcagcaataacagccgatgattggaggtatgatgtgcatcaatatttacataatccatctcaatcggcttctaggaaattaagatataaggcgttgaagtacacactattggatgatgagctttattatcatacgattgatggagtgttactaagtgtttgagtgccgatcaggctaaagttgctatcggcgaggttcatgaaggaatttgtggcactcaccaatcggcccataagatgaagtggttacttcggcgtgcagggtatttttggcccacaatgttggaggattgcttcagatattataaggggtgttaagattgtcagaagtttggggcaattcaacgagcgccgacgtcggctatgaatcctataattaaccgtggccatttagaggttcgggaattgatatgatcggtatgataaacccaccatcaagtaaagggtataaggttatattggtggcgacttgatatttcaccaaggtggtggaggccatttctttgaagaaagtagattctggggatacaacccaatttgttcaagaac

SEQ ID NO: 81711 - DNA, 5481 bp, Oryza sativa
  unsure (1)..(5481): unsure at all n locations
gacttcctggtgtactgtgacgcttcgcgccaaggattggggtgcgtattaatgcagnaaggtcatgtggtagcntatgccacacgcaagcttcggcctcatgaaggcaactaccctacccatgatttggagttagccgctgtggttcatgctctaaagatctggcggcactatctcattgggaattgctgcgaaatatataccgatcataagagtttgaaatacatcttcactcagtcggatctgaatcttcggcagagaagatggttagaactcatcaaggattatgatgtgggaatccactatcatcctggtaaggccaacgtggtcgccgacactctaagtcgaaaaagccattgcaacactcttggcgtccgtggcattccaccggaacttaatcaacagatggatgccctgaacctaagcatagttggtcgtggattcttggctacgctggaagccaagcctaccttgctcgatcgaatccgtgaggctcagaagaatgatccagatatgcatgggatcctcaaaaatatgaaacaatgtaaagccgctggtttcatagaagatgaacatggaaccctatggaacggaaatcgtgtatgcgttccggacgacaaggaacttaaacacctgatacttcaggaagctcacgaaagtccttattccatccaccctagcagtacgaagatgtacttagacttgaaagggaaatactggtgggttagtatgaagcgggaaattgcagagttcatggccctttgtgatgtgtgccagtgtgtcaaggcagagcaccagcgaccggccggacttctccaacctctccaagtaccagaatggaaatgggatgaaattgggatggatttcatcaccggacttccaaaaacccaaggaggatatgattctatatgggtagtcgtggaccgactaaccaaggtagctcggtttattcctgtgaagaccacctatggagggaacaaactagccgaactctacttcgctaggatcgtgagtctccatggcgttcctaagaaaattgtatctgatcggggaaaccagttcacctctcacttttggaagaaactccaagaagagttgggtacccgattaaatttcagcaccgcgtatcacccgcagacagatggacagaccgagcgtctaaataagatcctagaagatatgctccgtgcttgtgttctagatttcgggaagacctgggataagagtctcccctatgccgagttctcctacaataacagctaccaagccagcatacaaatggcaccctatgaagcgttgtatggacgcaaatgctggacaccgctattgtgggaccaagttggggaaagccaagtgttcgggactgataacttgagagaagctgaagcgaaagtcagaaccattcgggagaatctaaagttggcccagtctcggtagaagagttatgcagacaaccgacgccgtgacctggaattcgcagtggatgactttgtctatcttcgggtcacgccgttgcgaggcgtacgtcggtttcagacgaaagggaagctcgcacctcggttcgtgggtcctttccgtatcattgctcgacgcggagaagtcgcttaccagttggagctgcccgcatcattgggcaacgtgcatgatgtgttccatgtgtcgcaactcaagaaatgtcttcgagtgccatccgagcaggccgactcagagcaaattgaagttcgcgaagacttgacctacgtggagagaccagtgaaaatcttggacaccatggagcgcaggaccaagaaccgggtaatccgtttttgcaaggtccaatggagcaaccacgccaaggaagaagctacttgggaacgtgaagacgagctaaagtcagcccatcccgatctcttcgccagttcttccgaatctcggggtcgagattccgtttaacgggggtaggtttgtcacgtcccaaaacgtgtaaataaatttcctaaaagtcaattaaggcttagaggatttttgtatatttcctaaaagcctaaaatgtgtaaataaattttagtggaattctcagagcacaaataataattattaagaaataaacaaagttaaaatgattttataaaaagaaaaaccctaatgggccgaattcggcccatctccctccccctctctctcctctccccgcggcccactcggcctctccctgcgcgcgcgccgctgacgggcaggcccgcccgccaccctcgctgacgggtggggcccacccgtcatcccctttctcccaccgctcccgccgcctcccccgcaccctagcgccgccgccgccgcgaatcccgccgcctcccgccgtccccgcgtgcaataaagtggggggaatcactccccgtgatcccctctcccattccacccaattttgcatccctctctcccttggattcgtttggaaaccctcccctaatcccgccggcgccattgatggagcccgagagcgccacgccggtttccttcccctccggccactctctccctcttccaaccctatttaaaccctccccgcacctccttcgtccgtttctgcctctcgccggccttcctcctcgccggatttgagctcgcgacgtcactctctctctccgccgtcgccgccgagcttcggtccgccgccgtcgtcgccccggaccgcctcccacctcggcgccgcctccttcgggttcaccgcatcctcgccaacctcgtccacctctccgtttcggtcgccaaccaccggagcgccgccgacgccatcgacccgagccgcgccgccgcctccctccactccggccgcctcctccgtcgccgccgtcgacctagggtgagccgtggaccgtcgcctcctttcccccttccctcccctctctcggccgccgctccgccgtgccggtggtcgccggcggcgaccatcggggcgcgggcgcgccgcctcccgccgaccgcgccagcgtggccgccctcgtgcgcgccgagtggctgccgcgtggggcccggccgtcagccgcccgcgcccttgggtgcggctgacacgtgggacccacggcgccggctggtgcgagcccaggtgcgcccggtccactgtgggccgtgaggctgccgcgtgggccccactcccgtggacccggtccgcgcgtcccctcccccttggctgacgcaataaacccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttctttttcgttggtcgtgtagatgctgcagcttcggaagatccgctcttcgtggaggttgaagccgacgtttgggaaagcgagcaaggcaagtcacatcatccttgagcatattgaatcctagtttataaaattattttgatttaaattattgcattatcgctttacttaaattcacgcgttatcactgttttatctagccatgcctatttacctttgttatgaccttattattgttattgttattattaccttgttcaccctagattaaaccaaaccccaactagtggacactctactcatggtaccactagtatgcttttaggtagatgcttcgctggttaattaggcaacattaggtggttttacaactctagactttgggagtattctcatcacctggacactatggaattgttggatcattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggctggtgtcctgctgctaggggctcagtcctgcctacctgtcccgggggttccgcccgtaggtggggttgggtcggtactcttgtctatggctaggatgggttggaaactatgtcacgtcttccgtccgtataccatggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggaccgtgtttacaaaatagctttgagcaactaagtgtcttttagtgtagtttactgcaaaccctaaccccctatattatggctcccttgtactcccttgcatttattctgcacttgtggttttgtcttgttgagtacggtggttgtactcagtcttgctcaatttttcccaaacccagaagaggagcccctggaagataaaggcttttgtgtctagctcgtgcctgccgtcaagcgcctgtggtcgtcgccctagtcttccgctgtttttcgtttgtcttcttgtgtgctgggccttcgctgcccatgtaataaattaactatgtacgcttccgcttgtcaaactctgaattgtatcaacttttggtgtaccttgcctcctgggacaaggaataatgcacacacataaggaacgcccgttgggttatttccggtcgtgacatttgccgatgtacaatagccgatattgttatatcacccttagttgttttataattttatcaatgtttttgtcattgtaaaattaggggggcacatatatatcaaaagcatgttgacagaaaacacgaggcctgggagatctgcttaaatccagtgctggtccaaagctcgccttcgaatgtatgagcgtgccagttgatttgatcctgtaatcaacaagaaatagaagcaaagaaaccgcagttaaatctataaatgatagccgatcggctaggtgccgatgacatatcatttatctttgagccgatgtcatatatgcatcgatcggcagtcattaataaataagaagggactaaatctactcgattggctgtagatattaacaatatataatcattatatcgatatatacttaaatcaagtgattgggatagatcggtcgccatgccgagacagaataaatcacttagatcggggctgc

SEQ ID NO: 81712 - DNA, 6731 bp, Oryza sativa
cgacttcaccatgtttgacaaggtattgactagtaccccagactgattcttggaagttgttaaattgtatatgtgcagtgttaccatctgggctgagatcctcatctttcactccctgagaacaatcacccttatcacctgagccatctgcagcacttttatcacctaattgagctgtagcatctgaaacctgttctacctccccatccttggaagaacttgtcctaggaacatcagcaactaatttcatcttatacctctaaacaattgttccttggcgggtctccatgaatgagttcaagaattggttctgtgtttgctgcatcatcgcctcgagattattcttttgttcaagtgtcaatttgtctatagtgacgggcacgatgttgctttcatgaacttcggacccaccaagcttcgggatcctagatttgggaggaccctcttttgccagccgaagatggcgatgctggtggtttcttagcgatgagagaatgctattgcggttctgacttctaatctctcccactgggcgtgccaaaagcgtgttgacataaaaacatgaggcctgggagatctgcttaactccagttataaggttatgtctaagggagcatatatgttgcaagggcttgatggtgaagtctatgggcaagcgctcaatggcaagtatttgaagaaatattacccaagtgtttgagttaacgcatgatcggctagtattgccgatgcatgacagccgatgtgtttgcatcgccttgagatggccgatatggttatatcgcccttagttgtttttcatggtgtaatcggttgtggtttgccgatgtacaatggccgatatggttatattgcccatagttgtttttcatggtgtaatcggttgtggtttgccgatgtacaatggccgatattgttatatcgcccttcgttgttttataattttatcaatgcttttgtcattgtaaaattaggggggcacatatatatcaaaagcgtgttgacagaaaacacgaggcctgggagatctgcttaactctagtgcaggtccaaatctcgccttcgaatgtatgagcgtgccagttgatttgatcctgtaatcaacaagaaatagaagcaaagaaaccgcagttaaatctataaatgtagccgattggctaggtgccgatgatatatcatttatctttgagccgatgtcatatatgcatcgatcggtagtcattaataaataagaagggactaaatctactcgattggctgtagatattaacaatatataatcattatttcgatatatacttaaatcaagtgattgggatagatcgatcgccatgccgagacaatataaatcacttagatcgaaatatatattaataatgagtctatatacgttcatagcataaccgatcagatagatctagcatgtatcggctaatactccgataccactctatattaagatattaaagcaagtagaatatactaaacaaaagcctaatatacttaaatgcagcaagatcttaacgtaaagggcagatttaacatgtcaatcaagcatataggataaaaagtagttaaatcaggtaagatcggctgaaactccgatactaccctaatcagcaaccaagaagcgggctagagattgagattataatcacgactcataagatcaaacttaactgatgcagctataagtatgaaaagaaggacaatatctagacaatcaagccattggatgtgtcatagagtggtagatatcctatataatctaagtcaacattggtatttaacctaatcggctgccttctattgacggatgttggccgattgtaggttagatatcgatattgccaaggattatgtaggatatatgataactcgacgaaatacataaacaagattagagtgtcataaagatggaagcactaatcccaagaacgcaagccgccataacaagttttacctcttgttgaagatcgaaaccgatgcagctcaacccgaaagcaagaactcgtcgaaataaaactaaagcaaaaaggtagcgttgcgccgggattgtattgaacgtgtgtgttaaaagtaacataggactcgggtctatttatacccaaaaatcacaagatatgtccataacggacacgactactatctctaagaaactctaagataccataagtctgtacggcagacttttgcccaagcatatctccaaggagattacataaaacatcctaattaatagatacaattgccttctcaggactctatccatgtgcggcaatcacctcgaagcgccttaattcaacccgatatcatacatcagtatgcattgtcaaaatcggctgcatcggcttacctagcccgactcagacccagccgatcctaatcgtagccgatctggactccagccgattcctgttctatttctgaactcgatctccgcctccaactatgcttcgatctaatcttctttcccaatgccgatattacaaaatttggttgttaacacatgccccccaagtccggaatatttgataatttttcggatttgctgtaaatcgactctgagcaagtttcgcactttgccgttttccgaccattactgccgtgctttaaatactaaccattaccctcgagaaatctcacaccgtcctcctccgttttcaccgctgaaaccaactttgccctctttcgctccggcgatctccccaatgcacaaggcgatccctaggcgatttcgttcccgactagatctccgctcggggcgatgtcgtcttccaccagcccttctaatgcaccatcgggcaagtacgctgaggtaagtcctcaccagctagatcccttttcctctcatgaaattgatttctccttttcttctcatgttttccgcatcccgattcctttggatttgcagcacctttccaacctagtcgcgattcctagcctttcacacaaaaaccactattttcttggcccattcggcaatctcgaccccactgatttcatcatcggtgaaaccaatcggatcccctttagactagccaaccctaacctgggtcactggaagaatacattcaagtcttggccatctctcgaaaaacctactcctgataagagctagaccacctggtaccaacgcgtatcggctagtaagaaagttcactgggatgaaattggaatcggccaagcactcgctttcaccatagccaattctgctaaggatgaacctctgatggctgccgccacctacttctggtccaacaccatcaatgctttcttattcaaccaagggccgatgactccaactttaatcgacatcaccatgattactggattagatgtaacttcatcggctaaccctatgagtatgaacaccaagaaccaatttgacttgaagaccaaaagcataggtggctggtctggctatgtggcggcatatatgggccaagggtctgttacccctcgagagcatgtagctttcttgctgatgtggctggaaaagttcctcttttgtggatccagttgtggccctacaaccaactggcactctgtagctgaagccttagaatcaaagaaagaatttcctttgggcaaaatccttctcggctatctgtaccagatattgaacaatgcatctgctaaaatagccgtcggctcaatagttggagcaggtggaccatggtggctactgccaaacttggttaaacctgatagtcatgaaggttgtcaatcggccctctgtgacaaaagctgaattcccattgccagagccgattgtggaagatgacggagaagagcgcacccatcgcagatgcatgtcatatggagaatatgcatccacaccaaccgatgctggagcgaagctatcggctgagctactcaaggactggttctgcagcttctacgaaggttttaagaaagatgcacgaatctggtttccttatgaagactcagcagaccttgaacttccatcagactttagatttgaagacattaatcatgaaaaattccaaaaatccagagaaattcttatagctgcaatcagcccatgcatcttctctgtcggcattcaccatgggagaaacatccaagtctcctacgagttttatcacccacttggattgggccaactcccaatcggcttattctttgccgacaagattcagtgccgaggacaaatcacatccactctaatgatggatcggctacttaacctaccaggaccccctctgggcagtattgataatattgagttggcaggatttagaagcaaaaactttgacagatggtggggtaaatggaagatgcatctattttatcaatcggcttcaatgtatatgacagatctattccctgacgtcataccccaggtaaactttgtcattaccaaattgcataactagttagccgattcattacttgactaatctcttgctcctgttttgcagacaacagagtcctcccctcctcatcaaagtaatagttgcaggaacattgaatatgcttcaggtttaattctgaatggaggtggactatctcccccttttatcggctaccatgcccccaagacttcaactttccttcacggcctaactagggaaccagccgatgcaggcaagaaaaggaaaaccagatcatcagccatgagtaccttagccttggctccaaagaaaaagaccaaattcaagaaaactcaaccacaaccaactgatatgtcgactgatgatctgcccgccttggatccatctattaaacaagctttagatgaagaagaaattggtgaagatgttgaccaagctgtagccaaaatgagtgacacagaaagaacactatcggctttacccaagcaaacgcctccaactccttctgcccccgtttattttacataagtaagtacctctctctttggctaattacccatagactttgtggttgcagaagaagaaaactactgtgaagaaaaaaccagcagcaacaattgttaaatcggctccaccagtaagatgtccttaattcctttacttaatcaatctcaaccgattctatataacacttgtctatttcgcagcctcctcctccttctcctcctgtacagcaatcgtcaagtaatcagactccatcggctgtggggagtcatcacgtcgaagaggaagaacaaccagctgcttctgctatcccagtaagtttccctttgtctcaacaattagatcagctataatttacccagctcttattctttccgaaattgcctctgcaggctctagccgatctcttctcttttgacatcagagattaccttgatgaggcagaagaagacacttcaagcaaagccctagctcccctatccgatgatgtgagaaaaacacttgaagacatctctcatcggctagaagcctcttctttagacaatttggtagttgactttgggtcaattaggacgcggctgcatgaagttcaagctctgattcccgaagatctggccgatgtcctaactccagccgtttatctcgagcaacatcagttcaagctggaaaaagccaagctaagactagccgaacgccatgagcgcaaagagattaaggccataatccaagcgaattggcagcttgtgcatgaaaaaaaaaccaaacttgatcagctatctggaggtccaatcaaatccaatattgatcggctcgaagctcgcaagattgagctcttggcgcaacttgaagaatgcaatgccgagctagatatggaacacagaaatctagccgatctcccaaaatcaattgaagaacaaaaagcaaggctcaaatcggctatcaaaaatgttgctgacctaaccaagtccctgaaagtcatctctggaactgatgctcaagatgcccaagctattgtagaagtagaacaaattaggcaaaggcctattttggctatccagcgatacttgtctcaataacttttgtgtaataggactcagaaattttttgtaatcagctaagatgctctagtactttactgtcctgaaaatcctttgtgccgattaatatgactttgaaattcgctaaaaaaatttgcctcaaaaaatttgcattgcattttgatatatatgtgcccccctaattttacaatgacaaaagcatggataaaattataaaacaactaagggcgatataacaatatcggaaattatacatcggcaaaccacaaccgattacactatgaaaaacaactaagggcgatataaccatatcggccatctcaaggtgatgcaaacacatcggctgtcatgcatcggcaatactagccgatcatgcgttaacccaaacacttgggtaatatttcttcaaatacttgccattgagcgctcgcccataaacttcaccatcaaacccatgcaacatatatgctcccttagacacaaccttataaatttggaacagtccttcccaattcggcgaccacttgccgaatttactatcacgagtaccaatcggcaaaatcaatttccatataagttctccttccgaaaaatctttaggtaccactttcttattaaaatgccgagcaatacgttccttatccttggtaacctttgcaagggctcgcaatcgtcactgaaccagatcctccctctcatcggccataaggttgtaatactcataagctgttaaatcattttgtaattccgttcttcgagagccgattctaacctcccatggcaaaacagcctcatgcgcataaagaag

SEQ ID NO: 81713 - DNA, 15367 bp, Oryza sativa
ttgggaaaataaacaaatttttgaaattagtaaatttgtcttgaacaataagtgttaaaaacaaaccaggggttaatcttggagattattagtgcggtatttctctttagctatattttccagcaatatccaattattaacctcgctcattttcgaaaaagaatattgtatctatactattaaaatttgagtaatattaattaacaatataaacaaactatgtctacactataccctaaaacaactcagaatataaaaaacaatttattttcatcaccttcatcttctctttgtccttttttgaagggcatcatgcatgataatagagcatgctatgcaatcataagtatagctgggacatacatatagtgggctgagatagtctcaatgagaggatacctttggcaatagagctcaacttcctacccaggagacaattctctatgagggcacctataattaattaggcattaaaattatgctccacgctggtctagagaggcacggctatgagaaacccatatctcacggcagcagggaagaaagccttggcgcccgcggtcaacttcacccactacacgaatattcttatctaatttaacgttgttatcctattaattgatagaagaggtattgttagaatatttatacatagatttggaaagaagtgagacatggacactcatctaaataacatagatgattttttagttaactaataatgtattaatcttattgtaatggtatgatgtagtttgatctattaaatatactctcaactttcaaaatcaatgataatgataataagtatccactaaaacaatacaattgtcatgagaagaggtgacaatagaaaagtgatttttattttaaaattaggagacactcttatgatctagtatttttgagacggtatagatgtttttttattataagataatatataatactctacaatgaatatggcaagttgatttattttattattcttttcatcaataaaaaataagatgccaacctttttcctagctagaaagaaagattacaaatgatttcttataggcatgaattaaatactaaataatttcaagttaccaaatagtttggaaaaaaattaccgagcgatgctaatgaagaaattttttgaagaaattgtacttttgaagcatggcaggtatcatctggttatattccacttatataggtttccaaaacacaacatgctatacatgcccgcgcattgcgcgggctaccttcctacttattttggaattacacttaaaggcatttatgaatggcaacctatcctattcagacaaatttcaaatgctaatcgccgtggccaccaactttacaaaaagtaacaaaataataataataataattgcacactatcaagcacctacgtataaaagtttcaaccctaaatttgtgttggtacgcagagtgaatatactcagtgatcttttattctttaattaccttttgcagttgagaagacacagatggggagagttgggaatccggtaacagtcgatatgccagagatattgacgatgttgcccttgccggaggccttgaggagagggtgcaccagctggcttaggtggaagcatgactccaggttgcccgccatcacactggagagctccttcggtgtcacgttcaccgctggttttaggaagaagaagccgacattgttcacctgtaggtaatttaaattaagtcatatctaatagcgatcgattgcctgcatttctagcagatttaatccatacttgcatgcctaaattatttacccttcttttgggagtgtttggtcgcttgatagtggtaagaccgggtcaaaagaagaaatgcccaggctagcatcaaccagatgtgagaatacaattgtgacttgtttggttgtttagctatggtaagtctgtatatgtttaaagaaattttatagccgtgaaaggtataaaaaaatttagtgtaaatttagtacctcctaataccgagaggtccaaattttacagtagaaaatatgatatttttcggtaccttctcatagactataaactcactcatatgtttaggatgttgtttgattaattgcaccggagatgttgaataagtagtataagaaaaaactattagaactagtttagctgtctaagaacaatttaatatattttttttgaacgaattgcaccggacgatgcaagttttatattaacaagattaccaatttgggaggcaataatcaggaaaagggaaaaaacaccaaagcaataccaacacatgccaactgcacctgcacacactccccggaaaggatctagcatcaagccggcctccgctatgcatgattggatgccgctagccccacgaaggggtcacaaacgacctttctaagccaactccaaccaaaagatccccccataggctctgagccatcgccacgtagaagggttgccaaaagagagggcgagagagaagaagatccactcctcccacgagcaaaccggatggcaacatccaagaatgttgtcgaagactgaaagatcgaatgttggataggcaacagagccgcccatccagaagaggacttggttttcacccgaggtcctgctagagggagaggtaggcctctcaacaacgcccttaggagggattgaaacgttgaagacattgtcgttgtttgcccagacaaggtgtcaagcaaggctttcgcctatagccgatctcctcctcctgttatgacaccgacgtcctgccaccgtcagacctctgctagcatgtgctctctaccacactgatgcccctccgtcgactggccatcgtcgcaccgggagcaccactgcaccgacgaccctcatcggctcctccgcacgccgaccgtcccaattctacaacatgaagcaacgagggaggcgagtagaacacctccagtgctaggcaccaccaccatctctacgctagagctctccacgaccgtatctggagacagaacggctaaaggagggggagcactaggggaagaaggggcatgccaggcaaagaggggagacccatcgtcgttgccaattttgtgccgccaccatagggtccagctcaccgtcacccccggcctcccactgatacccacgcgcgcggcctcacgcacactgccgtccactgcagctagctgctccgtcctcccgccggcctctccctcctggtggctatacgcatggcccgcaccgctactgcccgcccgctaccgccatccgtgcccagcctctccctcccagcagctaccatcgtgcctctcattgccttcgccccccgctgctcgaccccagctagatccgacgcggaggcactagatccagccgtaggagcatcagatttggtcgcggaagtgccggatctgccacctccctcgccggggaggatgtgccgctgccacctccaggtctccggttcacaactcgtcacgctgcctctcccacgctcgagacagggcgcctctacgataaggcccctccaccgccatcctggctcatcgcccggttctccgacgacacgctccggcggcagcgaggtggggggatggggaaggtgcggcagtgggggctagggttttgtccctgagtcgcctaggcgtgggtgacgcgagagcctagaacaatttaacacatactacctctatcccaaattaattgtgattctaggttgtttagtgttggaggcatgccatgaagcccttcgaccggacctgccgaaactatagtaccagcaaggattcaagccaaagatgtcaaggccattcaggcgaagccctatggcgaaagccataagcgaagatggcgaaggctggaaagccgcgtcggtattctgaaagtaaaggcatctcgggtgaaggcatcttcggcgaactacaaagacttcgccatgacgagttcggcatcaaggaggcccaacaggccgcccctggccttttaagcccgtttgccatagaccaggcccagcctatcagcccattaaaggcctatatgtgcaaatgacactgcatacccatgtaaatgtccctttcataagggcaaccatgtaaaatcccctgtaacactaaaccctagaaagtgcaagcttgtgctaaggctataaataaacctctagggccatgtaatggggggatccccaaaaaatatttcacgaatcaatacaattgcttttacattccaactactgttgagagaaccacgcctttcgacatggcatagttgtacattcgacaacagctggcgccgtccgtggggaacccagaccgaaaaggcgaaatgggacccctttcaccacaccctttgccacagtacccgcgtggtacggcgacaagggctgggggcgaaagtgagttaagtccaagttggggggctacgaagccgcccaagcctctggacacctttcgccacatgccacgcccttcgccatagtaccaataaggcacggcgtcaagggctgctggcgaacaggtttcgccaacccacgcccttcgccatagtgccaatatagcacggcgtcaagggctgcgggcgaacaggtttcgccacacgccacacccttcgccatagtaccaataatgtatggcgtcaagggttgggggcgaatataagttgcttccaagctggggggctacgaggccaccctagcctctggagcctttcgccacacccacacccttcgccacagtacccgcgcggtacggcgacaagggctgggggcgaaagtgggttaagtccaagctggagggctacgaagccgcccaagcctctgtcgcgaccgagaaaaatacattttcccaaatgctagtgtattaatccccgtcccaggaaaagccgaggtacaccacacaaacatgatacaaaaggcacatctttattatatcgataatatttacattattacaaaggcacttaaggcctgacaatcaaaaataaacagcagcggactagcgggcctacggctccatcttcacaggtgctcaactggggtataatccaggactccacctaagacttcttctccaaagcttctcttactgaagggggggaaagattgagcaagaatgagtacaaccacagtactcagcaagccacaccggcggatgcatgattaatacaagggggtacaaggggtaataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctaggcttgcccataaccgagggcgcggctattcgaataggttttactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgaacccctagcagcaggacaccagccctgtgccatgacatctcgactaccgagccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcctgagcttaatccttatagtacccgaggtacgactaacaaaacccaaccacgcacctcgagcccagcctaaaaccattttgggggttttgaatagagggggaggtgtgtgtccaattccatcataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttgtttatcctagggtgaacaaggtaataataacaatagcaataataataaggtcataacaaagataaataggcatgactaaataaaacaatgataacgcgggaatttaaataaagcgataatgcattaatttaaatcaaaataattttataaactgggattcaatatgttcaaggatgatgtgacttgccttgctcagagagaacggccttccgaaccttcggcgacgaccacaaagcacgcttcgggaacctccggaacgacagaagctacgcgaagcacacaagcaaagctacaagcctataaagaagcaataacaatatataaaaagaaagcacacggttctttaggttataacaaacattaagagacttgaacgggtcgattcggagctcgtatgaccaagatatgatcatccgaagtttaatgctgttatatggagatttgcggattattataattaagctttgcaactataaaacatatggaagcgctagcctggaaaagacaggaaggctgcgctgttgacatgcggaccccacatgtcaacctaaaggaccgcggtagaccgagtacacagagacggtccacgggtcgacggaagcggaccccgtgtgtcaaccgaggcgagtggccgacaaacggactccactagacaccacacgggctgcacacatggaaaccacgcggctactgagcggacacactaacacggacactacacggtcaccacccgcacacgtgaacgactaccgacaccggtacacaggtaccggggtcgacaaccgcacaacgggtacggggcgacaccgaaaggacgaggacggggcagcgagaggagagatccttaccaccacgcgacaaggcgtgggaaagacaacgacgaacgggtgcggcggagacggacggcgagggaacgacttcggcggcgatccttgaacgaaggcgagacacggccggcacgaggcttgacgacgcggaggcgaggacgaagacgatgatggggctgcggcacttgacgaagcgaggacgacgaacgagaacggctggacggagggacgaacgccacgacgaccaggaacgacgagagggcgacgacgacgacgaccggggccggcgagaaagcgacgagggcagccggcagcggctgcacggagacgaggacggcgcggaacacgccgctgcgatgccgacgacggaggcggcgccgcgagacgacgagccggcgaggaggaacgatgacgacgacgacgaacaccggcggggttcggtcgaaggggagacgaggccgagggtgaccttgccgctgcgatgccggaggtggtggtggcgcagcgagccgatgagccggggaggagggaggggcggccgaagggacgccggcgacgaagaggatggagaggccggcgcgggcgacggcggtctccgaacgaatcatagggtaggccggggtggaggtcgacgcggcgacgccgagggaggagacggcgcggccggcccgcacttgagcggtgcggcaggggcggctggaggcagtgggtggcggcaatgccacccgttgccggtggggacgcgcctccggcggtcaccgcgcgaaacggagggcaggccggggagaggaggcggctgcgacgccggggaaggcggcggcacggccggccggcgcacgggtgaggagggagaggcggctggaggcggttgacgtgggggaaagagaagggcgacgacggggaggggtgatacgaccacggggaggctcgggatgaggctaaaacgagagaacggagcgagggggttccgttttataggcgtggggagggagctggccacgggaggagcggggaacggtggcagaaaaggcgcccggcggccatggaaggcggccatgaatggcgcagccgttccggtcaaaatagtgcacgattaaaggggagattagggggaaaagggagaggaaggaaaggggattaattccccccaattaattttggaatccaatgcttaaatcgtgcggtttcgagggaggaacgaactagggttttcacgggagagagaggaggccgtgcgggaggaggaagacgaccggcgcgtgggccccacgcggtcagcgcgcgcagtcagcgcacgcgcggcgcgcgtgcacgcggctggcttggctcggcctggcttgggccgggctgctgggccgaggcaggccgagaggaaggaggaggagggagtgagctgcccgggaggaaagagagaaaaacaaagagaggggagagggatttggactgtgggccgagggggagagagggagactttgggccagacttggcccaaagggaggagggggattatttttagctttttctttttaataaactttgttaattgttgttgtttaataaatattttcggtgctctgaaaattcaagtaaaatttgagggctccttttagaccaaggagaatttaacaaaaattctccggaccacattcgaatttttctagcaggtattttagtgtttgtcaatttctttttgaattttaattaattctattattccttttagaaaataatttttatttcgggatgaatttatcagggcgtgacagcctctgcacacctttcgccacacgccacgcccttccccatagtaccaataaggcacggcatcaagggctgcgggcgaacaggtttcgccaacccacgcccttcgccatagtgccaatatggcacggcgtcaagggctgcgggcgaagaggtttcgccacacgccatacccttcgccatagtaccaatgaggtacggcctcaagggttgcgggcgaggaggtttcgcccacccacgcccttcaccatcaaaccaatgaggtacagcgtcaagggttgcgggtaaagaggtttcgtccacccacgcccttcgccatagcgccaataaggcacggcgtcaagggctgcgggcgaacgggtatcgccaacccatgccctgcgccatagtaccaataaggtatggcgcatggccttgcaggcgaagaggttacgtccacccacgcccttcgacatagtgccaataaggcacggcgtcaagggctgcggacgaacaggtttcgccaacccacgcccttcgccatagtgccaatatggcacggcgtcaggggcagcgggcgaagaggtttcgccacatgccatacccttcgccatagtgccaatatggcacggcgtcaagggctgcgagcgaagaggtttcgccacacgccatacccttcgccatagtaccaatgaggtacggcatcaagggttgcgggcgaacaggtttcacccacccacgcccttcgccatcgaaccaatgaggtacggcgtcaagggttgcgggcgaagaggtttcgtccacccacgcccttcgccatagcgccaataaggcacggcgtcaagggctgcgggcgaacaagtttcaccaacccacgccctgcgccatagtaccaataaggtacggcgtcatgggcttgcgagcgaagaggtttcgtccacccacgcccttcgccatagtgccaataaggcacggcgtcaagggctgcgggcgaataggtttcgctaacccacgcccttcgccatagtgccaatgtggcacggcgtcaagggctacgggcgaagatgtttcgccacatgccatacccttcgccatagtaccaatgaggtacggcgtcaagggttgcaggcgaagaggtttcgtctacccacgccctttgccttagtgccaataaggcatggcgtcaagggctgcgggtgaacaggtttcgccaacccacgcccttcgccacagtgccaatatggcacggcgtcaagggctgcgggcgaagaggtttcaccacacgccatgcccttcgccatagtgccaatgaggtacggcgtcaagggttgcgggcgaacaggtttcgcccacccacgccctttgccatagtaccaataaggtatggcgtcaagtgctgggggcgaaaataagttgcttccaagctggggggctacgaggacaccctagcctctggagcctttcgccacacccacacccttcaccacagtacccgcaaggtacggcgataagagctgggaacgaaaatgagttgcttccaagcttgtcacgaccggaaataacccaacgggcgttccttacgtgcgtgtattattccttgtcctaggaggcaaggtacaccaaaagttgatacaatatagagtttaacaagcgggagcgtaactagataatttattacatgggcagcgaaggcccagcacacatgaagacaaacgaaaaacagcggaagactagggcgacgaccacaggcgcttgatggcaggcacgagctagacaccaaagccttcatcttccaggaactcctcttctgggtttgggaaaaattgagcaagactgagtacaactaccgtactcaacaagacacacccataagtgcagaataaatgcaagggagtacaagggagccataatatagggggttagggtttgcagtaaacagcattaaaagtcacttagttgctcaaagctactttgtaaacacgatcctagagctatgcaatattattaatcaaggccgtgaacccacacgaacctgccttaacccaaggcctacgatgattcagatcgaactggcaacccaaccctgggtcccagctcgtcccaagccaacccaggccaaccattccacattttagttgttaagcaggttttatgaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccagccctgtgccatgacatctcgactaccgggccgcagctcatgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccaaccattccatagtgtccaggtgataagaatattcccaaagtttagagttgtaaaaccacctaatgttgcctaattaagcagcgaagcatctacctaaattcatactagtggtaccatggatagagtatccactagttggggttttatttattctagggtgaacaaggtaataataacaataacaaaaataataaggtcataacaaaggtaaaaaggcatggctaaataaaacagtgataacgcgggaatataaataaagcgataatgcaataatttaaatcaaaataattttataaactgggattcaatatgttcaaggatgatgtgacttgccttgctcgctttcccaaacgtcggcttcaacctccacgtagagcggatcttccgaagctgtagcgtctgcacgatcaacggaaagaaaaaaggcttttactctaataaactccatataacaagcaggaacaaagcacaaaaatgggttcttaacttcttaaggaaaaattagagacttgaacggtccaattccgagttcaaatggccaagttatggccatttgaagttcatatgctctttaaatgaatatttacgaatttcttcatttaaattttaatttaaaaatggtttattgcgtcagccgaggggagagggcgcgcggaccgggtccatgggagtggggcccacgcggcagcctcacggtccacggtccacggtggcccactcggcgcgcccgagtgcggctaaaccggcgcggtcggcggaaggcggcgcccccgtgccccgttggtcgccgccggcgaccaccagcgcggcggagcggcggccgagagaggggagggaagggggaaaggaggcgacggtccacggctcaccccggggcgacggcggcgatgagggaggcggccggagcggagggaggcggtggcgcggctcgggttgatggggtcggcggcgctccggcggtcggcgaccgaaacggagaggtggacgaggtcggcgaggatgcggcgaagccaaaggaggcggcgccgaggtgggaggcggtccggggcgacgatggcggcgtacaagagctcggcggcgacggcggagagagaaagcgacgtcgcgagctcgaatccggcgaggaggaagggcgccgagaggtgtaaacggacgaagaaggtgcgggaagggtttaaatagggttgcaaggggaagagagtggccggggaggtagaaaaccggcgcgggaggtccggccgccatcaatggcgccggcgagatttgcgggggcaaatccgtccgtttgaaaccgagagagagagggaaaaatggggggaaaggaagagggaatcacggggagtatttccccccactttattgcacgcggggacggcgggatgcggtggattcgcggcggcggcggcgctagggcgcgggcgaagcggcggaaacggcgggagcggcgggaggtcagggatgacgggtgggccccacccgtcagcgagggtggcgggcaggctcgcccgtcagcggcgcgcgcgtggggagaggccgagtgggccgcggggagagaagagagagagagggggaaggagagatgggccgggccggcccaagggagggaagggggacttttagggtttttctttttataaaaccttttcaactttgtttatttcttaataattattatttgtgctctgaaaattccactaaaatttatttacacattttaggcttttagggaatatacaaaaatcctctaagccttatttgacttttaactttgcacattttaattgttggaggctttcacaaggattttaattattctagccataatttaaaggatatatttttgggtcattttgggacgtgacattgagcatcacttccagaaatgatcttttgggacttggttaggtcagcgacattcttgatagccgatttaagccttgctttttgctcttcgacagattttgggagatcggctagctttttgtgctccatatccaattcagcattgcattcttcaagctgtgccaagagatcgttcttgcgggcttcaagccaatcgatattggatttgattggaccttcggatagctgatcgagtttgactttgtcttcatgcacaagctgccgattgacttggattgtggcttcaatctctttgcgctcacggcgttcggctaatcttagcttggctttttctagtttaaattgatgctgctcaagataagcggctgcagttaggacatcggccagttcttcaggaattagagcttgtacttcgtgcaatcgtgtcctaatcgatccacagtcgaccactaagctatccagagaagaggcctctagctgacacgagatatcttcaagtgttttctttgcatcgtcagataagggagctagagctttgcttgaagtatcttcttctgcctcatcaagataatctttgatatcaaaagagaagagatcggctagaacctgcaggtataagtttagaaagtttgagagctaagtcaatatagtcgatctaaattcttgcatcaaaggaaaacttactgggatagcaggagcagccgattgttcttcttccacaatatgatgactccccacggccgatggagctcggtcactcgatgattgttgtacaggagaaaaagaaggagcaggctgtaaaaagacaagtgttagaaaaaatcggctgaaatcaactagtaaaattgagagtgtcttactggtagagctggtttgagaattggagctgccgatttcttttttatagcagttttcttcttctgtaactacaaaacctatgagtagttggttgaagaataatgattataaaagggtttgcaaggaaagatgttttactctgaagaagtgagtgggggcagaaggagttgaaggtatctgcttaggcgaagccgatggtgttttttcagtatcacttacttcggctgcagcctgatcaacatcatcctcaatatctttttcatccacagcttgttcaatggatggatccaaagcaggcatgtcgtcggttggcttggttttcttagacttggcctttttctttggagctagagtcaaggtgctcacaaccgatgatctagttttccttttcttggttacatcggttggttctctgatggcgccttggaggagggttgagaccttgggggcatgatagccgatgacagggggagacaattcgcctccattaggaatcagacctggggcatattcattgttcctaccaatattgctctgatgtggacgggaggactctgttgtctgcaaaacagggacaaaagattagtcaagtaatgaatcgactaaccgttatgaaatttagtgatgacaaagtttacctggggtatgatgtcagggaatagatctgtcatgtacattgtggccaattaataaaatagatgcaatttccattcaccccaccatctgtcaaagttcctgctcctgaatcttgctaactcaatattatagggtaatagaattcgtaggagacttggatatttcctccttggtgaataccgacaggtaggatgcatgggctgattgcagctgtaaagacttccctggacgtttgatatctttcatgattgatgtcttcaaatctgaagtctaataggagctcaaggtctgctgagtcttcataaagaaaccaaacctgggcatctttctggaagccttcaaaaaagctgcagaaccaatctttgagcagctcagccgatagttttgcaccagcatcggttggtgtggatgcatattctccatatgacatggatctgcgatgggtgcgttcttctccattgtcttctacaattgggtccaaccttgggaattcagcttctgttacagatggccgattgacaactttcatgactac

SEQ ID NO: 81714 - DNA, 1383 bp, Oryza sativa
gagtaactaaaagcactctagcgtccatgaagcaaggaatagtttccacttatttgccataacaccatatccttaaatgcattagtacgcagatcagctcctattaacttaccttgataaggagatcacttcctgtcatgaagccctggctctgagaaaaacaaacatagcagtttcagaagaacaaatcatacagaactgacgtaatgaagatttcagaccaaaaacaatgaaaagagaaccacaccagaagcttttcagctgcttcacagatcttgtctacctttgcttcagataatcccttgattcctgtcaggctctacaagatggatccatatattgaaacaatatcagataattatattgtaagacagaaatgggacaattgaaagaatataatcgtcataaaccagaaatagaacaagtgggagatagcatgaagatttgggaacccaattttgcaaccttctttgtatgcatcatgaggccattgcaagtgtagataccagcatcctgcagcttcttcacatctccagagtttatcccttgcgagattactgtggacaagtgcacgagagatggataataatgcagagattatgctcaattgctcatagttcgaattcatggatatgaatgaataatttgcaggaagaaccatatgaagaatgaaacccagggagaagtcaggatcacaccaaaacaacttactaatattgaactcgctagaattagggagccaccagaaatcgtaaaagtacaagagggactcaagcttaaaccctaaaccctccaagtacacaactggttcaactaatatacactcaagttcaccaaaacacaactggttcaactaatgggcagaaccccacatgtttgaactagccgggggcgaattccgacgagttccaccaaacgcgggtaaaattgactgaaaatggggataaattcgaaccagccctctcacatgccacacatcgatcagcaggaaatagcccaaaacagatatcaaatgtggggaggcgaaaaatcccgaaaaaattggccacgatacgaggctaatttacgtccagaacacacgaaattgagggagaaaaactagaagcaaccgaacacgcacagcacaaaacaaccagaccccaaaaaaaaatggaaacacaaaataggctagaatccatctacttcaccgcaaatcagcatcaaattacaatgtgaagagtaaccaatcgaaacgcaaggcagaatgagcactcgcacgcgcgaacacacacgcgcacacgagcacgagccaagcaatgcagtgccgggatacgagacgggggaggaggggatggaaatgaggcggagggcgttacatacacttgtcgatggggctgcaggaat

SEQ ID NO: 81715 - DNA, 644 bp, Oryza sativa
atcctgctgggctgggtgaaacggcccagtagtaattattcctcccggaggagaagcccaataacaagacgattccagaaggcccgagagcctcaagtagcccacctcgccgcacgcaacgcaacgcaacggcacaagcacaacaccacttcgagtgtgtttgtcgtctcgcctctgctgcttccttctcctacaagccgccgctccgacctcgccgtcgccggtcgccggccgcctccgcctacaggtgaggaaggttctctccgccgcagcggcctccgctcgacgtctttgctagggttttggggtgatttttcggttgggttgtctcctgatcgcattttgacgcaggtgcggggggtctgtgtgagcagatggcgccgtccaagcagtacgacgaaggcgggcagctccagctcatggatgcagagaggatcgaggaggaggaggagtgcttcgagtccatcgacaagtgtatgtaacgccctccgcctcatttccatcccctcctcccccgtctcgtatcccggcactgcattgcttggctcgtgctcgtgtgcgcgtgtgtgttcgcgcgtgcgagtgctcattctgccttgcgtttcgattggttactcttcacattgtaatttgatgctgatttg

SEQ ID NO: 81716 - DNA, 805 bp, Oryza sativa
tgtttgtaaattagggactaaactttagtccctctcacaaaaatataagtctctatcttagaaacttatatttttgagcccctctctcccaaacaccctcatatatatatcttgcttctaaactgttaatactccaccatccgttataaaatataaacaatttttagtatagtgtcaagtcaaatatttatatatttaactattaattgcaaaagaataaaaaaatcaatcatatcaaattgatgttactagatttatcattaaacaaactatcacaatatgcgactctttttatttaaaacatcttacttttataaatgtcattggttaaagtagtatctcgaataccgtgtcgaagatcaaaagtgtttatattttaggacggaggaagtaataaagatgtaagaattttatctataaataaattatttgtaatagctcaaccaactagacatgcactattttgggccttctggatcaatattttcccaaccactccttttgcacatcgatatttgcatgttcaagcttgaaagacatatgatggtagggatgaaaacggagcggatagtttctgtccgctccggataaaaacggatacggatacctttcggatcggataattctcggatattttggatacggatacgaatacggatattttctcccggatacgaatacgaatatggtatcagggttttcgtcggatacggataataattcggatatccggtgaacagtgctattcggatatccgcaggacccatgagacataccccatttctttctaactctataaccttca

SEQ ID NO: 81717 - DNA, 1078 bp, Oryza sativa
gtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatctaattccacaataatccaaccattccatagtgtccaggtgatataaatatcccaaagtctagagttgtaaaaccacctaatgttggctaattaaccagcgaagcatctacctaaaatcatactagtggtaccatgagtagagtgtccactagttggggttttgtttaatctagggtgaacaaggtaataataacaataataataataaggtcataacaaaagtaaataggcatggctagataaaacagtgataacgcgggaatttaagtaaagcgataatgcaataatttaaatcaaaataattttataaactgggattcaatatgctcaaggatgatgtgtcttgccttgctcgctttcccaaatgtcggcttcaacctccacgaagagcggaaaagagaaggcttttactctaataaactccatataacaagcaggaataaagcacaaaaattggttcttgacttcttaaggaaaaattagagacttgaacggtccaattccgagttcaaatggccaagttatggccatttgaagtttatatgctctttaaatgaatatttgcgaatttcttcatttaaattttaatttaaaaaaggggtttattgcgtcagctgagggggagggggcgcgcggaccgggtccacgggagtggggcccacgcggcagcctcacggtccacggtggaccggttgcacccaggctcacactggccggcgccgtgggccccacacgtcagccgcacctgagggcgcgggcggctgacggccgggccccacgcggcagccactcggcgcgcccgagggcgccacgccggcgtggtcagcaggaggcggcgtgcccgcttcccgatggtcgccggcggcgaccaccggcgcggcgga

SEQ ID NO: 81718 - DNA, 8156 bp, Oryza sativa
  unsure (1)..(8156): unsure at all n locations
aggtggacgagatcggcgaggatgcggcgaagccgaaggagacggcgccgagctggnagcgggtccggggcgatgacagcggcggaccggagctcggcggcgacggcggagagagagagcgacgtcgcgagctcaaatccggcgagaagaaaggccggcgagaggcgaaaacgtacgaagnaggtgcgggggagggtttaaatagggttggaaggggagagagcggccggaggggaaggaaaccggcgcggcgctctcgggctccatcaatggtgccggcgggattaggggagggtttccaaacgaatccaagggagagagggagggaaaattggggggaaagggagaggggatcacggggagtgattccccccactttattgcacgcgaggacggcgggaggtggcgggattcgcggcggcggcggcgctagggcgcgtggaaggcggcgggagcggcggaagaaaggggatgacgggtgggccccacccgtcagtgagggtggcggacgggcccgcccgtcagcggcgcgcgcgcggggagggaggccgaatgggccgcgggggagaggagagagagagggggagggagatgggtcgaactcggcccattagagagaaggagggattttagggtttttctttttataaaatcattttaactttgtttatttcttaataattattatttgtgctctgaaaattccactaaaatttatttacacattttaggcttttaggaaatatacaaaaatcctctaagccttatttgacttttaactttgcacattttaattgttggaggctttcacacggattttaattattctaggcataatttagaggatatattttagggtcgttttgggacgtgacagcatctctatggtgggaccacttccagctacgcagccagagggacagcctatcacctgggcccatttcaccgccgccttccggaggacccatgtgcccgccggagtcatggcccttaagaagagggaatttcgggagttgaaacaaggcaaccgctccgtgatggagtatttgcacgagttcaataatttggcccggtacgccccagaggatgttcgtgaagatgaggagaagcaggagaaattcctggcagggatggaccctgagctatctgttcgtttggtctccggggactatcctgatttccagccctggtggacaagagcatccgcctggaagccaagcacaaggaattggagtcgcacaagcgtcgcttggcgaatttccgcaaccaacagggggctaaccaaaggatccgctacaccaatccctatccagggggatcctcctcgcagccgcagcagcaaccccgctccgcgctccgacctcaattcgtggtgcgcgtcccacagccgcagcagcagcagaatcagcaaggggcccatgcaccccgccctcctgcaccagccgtgcagcctggacaaggccgcagggatgctcaaggtcaacagtgtctgtgcttcaactgcttcaagcccgggcactttgcggataaatgcccaaagccgaggcgacagcaaggccaagcgcctccccgccccaacaacggtggtaaggatgtcactcggggccgtgtgaaccacgtgactgccgaggatgtgctgagaactccagacatcatcgttggtacgttcctcattcattccatccctgctaccattttgttcgactctggagcttcccactcgtttatatctgtgccattcatggggagaaatcagctgggggtagaaaggcttaggaaccctctgctcatcaccacccctggaggggttatgacagcaaagtattatagccctgccgttcctatagaaatccagggaattgctttcccctcggatttgattcttctagacaccaagaacttggatgtgatcctcgggatgaattggttggctcaattccaaggagtagtggattgcgcaaggcgcactgtcactgtgtatcggggccctgatcaaccggttgttttctttgcacccccaacttccgccggcagttcagtacttcatcagctaggattgccagaaatacccatcgtcagtgagttcggagatgtgtttccggaagaactacccggtatgccgcccaagcgagagattgagttccagatagatcttgctccaggaaccgctcctctgtacaagcgaccctaccgtatggcggcaaatgaactggccgaagtcaagagatagttggaagagttgaaagaaaaggggtatatacagccgagcacttccccctggggtgctcccgtgatttttgtggagaagaaagagaagacaaagaggatgtgtgtcgactacagagctctcaatgaagttactatcaaaaagaagtaccctcttccccggatcgatgatctgttcgatcagcttaaaggtgccactgtattctccaagattgatcttcgttccggatatcaccagttgcgcatccgtgaagaggatatcccgaagaccgcattcaccacgcaatacggactgtatgaattcacggtaatgttgttcggtctaaccaatgctcctgccttcttcatgaacttaatgaacaaagtgttcatggaatacctggataagtttgttgtggtctttattgacgacatactggtgtactcacaatcagaggaagaccatcagcagcatctccgtttagtgttgggaaagctccgggaacaccaattgtatgccaagctcagcaagtgtgagttctggttgcccgaagtcaagttcttagggcacgtgatatctgctaaaggagttgttgtggatcccgaaacggtgaccgccgtcactgattggaagcaacccaagacagtcacttaggttcgcagttttttgggtttggcaggatactaccgaagattcatcgagaatttctccaaaattgccagacccatgatgcagttgctgaagaaggaagaaaaatttgtgtggagccctcaatgcgagaaagcattccaaactctcaaagaaaagctggtttccttgctagtgttaatcttaccggatactcgcaaggacttcctggtgtactgtgacgcttcgcgccaaggattggggtgcgtattaatgcagaaaggtcatgtggtagcctatgcctcacgccagctacggccctatgaaggcaactatcctacccatgatttggagttagccgctgtggttcatgctctaaaaatccggcggcagtatctcattggaaatcgctgcgaaatatataccgatcataagagtttgaaatacatcttcactcagtcggatctgaatcttcggcaaagaaggtggttagagctcatcaaggattatgatgtgggaatccactatcatcctggtaaggccaacgtggtcgccgacactctaagtcgaaaaagccattgcaacactcttggcatccgtggcattccaccggaacttaatcaacagatggaagccctgaacctaagcatagttggtcgtggattcttggctacgctggaagccaagcctaccttgctcgatcgaatccgcgaggctcagaagaatgatccagatatacatgggatcctcaagaatatgaaacagcgtaaagctgctggtttcacagaagatgaacacggaaccctatggaacggaaatcgtgtatgcgtaccggacgacaaggaacttaaacggttgatacttcaggaagctcacgaaagtccttattccatccaccctggcagcacgaagatgtacttagacttgaaagagaaatactggtgggttagtatgaagcggtaaattgcagagttcgtggccctttgtgatgtgtgccagcgtgtcaaagcagagcaccaacgaccggccggacttctccaacctctccaagtaccagaatggaaatgggatgaaattgggatggatttcatcaccggacttccaaaaacccaaggcggatatgattctatatgggtagtcgtggaccgactaaccaaggtagctcggtttattcctctgaagaccacctatggagggaacaaattagttgaactctacttcgctaggatcgtgagtctccatggcgttcctaagaaaattgtatctgatcggggaagccaattcacctctcatgtcacatcctgatttttgtttcaggatttataaattattattagaatttatattaaatgttcattaatttacaagtgaagttaaatgtgggaaataaaatttcctaaatataaagcatggatggatttattttttattaaattatccatggttaattatactctctggaatattctcggatttttcggagctcaattcctaatttttaatcatacaaagagcatttcagtaattacccacatattaaattaatcattaaatggtctaattataatttttttaagtactttgagtgtccaagtattttcaggatttttcttgaaattatttgagcattggaagtatttttaacaattcaaagatcatttaagtgattattttaattggaaaagtaataaaattctcctcccttgtcttaggctgaatcggcccattccattccttcctcttctctccctcctcgcgcgcgtgctgtgcagcccacgctggcccaacctgagccgcctcctctcctctcagcccagccggaaaagtctacttttcgtccctgcgctactgttcatcttccagctcaggcagagcctgagccagccgtgccgtgcacagtgccgccgcatcctccttccaaatctcgcctccccgttgctcctttttccaatttagttgaggggaaatattcctcttatcctcctctatctttaccccaaaaatcggagctaatcgttgagtatcttatccgaatcgaactcgttttcgagtttatctccaaaaccgagtttttgatttcccggatcgatttcttgcgggaggagtccaatctcttcaatccaaggctataaataggaccccctagtcctcctctttcgtttgcccctctcccgtggtctcccgtgccccgtatcctctccgccgccgccgccaagttcgccgccgccgccggccgaacttcggccgtgtcgcgccgtcgcctccgccgttgccgtcggtctccgtcaccgccgtaaggtgcgccgaggtgtgggcaagctcggccgctccctccccgctgtcgccggtcaccggagccccgtcgccgccgtcgaccgaagccgcgccgcggctagacctcgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcatcatgacgtcatcatcgtttttctttttcctttttatctaatagattaaatcttcggaaattcataactaaatcatcgtaacttgtattcgactggttcaagttgctaaattcatctaaaatcgagatctacatgttaaaaatatccacatgtactgtttatgcttgtttttgtactgtttatttggttttattagtttttttcttcgttttgtgtgttagcttgtcgtttctgtcgttgcgaaggttcgtgagtgcgtcgggagtgttcagaagattaattgaagaccgattattgcaaggcaagtcacacagatcctaaacacaatcctttgagcatgttgatcctatatttaaattctctatgtatttcaagtgtgcatttattttcgaatgtcactaggtggtgtgaatctattcctttgttatggcctgtttgcattgattactctattccttgataccttgggatattataatttgactagttgagctttatatatattggttcaactagatgttagatataattgcttagccatgcttagaaacattagctcactaatgggatgaatcatatatactacattattatttatggttatatttaatggtatctcacgatggttaatcgtgttatgataattaattggtaattaaaatatgattaatggtgggttgtgagcacatggttttgaaggtcgtactcatggcaattaaggaccggttcgcgagctactgttgtgaaacattaaccgtgccaaccacaagccagcgtgggcaacggctttaccttttgtatagcatggttcattgcggagcaccagactgagaagtggcggagataagcccacgggggtcactggggagtccaagccttgttttataagggggtgattatgatccaggaatggtgcactatggtgagttgtgttgtgcagagggtattgtcacagcctctattcgggtactttctagtatcgcgatgcatggtagacatgatgttgaggctgtgtcttgtgggtacagtggtacacctctggccagagtaaaactattcgaatagccgtgcccaagttatgggcgggttgagcaatgtttttcgtgattagtctcacacctctcacaataattattgatgctataactggtaataatttgtttagctcctggtttggagttagatctgtacagccgggtatggttgttcaggatggttgggcctgtgcagcatgggtgtgttgttcagtgttgattaaagtttctgattaattactctactgttttactactcttaactctttgctaaatgctgctttcgcaaatgagactatattgtgccatcctttggtatccttgtgtatttgcatatttgctgtgtggcttgttgagtatgtcatatgctcattcttgcaataatcaatcaacctcagttgaagacaagttgcgaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatacacagataagtttgtgtaccgtcgccgtccccgtccaccccctcgtcgatctcgccgaccgccggagcgccgccgtccccgtcgacccgagccgtgccgccacctttcttcgctccggccgcctttttcatcgtcgccatcgacctaaggtgagccgagccgtgccgccaccgtggaccgcgtggggcccggccgtcagcccgccgcgccctcgggtgcggctgacgcgtggggcccacggcgccggccggtgtgagcccgggtgcacccgatccaccgtggatcgtgaggctgccgcatgggccccacttccgtggacccggtccgcgcgccccttccccttgggtgacgcaataaaccctttttaaattaaaatttaaatgaagaaattcgcaaatattcatttaaagagcatataaacttcaaatggccataacttggccatttgaactcggaattggatcatttaagtctctaatttttccttaagaagtcaagaacccatttttgtgctttgttcttgctagttatatggagtttattagagtaaaatcattttcttttccgatggtcgtgtagatgctgcagcttcggaagatccgctcttcgtggaggttgaagccgacgtttgggaaagtgagcaaggcaagtcacatcatccttgagcatattgaatcccagtttataaaattattttgatttaaattattgcattaccactttacttaaattcccgcgttatcactgttttatttagccatgcctatttacctttgttatgaccttattattattgttattgatattaataccttgttcaccctagaataaacaaaaccccaactagtgggcactctactcatggtaaccactagtatgaatttaggtagatgcttcgctggttaattaggcaacattaggtggttttacaactctacactttgggaatattctcatcacctgaacatggaatggatggattattatggaattggattcacacctccccctctattcaaaatcctcaaaatggttttaggctgggctcggggtgcatggttttgatagtagcacctcggccatataaggaccggtcttcgggcctctgttgcaaagcactaccgtacttccac

SEQ ID NO: 81719 - DNA, 2886 bp, Oryza sativa
atcatcgtaggccttgggttaaggcaggttcgtgtgggttcacggccttgattaataacattgtataactctaggatcgtatttacaaaatatctttgggcaactaagtgtcttttaatgctgtttactgcaaaccctaacccttatattataacccccttgtactcccttgcatttattctgcacttgtgggtgtgtcttgttgagtacggtggttgtactcagtcttgcttaattttttcccaaacccagaaaaggagttcctggaagatgaaggcgttggtgtttagctcgtgcctccgtcaagcgcctgtggtcgtcgccctagtcttccgctgtttcccgtttgtctttgtgtgtgctgggccttcgccgcccatgtaataaattaattatttacgcttccgcttggtaaactctgaaatgtatcaacttttggtgtaccttgcatcctgggcaaaaaaataatacacgcacgtaaggaacgcccgttgggttactttcggtcgtgacactcaagatgcccaagccattgaagaagtcgaacaaattaggcaaagagctatttcggctatccagcagtacttgtctcaataacttttgtgtaataggacttaaaaattcttgtaatcggctaagatacgttaataccctgttgttttaacaatcctttgtgccgattaacataacttctaattttcactttcatttttggtatatatgtgccccccaattttataatgtcaacagcattgataaaattagaaaaacaactaagggcgatacaatatcggccgttatatatcggcaaaccataaccgattacaattggaaaaacgactaagggcgatataccaatatcagccatctcaagacgatgtaaaacacatcggctgtcatgcatcagcaacacgagtcgatcatgcgtcaacccaaacacttgggtaatacttcttcaagtatttgccattgagcgctcgtccacaaacctcaccatcaagcccttgcaacatatatgcccctttagacacaaccttatagatttgaaacggtccttcccaatttggtgaccacttgccgaacttgttatcccgagttccaatcgacaaaatcaacttccatacaagttcaccttccaaaaaatccttaggcactactttcttgttataatgcctagcaactcgttccttatctttggtaaccttagcaagggctcataaacgcgattgaaccaagtcctccctctcatcggccataagattataatactcatcgactgtcaaaccgtcttgcaattctatccttctatagccgattctaacttcccatggcaaaacagcttcatgtctataaacaagcttataaggaggaacttgaattgatccatgacaagccatccgataagaccacaatgcttcggccaaccgggtatgccattgccgaggataataagaaatcttctgcttaattaattagatcaagctcttgttagatgcctcggcctgcccattagcttgtgcataatatggtgaagaattcaacaatttgatacccacgctgtcggcaaactgaacaaactcatcggacatgaagattgaaccttgatcagtcataatagtttaaggaataccaaatcggtagattatatgttcttgaacaaattgagttgtatccccagaatcaactttcttcaaaggaatggcctccacccacttggtgaaataatcagtcgccaccaatataaacttatgtcctttacttgatggtgggtttatcataccgatcatatcaattccccaacctctgaaatggccatggcttaagaataggattcatagtcgatgccggagctcgctgaattgccccaacttctgacaatcttgacaccccctataatatctgtaacaatcctccagcattcttggccaaaaataccctgcacgccgaagtaaccacttcatcttatgagccgattgatgagtaccaaaatttcttcatgaacttcgctgactgcaactttagcctgatcggcagtcaaacacttaagtaacactccatcaatcgtccgataataaagctcatcatccaacagagtatactttaatgccttatatctcaatttcctagaagccgattgagacggattatgcaaatactgatgcacatcatacctccaatcatcggctgtcattgctgcaatttcaaccttaacatctttgatcatgagcttataccctgatgccccttgggccaaatcattagcttcaatattttgttctcgagagacatgctttaaagtaactagccgaaactccttcattaggtggtggcacttctcattataaaccatcaatgtatcattcttgcattcatactctcctgccaattgactgattactagcaaagaatcccccatgatttcaatggtatcggcttcaacttccttgagtaattgcaaccctttgagcactgcctcatactcagcttgattattagtcgcatacggtttaatggtataagcaaactcgaaacatgccccctaggggaatttctgagccgatattatcaaaatgcaatgcaaattttttgaggcaaattttttgagcgaatttcaaagtcatattaatcggcacaaaggattgtcaagacagtaaagtactagagcatcttagctgattacaaaaaatttctaagtcctattacacaaaagttattgagacaagtatcataggatagccaaaatagccctttgcctaatttgttctacttctacaatagcatgggcatcttgagcatcagttccagagatgactttcagggacttggttaggtcagcaacatttttgatagccgatttgagccttgctttttgttcttcaattgatt

SEQ ID NO: 81720 - DNA, 1777 bp, Oryza sativa
acatgtttgtggtgtttaaattcacatgattccactcaataggggtttaaatcctggtgtggtgtatgccaatattacatatatgagtgtgcataagaatatcttaggaagaacatgtaactgtttttctatttcataacaaattaatagagtgcacaacataacccttaataatcaaagaattttagtgacagtgtaaaaattacattagttgatggtttgaatattataacaacgaggctgtgttcgggaggcgaggttgggaaccttgcctcctgacacggaaaacgaagcacgtgattatagtgagactaattaagtattagcctaaaaaacttgaaaaatggatcaatatgatttttttaaagcaactttcatatagaaaactttttaaaaaaatgcaccgtttagcagtttgaaaagcgtgcatgcggaaaacgagagaagtgagctgggaaagaggggtaaagaacacagcctaagtgatttcgcgtacatagcaatgctattgtaaatgattggagaattggagaggcgtattctcgttgcatgactggtttgattacactcatgcatgtttgtatataatcataacaagtcatcagatttagtagctgtacttcttttgataaatctttttggtaaattttcatatgatcctactcccattgttcctagcttattagcccaaagctttcacatctgaaaaaggcacaccgagtcaggggcgaaggcaggcctggaacaatttgagcttgggtcctaggtttgcctctacaatgatgattaaattctcttaattcactatgtaattttttttaggaaattaatactctattagttaaaccctacttagccctaggttaataatttctagctccatcattgcaccgaatggaacttcgcatatctgagtgagagccatgccccgagtgctgctttcttcggtaaatagttcgttaagtgtcaattataaaggaaggaatggagtattaactcgcactaatccttatcgtcatcattctcttcttcatcatcatcaccaccacgagaaacgtctaagggtattttggctagctcaccgaggtgataagctagtcggtatgggtttatagcctcaccccttctaattatttgatattaggtcattccctaatattcatgtttttatcatcatcaccatcgccagttcgccaccatcttcattgtgcctcattgacagtgagctcgaattacggctgtgttcttttggaggggttgggaactcctcccctccgcacggaaaacggaacgatagattaacacgtgattaattaagtattagctataaaaaattttaataaaaagattaatatgatttttaaagcaactttcctatataaatttttcacaaaacgcgtaccgtctagcagtttgaaaatcgtgcatgcggaaaacgagggaaagaacatagcccttctcgacgaactggaggagcaccccctccttgtactccatccttatgtcctgcattgatcgagcgatcgattgatgaagcgcgcgtggatgattattagagcagccgtaatggtaaagtaagctgctctctataaaacttgtccacctcatctatagactattttatagtaaaccatcttaatggtgtgtctacaaggatatctatagctgtttttaatacttgcatgtacatatgaaagacaatgatcattcgtgaataccatccctgtaactacacatgtggctacatgaaaaaaaaacacagaaacatgattcactt

SEQ ID NO: 81721 - DNA, 2800 bp, Oryza sativa
tatgcagtcattttgcccttgtttatggaagaagcaaaacttactagaggcaccaatattattctacttccctctctgtagtcaacagcaaaatacaatatgatctatagtatgatattacaataggaaatctcaagagtatagcaaatgttttctttaaaacaatcttgatcacatttgatttcattttaattttaatggcactggttcatgtacttagacagccccaaaactagtgagccaaaccaaagtataaactgtattttggtgaagggtacactaacgtgggacagcccaactggatattacataggtacacaatgttgttgtgttcgtgtatagtggctatgtacttccatccctcttttcatgctccttccattgctgtgggtgtcaccatatttttgtactttggagtcagtaaagcttcatgtgcggcgggcatactttggactattaaggtttccaatacaacttgaacttaggaatgaccctattatcattttttaatacaatcgtgacttgagttagatgaatgtccaaagagcaactttatatgccttctgcagccaataggtacatggtttagtacaactagtgaatgctcataacgatttccttttcttttatgatcttgactgcccatgatactttgcctgccatttctttgaactgaactatgacttaagttatttcagatacagatgggcatcattgttttccttggtgcaggatacaagatggtgtattctgaaagcatgacggaggatggactgaaggaagcttatttgtgattcccttctggaactaatcacaactgcctaagcaataacaaccatatttgaaaattctgctgcaacactgtatgttatattgttagacttgaacgccaagctgaaattgtattttggcattgccttttttctgagagagacctctctcctcaaatttctgttaaaaatttgttgcacgattaaaattatcatggccaaattttgattttcctgcatgatctagttgcaaactgtgttttacgtttgggtacatttgtctacattttttgaatggaatattggagttcatcgttgaatttgctactgtcataatatatcataatatagtgcatagttcttttcttctcatatacaagttggtttgtgtataatgcaagcatgtccaactgctcaagaagcaattgaggtttgcaagtatttgtggttgacgaatagcattttgcgttcctccgtgaattgttaactccagtctgagaggaaaccggagccttgcaaatgggtcatggagtattgacgatgggatcagaaagtgttaatcaaataccatcggcacttcttggcgtgccagacacatctgttctagaagcagaatcggaatccgttcattccggtcaaatagaaacagagcagtatcttggtgaaaactgctgcatcaatcgataatacaatgttctattttttctgtaactgtcataaacaatgttctggaagaaagcaaatgcgaagaaaaagggaacatgaaatcaaagtttggatttcttttaagctgaaaagaaattcaaagcgtggaaacgaatttgaccgcgtgacgcgtgggatgaagaggagaggagacaagggaaaaaagaaccttctggaggccggtttaggcacggcttttcttttttgtcttgcttcattctaaaataataacttcattttgtcttgtcttctgatttatctaattttaatatatttgtcccttggtttttataatctcgattagaattctcgttactataattgtcctataaatttagtgagatcaaagaatgtattgttgattttcgtcttttaagcatgaattagggggcttctttatagaatgtaagtatggtgttatccgggtagtgatgtgtgtgcgtatgcgtttaccatgtaataaaaaatgtctctaatattataaactcaaatgtaataattacttacaaataactgagaaaaaaaaagtaaattttagaaaaactgtaattatagtgagaaaactattagtttgctgcaacattagcatcatatttcagtttgttgtaattataccgtaggaaatcatcataaaactgtaactttgcgtagtatgtgtaggtgataacagtaagcttgggccacgtaaaagtatagttttgtaataattttgtataatatcattgcaacaaaccgaaaataggttattaatattgctgcaaactgatagttttgcactatagttatagtttttttgaaatttaaaaaaaaaaagatctactatacaccctccgtttaaaaataagttcattcgtaggaatttatatacaacgtttgacctttttcttatttaaaaattatttatgataagtattttgttgccattagacaataaaatacgaataattactttatgtataaattatgttttttaaatattttttataaaatatttaaataagtctagtggttaaacgttagatataaaaaccaaagtgaagatgtttttgaaccgagcgagtagatccaaacgccatcattccctggtgcggccgaaaccggtggtggtggtggaggggaccggtccaaacccgcggatgtcagcatccaccgtttcgcatcgcggattaactgtgttgctggaggcaggcaaggcatatgctgcgattccacgtttttttcttctcccaaataaaaaggcgtcttcgttattgtattggattccagagtgtgaaagctaggaacacacaacccacacgcctcgctgcctcgattgattgattgat

SEQ ID NO: 81722 - DNA, 538 bp, Oryza sativa
aggaaactttactatggttgtgtaccaaacaatacaatggattgaaaacattgggttagagtggattatatttttctttgttttcccataaaagtggagggatagaaaattttcatctggtgcattcctttgaacgaacgatagtgcactgtccattccaaggactatatattactgtacttttccttcacaataagccctagcagtgcaagccacgcttggcttggcgtgccttcagcctattccaacaaggattttggaccaaaattcatctctaggtcacccaccccacagtgctgtacccacgtcttcctcctcatcctaatccccacgccgcttttctcggcttttcatccccacacgctgattctcgccagaccgcctctttcctctcccctctccacctcaccgacggcggtggcggcgtcctcgatggcggaggcggcgcggtggcctcgctggcggaggtcctcgaggcggcggctcagatctggacggacggcgacgcggcggcacacgtggcggcggcggcggctcg

SEQ ID NO: 81723 - DNA, 596 bp, Oryza sativa
tgcaccccagcagctgcctatcagttgagctaggcaccgttctcaacagagttatactaaacggatcatactaccagaaacttgttaatccgtaacggattcttggtgatggattcataaaccgtcacgacagcggcaatccgtgacgataatcttttttccgtcatggacgtgcaccagtggttattcttggcccgctaactcatgatggttttatccagatcgtcacagtgtgtgattttaaaatcttcacagtgtgaagataatcaaaaggcatttcaaaacttgttttgcttgaaaaggatttgaatttgaggttcaaatgaattttttaaaaaatgaaaaactacactctctcttgggccatttctggctgtcctgcagccccacatggccacacccacactctctccttctcttgggctcggcccagcctccctcttacgctttcccccttcagctgggcccggcccattttccgcatgggctagccgcaggccacctgcgccttgtaaaaaaaaagagacaaaattgtgtagctctttaggggattcgaacaccctcaaccaaaagcacaatatccctaaggatccacc

SEQ ID NO: 81724 - DNA, 1485 bp, Oryza sativa
cccctgttgttttcccagaagaattaacaaaataaacaggccaaggatttgagaaataaaatgataacatattagttgcaaggttaatcaatactggaaacctattttatacacacaagccaaaacaaaatcaccaaaacttctaaaaaaattgtacatgtacttttattgatattagccctgctggtaaagtctcctcttcaaattcaacacacaaatagggaggaaaaaaagtaggatagatttatactctcaaaactataagattaatttttttatttgtttttttaggctaaaatataatgaatttgaggttatgatttgacacatgaatgtaatattatttgaagtatttgtattttttttagagtttttgataaaatttgttagttggtatatatgatgtgtactctagaaaccacgtgtacacgtttctcaaaactaaggttgtgtttagatccaaaatttagatccaaacttcagtccttttccatcacattaatctgtcatacacacataactattcagtcacatcatctctaatttcaaccaaaatctaaactttgcgctgaactaaacggcgcctaaaagaaaataaagcatatgtacacagcattaattgttcctaatgaatactactgtactactgtacgtacgtttacgtctatatcttaccttcacttggcttggacccacgtcgagaactgggcacccgtccgatgtggctgtgatgagtaccgttgctctctgcggcacctactccctccgtccaaaaaaaaaaaagataaacccttttttccgtatccaacgtttaatcttccgtcttatttgaaaaagttatgaaaaaaattaaaaagataagtcacatataaaatattaatcatgttttatcatctaacaacaataaaaatacgaattataaaaaattttcatataagacggacagtcagagttggacacgcaaactcagggtttattttttttaaggacggagggagtacgttcatcccagaggctccagctcctaatcctactgaatacaaaaataagtcgtccgggggaattgatcaagaaactaaaatgatatagctagctatgttaacaaatacatatatatggtttgttactggttgagtgtcttacgacagaggctagggtgtaatatatctttatatattattactaaaggattcaattatggttatttgtgtttatcttaccatctcccgcctggttgtgcccatcaccttgagaactggcactggtggagaaaccatctttcgtcggtcggccgatttccacaatagtcccggatgcaataaaaaccggggctaaagatgatctttagtcccggttcaaaagggaaacgggcatatttgatctttagtcccggtttgtgttaccaaccgggactaaacatcatctttagtcccggttcgaatgctgtcaggacctgtcagacccccccgggatctttagtcccgg

SEQ ID NO: 81725 - DNA, 3168 bp, Oryza sativa
attattattcaaggccccaagcaacctggtaacgacatcgacgtgtacctaagaccactggtcgaagatcttaaacagttgtggcagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcacttactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcacagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgtagcatatggaacaacgcggcgaccttcacccggaaccaatggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtctgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcattctgaagaagtatgttcgtaaccgtgctcgtccagaggcaagcatcgccaagggttatggaacagaggaggtcatcgaattttgcgtagaatttattgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgcaaggaacatcggtaagtccgatgcatggattacacgacatcacattgatactttccccgcgtggctacgacaacatctcatgggtaacgagtcaatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggtagagggcctgataagcctaagcgtcaagtggttctcccaggcaaaagaaaaatcgtcggagttgaggacaagactgacgaggattacgatcagttggatgggcaacccactttcacggtgacgattgaccctagcatccttctatcaaatgaagacaccccttactcacgcagcgatcacaaggagggaacaatagtgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggttaaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttaatttattacagccaaaaataatttttcgaagtaattgtcattaatctttgtactttaaataatgttaatgcattaacttctattttataaacacatatgtaagcgaaaatcatatgcagcgctataatctttagtcccgggtcttaaccctaaccgggtttaaaaagaatttcgaaatagcgggaaaagatatttactcccggttgttgagaacaaccgaaactaaagatatctttagtcccggttgttgagaacaaccggaagtaaatatcttttctttactccc

SEQ ID NO: 81726 - DNA, 8827 bp, Oryza sativa
cccacaacgccacgccgcggccgccgtcgcacgccggcgcgccaaccgccgcctcgatgccgccacaccgccgttaacgaacgagaacgagaacgatcgaacgaacgagagcgagaactaacagatgcatgtacgttgccgcgacaacgtgaacgagaacgagaacgatcgaacgaacgacagcgagaacgagaacgatcgaacgaagacaagcgagaacgagggaacgaacgtgaatgaggacaagcgaacgaacgtgaatgagaacgagcgaacgaacgtgaacgagctagagaacatgaacgagcgaacgaacgaggacgaacgttaacgtgaaatgcaatatatatatatatatatgtatatatatatatacatgtatatatatatgtacatgtatatatatatatgtacatgtatatatatatatacatgtatatatatatatatatatgttacttcgcatttatcctaatacattttttttatcttgcagaaaagacgtgttgtcggagtcgtccgtcaagcctgagtggaagaacagcttgagtggaagacctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcccgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacacacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggctcgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactagcgaagaacaagggcacgcggagatcatgagagctttgtcccagattcggagaaagagatgctgtggaccaaaatgctcgagacattcacccttcctgcgggtacagaggacaaagtgaaaaggtggactctgaagaaaatggcagaacagtttcagagcttcaagggagatctgtaccagaagtatatactgaaggggcagacaccaaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggatgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccaacatcgactcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccctagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgactggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatatacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggataatctcgtccatctcctgaaggcgcagcattacaagacgttcatactgttgccatacaacacagagttagtttaattttactgtcttcctatataccaaatttcattcccgtacgaacttgctaagtgtttcatatgtaatgcatcccacgcacattgcagattccactgggtgcttttactcatcaacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttatccgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatgtatgcatatatatgtattgaaacatatatatgcatggtttatatatatatatatatatatatatatatatatatatatatatatatatatatatatatataaaccatgcagcaacaggggcatgcaaaaaaaaaaggttagctggatctttagtcccggttggtgttaccatccgggactaaagatcgatctttactcccggttatttcacccgggactaaagatagcgatctttagtcccggattggtactcccggtttggaaaccgggactaaaggggggttacgaaccgggactacaaagggtttctccaccagtgtggatcccggaatctggctttgaagacggtcgccccctgtactgttagggttactgcctccagttgtagcattagcaagctgcagagctccggatccagctacttggatagaaaaacaaaaatagatcaccaggggaattcagaaactaaactagccaggggaattcagaaactaaactagaataatatgtatagtaaggaaaataaacatagtctcgtttagacggtttagttaaggtaaaatttcattgtgagaattcacttggatatatatatttttagaaatcataagctgtagttaggagtcctatcgtctcaagttagcatgcaagtttttttaaaacagatttcttatatgattccttctgtattatcaaaagtgaacattcctaataaccgactcaaatacggatatgtatttccaatactgctgcttcaaacctttatatcttgaaaaataaaaaggctatgactgaaaatatatacattttaaaaatctactgaacaatacctacaacttttatgtagaaagcatatttttattctgccatttaaatggtctaatttgcacttgaaagcagacttcagaatctgtccagaatttcagagggtactacaacaactatatctggagttctactcatccgatcaaagtttattttaccaatacgaaaagctaagaaaaatctctataactttgtctataggcggtctgattgattccgctgtttaccccctcaaaagacagttcaatctactactatccagattacgacataaaaacaatggtcatactaaaaaatttatatctcctaaaccacttgagataaaatcgcgccatttggtcagaagatagatccaaacattgtctacaacttactagttatatgctttcgcagaaaaaatcgttttgatcctccaattggagaacttctgagaatatgatgggaaaaccaacccaccactcctcctgctcctcttgtcttcctcaatccgttttttccaatcagattcctgatcgcctattcgatcaacagtgtaaaagctgaacttttgcacgtttgttctaagatttccccaaatacactaatttaaagctcgaggtattacaacttttttcaaagttagagtatcacgactataaagtatagtatgtctgaagtttgcatatgagctaggcaatgaacacaatagaataatgcctaaatcctcttcatcatactttacctccatagactcaaggttagcaacaattttcttgaaagtggagagatgatccatcgcagatccatcatcttgcaacttgtgcaaaaataacttttgcttccggtgcatcttactagttagatccttagtcttgcatatctgttccagcttcaaccacaacctagcggctgtcttcttcttaagcacctcctgcataatatttttagatagatgaagatgaatatatgacatagccttatgatccatttcttctcatcgtcgaaccaatcttgagtcctcttgacaaatccagatagcgcatcatcgaggtcttgctgtgcaggaacggttcgcatcttcacttgtcaaagtgaaaatcttgtgtctcggtccaggagcggtagatcatacttcaaactcgccatgggaattaatcctgattttgttggtaagaaattaggtacacctagcaaaatcgtgaaacctggtacacttctcgtgtgcacgtagcgtagatctggcttcttcctggtacacaagcttgtgtgcgcgtagaaaaatcaatgtgaaatttaattcacatgaacagtcagaagctgtactggatcctggtcctcctagggaaccgtgcgcagtggatggcttgctgctgctcctccaccttttcctgcgcgacgagacgatgagacgacgcgcggctgctgcggccgattctctgcgacgtgcgctgctgctccttccccggcggcgtcgacgacgaggctaattagatcgatactccgatcgtatcgatcttcaatgataccacttgttataaaaatagatagacacgaatttttacgtggaaaattcttacgggaaaaaaccacgggtgtctaccggcaatgattactatagagaaattgattacaaacgtaggagaataagggaacgccaccccttcccgtactatttacaagactatatataggggacacataataggaaaagaaatagagttctattaggaaactaatccgaatatattgtgggcccaaaattcgaattacatatttaacagcagacttaaccttgattgagcagataatataaactggctggaaaacacaacttgaacgctttttttaacataataatgtaataagttttatgataatgacgtacttattgagtgcaaccgcatcctttcttagctggatagacaaggaaaagaaaaatgttgaaacggttagtcaacgatacaaacgaccatcaaatatagactaattataatttaatgttcctattttctctataattttgattaaacttaaaaattagaaaaatatgagcgaattattatatgaaacggaaggatataatgtgcgtctctcttaccgtcgactggtgaccccggcggcccatcactgtttcgagcacgtgcaacctgcgagcttccatgtgttgctttccctgaagaattaacaaaataaacaggccaggatttgagaaattaattgagaatgtactagtagctaggttaataaatactgggaatccttctatacacacaagcctttttatatacaccatacccaccaactaaaaaatataaccgtaaattccaaacaaattgtacatgaactttcagtagtattacacctcttctaaagtctcatcttcaaattcattgaatagagagcaacaaaaaagataaattatgacatatttatactctcaaaacagttaaattttttattttttttattacgtctaaaatataataaatttgatgttaagattttatacataagtacaatactattggaagtacttgtaaaattatttttaaattttttggtaaatttattagttggtgtggataatggtgtgtaatctctggagtcttgtgtgcacaataccaatcaatattactgtatgtttacgttctctttttgggcccaagtggagaactggacgcccgtctcatgtggtttaattagatcagtaccgttggtcgatgcgacaccaatgttcgtccccaagctgcgtactccagctcctaatacaaaaaagtcggcaggggaaattgatcaagaaactaaaatgatatagctatctaagttaacaaatatatatatggtttgttactggtttagtgtcttatgacagatgctaggattgtaatatcttt

SEQ ID NO: 81727 - DNA, 23344 bp, Oryza sativa
tttttagcttcatgtaaggttgtaaatggatataaaagaatggcatgaaataaatatcatttcttgttttcattcacaatactaaagttttaatcctaaaagtggtaatagataaatttgagcagtcaacattaaactcgcatagtatgagctcctctcatcctaggtgacttggtgccatctgattaaaaaaaaaaagacatgcctagctccaaaatagatttgctccacctcctacctccttgattcaggacttctctgtttccccccacatcaatgtcttcttctatcacaaatagtagtcaacatagcacctgacggtgtatgatgaatcttcatagccaaaaaatgatattccagcacaaatgatcttccatctctttacaaccagcaaattgcaagcaatgacaggttgatgattagccatggcatgagaaagttcataactggtactgaccggccagggttgacggagctctagatcggcgtcgctgttgaaggtgggaaatgggattgttgcagtgatctatagccaccgcagtgggggataggcagctaaggatcatgcaggaaacaccatatctgatctaaaaagaaagagccatgctcagtgccaccaactgattagtacatgcttgcttactgatcacaaacaacggaaaatctcataaaatagcagcactgaagtcaccaaaactgaaagaaaaattgcatccacggtagttctcgttgagcaggacatccgctcctcatccagggtcaagcgccatccttcgttctgcaaaaatgagtaaaaaaaatcaacataatatagcacaaaactaaatatgactcaagtcaatagtacatatcagttccgcaaccaggatctcaagcacaaaactgaatactaccctagttagttcccttcctattcaatcaccattcctattcaatcaccattggaggcactgagttcagctaatccaattatatgaattcagggtaagagctgcctacatgtgcatcaaagggaagtgctatcaataacatgtttaacataaatgtaccaagtttcacccacgatgactcaaaatgatgtaattaattaagcattgactaatcacaagtttggataaggttatgttatccttattgtaacattatataatgagctttgaaggagaattttatctcctgacctagtagtaataaataaataaattatgacaagattaaaccaaaatatacatccatacatgccaaaaggaaaatcgaactttaaagattcctagactcgtagcattcgatcagtgatgaccttgaaaaagaatctcccaagaaatacaaggaagcagatgtaaaatcaaaggtgtttttgattattattctgtgatgaacaattgggcattggagattattgattttgtatttggaatttattcacgaagtggttttggagatgattggatttacaggtgaatttacaggatactgctgtgattttatgtggaccggtcagaccggctgaacagcctcggtcagaccgggcaccggtcagaccggtggtacagaggcggtcagaccggcccccggtcagaccggccactgtacctcggtcagaccggcctcggaggaatttttctaaaaattctaaaattgattttgcacgtggatatatgtctattggatcttctggtcgtgtgtctcagtactggattcctaaatttttattatcatctaatcccagtactgaggcttcgacttctgcttgtgtgtaggctttggtggcaagaaaggagaacgtgtggatcgtgaattccggttgttcgcggcacatgaccgtagagggggagcgtgaggcttcccggtattgctttcgagagcaatagagttgagtttcgagttagggtttcgagtttagtcgaaatttttgtaaggagtgctgttggtgcactttgtaaaaacagagagaatcaataaagtcgtcatccactttaagagttcttcgatttgtgtttaccaggtttcggcggtcagaccggcgggagcacagcggtcagaccggcggcggtgacaagcgcggcgagcagcttcggcggtcagaccggttgatctataccggtcagaccgacgacatccgagcggtcagaccggcaaggcaacttcggtcagaccgatctccatcgatttcgagggtaacttttatttccgctaaaagttttcggttttttgggtataccaaccattcaccccctccctctggttggcttagttcttgtgattcgatcctacagcagcagtatattatgtttccattttatatattttttgtcatgttctccacacaattaaacaatatcatagtgattctaagccattagactcaattaaaggaagtacattttcgtaatacatagggcactgcattttaaagcaaataaataacattttgttccaacccaaccaaatctccaggaagcaaacacacaagcatatctaaaaggtcacatatccggcgatgtttattagtgattccactaagagcataagcatatctaattaagcaacatcagacataccatgaacactgcacaattggatctaagttacagcagagtaaatacagcagagaaaagtttagctattccgctccataatccatgaagatttcaaaatacatctatcagtaaaaatagtacctatgcctatgtcaattctcctgaactaccattgtataattccacgtctccgctcgccaaactgctcgatcaaaatagacataaaccactttaccactctgcgcctaacatatggacttcaaagtttagctataagggttaaaatatctggggttggtgattgcaaatcacctgcatatacccacatatctggggttttgaaattgtatgttgaagtctagcagatttgaagggaaaaaaatagatggatatgtattacttgcagattatagtattagtagtttagtacaatgcctatctatggtgaattaccgaaagatgcatcacttgcaatgtttatataagtagaactctgtcaatagagtgcagatgcagaattcctcctcgatttccatccacaccatggcatatatttgtgtatatgtatgtatatgtgcctgcaattgtagtattcatgagatcgtgctaatcagttagtatactgcataaattaattgcaggaaagacagggtaattcaaaagaacatgcctataaaatcacatgatattttaatcaagtagctaaatgcataacacaataatgtgtacccatctgcaaaagaaagtacatgcctgcttgaatgatcaagagcagtggaggacaattgtgatcatctccaacattggtgttttcttgagcagaagattagcatgttccaatctattctgataccatgaaaaacaagggaaatttgtagtacaaatcattcaagcttaaacaaagattgctaattacttagaaataaattcagcaagcagaccatcagtggattaatgctgggctagctgtttgtgaacaaccaactatcacatgtcctattttgacccctaaagcacgaaatatttttttccttttgtccccagactatcatgaatgcatagaatagtatgttagcatttcaggcagcaacccaaaaattagttggcactaacacattggcgtaatacattccaaccatcgataacaaaattgcttgacgaacagggtggcggactgtttctgcagcattcaatagaaaacataatgtgcatgttcaaaaacataccttgctggtacatcacagccaaaatcaaattggccggtttgtaaaaaaaatcaaccaggccaaagaaaaataatgaactggaagggagaagatattgaaactggacaacggaagaaaaaacaaaccgtgcggaggagaccggtggcggcacgaaggtgggcgacagtgcgacatgagccaccgagggcgacgacccaacgctgctccggtggcggatttcgaggtggagatcaggtgagacgtggaggaaactggcgagtggggaggggagcggcgcgcgacggcgtgcagggcggattcgtggagagagaggaggttagggttagggtttggagagagttcctccggcgagtggggagaggagcggcgtgtggcgacggcgacctggcggctcatgacggggagtccgggagagaggaggggggcgatgcgtgagttgggggttgaagatgcggcagggaggggtgaggccgtgagggcgtgatgtgtgtggggggttagcaggggaggcgcggaaatggagccgtgatgagcgatcggcacgcggaagagaggcggagctgatcttgatcgttcgatcggggtagagaaatatgagccgttggatttgatgaatgagtaatgtaggtgtaaaagtgagttggtgaattatagggtagataataaatgtaagtgacactgttagagtgcgcagcccgggccaccaactgtggatcacccaggtcacattgggcctgctccaccacaggcccaactttaggttctgggcctacacaacccaaaagacaagtctgatgagtgaggaccgcccctaccttttaagtcgtgctctcccatcatcaattaccgatgtgggactaaacccaacaatctcccccatcacacatcgggcccaacaatctccctcgtcacatcaacccatgtgacctgaagacttgttacctgggcctcgggcctaacaatctcccccgtcacatcaacccatgtgaccccgaagacttgttacctggcctctccatcatgtgacccatggaaattgttacaggttccaaaccttgggctctaataccacttgttatccaactggccccgaaattaccatcggaaaccaaacacagaagaaacaccatagtagatccaaacataatgacgacaccgaggcacgatatttgataatggagttcagccgaggcctacatctccagggcactgattacgggcgctcctccccgatccagcatatacagcgtatcagagttacaacgactcacagccggtcaccgccggcagccgttccctctcgctatgctaagtcgtcatgcggttacaacaggcatgcccctctatttatgagagatcctaagacagagttcgactcttattctagttctaatacctcttacagctccaagtcctaaactgtaaccgactaagtacacatattcgacacaaactctaacagacactgtgctccaagtttaggttccgaccgtgcattttactctatatttaaaacagtgtaattgtttagcatcaaagttgcactactagaaatgtaatctcaagtactttattagcatcttatatttcaaactatcctatttaatttgatgttgcttgaaaaataatggtcaaacttgatccattgctagtcaaaaccaaaaggtatgtgtgaacggagggagtacatggcatagtcgaaactagaatgttcgcaaccacacttgcttgattaattgaagaatgaacagacaccataagccacagatgaaaatcatgggtaaaccagtaatttaaaagacacatactaaggacaaccaaaaatccagtcgtggaaaaattgaagaagaaacacatcaccgagttgaaatttggaaaccaaccggaagaatcaatgaaaattttgcaaatattgtttttttataaaaaaaaacaatcagaggctaatggttaatgcataatttcttaccattacgtaagcaagcaagattgtgcatcaatcctaatcctggaaatttgcgaagatatggcattcaatttgcctcacatacgttgtcagtcgtatttgtagtgatgtgtgttgcaatcagactttgatctatcagaaaataattgagttgtttcatgtaaactgtattctcctaggtaggtcgtcccttgggaaatatccaacgacatgattccactttaatactgatctagaaagcatgtgaaaattagccatgaccgtagtggcatttcgacatgactcggagagagagacgtcacttaaagagatatatcaaccattaatcatgaatgcacctctaatacattatttcgttattattataagcacctctaaaatatctaaactatgaatgttatcacaaggaaaatacattttcaagccccatgtgacccttcaaggtataacttttggttaaaaaagaagaagaagaagaagtggtgcctcctggtacctctcaagaacaatagaataaaatcactcattttgagaagttacagtgaagctcttccataccctttcaaggatcataaaatttctccagcaaaatagtgaatacacctccatgccctaaatagtgaatacacctccatgccctgatggtttttcgagcttttttttttattaaatccgtatcctttgcctctttacaaaatagtagcatgtttaacaaggggaatttagcttgaatctacctaaaccaaaacttggacgaattatatggtttgtgaggcctacattccctgtatccacaggtcaccccatgaacacttccaaggagtgacctgtgaaatgaggtgatgggcagtgtcatgtcactggtcttgattagttgtggcaactatcaaggggtactaatcaatctcaggcgtaagaatggcagctaatttcgctgataggccaagtgggcgatggtgagggcgcctcatctgtctacatatactatgatccatccccatgctagcactcaagtgacatagctaacttagctagctagatcatcttagcttggagaagacagaagagcgttatcttggaaggacaacatggcaactgcagggaaagtgatcaagtgcaaaggtctgagtcttggtttacactggttttttcatgtttgcagaactcttccaagatgaaattctcctgggaaaataaactcagaaatgcactgatgccgcttttggtcattatcataacacggacacaaatttcaggacactaaactgcatagattgcagaggaaaaacagaaaaatgtacactcatatgtcatgcagatttgaggtctgaaatattttttttttatggagagttggatttgggtttgcagcggcggtggcttgggaggccgggaagccgctgtcaatcgaggaggtggaggttgcgccgccgcaagccatggaggttcgcctcaagatcctctacacggcgctctgccacaccgacgtctacttctgggaagccaaggtattctgaaccaaccaattccatcactattatattcactttggtgtatggccaagaactacagactgaagttcagtgttgccagtgtctgaattatgcttgattttttgaccatctcttggtttggatgtgaagcagagtgtgaacaattcccaaaatatacagtttttgttattcagatgtttactagcttgaattttgttaatctttttggtccttggttgaacataagtctgaaaactgaatgattcttgtcaggggcaaactccggtgttccctcggatcttcggccacgaagctggagggtaagaactactacaaaccaagaacaccctcagcaagaaccattaatcttcagtggcacaaacaattaatacctccgtcccaaaatacttgtcgctttgagtttttgtttgtaacttttgatcgtttgtcttattaaaaaagtatggaattattatttattttgtttgtaacttgctttattatcaaaaagtactttaagtatgatttattcgcttttatatttgcactaattttttaaataagacgaatggtcaaatattgcaagagaaaagtcaaaacgaccactaatttgggacggaggtagtatcatcttggcaaaatagtttgcaattcatcgacgtgtaattctgtacaatgaaattcaggcttaaatagttgagtgatttttacaatcttaaaggaagtaccagaagtaccatattttccaatgtaaaatttggtacatcttatttcttatactaggaggtaccgaatttgtactaaaaattttggtacctcgaagtactgaaaaatttctctaaataattttgtttgtacgtgtgcataggattgtggagagtgtgggcgagggggtgacggagctttcccccggcgaccacgtgctgccggtgttcaccggcgagtgcggcgactgccggcactgcctgtcggaggagagcaacctgtgcgacctcctccgcatcaacaccgaccgtggcgccatgatcggcgacggccagaccaggttcaccgccaggggagggcagccggtgtaccacttcctcggcacctccacgttcagcgagtacaccgtcgtccatgtcggctgcgtcgccaagatccacccagcggcgccgctcgacaaggtctgcgtcctcagctgtggcatctccaccggtatgctaaaactttgtgttttttttcttttttcattggtgaggtttaagtaggatgatccatacaacatccacacacacaacaatcatggagaaatactgtactccctcccgatttttaatgtatgacgttattagcttttgatgtgacgtttgatcattcattttattaaaaaaaaaagctaagtatacaaataacattcattttattgtgaattgttttatctaaaaaacaataatcttaacttatacttttagatacttatacttaatttttaaataagaagaatggttaaacattataagaactggagggagtgctttctttctttggttataaatattgtatttgctgaaaaaatatgtttatgatataattaaaattattttcaaggtaaaacttttgccattgtaagagtagggatatatataatacaacctgaacctagtgacctacatacaccacaattatgggagaaatattgtacttctccgataacaaatatatgacgtttaaggcaaaattcgctcaaacttttgaaactccgaccatcaacttttttattatatttatagaatatagtacatttctgtaggatttggcgcgactgtgaacgtcgccaagccaccgaaggggtgcacagtagccatattcggcctgggtgcagttggtcttgctgtaagtgactgtcacttctgctcttctcagacagagtacgagtagcccttaatcatcttttttctcaaacagagtagtatttttgaaagaagatttctgatttggtgaggggatcatgtataggccatggaaggtgcaaggatctctggtgcttcacggattattggcgtcgatttgaacccggccaaattcgaactaggtaactacggctcttttttggaacctggaaaatgtcatttttctactgaatttaaactgtatgctgcaagaaccctatctccataatttctcataaggatattgctactgtttttattgacaaaaatatataagataaatccacgcaaattcagatgccttttttttttctaaaattaagacaaagggaaggtcagcatcagaatgtcacattgggtttcttttttcctctgcatttgcagctaagaagtttgggtgcacagactttgtgaacccaaaagattacgacaagcccgttcagcaggtacactctcttcatgctctcacacaagacttcaaattgtagtaatccttttgtttcatattatgggtgtgtttagttaacgctaaaattgaaaatttggttgaaattggaacgatatgacggaaaagttggaagtttgtgtgtgttggaaagttttgatttgatgtaaaagttgaaagtttgaagaaaaagttaggaactaaaccatgcctatatataagtcgtttgaacttttttttaagtaaaaaagtttaattaaatttatattaaaaatagcaatatttttaagaaaataagcatattattaaaatatattaaaagtgagttttaataaaactaatttaatattataaatgtgttgataaaatttttctataaacttaatcaaactttaaaaagtttaactgagaaaaaaatcaaaactacttgtaatatgaaactgatgagtggtacctttggttgagctaaatcctatggccgacgcgataactatttcaggtgatcatcgagatgaccaacggcggcgtggaccgcagcgtggagtgcaccggcaacgccgccgccatgatctccgccttcgagtgcgtccacgacgtacgcacgccgtctcatccactcatccatcatatatattttcagtgatcagctgtgtcaatgatctgaaccctctgcacgacgatgtcgccgtcgacgacgacgacgatgcaggggtggggagtggccgtgctggtgggcgtcgccggcaaggacgcggcgttcaagacgcacccgaccaacttcctcaacgagaggacgctcaggggcacgttcttcggcaactacaagcctcgcaccgacctgcccggcgtcgtcgagatgtacatgaacaaggtccaaattattaattaatccatacccttttccagctcgagattagtgatgatgatcaatgcctgcaaaaatgcgtcatcatcttggactgatcataacaattctgcctgatggattggttaattaattaggagctggagctggagaagttcatcacgcacagcgtgcccttctccgagatcaacacggcgttcgacctgatgctcagtggggagagcctccgctgcatcatcaggatggaggactagccatccagatcgatgtcgccgccggcgatcgacggcggcggcgactgtataaacggagaaaataagaggctaaaactacctatgctacagcaataagctagccacggttgcaggaatgcggtttcaggtttgttcatggagaacatgggtggacacaaattatatatactgtgaattttctgaaaatttacaagacaaatatgaaattgcgcaaattacgatagcggatagcctttggctcgatcaatttgagcctatatatgctggctccaccgctacactgtttgccgcctttctgtattgcgcatctgctctctctaatgtaatgtgcaatctatatataactaaattatgaaacataatgtgcaatctgtcaatctacattctggtatgaatttttgcagatcataatattcacctaagttgggtgaagacatgtttatcaacaggacggattataagagataaaaagttgacctgtgttgtgtcacagactgaacaccatccaaaatggcatcatttgaggcatcttcctgtgtgtcaaaacgacaggaaaggaatctggttagcgcatgattaaatcctatcatccccaaagtaatcacagagaacacaacaaatcctatcctctctgcacatgcaagcacagcattatacacagagctccccactctcagaaattcagaggatgcatgcatctactccctgtcatggtagcatacaagtgcagaatctttgggttttggggctccataattggtgagctctagctatctagttggctaatctgttcttaatttcttgtagccaggttgcaggatgcaacttgcagagacaggctgccccataaacccagtatcggctttaaatgagattaaacttgtgtgttagccacgctactttggtagtacatacaaacaaactcaactatgactactgaatatagttataaattttaataacaacttaatttatttgctatagaattcaagttagaactgcataggctgtgttcgggagtgagggcctcactctccagcacgcaaaacgaaacagcatttagagcgtgattaattaagttttagcaaaaaaaaaattttaaaaatagatcaatatgattttttaagcaactttcgtatataaactaaactttttacaaaaaaaaaagtaccgttcagcggtttaaaaagcgtgcgcgcggaaaacgaggagaaggggttgggaacctgcacaaacgaactgagccttaattggcagagtgagtataactcaattgattaagttacttgtggcggaactaacctacaagtcaataatgagatgtctgtgatgaattcgtcaatctcaaatatgataacgagatgtttatgttggcttcattaatatcaagttatgttgggccctctctcggaggtgaaaaagaagaaaagaactacctctaattatactctagatttctatcagatggagaattcatgcttggtggagtaatttgaggataaggtctgaacaatgtacagtacttctccttctgataaagttaaatggatgccttttggaaagtgaagccaacaaaatatattagattgcaaattgcaccacttgtcaaattatatatgttgctagttggatctacggcgtcgctatcagagacctttctaacacaagtgttttggcttcatgttaccagttctaccagtagacagattacatcttgtaagcagtatggatcactgacttactagtcaccataataaggtcacataatatcatagtggccactacactactagtattgaaagagaacgaacaatggggcaagacctaagtttaagagtttattaataaagaagtttatttacaaagccgagcaaagaaggaaaaatgacttaaaagaagaaaaccaaaaggataaaagatcttccgaggatacactagacgctgatatctaaaggggtgaaaacggtcgggaaattcctgaccgaccgacactcgcttctgattttattaaccaagctatatgaaaatggtaatcggtgaaaatagaaatagtaaacaaaatatagaaagtggaacaattttattgatatatcgattgtttctgtattttttttattcttgtgaaaatcaatgtttttataatgtggtaattagcaactttctaaatataccaatatccatagtccatatctctatttaatacattgttgagaggcctaaatcacttattctcgtgcgctaacttttcattctagcttgcaagtttcgctttaattttttttctagtttgatattttaatgtgtcaattccaattccattcatcacacatgtacagactccagagatcatgttgatatttgtaaacgagtaaattctaccggcggttcttaaacttataaaagtaagtttcacctaaatccacaaacttgtaaaacacgcatcaagatccctaacacatggtttattgtatcatcctggtccaaagtcccatttactcataggcttgactaacatgccacatggatgatgacatggccaaattcctccttttccacctttttttctaccattcttcttcacttcttcctccaccactagatgcactagcggtgacggtacaggcagccgcaacaccaaagtacaggcagccgcaacaccaaaggcaggtggagagagagagagggaggcagtgagagcgacaacgctagtaatcgggggcagaggcgctggtggcggggtagacccaacagcagagcgaatatcagagcccttagctattgttcttgagaaatggccgggtctggcccattcctcaaaagatgtttttactagatccctatccacaacaatttatacttctggttctggcgaacaaatcagcattaagtctgggggcaacgatgacctcagaccggttgtggtttgctctgatgggatttgagctgggaggagtagagggcctgagccaacggaggaggtcgcgaccagagaagatgggtgtcggcaaaagcttgcaccgatgggtacggtggaagcagaggggaaaaaaaggagaaaaagaaaaaaaatttcatgccatcatccacatggcatgccacgtaagaccatggtcaaaccagactttggataaggatgatacaataaaataagtttaaaaatctcgatgcatgctttggaagttcataggtctaggtgaaatctacttacaaatttaagaaccgttggtgcaatttactgtctttgtgaattgtggtgcccaccttttcctttacatataaataaactacataccagttaaagtccaatttgtcacacgcccgttgcccttcatgaagtaaaacagttggaaaagggccctaatctatatcaatattgagttgataaagaaaatatgttagaaattactctaaaacgatgtttctatgccggagatatttctttctttttattttgaatagaataataccactgcttctgttatgaagcaaacaacaaagcacaacgactacaaaactaaatttggtgaacttaataaaataacatgtctgaacgatgaagaaaatattggccatacaaattactccctccattccctccattccaaaatataagacacaaccacttttaacccaaaaaccaaaaactaattattataactctctagtttggattaccctaataaatataatacgtgcacttaataaaattaaagatcttgagggcctaagctagcggaggaactcgtggccggaatgaagatgtactagcaatgctttatattatggaataaaaggagtagaaaaaattcattatgtagtaagatatgtatatatactccctccggtatcaaatatattgacgtttgagggttgtgttttttggatgcaaattattgacgttttggtatttgattgtcactttggactgctatacccttgcatgcatgtagcgcttgtcttcagtagctcatcaactatagcaggctcccaacgtcccaagcaacgacgcattaactccaactttgaaactaaaggccatagccacacaggtcgcatgagagtttttgataaaagagctacactaaagtttttaataggggtaaaacaggaaataggcaacctaattaatcacttcttggtaagtgagattctgtccaaaacgtcaattaatatagaaccggagggagtagcttccaacattgaaaagaaggaccaatctgtacgtcacaccatcccgttgtattctgttaatccatttggcacatgcccaccaaaatgttagtacgatgatctccatgcaaaattcgaatccacatccatgcaagctcattaaactctaaaagtacagaattcaaatccaattgtgactgatgggcggctctgcatgaaccaactaatcaatacacatattttttgtgcagtgatcagtgggcaagagtccaaatccagccagccaatttgacattatttttcaggtcaactaatcctatgcatgttactaccagatgcagcatgatcatatcccaaggcagggcgccatacggattgcaaattcctgcaccaggattgcatggtttttgcaaccctgcaactgcaactgcaagcacgagacgaacctagctagcttgctctgctttgttggttaattagtcagttagtgtttgcattaaactaattaagcgagagaaactttgctagttaatcaagtgattagccgctcatggttatcctccaaaccgtggctaattgcacggtttggcacctaaacccatcaaaagcatcaaacccttcccacatgctacagccgccaaaagcccagaggtagcaggtgcagagaacccaatggacgtgattcttttttttttttaaacatcttttgtttttaattttaaaaacattctatctataaacttattttcaaatttaaacatttttagcggggtaatgttatttcgtcacgccaaccaaacttaacaagggttttgttgtttaaccatgctagacgggatggagtgactaataggtttacggagccatcgtttagcgaaacggcatatttacaagtgaaaagtaatttgtaaataaaacttttacatacgtgttattaacgatctaaaagcaaatgctgaaaaataaactttgatgaaaaaacttaaaatcagctccaaatgttaaggttgaaaattcaaattttaactgataagtataagtataagcgaaaaaaagaggccattagatttaaaaatgagtttcttgaggttttatttcccaaaataaaaaatatgtaaaaaataataataattcaacgaactcagtacaactgcacaagaggtttatacgccatgtgtcaggtccagattcgcgggcagaaagcgacaaggcgtatatacattggcgcggccgctgttgttttgatattttcagctttcctccggcgccgcggcgtccgcgctggcgctgccccggttttggactcgcgagaagtcaacgccacatcgccacgtcacccccgttgacgcctatgggggggtcacagccgatgacgtgtcggtctagctagctactggtgcttctgcaagtggggctttggaagattcagaaaaggaggaatatactgttactgagtttgcgtcagtttgagttttcagacaaaataaaaatatcagtaggaagaacagtgagctagcagggcatccagaatatgcgtactgtgaacaattggccggacctggattataatggtaggattgatgtagaatttgatcttttgaatattttttatacatttgtttttcttctctggtataccaaatattttaacctcattgaaattaggaaatagtatgtattttcaattttaggtagtgcgaaagaaaacgacagtctatatattgattatatgagaaatatcatcattttgaggagatagaaaacgataattttcagggttaagcttgcgtgtgcgagcaattgtttttataagttggtagaataaagtatagttgcatgaaaaatttgacaatgatctggtggaaagtttctagattgcaaaaaaatgctaagaatataagtataaattgagatccttgtaccattcaatgggagcctacagctcaaatttaaaatcgtgtagggtttgaccataccaaagataatgtatattttaaatatatataggtagaaaacttttctaacagtgaaaacacttaattttgtacataagtttagtgccatgcaaagataacaaaacttatattccctgtaatcataaatatttaatgttataagataagattcggacagacattttagaaattttaccatcattttatattataaaaatttataaaatctagtttgtgatattatgatagtagcattacttttttggacaactttgcacgtacaataagtgtttgtttttgaattaaacatttgataaatatagattataaggaagttttaaaagtttaattaaattttgtcctaaacctcaaatattaataaatgaagagagtatgtaggataccctattttgtgccaatcaaaaaattataataccaaatattgaaaacataagcaaagaataaacataaaaagcaattcatcttctatttatttatcattattactaaaataaaagctaaaataaaccaccacatttactctaagggaacttgcccacccggattcaaactctagacttggcaagacgtaccagttgacagcaaggcggctatggtggcttcattaatctcaagatatgtcaacccagtttttaggatgtgctcataaatgcgataggtttaaattaaaaaaaaaactgtagaaaaccatagttattatgacacgtgacatttaaccctagttattacggttttaaagtttcataaaatcccattattgtgggttttatgcgtgaatttactcaaaaatctaagatatagtttgtataaaaaataattattaagttttttactaaagttgatagcttaattcttcaccacttttaaaaaaattgtttgagatatgctgaaattcatcaagattttaataaagatggggtttataaaacattgagaccataaaacatgtgtttgtgtgcaacatgtcttagtacatgtgattttctgtaaatttaactatagatcatgtggttttctaaaatttactatataaattataaacacatagataatcattataaaccaacagatatcttagaaaaaaaggtaatatctcaatccacaaaagttgcacattatttttatcaccaagatcaaggagaaattaaattatcttggatatttcaaaatcaaggactaaatgtaaacatgcaatcaatgagtatttaaattactccttggattctcatcaaatatttaatttatctcttcatttaagttttaaatgcataaagtctataaataggaacaacttatgtggaaaaaactaaaatatgaaatatgtctaacttttgtggatggaggaagtattattcctcatcacaagaaaaaaaaagtcaatgcattatgcttttctaaataatctagattaattcatagttggacagatatgaccgcatatcaacgttaattactgccgatttgactgttgattaggcatatcttagcactaaaccttactgaaaattcggagaattactattggagagaagaaaaggcatccatcctccttgtcttcactctgcaatgcatcatcatccgccggaaaccggaaaaccaccgaagctcgaaaaccggcggaggcaagcagcagcagcatgcagcagacgcagagccttcctcttcttccaagcaaaaaatattcagatgacgcctcctcctctttcccccctcctccacttgcttgtcttcaggcgtacttgcccgcgagactcctaccactctctgatccctatatatacaccccctcctcccctctcgtctcctcaccagaattccaagcaacgaactgcgagtgattcaagaaaaaagaaaacctgagctttcgatctcttcggagtggtttcttgttctttgaaaaagagggggattaatggcgacagccgggaaggtgatcaagtgcaaaggtccgttcttgctgttcttggagcggttcgtgagaaaattagtttgatgttttgtggggaggagaagctgattagatcgggttttggggtttttgcagcggcggtggcatgggaggccgggaagccgctgtcgatcgaggaggtggaggttgcgccgccgcaggccatggaggtccgcgtcaagatcctctacaccgccctctgccacaccgacgtctacttctgggaggccaaggtaattaatcagcatctgccatggctgagctttctcaccttctcaagcttgcaagaatgatcagtgactaactaacttggtgtgtgtgtggtttctgctttgatcttcgcaggggcaaacacctgttttccctaggatcttgggccatgaagctggagggtatgtgtaatctgaaccaaccctgtccaattcttgttcttctactacactgtttagtggttcagtctattctgttcttgtattgttttttttttgttttaaaatggcttttggtgtttagtggaatttagtgtgtacttgtacgtcataggttgtttggtttatggtattcggttactaactatagttagtgtgcacgttggggagtcctgattagtcagtggcattttcattaagttcagtaaagaaatctaccaagtgtccaattgtgcatgatattttactggtttggtataaaatcatatgaagaatcaaagaacagcgtcattgatgacatatacaacgacaattggattcctaggataatatacttttcttcatgtgctcctctatgctagtgctttattactttctctcctttgatgttttgaggtactcaaaggaaaaagacacactgaatcattatccatcttatgaactgtttaaacttgacttacttatcacttctctgctcaaatggaccccttttttttttccatttccatggaagatatatgtgtaatcctaacaatcaaattgatctaacaaaacaatttttttgctcacagcattgtggagagtgtgggagagggtgtgaccgaactcgcgccgggcgaccatgtcctcccggtgttcaccggcgagtgcaaggagtgtgatcactgcaaatcggaggagagcaacatgtgtgacctcctcaggatcaacgtcgaccgcggcgtcatgatcggcgacggcaagtcccgattcaccatcaaggggaagcccatcttccactttgttggcacatccaccttcagcgagtacaccgtcatccatgtcggctgcctcgcgaagatcaacccggaggcgcctctcgacaaggtctgcattctcagctgcggtttctctaccggtaagatgatggatggcttcatgattatgatagtagtagttttcacagtgaaatttgaaaggtctttttttttttgatgcattaagttgatgggattttgctgttcttgcaggttttggtgcaacagtgaatgtcgcgaaaccgaaaaagggccagaccgtggctattttcggtcttggagctgttggtcttgctgtaagtgacacgcacaaagatatatcatttccatttgatttgcagattgttgagatcttgaaactcaaactgatgaatgtttgtaaaattacatgattataggctatggaaggtgccaggctgtctggagcatcgaggatcattggtgtggacctgaaccctgcgaaattcgaacaaggtacaatcttttatcatctttgagtgaaaattacatgtttggtatatgttctggattgaacactgaactctgcaacttgttttcatctcttcagctaagaagtttggctgcactgacttcgtaaaccccaaggaccacagcaagccagtgcacgaggtacatcacattgcctcactaatttctcttattatcacacactgttcatgacatgaagtgtacaagcttaaacatcaactctgcaatggtgattctcaggtgctgattgagatgaccaacggtggactcgacaagggccgttgaatgcacgggcaacatcaacgccatgatatcctgcttcgaatgtgtccatgatgtcagtctctttcttacaaacatgaaacatgatagtaacaaattgaagatgatcatttcagcaatgcctccagttctgctgtaaactgtatcctgaaaactaagagtggcaatctgaaacctgaatccagggatggggcgttgcggtgctggtcggcgtgccgaccaaggatgatgtgttcaagacccacccgatgaacttcctcaacgagaagacgctcaaggggacgttcttcggtaactacaagccgcgcaccgacctgcccaacgtcgtcgagctgtacatgaagaaggtaaaaataattgcagaacagaatcagatttgcaacctgaatgtgcattgttcagaaatctatggtcagtgattccaatgagccactgattgatcactattttatgctaatgatttctggtgtttgatgtctgaaggagctggagctggagaagttcatcacgcacagcgtgccgttctcggagatcaacacggcgttcgatctcatgctcaagggggagagtctccgctgcgtcatgaggatggatgagtagagatgatgatgatctatctctctctctctctctcttgcagtttcagtgcatacaagaaaccaaaaatgaaagcaaaaaatggatgagaagtttgaggttttccatttaagtttaataatggtcgtgagacagggcttgtgtggagtcagctctgtttactccctcctttcatggcttgatcttgtttattgtcagcattgtggcttagcagattttcaccagttttaccctgtaaattagtaccattctgaaatcgtaataaactactagcagtgtgaggtactattgctggaactgaattgattgtgcagtaaagaggtgaatagcagccagtatgaaggttttacaatttgaacatcgaaacgaaatccacacgaaattcataaatttcatcgcatcttgctgaagcttaccagattctatcgattcgatctagctccaataggtcgatgggagcatctattgattttttcgacagacgaaaattttgcaagggactagctagggagttgtcgacagtttttgaggtccaaaactttcaaattttttgactacaggatttgtcatcaatggttataggggaacaatccacactagtacaaaccatgaattttagtgtccaagctgattgaacaacaagaaattggcctacatgtagaagggaaaaaaactttcaaattcaaaagtaatatgcgctcctaaaaaaattgcaaatcataattttatacaatgtaactaccctataactatcatgtaactactctgtaattagggtgtaagtgctatgtaactagggtgtaagtgttatgtaactactctataactaagatgtaagtgatatataactagggtgtaagtgatatataataaaaaagagttattgctaataagaaggtgcatggcttagcttaacgtgtgcatcatgttcgatgactgccttgcccatgcgaacttttttttaattctggccgtatatgttgcacgaatcctagagcgcatccaatggctagaaaatcgaaagttttccaaacaaaaaactgtcaacagttttttagcaaaaccgattttgcaaacatgtaaaagaatcacaaatatagataataaacagttctaaaatcatttttttcttccccgcaaaaaaaatcaattttttctatataactaagtgcaaatgcattataatcgagtgtaactacaagttaaatatacaagaataaaaatataaattttgaattaagattctgctgaaaaaattactccctccatccacaagagttagatatatttcacatttgagtatttccaaataagttattcctatttgtaatctttatacaaccaaagacttaaactgttgtgaatagaattgattgagcgagagagattgagtgagagagagaattgcacacaagaatgtagagaataaatgagcgatcctttattgataacaatggtcaacagaagacgcgatggtttgggaaccatctcgtccgttgttagaatcgccgtgaggcgagaagaggtgtggggcacaaccaaccatcgtgtcccagatttattgctgctctatccatatagatggatgagatcacccaaatatttcataacactcccccttgatcgaatccagctttgatcattgctcatttagtgttccagatatctgtaaagataatcttagaaataattatagttaaatacatcacgtaaaactcctcgaaaacccagtgggaaaaataaggagagaaccgtgatatatattattgactattttagatctatgagtaaagctcatagtttgatccaaaatagtataatgtctacagttatcatttagtaaaaaccccagtggggaaaagccaaatgacaggacatataagcttatgttgatattacctcgttaaaaactttggatgagaaaacctaaagggtaa

SEQ ID NO: 81728 - DNA, 10635 bp, Oryza sativa
ggactaaagttaagtccctggatctaaacaccacctaatactcttcaaagctggtcgattctgtccaggctacagttggtgagaacaattaaccaagagagcaaagaggaggagtagccatggccgccgcagcgattggagggatgcttgcctcggccgccatcaaggagacgacgagaaagctgggttccgccatcggaggtgagatcaagctgcacagggacttcaggagggacctggagtgcttcaggaacaccctggaatcaatcgaagcggtgatggaggacgcggagaagaggtccatcaaggagaaaacggtgcagctgtggctgaatcggctcaagaacgcctcctatgacatctgcgacatgctcgaggagtttgaggccaaaactgctacaccagctgcacgaatggtaaactgtcccttcctcctagtcctaggctagctacatctccaataagtcttcatactttctttttgtttggctttaatgctaatagagccctggatccatctaggtgtgtcgattatcatgtcttgattttcttccaacatagttgtggttctggattaatgttccactttttaaagagtatcctctgaattctccatatgagatatattaacctctcttgatttggggactgtttgggaactccacaattctttgcacggctaaaaaatttgcaggcacatgaaaccaaatctagttaatggaaagtaatttcacaacatccctatgtttgtatcaattctgagcgcattctactgaaagcattatgcatatgtactccaaagaagcaaatctgaagcaaatcttaccttgctcgtccatcggtccaacccctccgctcatccacctatcatcgatgttctcccctttattgccatcatcaccttaaaaaatactccctccgtttcaaaatgtttgacaccgttgactttttagtacgtgtttgaccattcgtcttattcaaaaaatttaaataattattaatttttttcatatcatttgattcattgttaaatatactttcatgcacacgtatagttttacatattttacaaaagtttttgaataagacgaacggtcaaacatgtgctaaaaagtcaacggtgtcaaataaaacgaaacggagggagtagaattctctccatcatcccaccgagcatgcatgaaaccaccaaaactcaaacaggtgagtcactacttaaatctcagcaagacaaccatatcgatgtgaatccattcctcccaacccagaccaagtcatttggtcttagaaaccaacacaagcaacagcggtagtagtaccatctgccttcaagacatgaagatcggcagcggtagcagtagtaggttcccaacaacagcaagcagcctcggctagaaataagtggagattgaggagaaagagagataaccaaccaaaagttctacacctcaaacacaccacacacaccacagctcaaccatagcatccatggtcaggcaaccagagagagagaaagagagagagagagaaagagagagagagaggtcagaggagtagaaggagaagcaggagatagatacctgagttataagtggagcaaggagcttcagatcaggaaggtgattcagttccaggaagggctgatactccaggtgccaaccaagctccaagaggagaagaaacactttaaccaatttcaggagaagctacctgtagcagctcaagcaagatggcagaaatcagaacaaacagagcaaagaaaataaattgacaggagaaaaaataatggaggagaagaactaatacaagggaagcacaaaagagctcaccagatcaaaaaaatctcaccactaacaccagaacaaatcaaatgcaagattgtcaagcagataaatcaagaaagaaataaattcgaagcatgtcatcaagtacatggtttactatgattaggagttgtgtggatgcatctatatgaacttaaactgaacaagaatatctcagattcagcaaaaaggattatattaataatctaaactgtagaatagcctatgtaacagataggatatattttggtctaaatgacaagtagaagatattttttgtttcatcactaagatgggttgaggattactggtgtatgtagttcccctgatattaggttcagtaaggtttaattctataggataaatcttgaacacataattagttagaattagtataaccttaacaaattagcctctagtttcaacaataccatatcttagggacatcagtagtttagattagtatccagtaaaacatgtagcagtatgcttcagtacaagaattattctgaatatatagagtaatagacagggtagatatatttacttatgacatgatatctcgactaaattatagtagtatgcataacagcagaaaactaaattttaacctgtagctccaatcagtcagtagtttaatctttgccataattagcagcacagaacatcattaatcagtaccatatttaatcaataatctaagtccttcaattataaacaattctagcatgactacctccgtcccaaaataagtgcagccatggttttcagcgctcaactttgaccattcgtcttatttgaaatttttttgaaaaaaattaaagacataagtcacgagtaaagtactatccatgttttatcatcttataacaacaaaaatgctaattataaaaaaattttaaataaaagaaacgatcaaagttgggcgcggaaactcatggctgcacttattttgggacggatgtagtattttataggttgaatttcttttcagtagaaaatctagagcaatctgttaactgatcaagttttggggagtagtatagatgtttttcttttcctgattgacaaaaggatccagccatgcgaattgatgcaatgctaaagtgaagctccataaggagctgatgtgtacagtgtgtttactagttccaatagccaatcacttatacatgccgcaagtaagataaggacagaatcatgttagggtgctttcaatttcagtagtgcatttcataggattactactagctatgtgagcattcattcattcgtccataagaccataacatatagccatcatccaaccatacatagcaagtctcaattgaactagaaacttagaactacaaacagataataaccattagcagagcacatcaagttgaacaacaggagcagtctatagtcatcacggttggttcatagaaacatcaacccataagaagagaacacaaatcgtagcacatgagaggaagggggaagaagttcacctctggaatagataaccaaccgtacgccacaggagttgcgcggtgctcagcaccggccatctcggcggcggtagggagtcgcagcagcagcagcagcagaggaggaggccagcggctagggttagcttgggaccggattcgcggggagctgcgggaccaattctgggtggcggcgactgcggggtggttgttgggggggggggggtcgccggagtggggcgcggcagccggcgcttgggagagcggcggcgttgtcggcgctgccggaaagcggcggcgctggagtctggacagaaggatgggcttttcgagttggaataagttcactataggtaccttcccctatttgtcccttatttgtcgggtcttttaactatttgccactcttacgatcggtgcttaacgatttaccactaggcccacatgttatagacacatgagggcccatatgtcatagatacagtgtggcaaatcgttaattgtcatgtcacaaaagtggcaaataactgcaaaaccgggtatgacatgtcccccaacttataaaaaccaggcaaacgtggtccctcagcagttttgaagtctgttttggctgacatggctcatacgtggcttgtttgactaggtctccgtcccacgtggcattgacggggcgcttacgtgacaattatatctcagcaaaataataaaaagtgtggccccacatgtcagctgcaaaaagaaataattttaaaatggtggggccatgtgggccccacatgtcagcctcactcctctcttcttccctctcccttctatctcttcttccctttcacccctctctcttcttccccggcagaggacggcgcgggtgggcagcggagcaggcgagcttcggcggcggtggcggcgggcgtggtcggagccgccccccgaccggagcgccaccggtcagcgtgaaggcgagcagcgcggtagcgccctggaaggcgccatcgacgctgccatccgtgtcaccgccgccgaccaccggaccatccgtgtcgccgccgccgacctccgcgcgcgccgggacctccgctgccgacctccgctgaccaccggaccatccgtgccgccgccacgtcgggacggcatcgccgagcgcctctacaccgcgctcgttgtcctcccgccgcctacgccgcgctcgaaccatgtcaagctccctcctctcccgccggcgagctagaagggcggcggacggctaggcgagctccctggcacaaccaatcgactaaacaaattcttatcccttcctctttgatctcttctccctgctcaatctcaagaacgtacattttgtgttcgacaaattttcatcaagaaatctcaagaacacgtcgtgttcaggcaaaagaaagacaagaggcgatcgatggcaatggccatggcgaagctgttcatcaccgggctgagcacgacgatgacctgctcctccgcggtggtgttcaagggcgccgccatggccgtcgtgctcctgctcaggctggtccagctcctgggctacctcggctacctcctcctccgcgccatcagagctgccgtcgagggggccgtggcagccgccttcgccgccgccggggacgccgtcgcggcggcggcggacgccgcggcggggtggagggatgccgcgtcgtcgaacagcaccgcggcggtggcattcgtgcaggccgccatggggaggcccgaggcgctgctcgccaagatgctcgccatcttcggcctcgtcgccttgcttcgtgcagaccatcatcccggcacgtgcggagggtgtctgggtggtcggcggcggcgacacggatagcggcgtcgaagaaggcggcgacgcaacggaggagaaggaaggagagaggatagagagagagaaaaaagaatagcgaaagaggggcagtgaggattcagcctgcaagtggggcgggtcgacccattaggtccgtggcccgaacctaaatttgtggcaccaataggttttcgggccggcccatattttcttaggtgacaatgggtccaggagtcagttgaccctaggggtttttgggtcagccttgttcgagcgctccgcttgctcgcgttcgcatggcggcggcggcggctttacgggtcccggcctgaggcggtgcggcttcaccacggatcgagccggcggcggtggctcccggcggaggcggcagcggtggcggcgcagctccatcacggatcgaggtggcggcagcggctcccgacggaggcggaggcggcggcagcagcggtggcagcttcgacttcgcggtgtgctccaccgtgttttgaggcggcggcggctgggcgtgctctttcagtcctcctcccgtctccaactccccccaagacgtactgtggttcccatcgtagcaactagcaacggattctttggttcttgattttctctttcttttctttggttcttgattttctctttcttttctttggttcttgattctttggttcctcttctatgcagttccttctttcggcggcggatggaggcaccggcgggtggcggctacctgcttggtggccaaccggcgaggtgctacggaggacactccaccggcagcaacggcgagggtttcggaggacacccggccacatcgccaccttcgtccagctgggtttctctccctcgtgagcacaggtatgatttcctccatgaaccctgtcttgttcatctgtcttgctcggttttggtttgatttgtatgtacagagacaaagtaaaagaccatctatttaacacaaggcagtaggaaactttaaattagcagtaattgaaactttctgctagataaatgaagaaaattagtaaaatctgcaaatttgtgtagcacctgttagatgattcttgtattccttaatctctgattgtgaatactattgggtgactgcagattacttctgtttttcaagcatgttttatatgtcaaatactcaaatgcttagaacacctactgccttgattcctctgtctgtctgcatatgctcatgtcttgattcagttgttgcccataaaacataaatgcaccatttctttttctgagagatattgcaggttattacctttttaaaacaattattgtatattttcttcctgtcattataccatgatcattcgatctctccatcatgttaacctgcagaatctggacctgggtgattcaacgaacagtgcaagctagggaatgccaaatgatgcccactttgatcttggaaggcttcattttgtttgatctcaatctaatgaaccggatatttgggttgttcagatcgatttttgtgaatgatataagtatatgcatgtacttagttttaattgaactaggtgctagtacccagtgattgatgtttgtacttttgaatgcaaaagattaagtcatttcggaatgtttgcattgggtatacagtgtgttctggtatcgtttttgattatttatttattttgctgtagtgatgttgatttgcttcgcacaatcgaaatttctagtatgttagtatgtgttcagatataatgccagtgtatgtgttttttttcctaatttcacttgatatctgacttatataaaattagtatagtaaagaaatgatatcagtgtaatatccaatgattgttcattttttaatcttgtataattgaattgagtgtatagctacttgctttaatggttcaatgataacacattaacacagccagtcaaccattcactggacacggtggctcagacgctcagtgcatccagcccgcggctatggtgggtcggccacgaacctaacgggccggctccacttccaccagagacggggcgagtccaggcaccaagatagatagggtcagagggtataggggatgggtcggcccgatctgccccctttgcaggctgagtgaggatgacaggtggggtccacgtgggccccaccattttttaaattattgtgtgtgtgaaactaacatgtgggtcccataatttttattatttttcggatcgaattgccacgtaagcgtcacgtcaatgccacgtcagatgaagaccgagtcaattagccacgtaggcgccacctcagccaaaaccggagtcaaatactgccgagggaccttatttaaacggtttcgtaagttgggggacctgttgtacccggttttacgatcaagggacggaaatcagactaggcgacaaatagagggacccaaagtgaacttattcctttcgagttttggagactttgctagatgggctagcccaagaaattaaatgcagaattatttagaataggaataagttcactttgactcccttctagtagccaaatatgattcgtatccctaagccacaataccggatatcttggcccctcaactattaaaatcagtgcaatttgacttcctcgacagttttgaaggacggtttcgctgacgtggcacctacatagcggtgttgacctagtctttgttccacgtggcattatatatatatgacccatttatcattcacccaaaaatatttgtgggacccattgacatgggacaaataccaggtcaacaccgccatgtaggcaccacatcagcaaaaccgccctccaaaaccaccgaaggagttaaattgcaccggttttaatagttgaggggtcgagatatccggtattatggttcagggtatgaatcagattcggccactaattaaaggagtcaaagtgaacttattcctttataatacaaaagaacgtatgagaattgggacatatgtaaattagtttaaactcttcaaaactatttcttgcaaattctgatgtactggtgtagttacttagtattattcagtccatctgatttttaaaattaatttgaagtgtacattttctttaggtcaatacaaatacaacttaactttttatatcataattgaaataaaaatattccttcaaaatataccttataaattatttttttcaaacaaaccaaaatgtatattctattgaaagcaatacatttagaggctattgaataattttttttctaagtaaataattactctttcttaaaataagagtgtaatatgtgttttggaaacctatttttatagtttacaattaaaatttacttacacagacaaatcaaaaatacatctgacttcacctatacaaaggtaataaaaacaagttcacaaccctgcatatgcatcatattcatatagccattatcatatttagtagtattttattatttctttcagttggtcatttatcttggatttttttggagttctccgttgatgtattcgttcttcgattgcgggtatctcaagcaagtacaacacttttgaccatctattgttatattttcgtaatttcaatttatatgtataaccttgcattaaattgtactttaggaaattaaaataaatatgttgatggatttgattgactagtggagcagccggttatattatgggtgcattccgaactttccattgtcatggggtttcagttgcatatattgatcatcataaggttttgttatacggtatgcaagcattgtagcgatcgtgtcgaccacatgacctggtatgggacggactagcctagtaatactttcttattggcttatatctgtggtttatggacttccatgaacctcgtgagcttgggctagcgatgaggattatgttgttgcggaattcgagtagaggatgtggattgctattgttgccggatccaatgatctgctgttgttgcagggatcgctgcaaaggtatgacatattggattgatgaaaagtttgtgttcttgttggcatacaccatgaagtgtgcttcaagcgcggacgggcgtgagcattaaaatgtttaaggcgtgtgtgggtacagcgacacatctttacagggtgtatgaattatgatatgtcactccttgtttcgtgtacaaattgcgaagtcattaggaaaggaacctatcggaggatctaatacctatgatgccttatatgcaatagattttataattacttaatatgatcttttataacactattttataaacatgcataaaattccttgttgggttatggggctttggagatatattattatgcaggtgggttatgggcatatatttgttggattgctacagttagacttgttgagtccctttcatactcatcccttatgtgtattcttcatttgtaagatgattgaggtaactcttaggcgacaagaaagttctacacaattgatttgatcaagtgccttagatctatacatcaactagaagttgaaagtcatgaagaaatagaagaaagtcttcaaggtgttaatagtgattattttgacaaaagctattttcttatggtttttatttcatgggctcctctacaattgtttattttatgctactctagtgtggccatttcactgtaagttggttcttaatgagaaataagacatagatcggtattctacctcagaagtgaaatgcgaaggtcactatacaggtccaaagtgccacaaaggaaaaaatacctggtccaaagtgaaaacattggttggtcaaagtaaaatttactcatacatggtcactccttaaattaacttagatcagggtgtcacgtaggtccataatctcgcaaattgcttatctaggtctgtaatattggtttaatgtatcactcgaagtccaaagtgcctttgaccagtctcaagtgccgacgtggctgtccacaatggaaaacatcttgtatctaggcccctccaaaagtacggtacccccaatctgactcccaccaccactcctaccgcgcccctagagggaaaaaaaagagatgattagggtcggcaatcagagataaatagcacaatagggagaggatggtcttggaagtctggtgcatccccatcatcatcgtgaagatgaacgatggaccttaggctacttgaaaatgatgagtagcttggaggagccatggcagtgacgatgaaaagatgccacactttgcctcctccctcgcctcctagacaccctacccttaccgcactttgcgctgccaccattttccccacccaaatttaaaagaggggagatagagaagagaggagtcagatcggagacaaattgagagagaagggctaagtgcaaatttatcaccatggtgggttttaaaggaggctaaaattcaagatgctggttaccgtggacagccatgtcagcaccctagacctcaggtgatatgttatcaaagcaagattacagatataaatgagcaattacaagactagtaatatgcccgtgctaaacgctacg

SEQ ID NO: 81729 - DNA, 1143 bp, Oryza sativa
atttatcttgttttgcgttgttttccaggattcttccatgcagaaaagcctatatttatcacatatgctgccttccaaatctttttttttccttctgatatgtcattagtatgttctggtttcgaactaattgtcattcaatactgtaaaataaagaaaacgtttagtgaccggccgtctaccagctcaaatgggaagggacggtttcttttgtctttttttttttattcagcaccaatttttcatgatttcaggaggtattccgttcaagtgaactagagtcgatgctttcaaaaatgttaacttttatttgttttgcagaaattgcgttaattagcaagccataaactcatacagcatagaagttcactccaggctgcaaaaatcaaaggccttgattaatggagattgagatcatagaagttcactccaggctagttctgttgcctttcgtttcacagtttgttgctgcgagacaacattgatagtactatttaacagtatatttctaattatttgacgaaacccgctcttttgatctgcaggatgaatgaagctgtcatattcagcagagttttttgtcaggtcgtcgtccatcgtcctcgacttctgttacggttttattcagggaaatttacacttgaatataatcagtatgggccgtcaatccatccgtatcctgctgcatcccttcgcgacggaccttcagtgatgaaagcgtattttgctattttctgccaggaatttaagttcatagttaagagaagattcaattttgttacataatgctaggtctaaaatgttagattccacatcttgtggtataagtttttatccccaaattcttcatcatgttttaacttctattctctacaaaattctatgcatgtgttctatgtaacacatccttcataattggtccttgaccacttaatttagaatatatattgtctatagcatatccttatttaatagtaatagctaatttacatttaatggaatttgtttaaggcatgtttgctgcgcggcgtgctgcctcatatgttgcacctatacactgtatttctatacaacattaatcaaactcacactctctgcatagaagttgaaagaagaaattaaattcattagaagatatttgtg

SEQ ID NO: 81730 - DNA, 14090 bp, Oryza sativa
cttcgcatttgctctgagtggtagcatcttctactcttttatgatttgtgggcaatacgccacgacctattgcgaggaacatgtctatcgagctcctattactagagcaatctaatggtgtatttctgaagcaacccgcagttcgatccatgagctcccaatcttgtggtgacttcggagagaagccctccatacaatcacaaaatggttttctactgccatcgcagacgccaaaaggtccgcaagtagcaatgcagaaactgaatggtccgcaggcagcaaataaagcgcagggatcagtgggatgggcatatacttcttgccaatattgattaacttgcgaccaaatgctcaacttgagctggccagacatgtctattgagacaaatgaggaagctaattcgtctgatgagtggtacatgaagtattcctcttcatcattattaacataagatggcataaggaaacctttggtctgtgaattcatctctagttgcgaattatgtaacggtatgagcatgttcgtcaattgtaccgatgaccaggtcaaatactctatgtaaggatctcgacgccacaggataaaacccctctcgttcagttggacgaaatatgagccgagacctggatcaataaggtttttctttgatataccggtacgatgcaacccggtgaccttattccacccaaactttgcaccaggaagcacaagatctgtcgcgtcatcaaagctctgccacagataaacatcagataggctttctatgacaaggtttccactatccaagagaattgcactagtattcatgctggttttggcttgtgctgtcctattggcaatttgtctggaccatactgtggattcagtggcacggtttatgatgatggcaaggctactgccatcttgtgagaatttcagctgtgctagattaagctcgtgatcagttattggcctctccctgtttgcaacccacacggtggtacaaactggaatctcgttgaaccatatggcgaggtaccagccaggagatgcaatgtttttatacttacttccagcgtcttcagggagtgtaggcttgaagaagccgagcgcgaacttgccatttctcgagatgagcttttcgccaacggcgagcaactggcccgccgcaagagtgtcatttgtggcatagcatgatggagtgtgcattgagaggaggaggaggaggagcccgagataggcgtggaggggaggcatggaaatattggagaagcatatagtagcagagaatatattgggagtacgtatgtatagcagaaagtcgattcaagtttgactgttgattgttgagcggcgacgctagctgccgggaaactgaactgtcagattaagtgttgatttggacatgagtggcaagcatgtacgaaccatggaattaattaggcaggaggtagactaattagtctccgttgacgccatcggcgtttaattactttggtcaatcaccaagaccaagcctctccagactggcagatttggatgcatatatgcagctgcagctccagttgctgtacgcctgtatattggtggagaataaaatgaacaggaagctactgttaatctgcacatatgtgtgttgctttgatacctgttttaattgatggggaaacagaacaaatatttgattgtgcaagtctgtgactttggcaggcacacggcaacttgagattattgtctattacgacgatacaggagtacgggaccatatatagccactttgtaccggcctactgagtaggaagaagagatgatataaataacctctagtaagtgacaatactacgcgttatgttcttagcacatcactaaaactagggttgaaagtgattaggatagtttctaccaccggacattttttcggattcggatagtttcagttggatatatccaaaaatttttgaattcggatatttttttttcggaaatgtaaacgaatatgatataggtgatctgtcggaatcggataacggtaagatactatccggtatttttcatcggatatccagtactcttatgcaaaaacatgtttttttctctacttaggtagaacaaaacaaaccatataaaaaaacaaggaatagcaattaacatacaaacaaatggaaaaattcaattctgaaaaataaccactcaaattttcaaaaacattcaattcaattctgaaaattttaaaaacttttaattcaaaaattgaaaagtttcagttcgaattcaaaactctcaactcagatttaaaaaattctactcaaattctagaacgtttaattcaatttcgaaattctcaactccaattgaaatgttcaacccaaaatttaaaatattcaaccaattttcaaatatttcaatgtgcctacgaaaatttcagtgatacacattaatttatttgtttcatgataacataaatttgtatggaaagtaaacacaacattttctatctccccatttttaaaatattgatgttttgtttctgaaaactaatggctatatctcttcctcgatttaagaagcttactttgaggggccttgatatttcgataattattcgtcaccatattcgtttcgattcgtattcgctccgtatctgtattcaatatatattcgattccgttttcgtatctgggtttccgatttcgattccgagaaaaaaatatgaaaacgaatatgatagagctagtttccgaccatattcgatccgttttcatccctaactgcaactagtaagcgtgcacgtggattccacgtgactaaaaatttaataaatagatcaggggttgaggttagaagatatcgatattttgggatagaaaagttaaggtttgcttcgaggtttcaatcctagttcgtgagttgagagagaagtgctttagatgcactttgtacacacatattgatcaaacaaaattgatctactttcaagagtttcgtcaatacatgtttttttttgggatcccaacggtttgattggagtacattgtgtggtctaaccggtgggtggtcacattggtggaagggagatggttcaaccggcagtcagaccggtggtgtgcaggcggtcagaccagcagcaatccagcaatgtaaccggtgcaacttcgtcaagttgagggtaacaacttttattttcactaaaagcttttggttttttggtgttcatgacattcatccccgtctgataggcttggttctggtattcaatcctatagagctcagcgatgccagatctggcatgggggaacacggcaatggcgggtatggcagtggggagctcaacgacgacgagtgtggagctaggagctcagcaactgtgactgtggcgctgggagctcaatgacagtaggtgcagcggccgggagtggtgatggcaaatccggtgttgggaagctcgtgatgccgaatctaacactcgagagctcgatgtcggcggtccggcggtgccaaccttgagaggtgcagatccaccgtcgctggcctcaggagctgtaaggcctcggcggcgacggacagtagtgatgaggacgatggcagcggcaattgatgtgggctagttagggtctcgaattttggaatttttattctttttcacaagcagacggcttaactttacggtttacaaaaatcacttctcacgcacgggtgtactgtctgcttgaaaaaatgctgatttttacatacacctaggaggaggcaagtgttatagcacataaaaggaaaacctaaaaaattgaaaatttcccaccagatttcaacagcatgccactcagccatttgcaaaaatgggttttagccgtttgcaaagattatctttcttagtgttaaccgtcataaattttggattatgttcctgctatttgaagaatatgcttatgcttcttgaccaaatctgcatataaattaatgtcctttggatggatgaattatctgtatacttaatatatgggaaaacctcaaagacatatcacatatgaatacacaccggcctacgtatagtatatctatgcctatacgagaaggattcttctgaacaggaatagagagttccgaacagataagcaataagacagcagctttggcaagatcttgaagaccacttggattcaaccagcatttcgtcaaaagacttccaactttccaagattatgtctagaagtccctgacgaatactagtcagggctaggacagggtcagagtattgaatcaaccaactggccatcaacccattgagccaagctgccaagaagatccagaagatcaatctcgacaagatcattagctcactaattagtctaaaatagatccgtatacatccttgtaaacataaattttccctcgtttgtcaatgccaacaggacataagtttattaatctgagaacagcctaaacctatataaaaatcttcttgcatcttactgggatatataccacagaggagacccgagtatacattttactgacaatactattctatgacaaatatatactcacattttgcatggtttagtgcttttaattttcgaagtagaaaataccacagccaaaattttcaaaaaaaaaagaaagaagctgcggtctgaaaaatccattaaattttaactaaaaccatcaaaatgtgagaatttgtcgaaaccaaatgaattcaaccaaatatgatcaagatttcaatcatctggggtactgaaacttttgaaattttggtctgaattttctttttaaccctgagcatgttcagcttgcacttgccgtctatctccaaaacaactagttggataaactttggatactcgtggcatgcttttcaaactattaaacagtacgtttcgtgtgaaaactttatatatgaaagttgttctaaaatataagattaatttatttttcaagtttctaataattaaaactcaattagtcacacattattgccatctcgttttacgtgaaacacttaatctttatcttcatcttcaggatgttcaaacaccacctaagtaatggtaccagcttcttcaattttagggtatatgtcatccgtccgatcaatgaatagcaaaacatacacaatggcaggtaattttagttctatcatatttggatataatgcgtgcatagtataatcagtcattaggaaaagtaataagaaatgagattactcaccagcaccacacagtaaaactaagcaattgccagattattacattggaactttcaatttgctcaaacaaaagactgattacattgaatacaaagtatttatgaaatattacaacactgaaactatatatgagacctttcggttatggctgcaagtagtcttggcatggggggcatgtcaacctcctgtagaccctcaagaaagcgaaccacttcacccattgttggcctatcaatttcatcttcttgaatgcaccaacatgcaactttacaaactctttcagcctcttccaaattgaaatcaccatgtaattctggatcaagcaaattctgcacacttccctcatgaagtttgctgatggcttgcacgggaaaataatcaaaatgataatggttgcttgtgtatgcttcagataaattccttcttcctgatatgatttctagcagtaccataccaaaactgtaaacatcaacttttggagtaatagcgactccgctaagccactctggggcaagataccctttagttcccctgaaagtagttagaacccgactaaaatcccttcccacaaatgccgccatcccaaagtctgcaattttaggagcaaatgatgcttcaagaagtatattttctggcttaatatcgcagtgtatgatgcattcacggcaactctcatgcaagtaggacaatcctctagcaactcctatggctatttgatgcctagtgttccagtctaggacagcaccattgctatgaaaaaggtgggcatcaagagaaccatttaccatgtgttcatacacaagtaacctcttatcaccttcacagcagaaaccaatcaatttgacaagatttatatgttgaatcaatccaagtgaactcacctcagccctgaattgcttttctccctgatgtgaaccatcgagccttttcaccgcaatagtagttgagtctcttaatactcccttgaacacagaaccaaaaccacctgaccccaacttttctgagaaatttttggtagcatgacttaaatcagtgtatctgaaggctattattccactgttgccttggttgtggtgtaatgttacaccacaacacttgaatttgttccgccaaatcaagaagaatagcatgagcattagtaacccaaaaccggcaatgcttgcagcggtaacagccacaacaactggtttttgtttgtttttggtcgtagctggcatatctttggcagctaggcgaaggtaaagagtatcttcagaaagactttcaatgctgtcatgtagctttacattaaggagttcactatgccagacaaagcatgtgctatctttgtaggcataagcattgcaggagcagttactgagacaagattcggcacatttgctttgagtggtagcatcttctattttttcggggttagctggcaatgcgacccgagttattgtgtggaacatgtctgtcgagctcttgttactagggcaatctaatggcgtatttctgaagcaacctgcggttcgatccttgagctcccaatcttgaggtgacttctgagagaagctctccatacaatcacaaaataaatctgaattgccattgcatacgctaaaaggtccgcaggttgcaaatggagtgcatggatcaggaggctgtgcatatacttcttgccaagactgattagcttgtgaccaaatgctcaacttgagctggccagacatgtctattgagacaaatgaggaagaggattcatctgatgaatggtacatgaagtattcctcttcgttgttgttagtataatttggggtaaggaaacctttggtctgtgcattcatttctagtagcgaattgagtaatggtatgagcatatttgtcaattggacagatgaccaggtccaatactccatgtaaggatctcgacgccacaggataatgcccctctcgttcagttgaacggaatatgggccgagacccggatcaataaggtttttctttgatataccagtacgatgcaacctggtgaccttattccacccaaactttgcgccaggaagcgcaagatccgtcggttcatcaaagctctgccacagataaacatcagggatgctttctatgacaagatttccactgtccaagagaattgcactagtgttcatgctggttttagcttgtgctgtcctattggcaatttgtctggaccatactgtgtattcagtagcacggtttatgatgatggcaaggctactgccattttgtgagaatttcagctgtgttagcttgatctctagatcagtgattggcctctccctattagcaacccacacggtggtacaaaccgggatcttgttgaaccatatggcaaggtaccatccaggagaggtgatgttgccatacttacttgcaatgccttcagggagtgccggcttgtagaagccgagcgcgaacttgccgttcctcgagacgagcttctccccgacggcgagcacctgccccaccgcgagggtatcattcgccgcggcggagcatgatggattgtgcaaggagaagaggaggaggaggaggaagaacccgagatgggtgtggagtggagacatggaaatgttggagaaagtagcagaggatggattggagaggcagaagcatggatgtgtgagaagtaggtgttgttgggacttgggagtgtgtggtgatatatacaggaaaattgatgcaagtttgactgttgatattgagcagcgacactagatgccgggaaactgaactgtcagattaagtgttgatatggacatgactggagcagttgtagactagtctctattggagtttactttggtcaatgaccaaagaccaagtaaagctgtagctacatgcctctccaggctggaagatttggatgcttgcagctgcagctcccagttgctgtactcctgtgagctggtggagaagaaaatgaacaggaagcttagtgtgaacctgcacaaatgtgtgttgctttgttagctgttttaattgacggggaagaagagaatggatttgtagaaacagaacacaaattgtttgactgttcaacttcagcaggcacatggcaacttgagattattgtcgattacgacgacacaggactgcacatggccccacttgtaccggcctaacgaacaaatatataatctcaagtagcaagtgacagcactacgcgttatgttcttatattagcacattagcgaaaagaacaggactgcagaaaaaccagctacagattaaccgctaaacaactcattccaaaacacagttgttcttcctagtgaaactaacctagcaatctcattgacaagacagagagttcttgttactgcgaactttaagccttgcattactaaataactaagaggtgcttcatctagctgatctattgttacttctttctcattttttctttttttaaaaaataactgaaccggcagaagaactgccaattgtattataataagtcggagaaaaaacatagccaggttacaagaaaaggaaaaggtaacacctcggcgagaaaatcctcgccaagcacctcagggaaaaaaaaagcgccactactaggattcactgcgtcttctttcttttttttgaccaggcatcaacaaatatttccttcctccagacagaagactgcatcagtatccaaaatacaataagtttgaggcagagatgtgcgattcaatcaacaatacgtgcaatactgaatgccctttcaaagataaggaacaataatttcaaagatgaaggtaaataagaagccagataatgtatcaatgtcagataacaggtactaagatctattccactagtcaacaaattgtgttcctgtccagaattactcatgcggaaactgtgttaacaagactaacatgaaatgaaagatattcaacaagtaaacagttcaaattgtagaagtcaagttattctgtttctatttatattttcatggatcgtacttgacaacaaaacacaatggatcatgttttccttttatcccttctaaatacagttttcttttttcagttttcctttccttgttttctaaatctctatttccagttctagttatttatttctatcatttgcaataaaaaaaaaatcagaaatactggaagaatgaaaaaatgtcaacagtaagcttacgttttggttgttgtttcctctgcttgataataacttttttgtccaatgtactcaaccacttcccaattttgtaaaccccctcatcaacttctttacagtggactttcactaccttaaggtgttctgatattgcagctggtttccacaatggattgtcattctcttctgtttccaattccaccatagatttatattcctgtagcagggaaataaatttcaccttcaattaatcatgcacaacaactttaacaatgcagcagttgtaaaaacatataccttggaaattttaagagtgagcttccgtagaactggtgagtgttcaagaatacaagctagtgccgagaaattagaagcaagacaccactcattgagtaacaaacacttcatcttgctaaacaaagggcaccatcttaaatcacttctgaaaataaactggataaagtgcaagcgagaaagtcaaccgaattttgttgtgaatacaataatttaagagccaagacatagtaatgcatgaaacatattcttaagaagttaaaatggtgaatcagatacaggaaataacataaattaaggagatatctgataagatgttaacgtaagcttactatgttaggtccagctatcaacttcaaattctcagcttctgttagacctcctaggagcacgctttcagaatcgtcgctaacctcatatctacaatgacagccatcacagtattcatcttcacaattaccagagtaactattactgcacgagtcatcgcaatcctggtggggtctgacagatgcttcaactaatgagggcattcttccgagaaaaggagttctgccacaaaaaccttcaagtaagagcgtaacgaggctcggtgcataaatgtccgtgcggtgatactcaccgaattgacaatggaagatatgaagacattgtatcgaccgggacaaaatctcgtaaacggaatcaaagccgcaattcttggtgaaatatagctccttcagcgcaggacagctcgagaagttaaggaagcaattcttcaactctataccagagagttctatcttggtcaagtgtggcgagacaagaggcatgcccttgtacacttcaatgtctatctgatcgaggttatggatcttgagcacctgaactcggcacattacggcatacatgacccacagcatgacgcattggtatggatcactgccgccatcatgcaccacgtcctcgtatcggcgtgcattgaacctcaaatcaagctcgcgcaaaggcgagatgccacggaggagcaccagatggttgacgaacttcttgaactcgtcggagctcttccatctatcagtactgtaagcgacgcgcaggatgtccgtggatttccagaggtggcgccatcgccgggacaggacgcaggtcttcacggcctcgtcggcggacagcagggacaggatctgctggaggagctcgtcggggaggtcgtcgatcccgcactcttcgctgggagacattccgtcgaacaggtggcgggcgtagccggggcactgtgctacgcaaagacacgaagagatcggatgatcccccggcttcaccaggcgctgtgtcgccgcttcgacttcgcggcggtcctctgcgcggcgcggggcggcgctagaacgaagcgcctcgacggggctcttctgaggaggcgtcgccggcggtggagtcggaagccggggcgccgcgtcctctagaagtccagcccttataggatagactggtaatatattataaaaaggtaatagaaactccatgcattacggtttttatttattaatctggagaataaactccagatatattatcatccaaatcacttaaaaggaaacatctcaccatgagctctataggatatgaaacatgtccaaatactttgccagatgtgttatatgcagagcaatgttgacatccaaatatccaattcagagcactctcaggatatgccactcaattcgtagcacttttatattatgccactaggagtgtgaattccttttttcccatgccactttttgtcgttcaatgtcaactctccaccctcgacacgccggcgagtttctccgtccaccacatgccaacgcctgtgggatggacaacgagttcgtccgtcctccacaccgctattgagggggtcttcttcttatcttcctggccatcaaagaggcgaggattgcctccacatcttgttggccatcctttttaacggatgctccgacgaggaatgggttggcaaaagtcgagaaagtcattcttgaaggcggaaacaggaagcaggggtcagctcgaccttgatggcgcaaccctccttgttatctcgggctactccgggcataggatgggtgggcgagcagaagttgagaaggccatccttggcaacgaagacaagaagtggtggataatatagtgacgttgatgacgtttgcagtgtacaaataaacaaggtagatacatacacataatgtttttttttttgaaggaaacccatacatatataataagctagagcgatttactgagccagattctatgtcgcagatatccattcggtgtatgccaccttgatcttcttcagtctgacgaccacatcactcattgtcatcctttcatttggcaaatcactagagcagatcaaacccagctcaaatattggcacaagaaagctctcatccaagttgcagctggaagacgaggagccttgcagtagatgcctatccaccacatggacaagttttgtaggaaatacctgatgaacccactctctaaggcttattaggtctccaagaaacatagcatccattggtctccttccagtgaaaacttcaagaagcatgatcccatagctgaacacatcactcttacgtgatgcttttcccatagagccatattctacacaggaaaaacattaaagaagttatacttaggacgacgtgatatctatcttctatctatctatctatctatctatctattatatactaaaagtccattaaacttcctacaaaaactttcaagccgctatgtgggattcctataaatgctcctaaactgctacgtggctctctaataaatcggtaggcccacaattttcatctattagatttatttttagaaaaaaaaaacaccacaatccatctccctcccctctccccaccagcccaccctcctcccctacgtgagtacgtatcctcccccctcctatcaaatcttctcgtctctttatttcttttcaagtttattataattaaaaatattttttaaataattttcgtatagagaaataatcataacctttaaattgcacataaatcttttttatcgttcttcattgtcgtattcatagtgcttaatcaatcattcaaataccaataaaagctactatattatttaccaataaaagctactatattatttaactcataaggaatatttaattttcatcatatcctaaccttaggatgcaattgaaactgctaaaaaaaatagaaaaaacaacaatgtatattatatgatcaagtatcactttataaaatattcataaaaaaattaaatatgatagatatgacaaaaataaaaacacttaaatcgttagtaacattcaaaaataattcctctattattttaaatcatatcagtacctttcgcatgccatcccaataataaaaaaaattatgtagaaatagataatgtagatcatatcatcatatatcacttcacaatcatgtataattagattagatctataatatcataaaataaaatactataattagttctgcttagcactcaaaaaaaataccactgttctaatattgatatgttaaaataatattatttttcacaaaacgaagtaatgttacttaaatatttcatgaaaaattgacgtcatcataactttcatatttaaagcaatctacaatatcccaaactaaaatactctaattgtgattagcattaaaaatattatctccactttaaaatatgaattatcacaataatgtaaatctagatatgtctagataaatattttgatataattatatctttagtatttaaaggactataaaaaatagttaaatgaactagaccaatgtgtcttaattaagagtaataggaggtgtatatgtttatccgttcatcttcaatctttcgagtttaaacttaagttaatctgagtatatagtatataaggtccaatgtactcgtctcacacatatcttgccttatgtgtcaattctatgttacacttagcccttgtatcaattctatgtatgtactgctatccaccaatcattgaggcagaatattattatatactctttccatattttaatgtatgacacggttgactttttaagatacatttgaccatttgtcttattcaaaaatttatgtaattattatttattttattgtgatttgatttatgatcaaatgttcttaaaacatgacataaatacctttttgcacaaaaaatttgaataagacgaatagtcaaacgttggtccaaaagtcaacgttgtcatatattaaaatatggagggagtactaaaaggccattgaacatcatacatacgctactaggccaccacgtgatccatctatctatctatctatctatctatctatctatctatctatctatctattatatactaaaagtccattaaactttctagaaacgctcctaaaccgttgtgtggtgttaccataagggggatc

SEQ ID NO: 81731 - DNA, 6491 bp, Oryza sativa
ggtggcgggcggtcgcggccgcagggcaagaaacaaccactggactgcacgggcggatgaagctggagcaaagcgagtgagaatcagaggcagagacagacggagacctcgccgccggcagcctcgcccgccggagctgaggaagatggtagtgtactccagccctcgagtcggagagtgtccgaatgaggaagaaaaggccaggaaataaagaataaatgggctggaccagaaaggcccatttaacagggcacattgaaaagtccaacttcgagcagtacagtacaactttaggcctatgtggaaggcccaaccttatgggtaaacaggcctaatctcatccagctcaaaattaatacattgtgctatacatttgtagattaattttctctcaaaaaattgtagaatgtaaatatattataaattacattgtaacttgcatgtaattggtatgtaactttcatatgattattatgaatagttagatttgctttaaaattcgtgcgagtgacaaagggaaaaaaaatcccaatgcacgtaaggggtgaggagatttaatcccacgacctccacttcataaaatagcatgttaccgcaggatttttttaaaagttccatacaacttatattctataaacatataagttatatctctacgtttcttttcgtttgacaccggttagttcaaaattgcactaatcaatatcattcatttggaaacaaaagtagtattatggattcttttttttaaaacacagtacaaatgtggtgtccacaacgcatgcacactcactcttataaacacatacgcacatcgtacccctatgagcacatctgaaaagactgggccggcatattttactgtcgatggatacgtcacctactactgaaaaaataattagccgtaaataagagcacccgtgttaaacttaggatttgatcccgagtggatataaggcccaatgtaattattctatgattatatcatacttacatttaatttttttagaaagtttattaataaatatacaatatatacatagcccgagattaattcctcgggtatgacagaaagcacatccatcaatttgcatgtgccaaaattttagttcactttggtggcctattacactttgatgggccaaaatttggtccatccaaactaggtctaattgaccaataactctgagaggaattgagcctcacaaatggggcaacgaagagcactggaaccttcgtttcataccataggtcattttaattttttcctaagtcaatttttttaggtttgatcaaattaataaaaaaatattgtaatattttcaacacaaaacaaagaaactaccaaaatatataacatgttcaatattagatgtaatgaaacatataaatgttattatatttttttataaatttggtcagacttttaagtagtttggtttaaaaaagtcaaaaaaaattataatatgcaacgaagggagtaataaatttcaaaaggttggtatagaaattcaatgtttcatggtttgatctgcataaaactataggtagattctcatccataaccaaaagaaacatctatcacaaatcaaaacgacatgagctctatggatcgacaaacttgcccaaaatacattaccagatggagcaatatttacagaactaacagatcatcatcccagagagaatgaatccgagttaaccaaggggccaaaagagatcaaagcatatggttggtatattaggtccaactagattacctgcacttctaaatccattatttgggcactacagttacaaattctgtctagatcatttcgtcagttctaaaccgcccctatgaggctgagactgcaagaatagggcatgcttgtcacagcagattaagcaccaacgctctgagtagcagtagatcctggagagcccaactttaaaacgctactcgaaactgaaacctgtcaaagaaaatgtagggtaagttcacaatctgaggcagtaagcatcatctgcagatattacaatgttcagttgcttgacagtaaatttaaataccggaacagattgtgaactatgaagagaggggatgatctaatcttatctaaatatatgtctgggacttaaccgatcagatgtgggggagaaatatttactccggttaatgacttaaccgatcagatgtgggggagaaatatttactcccggttaataacaccaaccgatactaaagatctaaatgatcatttaaccgggagtaaatgataatctttatcccagttggtagtatcaacctgaactaaagatcctcggccccctgacatgcctctgacagaggatgaaccgggactaaagatgatcctttaagatcaaaatttttttaaccggcatttttagtcccggtttttaatgtgaaatttgatcgacctacgaaaaatggtttctccacccatgaacacacgcccaaatagtcaaatacattaccagatgtgtgtactattaaacattactggcggagaaatgttgattaaagcaagatagcagattcatcatccccgagagaatggatccgaattaactagcatagttccaactagattacctgcccttcttaattccgtctactacagattcttactaggtcattgtcagttctaaaccgttcgtgtggctaagaactgacataggatatactaactccatcccataatacagcaaccatctcagttgtcacagcactgaacagtaaatagactagtagattcatgtacagcccaatttttgaaccctactcgaaactgaaacctgcaagagaaaatgcagtcagttcatagtcagagcatcaactgagcaattaaaatgtgcaattccaagaaactcataataaggtaacagactacaaaaatagtttttttttaataaaaacatggttagcaatttgtttcatataaccctacttaaggaaaaatgtttcataaacaagcatctatatgcaaaacaattatgccactaaaatatataattatatagtatttcaagtatatactcacagagtaggcctaaaacacattcctaggctacgctatctctcccactgcacgatggcagaaaaaaaagatgataatgtgataatgtgaaccccagcagtaaagatacgttaactagttaagtaaacccacaaatggtcatgctatcagcaatcaacggttgaggagaaggtagctaattgtctatgtaaacccacatacgatctttgtataagcattatacacaaaaataatgggccatacacaaatcgatgatagacatgtaactaaggttttatgaaaagtgttgctccgaaaacctgggtttccttgaaataaatagtgaaacctagggggttttatgaacctccaaaaccaagattttgtgaaatgtactaaaagaaaggtgaaattcacttgatcagcatgcagctcaattaataacagtaatacgttctagtagtaagtagtaacataaagatgacacaaaaatatgattaatgatcatgaaccatttcccattttccacctgctctcaacaaaaaagttcatcagcctaaattaccccctcacaaacacagaccaaccatgttttctcacaagtcataacatccgagctacaatcaaaacataaatcagtcgaaggcgtttcattcacaaggaactattgaagccatcaatcggataaaggaaatagctggacatggacatggcaagaatggttttcttcataaatgtgcaaccagtacaaagaagaaaaataactcaaattattgagcatgtgagactacaggtttataaactgatgaaaacaaggcccatgtaagaaagtattttcacagtattataaaagaaaacgaaggtggaaaataaaatgtgttattgcttacaattactgattgttaagttataaaaaaaaatacaatcgtgctgcttcggaactagtaatcagcaagccaataaattatcagcacaagtcaaatattgaaaactattcaacacatcaccctactgtttatgcgttgtacttgacaataaaatgaccgtacatagctttatgcatacaatctgccaacacaacagattagattgagctccacgttcccaccaaatgcagtgcaggatttttcattttcttttcaatttcgtacagctatctcttgattttctaacaaagtaggagtttctacattatttgctttctttcataaatatgaacctggaggaaaattttagaaatatagaaacaatgaacagtgttgctagttatcttacgaatattaaatgtagacaggaacttcaaaactttggtaactctctcatcaatcactccacatttgactacgactgacttaagatgctctggtattgcagatgacctctccgtttgattatagcttcctttcatttccaatatatgttcagattcctgcaaacaataacagtgacaaaaaataacaataaaacagttggccaagatcaatcaatgtaatgtaataaatgtaaatatgtagcggttttctatttagaatatatgtacctgacaaaaaagctcaagagtgagtttctctagaactggtgagtgtcgaaggatgcaagttattccatgcaagtcgaaggccacgtagaaggagtcaatgagtaacaaagtcttcaagttactaaatgtagggcaccgcatcatgtctcttttgaaaacaaactggacaaaatagacacagaagagatccataaaaactcgatgttaacaatgatttaagaactcccttgtggtggccttgcatgcaaaaaaggttattgcaattgttaattacgaatatccagtggtgggtacacatagattctgcataggaaagatagaagtgtaagcatagcgatacctcttgattctgagctaccaacatcaaactcctagcctgtgataaagcttgcagaagcattctgttggtgttactataacaaagctcacaatcgtcatgagggcattcctcggagtcagcattaccacttgtacaagttaaccaatccccagagtcaccggttacactgacaaatgctttcactaatagcggcataacctcaaacacaggagtccggcagcgataatcttgtagccacagggaaagtagattcggcacatcaatacgaattcggacattttcgctgaaagtgcaatgagtaaggttgaggtgtttcagggactgggaagagatcctcttggcatctgacaactcggaggagacaatctctaaattttctagcaccggacagctagagaaatcaaggaaactgtgcatcaatatcacaaaacgaagctctagcttcaccaagtgccgggagacgaaaggcaggtcgtgtagctcgaggccgaagacattcagccggagcacccggacttggcacagcagggcatgccggaaccagaggttcatgctgcggttgtctccctcggccaaatcgatggaacctagctcaaacgtgtcgaggggcgcgcccccgcggaggagcagcaggtggtgcacgaaatcatggagcttttccacaccgtagccttcggagatgcgcaggcccgtggcggacttccagaggtggcgccagcgccgtgcgagcaggcacgtccgcacggcgtccggcgccggcaggaacccgaggatgtggtggaggaccccatccggaaggcatccaatccgatcctcgtcggcgccgccgcttcgagatggggatcccttaacccttttccccgtctcccctggacgcattccgtcgaacaggtggcgggcgtcgcgttcgcagagcaagaaacgtccacaacgcaagggacgatgcaacggggggagagagcgggtgaggatgagagacggtacaaatgcctcgccgccggcagcctccctcgccggagctgaggcagaaggtaaatccagctatgacctatgagtgaggcattgagtcctcgccgcctcggctggacggaagaaaaggcggagacacgaagtcaagaaaggataaacgggatgggccagatttccgacccattacctctctttgggctgtcaagtcccacatttggcccatgcaaggggcccaacctttgagaatgtcggcccaatcccatccggcatgatccataattttgaggaataagttcacttcatgaccctcaaatgtgatcgaaatctaatccatgaccctaaactacaaaaccggatatctcaacccccaaactcctaaaaccggtgcaatttaactcccttggcggttttaggaggctgttttgctgacgtggcgccacgtggcgcctacgtggcaatattgaccgagtttttcttacacatggtgttgacgtgacacttacgtagcggtagaaataaaaaatatgcatggggcccattagtcattcacacaaaaaaatgtaggcccactgacatgtgggccgacatgtggggcccacatgtcagtccttcttcctcctcc

SEQ ID NO: 81732 - DNA, 23358 bp, Oryza sativa
gtctcgcaatttacaggcgaactgtgcaattggtttttttcgttcatatttaatactccatgcatgtgtttaaacattcgatgtgacgtttttggaagaaattttttgggatctaattaaacacaccctgatatatatactgctccctccgtttcacaatgtaagactttctagcattacccacataaatatagatgtcagtggcggatccatgatttatgtgatggttattcggaattctaaaataacagatatatcgataccgattgacatatattgactgtacgatacatcattttgatgcataatctttactacgaattgtgcgcatatataataaaatatatagaaacatttataatttcctataatcagcatcaaacaattttctattgatctaatcatctaagtatgagtgaagagtaccaaagaatttggaatttttggagattgtatagcataggtcgatagctttatgtagcaaagatattctgatttattgctaatgaaggaaaacactcataaaccacgaagaaactagtagctagcaaaggaatataacttatttcggtaggacaattgatatcaattagacaacaacatgtagagaaaaataactgagtgggcaatatatatatgtatatacaatttgcaaagataactattccctccgtttcataatgtaaaactttttaacattgtccacatttatatagatgttaacgaatctagacacaaaatcttacattatgaaacggaggaagtaggcattaaagtaattgcttattaattgccacaaccaaaatgtaaataagaaaatcaaattagcatgaatatattacaaaagaaagggagggactaggaagactattgatcttgttgggctgaggagagctagaaaagggtggaattgaattgttagggtataaatatcacaaatcaagatagactatgggggtacatataaattatggtcaatatatattagatttgtgtccaaaaataaattatgtgggatccgcccttgatagatgttaatgaatctaaacacatacatatgtctagattcattaacatctaaatgaatgtgggcaatgctagaaagttttacattgtgaaacggagaaagtagtagaattattgtcaagaagaactggtatttttagttgttagttgtatgcaggagatgctcgctacgctagtaacaccaactacattcttttgcagaacaagcggggccatcggagccacaacttccagaggggtatggttcaggctatatgcaacctgggtaccgtggtgcctataccggaggtggtggcaacggtcaaaacggtggtggtggcagtggttattatcataatccttgatgtggatcagtattgctataggtggtggtatgcaatagacaacgctatgtgtgtctatctagctatgaaataaggcatcgttcatcagcttgaaaacactttctatctctatgtgtttttttttttggcgaacctatctatctatgtgtatcgatctagctaccgaatttgacatcgttcgtcagcttgaaacgcttggataaaaactggattgttttgctgacagaattgaagataaagatccataagttttatagataatggaaggtttcccacaatgaaacatgtagccaagatatcaaaaactctgataagaaaaacaacaaagtaaaagaaaagaaagaaatagaaaaacaacaaagtaagagaaaagaaagaaattcaaaatcttgaaattgcggccggagtaatccttcttttcacagcttgttctgtaatgttaacacaaaccaaatccaacataggggaagagaaataatttcatcttgcttgaagttctgaccaccaaaccaagaccacttatagaagcatatccttagggcattaatagtgcaagctatggggcccatatagggctgtcaacgagccgagctcgagcgagtttggctatgtaggcttgagcttgacatgaactcgagccgagctcgagccgagcctggatattgatcgagcttgggagtgagctcgagttcgagctcgagcgagcttcgagcctactcgagcttggctgcttgacttggtgaaactccaaagaacttacttttgtataagagatattaatgcaaattatcggtagtcaaaattaatgggtgctacttgtcttgaatgaagcctctgcagcttttctcatgaattcatggctttgaaacattgcaattaacaaaagctagctactacatctaatatgaatagtagtactattactagcagccagataattgctttattgagaagcattgatgaggtcttgagacttgagcatgtcaagcacgatgacaaatatacattgacccatcaagaatatcttcctacatgcaatacattttatactaatcaagccctgccgagctattcgagctcgagcttgctaggcttgcgagcctcagcctagtcttgagcttggcttgtctagtattcgagccgagctcgaatcaagcctataacgaatcaagctcgagcagcttgcgagctccgagcttttttgacagccctaggcccatacccttagcctcaaaacttggcccaaagacacccaccccacagtacaagcacccacccatagttgtctagattaattggatggagacactaagtcagggtaccaagcccatagtggggtgtgaccctagcgcccaacccggtggaccccacgaaaatttatttcctccgctttccgttccaaccctcgcctcctctcctcgatggcatcaatcgagtactacttctcctctccatcctcgagttgagtactactccaccactcctccttctcctccctttgccgcgacgccgacgggaaaatccgacgaggaggcgtccccagcggcggtggctggcgcggtggcgggaggcgtcctcggcagcagtggctggcgcggcgaggaggaagcgagcgcaggagaaggatggaagcgggcggcgtcctcggtggtcggcgccggatctcctccctccagcgccggcagccgcggttgccggcccgcgcggtgttggtggctggcccggcgacgggagtcgtccctggcgggagcggctggcgcggcggcttgatatgatgatagattggctccaactccgattattgattgttgtttttgtgcatgtgagatgtgttgttcattggttaatatgagatctagggcctgggttcctcttgtgttcttgggacggatcaagatttctttgtttcttttgcttcttggtgattcctcttgtgttcttgggacggatcgagttcttgcttgggaagttcttggggtgtttcggtggcgggaagaaggaaataggtgcggcgggagaggattttggagggcaaatcgaagatttcgccaggaggtatgggcgcgaggtcacgagagagcgaggcgacgctgcccacagcgcgcgtgcccgtgactttcggcgtcgcgcgctccctcacttggaccaggttcctcgcggctttgcttggggccgaggggctctgctagggcgcgcgaccttgctccacgcaagcacaaatcctcgctggcgcggtgtagcaccgggtccacgtcattgcaccgtgagaggccttacttatgtctgctatacttaaggaatgcgtcagcttatgttgcagggtaacggctagcacggtgattccctctgtagtttgaaatgctagctccgctcccaccgcctcccgtcggcgtcgcctacgcccctccgctttctccgcgggtaccaggaagtctccgcagcagcctggccatcccccgtcgctcgtggtcgtggccccaggccttcgtcgtggtcgaagctccccctgccaccgccgccagctacatccacatctacgcgctttgccccgcaaggtgcctcgttccttcgtcgatgtcgtcagaggatctgcacggatggattcggccccaactcctccacagctgactccacggagatttttttttcatatataccaaaaaaaacttgtttcgctataataccatccttaaaataggattcgaccaaatgccactcttaagtcacatgcattcgctataatgcaactttcggcctttcttccatttccaaaatatttttccacaattttagcatttcccggacgcttttgccccagagtcaactggttgaatcggagcagtggattcaactaggagcaacgcttgagacggccgagctcctcgtcgtcggcaccccgtccgggttgccagaggggaatccccatttggacatgctggagctcaccggcgagccgaccaggagcgaggcggcggcgccgaggtctcgagagctcatgcttcgcagcgtctgctgctgcatcttctcctgctgcgccagagcggcgaggaggcgggagttcatcggggagactggctccggggtcaacgcggccgcccgcggcgagagcaagctctgctgctgctgctggaactggttgagcacggcggccttgcgggtcggggagaacgccgcgccgccttggtcggcgtaacgtggcgagcgcgacgccgcggcggcgagctcaggctcagccgagaagagctcgtcgagatttgacggcacgagcgccttccccctcgcggaccggatggaggcgggcgagccgacgaggccatcgtagtccgcctccgccgccgccgccgcggcgagcagctcgtcgacggccatgtcgcgggcgctcagcaacgtgcgcagccgactcagatgcaggttcccggcgctcccgggcaggcagagcgccggcatgctcggctgatgcgaccaagcgccgccgcccatcccgctccccccgccgccggccgacggcgacagcggcggcgtgaacgacgaccccggcgacgacagccccatccccatcgccgccaccgccatctccaacgccctgcgcggcgacggcacggccgaccccgtggacatgtacagcgggcagagctccgattcaattgactcaggggcaaaagcgtctgggaaaagctaaaattgtggaaaaatattttaaaaatggaagaaaggtcgaaagtggcattatagcgaatgcatgtggcttaagagtggcatttggtcaaatcccattttaaaagtagcattatagcgaagccagtctttttgggtggcatatatgcaaaaatatcagctcgacgcccccaattgaaatccacatttactctccctatccgaagcagctaccatccggccaacaatgccaatggctagcggcgaagtacctcctacgactctattctaccccggcgtcacgacgctggtctagaccagggagacagcacggccaacaaggagacagccggggaaaccgcttggatcccgatcaaaaggcggcattggtggcgggtccagctcaacagcgacaaccgacaacgagttgggttggcccgatggtggcagcgttgaggagtgagcgagaggcactgacggaagagcagctggatagacaggagtgacgtggaaggaaacaattcgcattcctagtagcaaattacagaaagtggtgccggattgggtggcaaattctaaaagtgttaccaattggatggtatataatgaaaattctcaaaaatcgacatgctaatcgaattgaggaagcagaattcatcatcccacatagaataaatccgaattaaccaaaaatttcaaaagaaatagcaaatcacagtatactaggtccgtccaactagattacaagcacttctaaactctccctaggccatagtaaggcagttacaaatacagacaaggttattttgtcagttttaaacagttactatgactagaacatcaatatgataccaacagacataataccgcaaccttctcaattgtcacagcaaattaagcaccaagccaccaatgctctgaacagtaacatagtagtagatccatggaacagcccaacttttaaagcctactcgaaactgaaacctgccagagaaaatgcagtcagtttatagcctgagaattatctgcagcaattgaactgttcagatacttgacaagaaacttaaaaatatgggaacagacttatacaaaaaaaagtagttttaataaaaaccaatgttccgaaatttctttcatacaaccctattttttaagaaaaatgtttcataaaattagcatctttatgcaaaatactcaaagccattataatatatcttatctcaagtatatactcacataataggaccgaaatacacattcctaggctacactatctctgtcctcactctcccactgcatgacggcaaaaaagatgaaaatgtgaaccccaatagtagagatgtattaactagttgtataaacccacaaagggtcatgctaccggcaaccaatagaggagaaggtagctaatatgtctatttactcaactataacacattcaatctttgttcaagtactacagataaatataataggttagagtcatagccaaatcaatgatatatggctatatgcatatacctgaggttttatgtaaagttttgctccacaaccagggtttgtgaaatttaccaaaaagaaaggtggaattcaattgaccaggatacaatttaatcatagtaagatgttctagtaaattgtatgcaaaaacatggttaatggtattgaaccatttccacctgctcttaacaagagttcatcagcctaaactacccctacatatagaacacagaccaaccatgttttctctttaacatcagaaagtaagcatcagtcaaaggaatttcattcacagggggccaggtaaggaagtatcataagcaattgcagagcataataaaacaaaaaaaaaagtggaaaataaaagtaaatcatagcaggttgaaaggtagaaaaacaaagagagtatctaagaataagctacagtctaaaggcaccaccgcaccatgctaatgtatgtgtgctactactcagataattcaagaagggtgttaaacgcacaattaatagacatatagagagaagcattgcttcattagctgttcacatgcatgcagttagcctgtacgaagaacagaatgatgggtaatatagtcaacaagggtatggaatcgagcataaataagagtggagacacaagacatttcactacagtgcgttattccatggaactataaattattaaatgcagaaagacagacaatcttgctgctgttcagaaatcagaactaatatgtgaactgataaattatcagcagaagacaaatattcaaaactattcaacaatttaagcaatgtacttcacaataaaatagatattatatagctttatgcaaactatctgctaacatgatggattagattgagctccacactctcaccaaaagcaggacaggatttttcattttcttttcaattaggtattcctatatcttgattttctaacaaagtaggagattctagattatttgctttctttcacacaaatgaagatgaaggaaaaattcagaagtatagaaagaacgaatggtgttgctagttatcttacaaatattaaatgtagataagaacttcagaattttggtaattctcccatcaatcgcgttacatttgactatgactaacttaagatgttttgatattgcagatgatctctccatttgactacaacttcctttcatttccacctcatcatcatgttcagtaacctgcaaataataacagtaacaaaaacaacaataaaatacttggccaagatatatcaatgttatctaagaaatgtaaccacaaaacggttttccatttagaatatatacctcgaaaaaaaactcaagaatgagtttctctataactggtgtgtgtctaagaatggaagtgattccatgcaaatcgaaggccacacagaagcagttaatgagtaacaacgtcttcaagttactaaatgtagggcaccgcatcaattcctttttgaaaataaactggacaaaatgggcagaaaagagatcaactaaaacttgatgttagcagattatttaagaactcccttgtggtggcagtgtatgtgaaaaggtcattctagttgttatttacgaatgtccagtgatggacagtctttctgcatatgaaaaagtgggataatataaggggggttaaagataaaagtggaagcatagcatacctcttgttcatgagctgacaacaccaaattcttagcctgtgataaagcttgcataatcacacaattggtgttgctatgacaaaagtcacaatcctcacaaaggcattcctcaaaatcagcattaccacttgtacaactataccaatccccagatcgatcgtgtactctgacaaatgcatccactattaacggcataacctcaaagacaggagtccggtgccaataattttctagccgcaatgaaatgagattaggggcagaaatacgagtgcgggatatttggctgaaagtgcaatgtctgatattgaggcatttcatggactgtgaagtgatcttcttggcatctgacaagtcacagaagaagatatctagatgttccagcaccggacagcatgagaaatcgggaaaactgtgcatcaaatggacaccagaaaggtttagcttcgccaagcaccgggaggctagaggcaggtcgtctagcttgagctgaaagccattaagaatgagatccagccggagcacttggacctcgcacagaaccgcatgccggaaccagaggttcacacggcgggcgtcgccgtcggacgacagccgggtcaagttgagccagcacgtctcgagcggcgcgcgcccgcggaggagcagcaggtggtccacgaaatcctggagcttttccatgggcgccggctcccgcatttcgcggtcggtgatgcgcaggcccgtggcgaacttccagaggtggcgccaccgccgcgcgagcacgcacgtccgcgcggcgtcccgcgccggcagggacccgaggatgtggtggaggatcccatccggcaggtctcctgtccggtcttcgtcgccgtcgctgctccgaggtagggctctcttgcccatttccaacgtcttcccttgtggacgcattccgtcgaacaggcggcgggcgtcggggccacggtgcaagaaacaaccagtgtgactgtacggacgcaggggcagagcaaaagtgagagtgaaatagagaaggatacagcggcctcgccgccggtagcctcacccgccggccgccgcgtccatcctgccctagtggctagtgcttacggggaggcgatagaaggacgcaccttgccggggctccgtggtacgaggcgacgcggctgcagtagcgcgattctatcttcggaggagtcgccagcgagctcgtcggagatgtccgccggcggcggtgtcggtggccgtggcgccgccgtgcccgcgtctactgctatggtattcccaggctggccacctgaccgaggtaaaggcccaattactggataggattaacgggccggaccatacaggcccacaagcgtgggccatgaacatttcagtgctgggcccatttaaaggtccaacacgtaggcccgagtagatttttataaagaagcctcgtttggacatacgattcaattaccttcctgtgcaactcaactcctgtactctgtacaatttattgttcaaaactactctgaatgaaaaattcagcatgttcttacggtttaatctgcggaaaactccatatacactctcatctataacgaaaaggaagcatctctcaattcgacatgacctccacagattgacaaacatgctcaaacacattaccagatgtgcatactatcaaacatttcagacggagcaatgttcacagagctagacatgttaaaggtagcagatttatcaaaccagaaacccatagattacctgcacttccaaatccttttttttagggccctacaattacaaattctgacttatatttccaactgtcaatatgactggaactgacatatgacacctacagacagaaaatggcaaccttctcagttgtcacagcaaattaagcagtaagcaccaacgcggtgaaaccattttagacctgtagatccatggacaatccagtttttagaccttacttgaacagaaacctgtcagtaaaaatgcaaggtaagttcacagtctggtaataatcggcagcaattaaaatgttcagttacttgacaagaaacttgaaatcccaggacatactacaaaacgagttaatttcaaagagtctgaggtttagcaatttgtttcatataaccctagtttctaaggcaaagtgctccataaactagcatatttatgcaaaataagtttacagggcacagatgggtgattcagtcaacaatgtctgcaacactcaatgacctctcgaaggtaaatttcaaagatgaaggtaaataatagccatatgatgtcagaaaacatgtatatttaagagctattcgacaagtcaacatattgtgttgctgtccagaactactcaatcagaatgaatgttaacaacattaacaggaaatgaaagctattcaacaagtaaacagttcaaattgtagaagccaacatactttgtgtctatttatattattactcagtgcaacagggaaaactctgtacaatttcatggatcatacttgacaacaaaatatactggatgatgtttcctttttatcccttctagatagtttttttcattctttttttttacttttccttttcttttgttaaatctgtatttgcatttttagtaatttatttctttcattaacaaataaataatgcaaatttcagaaaaagtggaagaatgaaaaatgtcaatagcaagcttacgttttggtgattgattcctccgtttgataagaacttttatgtccaatgtactcaaccacttcccaattttgtaaaccacctcatcaacttctttacagtggactttcactaccttaaggtgttcagatattgcagctggtttccgcaatggattgtcattctcttctgtttgcatcatagatttagcttcctgtagcacgaaaataaatatcacatttaattaatcatgcacaacaactttaacagtgcagcagttgtaaaaacaaataccttggaaatttgaagagtgagcttccgtagaactggtgagtgttcaagaatacaggctagtgcccagaaattagacagaagacaccactcattgagtaacaaattcttcagcttgctaaacatagggcaccatctcaaatcacttccaaaaataatctggataaagtgcaagcgacaaagtcaaccaatttttgttgtgaatacaataatttaagagccaagacagtagcaatgcatgaattttgttaaggtgacaaaatggtgcatataggtaaggcaagtaggcaacaaaggtaagttacagcaattaacataaaggagataagatgtcaatgtaagcttactatttcaggtccagctatcaacttcaaactcttagcttctgatagacctccaaggagcacacaattggaactgttgccgatcttatctatcataccatgacaaccatcacagtcttcatcttcacaattaccagtgtaagtattactacaccagtcatcacaatcctggtggggtctgacagatgcttcaactaatgagggcattctttccagaaaaggagttctgccccaaaaaccttcaagaaagagcctaatgaggcttggtgcataaatgagtgtgcggtgatattcactgaattgacaacagaagatccgaaggcattgcattgactgggagaagatcttcttgacagagtcaaagcagcaattcttggtgaaatatagctctttcaatgcgggacagcttgagaagttaagaaaacaatcctttaacactataccagaaagttctatcttagtcaagtgctgtgagacgagaggcatgccgccatctatttcaatgtatctttcattgaagttgtggattttgagcacctgaacttggcatattagagcatacatgacccacatcatgacacattggaatggattactgtcttcgtcctcgtcactgtcgtcatctgattcaccgtcgtcactgtgttcatctgattcatcgccatcactgtcttcatctgattcatcctcacctctgtcatcgtctgattcatcctcgtcactgtcttcacccttttcatccttctctcgacatgaactgaattccaaatcaaactcgcgtagaggcgagcagccccggaagagcactagatggttgacaaacttcttgaaccgcttggagctcttccatctctccttatcagcatcaaggcgcaggacgtccgtggatctccagaggtggcgccatcgccgggacaggacgcaggtcttgacggcctcatcggctgacagcaaggacaggacgtgctggaggagctcgtcggggagggcgttgatcccgccctccttgctggcctccgccatctcctcgcctctcgagccccttcgcctaggaggcattccgtcgaacaggtggcgggcgaagggcaccgcgcggcaagaaacgaagagccgactcaccgatcacccaggcgctggtggattagccgccggtcgacgacgacggcgaggaggagccctagcctggcgccgcaagctcgccggatccggccgccgccggcggagtcggtggctctggcgccgcgtgccccccgcttctagggcctagtgcttcggggagtcggggtcgcggctctatgacctaaccgtcggcctttgaacatttccgctactgtgggggctctttcacgacccatggacggttcaatttcctgaatggaagaggtttattttggaggaaataaaaatctcacaaatattatgaccaaactattaaaaaactatagatttaacattaaatttataaaaaaactacacgttaaagatagagtgtcataaaattatatatttattggtaacaaaattatcataaaactaccgatttagaattgatttagtcacaaaactacgatgcattgtttgaaaattgcttttaaaaacttatattaatctatttttaagctaatctattgctctgttttatgagtcaggggaagattcccaacccctctaaaagaacacagtctaagggtgtgtttggttgagctgtggcttttggaaaagctgttgtgagctatgggctgtggaaaagcggctgtgaaaaatcagttgtgggaaaagcagaagcccgtttggttagagtagcggtgaaactgtagcttctagaagaaatacctataatgcccctaaaagccattaggagtgtaggactatttatatgcaaattactcgtaaaaacctaatatgtccaatatctcatatttaaaaggccgatttggaaagaaaacatttataagtttttcatccatcaaagtttttcatcaaaatatattagcttttcatccatcaaagtgatatggtccacataaacagagcaaaagataaacagttcatacaatgataccatatctcaaaataactatcctcctcttgttctaatcaaagcatcagctatcctagtgcgaatagtattcatggtattatcattctctgtatcttcactctcatcgtccgccgtgtcacttgtatcttctagtaagtagtcctcatcagcatcacatctcttaaactccttatcacgtaaattgctatcacggataaagttatgcaaagcaagacaaaccatgatgatatgcttctgagtagtaggtgagtaacttgggatgcccttcaaaatacgccgctttcaataacatttcgacgtcggggcagtggcggcgtcagactgcagctccctcacctgataggtgaacgacgggcgcttctttctggatgcacctcctgcattagctttgttgttcagttcaaacatcaatatatatgtagaaatgtgtatatattgatacattctggacacattactgttctggacagcaatatatatgggcatcagtatatattggtgttctggacacattgctcggtggcaatatatatgtacatagcagagcacacctttgaactaaactaaacagcaatatattattgaaattataagcacataatgatttaatttattccataaataaatcatgacattgcagatgtaaactagattgaacgcatcattagatctacacatgtaaactaagtagtaaaacatgaacagatcaaatatgcgcaacatgtcgaacacgtaccgaggtgacggaaagaccggttgctcggcaagaactactcgtggttgcgagcgtcgacgaaggcgcgaagcacgcgagcggagaggaaggcgagccatcgcggacgaacagggagcagtcacgcgaagcgcttcccaaaaaccgtattgccgccttctcccggtgcaggacgtcgaaggcagaggttccggagacctactctcccgatcgccgattcacgccgacgagcgggatggagtagtctacgagcgacagcgcagcacagagtaggaggcaaaccctagattgatttcgcgtgtgttgcgtgaaggcggtgacccggtttatatagagataggtcgcctgatcagggcgcccgcttaaccgaaccagataagtcgcgcgtaacctatccggactccacgccgttttcacgcaccgaatttttcggaatgtttccaaaacaaaacaaatccgaatttcccgcagcaaaacaaaactgcaaaaggaggctgcatctgcgcaagggtgaggagccaattttgcggaccattcgacgcgtacgtcgtgcacgcgcgccgcctgccctgccctgccaggcgagcgatcgcgcgcgtgtgtttcccctcttctctccaccacacatgcttcaagtggctaggagggcatcctcccttttaaggaggtccccctctcctagaataagcaaggtggtactaaactccacatgcatgccatctcatgaggtgggcttttgtgattttccaaagaattaatcttcgaatgggccttagcccatctattaattccaacaatcccccaccaaatctcaaaatcccactagagatttgtcttttccaatgtactgtttatataccagcgattcgatggagaccgattaaggttgaacatccacctagaactctaagctacacttactcacaacttgaacaatggactacgccttgaattgcaagtcttgtgcaagcaagtttcactcagagtcttatctggtactagaccgtctgtagactacccctcgggtggagcgtataagtcatactcctaggtctttagtaagcttcctagaagattcacccaaaatctccatagactgcgaccaacagtcaagcttacaaaggtgagttctttcaagaatgcatcttcactaattaaagccaacagaactcattaaggcatagccaacctgccttgcagctcacgagagtacatgcatcttcacttagagagggtatagattggtactctcctctagtttactaatggtttgttcttcccaggttctaattcacgggatcttcgatcacatagactgggttaccaccatagtataactcacatgggtctcaaacccatctccttcgatgcattgtctatcacatttcgtgatagtccctttgtgaagggttctgccaggtttctagctgtttggatgtaatccaacgttataactccggagtttctcaatttcctgacagacttcaatcgtcttttcacatgtctagactatttcatattatccttagaactattcactttgacaattaccgtttgattgtcacagttcataaggatagccggcaccggtttttcaacaataggcagatccattaatagatcacgcagccattttgcctcaacagtagcagtatccagtgccgtcagctctgcttccatggttgacctcgtcaaaatggtatgtttgcaagacctccacgaaacagcaccaccacccagtgtgaagacatatccactagtggctttgatctcatccacatcagagatccagttagaatcactatatccctccagtaccgcaggatacccagaatagtgaagccccaattccatagtacctttcagataatgcattactcgctcaagcgcacgccagtgatcatctcccggattagaggtaaaccggctcaacttgctcacagcaaaggagatatcaggcctagttgcactagccaggtacatcagcgagccaatgatttgggagtattccagttaattcctagcaattctcttgttcttgcgaagcaacaagctaggatcataaggtgttggagaaggcttactatcaatgtagccaaagcgattcaagatcttctccacataatgggactgcaagagtgtaatcccattatcacctctaattagcttaatgcttaagataacatcagctactcccaaatccttcatatcaaaattttgagacaagaatgatttaatctcatttatcacctcaaggtttgtcccaaatatcagtatgtcgtcaacatagaagcacagaataactccctcacccccaccatggcgatagtacacacatttatctgcctcattgactgcaaagcctacagatgtcaatgttttgtcaaatttctcatgccattgcttaggatcttgtttcagaccatacaaagacttcaacaatttgcacactttgccttcttgaccttcaactacaaacccatcaggttgatccatatagatctactcatctagctctccattaagaaaagctgtcttaacgtccatttgatgaacgagaagaccaagtgaggctgctagggaaagtagcacgcgaattgtggtcaatctagcaacaggtgagtaagtgtcaaagaaatcttcgccttctttctgagtatagcccttagcaacaagccgagccttgtactttttaatagtaccgtcaggcctaagcttcttcttgaacacccacttgcaccccacaggtttacatccatagggtcgctctgtcacctcccaagtccagttagcgataatggaatccatttcactacggacagcctccttccagtagtctgcatcaggagatgcctatgcttctgaaattgacttaggagtgtcatccacgaggtacacagtgaaatcatcaccaaaggatttagccgtcctttgtctcttactccttcgaagagcttcactgacatcctcctcagtgacatgttcatgtgtatgttcagtttgttatggtggtgtgattgaactgggaattatttcagagggttggctcgaaccactatgtgtatcttcattgggaaaaagctctcgaaaaaggtagcatcacgagactccataattgtaccaacatgcatgtcaggtacctcgaatttaactattaaaaatctataggcaatgttgtaatgagcatatcctagaaagacacagtccacagtcttaggtccaagtttgcgcttcttcgttattggtacattgactttcgccaagcacccccatgtgcgcaaataagaaagtgatggttttctcccaatccatatctcatatgaagttattcaaagcaagacaagccatgatgatatgcttatgagtagtaggtgagtaacttgggatgcccttcaaaatacgccgctttcaataacatttcgacgtcggggcagtggcggcgtcagactgcagctccctcacctgataggtgaacgacaggcgcttctttctggatgcacctcctgcattagctttgttgttcagttcaaacatcaatatatatgtagaaatgtgtatatattgatacattctggacacattgctgttctggacagcaatatatatgggcatcagtatatattggtgctctggacacattgctcggcggcaatatatatgtacatagcagagcacacctttgaactgaactaaacaacaatatattgttgaaattataagcacataatgatttaatttattccataaataaatcatgacattgcagatgtaaactagattgaacgcatcattaaatctacacatgtaaactaagtagtaaagcatgaagatcaaatatgcgcaacatgtcgaacacgtaccgaggtagcggaaagaccggttgctcggcaggaactactcgcgattgcgagcgtcgacgaaggcgcgaagcacgcgagcggagaggaagacgagccatcgcggacgaacagggagcagtcgcgcgaagcgcttcccaaaaaccttattgccgccttctcccggtgcaggacgtcgaaggcagaggttccggagacctgctctcccgatcgccagtgcacgccgacgagcgggatggagtagtctacgagcgacggcgcagcacagagtaggaggcaaaccctagattgattttgcgtgtgttgcgtgaaggcagcggcccggtttatataaatgtttccaaaacaaaacaaatccgaatttcctgcagcaaaacaaaactgcaaaaggaggctgcatttgcgcaagggtgaggagccaattttgcggaccattcgacgcgtacgtcgtgcacgcgcgccgcctgccctgccctgcccatctatgaggtgggtttttgtgattttccaaagaactaatcttcgaatgtgccttagcccatctattaattccaacatatatatgtacacatatttgaactgaacaggaatggtaatatatatatcgctgaacagcaatatatatcgtccctcaacttttaaaactggtgcaactaacattactcgatagtatttttgatgtttttaagttgacgttgcacatatttgttttcttttgacttagtctttatccctcgtaacacttacgtgacacaaggaaacaataaaaagcatcaataagacccacatgccagcaagtgaggggaaaaactaatttgtgtgtcccacgtgtcatcacctctctttcttcctcttcatctccctctcttcatgctcttccccatcttctctcccttgctggcctcccctccttcccctcggtgtttcctcccatcaatgtgtcagccctaagaaggacgagcacggcgtaaagggcccatcaagaaggaaaacatattcattaacatgtagtccattaaataccatcatcttcgtcattttacttttagagtaaattttattttgtgctatgttttattacgatgtatcattttggactatcctttaaccaatatttgcattttcaatccaatatttgcactttcgatcaggtaatcttatatttacctttgtttcactttttactacccgactttttatcaatgaagtccaacagctatacttaaaagaatcttatactttgtctagagtcgtagtcataggataggtctaatcccatcctaggttgtaatatattgggacggaggttgtaatatattgggacggaagaagtactactgttttaacatatgacaatttgatgtaaatgggcaaaattgtgagagtgatctaaagtggcacaaacataaatttacccggtttaaagtgaaacatttattaaaggatagttcaaagcgaaataatagtaataaggcggcctaaaatgaaatttactccttaagcaaatgcttatccatgtcttttatttaaaaaattacagataaaacttttatatacatttttttagcaatttaaaaccaaataatgtaaaaataaattatgctaagaaaatcataaaaccaacttcagaattaagttttaaaatttaaatcttagcctataagcgtgctatggggctttatgtgtggcgtgtggtttgcctcgttaattcagaggggggaggagaggatggatgtgtagaaacagaacaaactattgaccgtgcaacttcagccggcacacggcaacttgagataatcacataatctcctgacaggagaagagagaacacacatatataatctcaagtagtaagtgacagcactgggcgaaattagtgaaatgcagacgactgcagtaaaaccagctcagatacactgctagaagatctaaacaactcaatatatgattatgtatccggatcccagatgttcctcgtcctgtgaactactagcatattactcagttcaacatagtggagctagcatagcaatctcatagacaaaagacagggttcttgtcactgtgaaattaagccttgcgttcctggaataatcaagaggttcttcatctagaagatccatcgtcgagacatcaacccttttctactttgtttttcgaccaggcatcaacccatacttccttccttgaaactgaagactgcgcatacccaatgatattttgaagataagacacagtttatcatttttcaaagatgaaggtaaatacgtggccatacaaatgatacaatgtcacataatatgtacaataattaagagctattttatggccaagaacttcaagcctgagttaatacttaatagcaggaaatgaaagctattcaacgagtaaacagtccaaagtgtagaggtcaaaacatattgcaacttcctatttatattactcagctcattatataaaaagaaaattatattactcagttcaacatggaaaaactctgtaaattttcaagtatcatacttgacaacaaaataaattggattatgttttctttatatcccttccaaatgctgttttacctattttcccttttcttcactaaatctgtatttgcacttttagttttcttctttcattcacgaatattttttttcaaaattcagaaatattgaaagaacgaaaaggagctaacttcagaaacctcgtgttcagcaatttgtttcatataacgttatgtttaaggcaaaatgcttcatcaagcctcacatgtatgcaaaatactcatgtcattatacatttatactatctagcatttcgagtatatacctacattagtaggcctgaaatacacattcttaagctactatatctccttccgcactctctcactgtgcaatggcagagatgataatgtgaaccccagtagcagagacacattaacaaacatttatgctaccggcaaccaacggttgtggaaaaggtagctgatgtgtttatgtaccaaaaagaattccattttgtataagtattgcacataaatatcatagataaatgggttacatatgcatgtgcctgaggtattatgaaacattttgctctaaaacctataggtttccttgaaacaaaatgcagatctgggttttgcattacagcattaccgacgcccctcaaacctgcgttatgtgaaatttattaaaggaaaagtggtattcactcgaccagcatgcagtaatatcttcaactaacattaagatgatccaaaaatatgattaatgatatttaacagcttccacctgcccttaaaaagaatttatcagcctatactgcccctacactaagaacacagaccaactatttttccccataacatcagattttatacaattacaaaagaagaaatcagtcaaggtttttcatccacaaggaactatagaagtcatcattagggcaaatgcagcaaaaataactagacatgaagatgggcactgaaaggcactgaaagttatgtacaacctacagactcaaaggaacaatgaaaatattcaagaaaacagttaattctacagattcaaagtattgctcagtttagccattcacaagggcatgaaactgagcatatatagtgagccatttgtaagagtgaagtaaacaacagttcaatgtgttgttgcttaaaactattactcctacttgttaagtaaaagcataaagacagagaaagcttgctactgttcagaactaatcagtgaggcaataaattatcaaaaagtttaatattcaaaactattcaacagaaatgtttagattgggtttccgactcccacgaaatgtcatgcagcatttccattttcttttcaattaatctggtgattggtactcctacctctagatttctaacaaagtaggagtttctgcattatttgcaatcaagtggaaggcaaatttcagaaatacagaaagagcgaataatgttgctagttagcttaccgatattaaatgtagataggaacttcaaaattttgataactctctcatcaaccactccacatttgactacgactatcttaaggtgttctgatattgcagacgatctctccattcgactataggcagaagtttccaatttagaatataaatacatatgtaccgggtagaaaaactgaagagtgagattctctagaactgggagtgtcgaaggatgcaagtaatttcatgcaagtcgaaggccacaatccagctgtcactgagcaacaaagtcttcaacttgctaaatgtagggcaccgtatcaattcccttttgaaaataaactggacaaaatgcaaacaataaagatcaactaacagatgatttgagaaggaaaagctggttctgtaaaaggcagttcatgtgaaaaaaaggcataacaaaaacaaaccttttgtgagtcagcgaccaacgccaaattcttagcctgtgaaaaagcttgcagaaccttgcaattgttgtcactgggacaattgtcacaatcgtcataaggacattcctcaaggtcatcattaactcctggacaacacctgatatctccagaagcaaaggtgacaccgaaaaaggcatccactaataacggcatgccctcgaacacaggagtccggtgattatataattatccaggcgcagcgaaaggagattggggacatcaatacgagtgcggaagatttcgctgaaatcgcatgcagtgatgttgaggcgtttcagggattgggaagagatcctctcggcatctgacaagctgcagaggacaatctccagatgttccagcaccggacagctcgagaaatcgaggaaattgtgcaccaaattcagatgagcaagctctagcttcgccaagcgcccggacacaagaggcaggccatctagcacgaggcgtgaggcacttcgaggggcattcaaccggagagcttggacctcgcacagcacggcatgccggaaccagagatccacgaggcgggcgtcgccgccgccgccgtcggacgacagcccggcgaagctgagctcgcaggtgtccagcggcgcgcgcccgcggaggagcagcagatggtccacgaaatcgcggagctcctccatgggcaccagccccaccccgtcgtcgtcggcgatgcgcaggcccgtggcggacttccagaggtggcgccaccgccgcgccagcacgcacgtcgcacgggtcggcgccg

SEQ ID NO: 81733 - DNA, 24168 bp, Oryza sativa
catctgatccagcccggttgtgcccatccccttgagaactggatcccggaatctggctttgacgttggtcgcccccctgtgttagggttactgcctccagctgtagcatgctgcagacttctggatacagctacttggatagaaaaacaaaaatagatcgccaggggaattcagaaactaaactagaataatatgtatagtaaggaaaataaacatagtctcgtttagacggttcagttaaggtaaaattttattgtgagaattcacttggatatatatatttttagaaatcataagctgtagttaggagtctgatcgtctcaagttagcatgcaagttttttttaaacagatttcttatatgattccttctgtattatcaaaagtgaacgatcctaaaaaccgactcaaatatggatatatatttccaaaagcaaacgaacttaacaaccgactcatacatggatgacgtatcaaaataccggcaaaaatatcttcaatttttataatactatatatatagacacacacactactctatctactccataatataagacgttttggcctcttcatcggccgtatatattcactgatattcatatgagtttacatacgcatataaaacacataaatggaatagtgcatgaatctatttaaaacatagtgtgaaacagaggaggtaccttttgcgcctttctgttctgcaggaggactattaatgttgccgggcggcatcttgctatgctttttagcacccggtgcatgggaagggcctccacttgcagatggtgccctgaagaagaacaagtaacagaattaagcggggggatcgatgtgagtgagatccgaacgcattgcatgattgcatgccgaaccacggagataattaatacaaatcacagaattactaataaattaaaccaaacatgaatacgtacatggaactatacaagaaagtatgtgtatgattttttctagattttttagtgatattttttagttggtgtgcacgtgtgtacacgtgagggcctgtgtgcataggatatgttgctatatatatatatatatatatatatatatatatatatatatatatatatatatatatcccctggtgtggacggacgatatatattaattgcaactctctgaagcagcaaattaaaggaaatgcgcaatgcagcagaaagatcgatcgatcgatcgatggagctggattgcctttgttggtttgagtcgacgacgtaggagcaagatgatcgacatatatatagtgatcgatcaggaacgcgttcgaaaggcccaaactaacaagtatatttttctgttattattattattattcgtcattcacaagctatagtagctagcaaggtttgatatgccagcctccatcgttcgatcgtctttcttaaattttctctggaacgcgcgcaggtcgatcgaaacctaattcaactcggacggatggattcgttccacaacaatttgaaagctacgtaccacgtaccaacttcatgaataatgcatgcgtagatgtttctccaataggcgcgcatgcttgctggtacgtaccatatgttacaatataattatttgcatcaattagtttcttgtcactactgcctagctagatctacttaattaattactccctatatataatttgtccgacctatcccgcgcttgtggagattaattagcactcctaatatataattagctagtactacatttgtatatacggaaacttcctgttgcattaggtatacgccatgctgtagtacatatcaaccagctttgcatgatcgctcttaatttgcttgtcaagcaacaattcaattaataattacggaactagtagtactgcatatatatggtgcgcgcgcgcgtagtgaattatacatgtacgcgcctttcacgtattcgagaaacaatatatataatatataaatactcgtaaaatttgtaaagtacttacaacgggttaaaaataattaattatcgttttggacgaagctaaacttaatttgaagacaaacaagaagagcatatttttatagatttaacttatataaaaatatacttcaataaaatatttgtttatatttctatatatatttgaatagaaaatagtggtggttaaaattatttttttataccgcgtgcccatatctaaaatgaaaattatttttagcttgagggagtaatttgttaagaataatcgcatctcacgtacgaatgtgcacaattaaccttcggcttgatcatttctaatctccatgaatttcttccatacgcgcgattgacatttttttatggttactcgtgctaacttccataaaatataaagggaagaagagcacagacatcctggacgcgcggtcttcatgctaattaagtttacttgatatattactgtacacgtagaagaagaatgaagtctagttgacccctcctaatcttccatggaaatccatttagtctcatgttagcgtgtggaaccttgagtcaactgtactgttgtaatcatagaaatgcatatcaatatataacgggtatatgtttgtcagttctctgccagacatatctaatatggtttcatttggatatatatatgacacatttggcatatagctagcttgggtcattgttttattgaaacatattaattatatctctgaattctcatgggatcgttcctctcaattaatgggctcttgcgcattgaataggtcgactatcattcaaatatatattcagcgaataaatttattgcaaaacttaatcactaattaatggttgaataatactgtaatcttaaccgtcaagcattcggtcattataaaaaatatagttaattagatacaatgggtcagttattttggggctacgttttaattgagctagtcacagctttgagccttaattagcttgtctataactcatcgttataaactgttaatgataactagaatcgttagtgattagttagagggttaacgataaacaatgcccattagatgcattaattatcattcatctctatacgtcgtacgtatctattccctccttctcaaaatataaatatttttagaatagtgccaagtcaaactttttgaattttgactattaatagcaatgaaaaaaaatcgatcatataaatttgatgttacttaaacaatcataatcaacaagcgcccgggttcatcattttacgtactccctccgtttgatgtattttacctatgattgggttcgggtttctgcaatgtgtttttaatttattttcccccaaaaattgtgtcgcaatcgatcgccataacatgcctacctatggaaatctgtttttgcgtgcagatgtgctgcccgtctaaaaaaattgtgatttttaccgacatcgggtgactggtccccccatctgcaaaaatggattcaatctggccgtaagggaaaagcgcatttatatatatatatatatatatatatatatatatatatatatatatatatatatatatatatatatatatatatgtatgtatatatataagtgaagattaatgtatatttagttttagggagtttcaagatttcagacaacccatatttttctaattccttgaatagcaatcgactaaagtctagtgacttccctatacttattatttaaacaatgtatattctttatgatataaaaggacaaacaataaataaattattctaacctcaacctgaaataaacttaaaattcatagaaaaatataaaaataataaacatggatcaaaaataaactaaaatcatatataacaaaaagaatgtagttaaagtgaaattaaaaaaagcaagttcaactgtaatttttgacttaccaatgcgtaatttttggttagtcaacttttacacatttttggatgtgtaatatctagcaaatacaaatgttctacattacatacgggttttcgttctcttaccaattcaatatataggaaagtaataatgtaattagaaacttacatatttatacttgcatagtctaaataattggagtgtctacatttcaggtgagtacagaaattttagtcacttttttcgtcgattagatgacaatccggtggttctcattacccctctttctcttatataaaaggttgaacaacatattttaacatagaaaaattaaataataacaataaataaacttactattcataaaagttacaattacattaaaaaattaacttcgatcaaaaaagtaaaatgatatataagattgacattgcagttaaaaaattgtaaaattgcacattaaatatcactgcaatttaatatttaggaatgtgcaattttaggtgactaaaaatttataaacataaaattaaattttacgtttaggaattgcacattgaataatcacacacacagactcacgaaatatatattgactcggaagtagttagtccatccatcaaatgtacaacatgttcaaacacaataattgcattttacgtacttgtaatatatcacatctttctttctgttcattctttgtagttaatgaagagtcagtcttgcaataattcgttacgtaattataaaatcggattctttgtcaggtagttcgctaatctcggatagatccgaaacagttgtttgctaaccccaacttgattccaaaacaggacacattattccctatggtttgggataaaataatgtataataattttccaaatccgtgtgatcgatataactctgcccgctgaatgatataagttgactgattaattaatactgactttgaaaacttcgtaagtcctagaatttcaaacatgagttttttactgttgtttaaatttttttgacactttccacatccatatacttgtcgtggattgattttggagctcacaggcacatagagcccgtgactcactccgttattgagcatcatcaccttgtccattcctccattcgattaacaaattaccaaacatatatttggtactattgaagttacttaaattttataaggccaagatatatttcgaaaagaaaatgtaattaatacaatagtactttttatttaagattctgttagaaaaaagtaacagtgacaaagttagcgtaattattaggttcttgtggtgcaaccagtacaacgggttcaaatcctagacttgatacatgtgctcacatttacggctaattattctttcagtggtacacaacatatcaatcgacagcaaaagctcgtgatgacttcatcaatctcaagatatgccggtctaatttttcgaatgtaattataggggtagtgtatatattcataggattgatagtgcgcgtgttatgagcggcgtttgtaccgtgtttctaaaaatataaaggaaatagtatatatccaaggagaataagtcgaccatctccaacctcgacagtgtaccagccaagtaatacctagaaatagaacaaaaatacaaagggaaaataaatttcagtcaaaacaagattttcaattctgaatagatactagtaaatattttgatgatatcaaaatatatacgctaaaaaattttcactactagaaaaatcgttttctcaggcggccaaaaattattttccccggcaggtggaaggcccgcttgtatgcataagcctgtgaaaatattttaggcgaacaaaaaaaaaaacaccaccactcccaccctctaccctacccacctcccaccgcacagccgtcgtagccctcccacctctggccagatctagggcaggggtttcgggatggagagggagagggagtagaggtgagggcagactgttgcagaggtgccgctgccgccgggggccgccactgcactcccccctccccccctctcccctctgggcagatctgggagggaaggagggaggggagccgccaccgctgggagggaagccgtgtcggggagggaagctgccaccgcctccaccctccgcgccgccgccgttgcctccaccagatctgggaggagggaggggagccaccacctccttcaccctccgtgccgccaccgccgacagccgctgccgcctccacccttcacgttgccatcgccctctggccacagcttgggagaggaggaagggaaaggtactgagggagaggtgggaggggagagccagagaggctctaacttagggcctatttagtttgtgaaaagaaaatttttaggtatcacgtggaatgtttgaccggatatcggaaagggttttcggacacgaatgaaacaactaatttcataactcgcctagaaaccgcgaaacgaatcttttaagcctaattaatttgtcattaccacatgtgggttactgtagcacttatatggctaatcatggactaattaggctcaaaagattcatctcgcgattttccccataactatgtaattagttttatttttatctatatttaatgctccatgcatgtgtctaaagattcgatgtctttatagaaaaagttagctattttggtgggtaggtggtgtttttaatatgtataacctttttgcaggcggaccttttagtgtaccacatgcgaaaagcctgcaataataaaagtatttttgcaggcggacctcttaagtgatccacctgcagacaacgatatcaccgacggttgtcaatttcgcaggcagccatttagctccgagaggcctacccacctggaaaaaaaatagcatcgtctggataaatggttttctagtaatgtttagaagacaaagaacgacaattaattcttgtacatggaggaaaagataaaacttgtccagaccaagacaacatcgatccttggtaaaactaagggttaattggatccatgacattataaattctttagttttgaaatatgctattactattcacctatttgaagtgatgccattacaattttgaaggtatttgaaatatgccactgcataccctttcaacacatttaacaaaaactttagaccaaattgcccttgtccttttcctctgtctcctcccatctctcctgttcatcttcttcctccctttcttccccttctggatctaggtcgggcagcttgatttcttccttcccatttttcgccggtgaacctcggctaaggacacccccttcacctttactccggcgtggatcttcaaaccccgcgaggaggtgatgaacgtggcgtcgagggctgggtcgtggcggtaccatggttcgactctgtgaagtggacgaggccgagggaccagaggccctggcgttggagctcagccatagccgagggaccgtgatagtcgtcgtcctcggtggggaatccagtgctcggacgctcggtagggaggtgcaggcttacagtggctgggtaggcacaggcttggtggatccatggcagcagagataaataggagagatggaaggagatagaggaagaagacaaggacaatttggtctacattttttgttcaatgcatcaaaggggtatgctgtggcatatttcgaatatatgaaaaattgtaatggcatgacttcaaataagtgaatagtaatggcatatttcaaaactgaaaaatttataatagcataggtctaattaaccctaaaactaattggttctacaaagataatcaaatttcacaacaaatattatttcttaaataatacggtcgacacagtcgactctttaaattcaaattaaaatgaacaagcaaatgattttccatctccctataagccaaaccccacatgataaaaatatgaaattataaaagataattgagccctatgatcacctctacagaaatcatttgtacaggcatctgccatatttatctaccaacggattaaaaatgcagttacctatttatttgacttacagggccatccgcattgcctctcgcactgagaccggcggtgacaacccttgccgctgtaagcacccgtccctccttacttcgtcacgtcacagccagagcttgctgctggaaaggcaggcagtgagctaggacggcaatggataggctccattccgtggcgctccaacagatctagcgcgagcaaagctggatgtgcgtggatctagatggccggggctgcgcaggggtgaagacggccgaggtggcgtgagaaggaagacagcaggtggcgccgcaaagcctcgcgctgaggccgctcggtggtggtgaggtgacccgatggtgatgatgctactatttagtgacgcaaagtggcagcggcggttcgaggtggcctctctaggtgtggggatggctgtggtggtgggatggcgccggcctcgcgtgcagacatgaccgtcgcagcgaggcctcccttctactcgacgacggtggggatggtgagcggcgggcagatctgcaacagcgaaggcggatctgacgcagtggcatggacatcagcgcatcgaggtggagtccctgggtgctccctactaaaattgcacaagaaaatagggaaagagccgctaatgagaaaaaagaattagatgctaaaactgaaaatcaacaagtgcttaaattgaaaggatttgttatgctagctgttgacggtcgttagcgatcagtttcgaccgtcaatactaccaaaataaaggagaactagttatgcttgtaatgtatatttgtgttagaataataatattccactagtattaggattactaaccttttgcagagaatgaaataaaatggaggagaatcgacatcaaatcaaacgatcaatcaatcggatgatgacgagaatcagacttatgcatgaatgggccaagaactcagaattgacacgacaaattggaccaaaattcacaagtccgaagtgagcaacagaagaggaggccgccagccgaaaatgggctggattgggccatgtggatctagggttggcgatggacagtgtggattgcctccctatggcggttggagggtattactgacctttccaaccgtcgtaacggtcattacctacctatttaaggagctcactctctccatttcaacacacacttcaagtaaaactctctcatattctctcaagcttagtttagtattctcaagctagtggagcaggaatagaatagtaatcggagtctggaagtcttcggaagagttcgggtatagctctagtagctcgcctttcttcttttgtaagatttgtactttatttagaatattcttctttatacaattctggtattgaaatactttccaagtatatgaatgccaactttactttattttcaagttatactgattatactactagcttatctgggagatacataggtagaggtatagtgtttgcttatgcaattactatatgtcatgacaatgatattagagtagtatctgatagtttagacgtggtgtctagattactgggtatcattatttagggttatatgctgcggatgagaggtgggctgctgatggtgacagctcagtatgggtattcctccgcgcgtgtatatagtcctaagtaaatgtcctagggagggtactcctccatttttagccccggttgtatggtcatgacgggctttcataagaaactcggcagttaggggtggcttctcgaagtaccaggaggtcatcggatagagagtattagctagtatgtcagataactaggatgtatgtatactatgtactccccccgtcctataaaaaacaaatctaggaccagatgtgacatattctagtacgatgaatctggacatatatgtccagattcatagtactaggatgtgtcacatccgatactaggttggttttttatgggacgtagagagtatactagaagtataggaatatattcttttctattttctttccacttggctgtaacatcgtgaaaattcccgacaataaaaaaatcactaaaattttgaactttttaaaacttgttgcatcatgctggatgttatggttgctattgcttgccaaactataaattgtcacaatgaaacattaacttaaggatgtacaattcgctagaatattctatctatcgattccataaatattatgcaggaagctaaatgaaggaaaagttaattattaatttgtatggtatgaattacaaaccaaatattaaatattcaaaccatgttgatagcttggtttcatatttaacaaatggaaacagtaagattaaatggaattcatctgaatccaatctcacgtgaaataatgaccacttcattacaatgatcccatctataaaagagtgtttcgctggaatatttaaattaatatttaaaacactttatcaagcccatatggtgtagaattcactcatataaataaatagagtaaatacatcactaccattataatggtcacattagaatattttaattaatatcaaagcctagaagttatattggataatttttggataatctaatggaaagcaaattcgtttgagaactaatgaataaataaataaatattcaaatgaaatatttgaattaccaaaatccaaaatgtgtagagctacatttcaattccaaatccaatcttagccattttgcagtttagcccttccctttttccctctttctccttttctcttattttccaccggtactgttcattgcgcaccatgtgctcgactcggactccacccggtcgaacacccgacgccgccttcttcggtcgcggatgtgccgcacgcccacttggcgtgaccgtgcgccgcaccgcgtcacgccgcgccgcttgggcccgccgcccgaccgagccgccggattcccgcataaggctgcgctgccatgagcgcctgcgtcaccctatcccgtcgcgagtcgccatcgcatcgccatatcatcgcccctagctgagaccgttggataatgcggcgtttcttccccagctaggactaaaactagcagactataggctataggcgcaatgatggagccacagaactttaatggagaaggagatgaaccttagccatgtcatccacctcattgctcttatccgatcgccattagagctccagctcatccaggccatgtgctggcgatcttatccccatggtttccttacaccctaagctaagcccccaataaaatccccattcttctcagctttcttcccgaatgcatttcatcgaacaccttgcgatcactctctcaccaccactagagatcaccattgcgaggcttcccggccagagctggaggttggagggagtggaggaagagttgtgctcctgccgtcgccattgaaggacccgaggaccgctggacaccgggaaccacgcgtcgaacactttcgggcgtcaccaacagctagccgcctccacttcgtccgcaccgcagcacgcgtcgccgcccttcgccgtctctccatcccggggtaaaacctcgagcccatagcatcctctacacctctaatagctagcgccggctccagtttgtacgattaatgccgatggctgtgccgccccgaccgccgttccgccgccgacgagctcaccgtggataggccatcccgggtgctctccctcccatctttctggagaaatcgaacgcccatacaccgtagatgctcctacgcccatcaatttggcaggagaccgtaccaatcacccaagcaccaaacctcctcgagctcggtcatggcagccgtgtcgtgccacttgcctaggcgccgccgcacgccgcattcggtaccagagggtcgcctgagctccaccgcaccttccctagccaccgtcgggtcgccctcggccggctctgccgtgcgtgccgtgttcccctgctgctcccgcttggtcgggaggaagaagaagacgaaggttgaagacgacctttagccgtgccactgacgagccgtccccactcctcctatttcctttagaaaattaatcctgtgaaaaagaaaatcaaagctttgaccccacatgtcagcagctgttagggataaggatagatttcggattaaaataaatcaattaggaacagtaacttttcgctatttcttggattaattcaaatttgggtctttaaactagcataacctattcattttaactccgatttgagtgaaacttgaatctaaattcatctaaattcataagctttccaatggtatataattcactatttaataacatatattcatatttataaaataattaatgttcaatgattagattatgatcaacttaaaaatgtgctaataaataaagttggtattgtacagtaagataggtagaagaataattgtctttaacatgctttgtcactgtaacaactacattaattaattataaatattgtttcaaattaattgaagcatagaaagtaacattgctattcattagtcgctgaccatatatgtagttaagtccatgccttactaattaattaaattaagtttagtcttataattaggtaaataaaatatgagtatacatagatcattcctaagcttgattgggggggaggagataatagcagagctagtgtgattaaatcacctatacgaaattaattacttaatgtcaagtcccatggagtgagtagtatcttttaaattggtaatcaatcttaagttaataaacagtaccaactcgccaaatccacctacatcacatatactgtatatatatagattacagtaaataactcatgttcggtaaatggtccaatattaatatattattgaactgccataatgacaatagaagattaagaaaccttatccattagcaagaccaggtagtatgagaaaccctaggttcgacctcaacaattatattttgtttgtgcacattggattgttgtttgaacattggtttttctcgcgtattatagaaattgtatatcggttagtcgtgaggcaacgtatgcagcttccaggaggtgaagattgatcaagattataccaagaataagaactatcctgagcaggcaagtcatcaccccatcccctgagcatgttggtcccaattgtgaaattgttttgtttataaataaaattgcatgcaatgatgaatatcctacttgttattttgccatgcctttgattattgtttacctcattatttccttgtacccatgattacgtatgagtccttagtcaattatgacaaaagcttagtaatgctactttagaatcatgcattctcatatttatcaaatgctatatgcttaggcaactaccttagggaaagtagttgagatacggcttgtggagacatgagcgccacattgccatgacattggtgacatgatttgtgaaaggaaaaatgaaactaaacaactgttttcgactggggcggctggaggacttgggtggtgtccagaaaaggctagtaccgtccctggtcagttaagaaccgagccatgaagttaagcatgaaacggtccccgtacaaccatacttgtcgtgtgggtatagacctagcggagtaaatagctgagcggaggcggtacccaagccgtagtggttttcttgatgtgtgtgaggcaggccctacggtggggcagccattggtaggaccgcgaggggcgggtgcctacagttgtgtcgccatcggtaggactgccatgtgtaaacctaaacttaactataacttaatgcatgtgtgagtctgcttgtggcatgtcaaccgggcccttgtattattttgtcttccgctgttgttctctgatagttgttggcctacctggccctaatgtaagcatttaactcttttagcctgaattcattcgtgatatgttgtgattcggctatgtatgtgtgtaccaactactgatccagggattggtactgataaacacagaagatttccgatttccaaaattgggggtcgacattggcttagatagtttaatatgagaatgagtagacttatgcttgtgtgtcactctaccctatgaattatattaaccctgcttagactatgattattacaagtaatatataatttatcagtacggttctctctactgtaatcttcccatgggattaaacaaatacaatacccttggaatactctcgggtgaaaagctacactggtatatccgtgcgcttgcggataaactctataaccataatataccaggagtattttctacgacattgctgggaattatatttctagtaatgtcattaagaaataccatcactagcaacaaaatccggtcttgctgaaatttgtgatgaataagacacatgttatgctttggtttgcaaagatactctattttctgttgatgacgtctagctctttgccttctcctgtcactaatctttttgcaggagtttcgagatgtattcccatctgagttactgcaggtctaccacccatttgagggatttggagtatgaaaaagtggtttgataacgccatagaggctggtgatctgcctcaagcaaagagtggttcattcatgttgaggatcacccaaaacattaaagttgtttttaggagaaagtagtgaacggatggaagagggtggaaatcgcaaggagaaggtacatatatggatccttcaaatacattgatgtttacgaagacatcaattttctatgaatatccatcatactgggagcatttagaagtttgacatagcattgatgacgtgcacattatgaaaaatgtgtgtgaaagcattgttgacatcttattggacctctcatccaatacaaagaattcacggtagacctggcaaggaaagagttacaccctacgaaattgataaatgcaatgtattgtctataaccgactagcttctctatgataactgaggagaagaaattagtgtgcatgtgcttacacgggtttaaagtgcctatactaggtacacatctaacatcagaaacctagttccgataaaagatttagagataatagcaacgaagcctcatgattgccatgtgttgatgacacatctctcagtagcaatcatgggagtgaagccagaatcttcaaggtggcactaacatggttctgtcattttggcaacataatttcacaaaaggtgatggatgcttaaaaaactccaaggtttgcagggtaatttgcaactaccagaattttcaatctcgaactaactctttgcgcatttttttgtgagtgttgtgctttgcatctctctctctctctctatgaagatcaaatgtcttttgagcacctggaaatacaaatgctagcattgacttgaacacgtcttgtattgtggcttttcccaagagtgaaaatttgaaatcaaattgaattaaatcgcctagtgtcctttagccctttgctttcatttttaggggtcaccaagcatcaatcaaatcgccatgggactaataactctactttagctcaatacacacataggtcccctaattgccttgtgatctgtcatccaaaatccgctaggggccgagatgcactttcagtttgttcagggcttatgtatacttgttaaaaaggtctttcatatggtttatggtcgacatcaaaattccagatgaactgctcgaaatcatacaatcaacaaagcaaagctttgaacctcttccatccaagtcgtaggctttgtaactgagtcttggttgacacatgatatggatgacctcccacccatgtaacgcataaatagctagacatttgtcgccacctctaaggtttttgttttgcttaaattattcctactctatgtagtatcgctgctagattgttttctgcaactctaggctatgtgtgcttcatattcctttgcaatttaaactgtgtttttcttatgaacttctcgattgtttgcaggctcaataccttgtgagagcatcgttgataactacgagacaaacagatgtagggattgcgaggtgatatctactgatttaaagcctcaaattgtgaatgtacacatgtcgataaatcaaacctattgaaagatctggtaactattcgtatcaacaagtatttaaaaattacaatgtaagtttttaaatttaattgtaagtatataaaattcaccaatgtaattattaaaatctatctattattatatactaaaagtccattaaacttcctaaaaacacactcaagccaccacgtggcaccctataaatactgttatgccgccacgttattttcatttaattggcggacccgttattttagactattagattagatctatttgcttcctcttgatataacatgtcctgtgcatatggatgctgtttataccggaaaaaccaaaccatcagtacgtacttggacaacactaaaaaaggaaaataaaggaaaaaaaggaaaaaagaaaaaaaagaaacagaacgtacttacgtacaataaaaaaaactataaaacagaaaaaagaaactgttcacttgaaaaaaataacaaaaaatataaaaatatatatcataataataagaaaattataaatatatgacctaaaaaataagaaaagctacaagacctaaaaaatatatgtacataggtagaaaacaatagagtctttttaaaatatgtttttctttactataataatatatttattccacaaatatggtcatgtggcgttcctacaagcactcttaccgccatatgtcactttataatttcgttgtcaattttcatttaaaatgatggacccatttttagatcaatagattagtccgcttactgttaatttcctatgtataagagataaattgtttaccggatgtctgattgaaacaaaacaataaaagaaatatgcgtacaataataaagctataaagccaaaaaaatacatataaaagagtacataactacgataaaaaaccatcaaacaaaaaaattagatattgttcacttgaaaaaaaaatatgtacgtcgatagaaagaaaaatataatatacggtcctttcaaaataggaatttctatactataaaaataaaatttattactcaacaaatatgatcatatggtgtttcaacaagaactcttatattgcaacttggcactctaaaattttgctgtcaatttttatttaaaataatggacctattattttagatcattagattagcctgtttcttaatctcctgtgtatatgagagaaactatttactgaatatttgattgaaaaaaaataaacatacatacatacatacatacatacatacaacaataaagctataaagcccccaaaaaatacatatataagttggtagaaccttcgaaaacatatagacgttcttcagaataggattttctacactattaaataaaatttattactccagagataaatatgcaaaataaactacattaatataaaaccaaattaaatgtgtttaaacgcccattttaaatttattttaaattatacggtcaacttataatcaggtctattcaaatgttgatgacttatcatagttatattatagtgctaaatacattacaacacatggagctgacatataatctcaagctaccacgtggcactctataaacactcctataccgtcacgtggcactatctaatcttaccgtcgttcttcatttaattggaggacccgttattttataccattagtttaaatttatatctatagttgattttcatttaaattagtagatccattactttagaatcatttggtgtatatataattacttccccgtataaaaggtgtctaatttgaaaaaaaaagtacagtcagcaaaacaaaaaatcataagtacagtacgtatgatccgggaaaaaaaacaataaagcttatgttccgttggccggaagaaagaaaatgcctgtgtgacaaagtaaaaaacaaacgtacatagtataatcggggaaaaatgtaaatataattttctaccatataagataaagcgaaaaaccatatgtatgtagtactatctatctatgggtgtgtatgggtgtgtttaattctttaggtgtaaatttctttgaagtatacggacacacatgtattaaacatagataaataacaaattacagattccgcctgtaaactacgcgatgaatttattaagcataattaatccgtcattagcaaacgtttacggtagcattacattatcaaatcatggcataaaaactgtgcaattggtttttttcaccatttaatgtcctatgcatgtgtccaaatatttgatgtgacgttttggccaaaactttttgggatttaaacaaggcctatctatctgtctattatatattaaaagtctattaaacatcctacaaacatttccaaaccatcatatggcaccttataaatactctcaagtcgtcaagtggtaccttaatgaaatagagaaatctaacactcgattttcatttaaatcggtggaatcaatattctagatcgttagatttatcttagaaaaccaaaacctcccacgtccccgtaccatgtaccgcgcacaaagtgatcaatttgtaggctccctgttcctttatgttttttcatccctatcacaattaaaattaaaattatatttatggaaaataatctcaaaagtaggtgttaaagtccattaaatattttataaatatttctaaatctttgtatgacattattaaattagagaaaacccatccattggtttccacttaaatagattcgcacaatattttgcattgttattgtatctatttttttaatagaacaacatcccaaaccatcttcccttcctctccatccctatgggtgttttgctaagctgctacttgtctcacttaaattagaataaatcctaataaacctgagggaaaaaatagcatccaaccatcaacacattatttaggtcatcagatcaatcaatttttttcttaaaaaaataaacatcccaacctttcctccatccccgttctcatgcggtgtgcggtgttacttttctctgtttttaatatctctatgataattaaaattaaaattatttttatgggcaaagaaatgatcacaaaggaatctccacctattaggtctagccagttaatattttttttaagtgaaaacgatagctttatgtccatattgactatattttaagtgctaacaaaaaattacattatggactcacatccatattgaagcctctactcaataaagttaaaatttgttaccggacatccaaaaaaagtatgattagctaagagacactacaagaacgtatatctgctctgggacaccgcaaaaaactagtaattagctgctggatacccatggcattattctgttatgtccaaaggaaaaggggatataaacaattgcgcaagtatgatttttgccccttcctgccatgtgtagcttgtatatagctatgatgtcgaggtagtcacgacatgggcggtgaagggtatggcagcgtggcatggcacagctatgagaccgacagcaatagcctacgctctgcggtgccctgcttgacatgaatctggaggtggtccacgttgtgcttaccccaagcgctgtgtgtcgcggagcatcggcgccggcatggccctcgtgctgtagcggcgacgagtgcgggaacgacatggagccataggcctagctgcactggccctccttgaacccacctccccccctctagagagccacctcaccgacggcgggtgcggttgcaacatcgaaggtgtatgcgagccggaattggtaggtaggggaaaagtcatgcttttgttttttctttctccatttcttttggatatgataaaataatgtcatgggcctccggtagccaattaccagttttttcggtgtcccatgacagatacgcgttcttgcggtgtcccccagctaattacacgttttttaatgtcccgtagcaaattttaccctaataaaaggaaatactaaaattgctcactctacaaatcaaaatatcccagcttattttttaaaaaaactggtagacccattacttatatcccgttagacatctaacgactttccatcaactttttctcagcttgtatatgggagttatttacccatacattttgatgttgatgctttaatcaataaatgatcatttaaggagataaataaataatctttagatgaccatagcatctaaattatatatatgatctatgaagtcacgtggcaagttgaagaacatactagttgtactgagcatgttggttgcaccaagacaaccatggtatggcctcagcaatatataagccaattacagataggaattaaaagaccatatccatttcttttggtaaaacttgctgcagtacatcgtgaatttgtgacatatagcatagaacaatctagaaacatgacgctccagtttagtggtaatttgctaagaaaatactacgacatctattttaatttttcttacataattggagcgagataatttagaattgatgcctttaccacatgccagcttctaggaccaacccacttatattttcaacccgaattacagaatcaaagcatttcaaacatgcttcataaagtggatttatccaaaaaaatgaagataaaaggaatgaaaattgaataaaatttatctaatttaatttttttgttgggtttataacccattctaagtagaaatattcaaacattttagtaggactaataaaatgaatatatttaaaatttcaaacagaatctaacaaaaaaaaaggacatttataggaaacacatctattgtttcaacacaacattttctcatgaaatagaaacaacacggtttaaagtaattttagttcacaatttatatgttgtaagtaaccagtgctcaaaggacgttaaataagttcagttttagtttatgataaagtgaaagaatatttttgataggaaaccatcctcacatgacattcgtaataaaattttacgtacatgcccgcgcatatgcgcgggctaccttcctagttacattctaattaaaattttagtacaaagatttaacaactttttaataaaaaatacagagccataaatataaattctcccttaatataatttggacatacgcacacgaatctggatacactaattaatattgtcagacatagtacatccgtatgtatttaacgtacaagcaaattattgcaaacgctaacacacacgtccgcaagcttatgacgttattaattaattaactagggcaagaagccctatatatatccctatatttctcttggagaattcaatacattatctaatttgttcttacatactatacagctcgacgacaaattattacaatacttaattataactgcaattaagcaacagtacatattcatttgttgttaggtctcgatcggttgatccttgacccaactattatacgtaagcgtagataccgatgtttgccagccattccactattggagtttgtctgtatatatgcagaggtcgtcgtcgacgactcacttcttctttcctttcttattatcaccttgcttattaccatctttcagtgtttcactgcatatgtccaattaagcacaaattcagaggttaaccactgcacgacatataagacggctacaacacactatataaggataaattaattttatgcatgcactcgatcaattgtgttcatataagtactaaaacatcgcaaatgcaaactcatttgtacgtagtaccctgtagcttcgaggcgaggctgagtgctgagtgacgcgctcttgtctgcatgaggagaaaaacaacaaagaaaaaatgagcaagtcaagcaagctacctaggccatcatgcatcacgtaattagttgttttctgacatacgatatattgactcatttcatgcatattcaattgaaagaatatatatatatatatatatgcttttaatcgtgctctccctccgtccatggttataagggcttcttggctattgtgaaattattttgatgttgagtggagttactgttgactgcaaatatcaggactgacgttgtaactacgactactgagcgaagtaagtgtagtggttagatagacggtttgggaattactccctccatccgtttactttttaaaatatatttgaacatttgtcttattaaaaaaatttaagtaattattaattattttcgtatcatttgattcattgttaaatatattaccactactcgattttttgaataatattcataaaagtttttgaataagacgaacggtcaaatatgttttaaaaaaatcaacggtgtcaaatatttagggacggggcagtagtacgctaaagtctgtacgttaattaatttgtagacaaaagcagaagcataattcaattttggacggagggagaactcaatcatatataccgttgattgaaaactaaataaaaacgaatgcttcgcaccaattggcatgaattaatacgatagtataaactagtatatgaattaggtagttactagctagagtttgaaattaatcgccgtcaacaccgtttcttacctggcgtaatacatcttgtgtcatgttgattggaaagcaggcctgattgtgccacaagtcttggatgatccattcttaaggatctcaacgacaaacctccatctgcacatactgaagcatattaacagcgctagctaggaagatttcttatatgttaatggatgagatttactttagggccgacagagttcacattttcggaaaccaccgaaatttcgtgaatttcagaattttttttgtcctttttgcacgaaatatttaaaattttaaccttttttactaaaatttgaatatattaaaccaaatttatagaaaattccaaatattttgggggagatattgcttatcggggatatgaaatttctgctttaggggcttgcatagacatcaattatttccttttaatgatatttttccaaattaacctgcaaccttttaattgcacgtatctaaataacccttataattaattggatcagtgaagaaatcagcaggggctcgtacctgcgatgatgtggtccccggcaaccgggacaatcgtccagcagcagaacaactgatcttgatcactccccatgatcaccatgggcttatctgtcagctcgattatggagccgtctctgccgccggtgttaacggctttgaagacgagattggcgttgctcgccctctggatgtagcatctcctgctgatcagtcgccggtcatcgtcggcgtcggccgtggccggcgtcccatccgttgtccagcgttctccttctgcaccgtgcttcccgagcactacctgcagtggcccttcttcgcggcgagctggccgcttgcctgcagatttactgctgcctgtctccggcgtcgaccgccgccgttctccagtctgcggctgatgcgtccggctgctgctgctgccggcgccggggacgatctgctcaggcttagtcgtcccctgcttgtctcctcctgctgcttctgctgcaggtttactggcgactacgagggcgcagttccgtttcttgtttcttaggatgaacggcttctgctgctgctgctgctgaccatgcggtggcggcggtggcggcggcggcggacgtctgctgcttgtgttgctgctgcggctcgtcggccgtcaccatgtaccacagctgcatccacaaggcaatatatatatatatatatatatatatatatatatatatgtaacaaacatgtattacaattaactagaagttattaaaaagtttatactgctgctgctgatgaatgatatgatgatgatgcgtgtgtgttaattatatatatcgagcatggctggagttagtgttttaaaatttaaatagtcggctaagacatttaacacacggtcttacctaaaatttaaaacattgcctcgagatagcggtagctatagctagagatttaaaaccttacctggagatcatcgaagacgcgggagccttctgtattctccttaacgatgacttcgtcgctgctgtcgacggcggcaacgtagtatttcctgtcattgggatcgaccgtgaagatcgtgtagatctcaccggccggctgctggggcaaatttcccatgccttcgttttgggtttcagccatagttgacctatagcttcctgtagtttgtagctagagatcgatcgatcgagcagttagcacttagcaagcctatctagcgagatcgattatgcaattccagttctacct

SEQ ID NO: 81734 - DNA, 4735 bp, Oryza sativa
atatttgatggtcgtttgtatcgttgactaacccgtttcaactttaaattttttcttttccttgtctatccagctaagaaaggatgctgttccattttataagtacgtcattatcttaaaactttttacgttattatatatatatagtttgcgcatgcaagtttaacgagcaatatacatgtgctgacgaaacttttataatctttttcattgacataatgccaggtgtatgtgacttgtgaggatgcaagagcagtaacctttgatggacgtacgatctctctgcatccaagctttgtgtgcaaaatggctggcggtcgaaaaaaacaaaaaacaaaaccaaaaccgaaaaaaaccaaaaaaaccagaaaaaaacagaaatagcaaaaaaaaaaacaaaaacaaaaaagcgttcaactttgagcccacaatatattcggattagttttctagaaggactccatgtctttttctattaggtgccacctatatatactcttgtaagctatacgggaagggactcttgtaagctatacgggaaggggtgacgttctcattgttattcccctacgtttgtaatcaactcttctatagtgatcattgccggtcggcgcccgtggttttttctcgcaagggtttttcacgtaaaattttatgtctttgtgggccatctatttttataacatgtggtatgcataacactcaggtcggcaaaatgggctattgtatgtatatttgtcgtcctttgtactgaaagaaagttattactagtaaagatgaagaggcgtgttgtggaattcccgtttcctccatgacgctgataaatttgaatgtttctaaaaaatatatatattgtttatttaccgaactattcctcaacaaggtaggcccttagctggcagtagctggtgacacccaaataatttggtcccgtctaaaaaagtccagcctctaccttccgtgagcctcgccgcaataaaaaaaacaaagtgggacctaccataatattattactccctccgttttaggttataagacgttttgacttttattaaagtcaaactactctaagttagacaaaaacgaaactctgtagaaaaaaagtagtaatatttacaacataagtatagttttcattaaatttataattgaataaatttttataatatatttgtcttgggttaaaaatattactacttttttctataaaattagtcaaacttagagtagtttaaatttaaccaaaatcaaaacgttttataacctgaaatagagggagtagttgatttcaatcttaccggtgataagttaggccatatggtagtttaaaattgtcctcaacgtattccctgctccgtcaaaaaaaaattaaacgtaatctggggtatgcagatttatctttaaaaaaattaaactttagttgaaagtactccgcccaaagtcttcttatcatcttacctagaaacactcattgtcatatatgtaaatactattctttcgatactattctcatccaaaattaataaactgaaaattattttcaaataaaatttaaaactttatattaaaaatgaaagccatattcaaaatatgaaaaaaattactcaaatttttaaatttcaaaaaaattgaaaacttttaacttaggatttgaaaactttcaacatatgattcgaaaactttcaactcaaacataaaaaattttcaactcgaaatttaaaattttaaagtcaaaatttgaaaactttcaacttttcatctcaaatttgaaaacgctcagttgaaatttaaaactatcaactcaaaatttgaaaacttttaacactaggtttgaaactttctttatactggaaaactttcaagtcgagatttaaaacttttaattccaaaagatttgaaaacacataagctgacaactaaaaaataagctgacaactaaaaaaatccgaaaagaaaacacgggaaaaagagggaaaacgaacaggtggcaccaaaatagaagataaaaaaaaaaaagaaaacgcatgcagtggcgccagctcgcgcgcgcgataggaacccccgtgtccatctggtgagcgcaatcaaaatgtactgggaacctagcttcaaggacgaattcaatgcgaaccaataagcgggccgaaatcgaatgaacgaacgaacaaggtgctgctcaacaaaggagtggctgacggccgagctcaatatgccggtgagctccaaattaaatcaatccacgacaagtacggagtacatggaaagtgtcaaaaaaatttaaacaacagtaaaaaaacaactcatgtttgaaattctagggacgacatacagaagttttcaaagtcagttttaattaatcagtcaacttatgtcattaagcgggcagagttatataagttcacacggatttggaaattattatacattattttgtcccaaaccatagggaataatgtctcctgttttagatcaagtgggggttagcaatcaactactgtttcggatctagcagagattagcgaactacctgacaaagaatctcattttaaaattacgtaacgatcgaactattgcaagactgacccttcattaattaactacaaccaaattaatttctattttgcgaatagaaagtaatactatgtgatattgtacgtatgtacaaatgcaattattgtgtttgaacatgccaacacaactcaagattgatggatacatggactgatcgacaacttcgagtcaatatatatttgcgtgcgtccgtatgtgtgattattcaatgtgcaattcctaaacctaaaatttaaattcatatttgtaattaaatttttagtcacctaaaattgcactttcttaaatctttaatttcagtcatacgtacttatgtattttttttgcacgtaattgtaacttctaagaatagtaagagtgtgtatatatatatatatatatatgggggcaccatggtacccgggcatcatggtatcaaatacacaaattcacccaaatttttcaaaattttcaaattgtgagtatatacctagttataagaattcgattcatacctatacttatcaacaaaacaactcaaatttaactttatttcacaatccatgattacgtacgtaactaattatacatttagatgctatatacctagaaacaaaatctaacaaaaacaagttcaaattcagttcaaacttgcttcgaactagttagtaaagtagttaatgttaatacctaaacatttaaaaaagtttcatactcatttgagttgagtatgtactcaatttcaaccatgttgcccgggcatcataaagcaccaaacttattatatatatacatatatatatatatatatatatatatatatatatatatatatatatgcgcgcttgcacactatacatatctacacaattgatagcttataatgatgaacagctgatatgtattaagggatatctaataatcagcaagcgggttcatcgatgaattaatgcatctaattaatgggcaatgttcatcgttataacgattctaattaatcgtctaattaatcactataattatcattgatactccctccggttctattttaattgacgttttggacaataacacggtctacaagatacatctttgatcttacttttctattatagtatatataataaataaatgcatgtttaattttattatagtattttaaaagataaatctatatatgttgttctagttcctttaaactaaatatttttaaagttagtgatggtcaaaattataaaagtttgactccaaccttattcaaaatgtcaattaatatgtaaccagagggtcaataattaatatgtaaccagagggagtagcttataatgatgaacagttgtagactagctagtaatttaggctcaaaagctgtgcctggattatcgtagccccaaaatcactgacccaatgtagtactcatctaattaactgtttttttataatgaccgaatgtttgactgttaagattacacagtattatttcgaaccattaatataattagtgaatttatatatatttgaatgatagacctatatattgacgatgcaagagcccattaattgagagaaactcccatgataatgcagatataatatgtttccacaaaacaatgacccaagctagctagctaatagctatatgccaaatgtgtcatatatataaccaaattaaaccagattagatatggttggcagaactgacaaacatatactcacctgttataaattgatgtgttttcatgattacaacacagttgactcatggttccacacgctaacttgacaccaaatggatttccatgggagattaggacgggtcaacaagacttcattctttttctttcctgtacaggaatatatcaagtaaacttaattagcatgaagatcgtctctgctctaattttttttaaaagcaatatgattttaatggaaaatcacaaaactataggtcagttagacgaaatcgcaagtttagcaccctgtcgaacaaccgcggttcgacagggatatctatcgaacaaccacagttcgacaggtacatgtcgaactgcgtcagttcgacagggtaggtggtccaaaaataaataaaaaattacatgaacagtatcactacaatgctagacagggacatatcgaacagccaaagttcgataaggttgcgtgaacagcgcgctacagtgatgct

SEQ ID NO: 81735 - DNA, 6478 bp, Oryza sativa
ttcgtctaactgacctatagttttgcgattttccattaaaatcatattacttttaaaaaaaattctctctgctcttgttcccctttatattttactagttttatacggaagtcagcacgagtaaccataaaaaatgccaatcaatcacgcgtatatatatgtataaaagaatttcaatgtgattacgaataaaaccgaacgattaccatacgcaaataaaaggaaattcttttatacaaatatgtataaaaaatcaaagtgtttaaaagtttaatacctgtctagttcaaaactagaattattttcaacctcacgaagagtattttacaaatttcacaagtatttttatatttaattttttcgattacgtggtagacacttatacgtatataattctacactacgcgcacacacaccatatgcattgctgggtccacaattattgctttctcttatgcatggaaccaaattaagagctcaaggtggttgatactcctacagcatggcgtatacctaatgcaacaggaaatttccgtatatgtacacatgtagctacataaaatatactccctccgtcccaaaataaatgcagttttgcactattcacatttaacgtttgaccgtttgtcttatttaaaatttttttaatatttctattgctattagatgataaaacatgaatagtactttatgtgtgactaaatatttttaaattttcacaaattttttaaataagacggacggtcaaacgttgggctcggatatccacggctgtacttattttgggacggaggcagtactactcaccaaggcaagcacaatatatatatagataggacaaaatagagctactaattaattaaggagatctaggcagtagggacaagaagctacttaatgcaaataacatggtacgagagcatggattcgatgagcgcctaagctagctattggagaaacttctacgcatggatgcattcatgcatattacacatgaagttggtacgtggtacgtagctttcaaattgttgtggaacgaatccatccgtccgagttgaattaggtttcgggagaaaattaagaaagacgatcgatcgatcgatagatggagcgtgtggttagtacgtactacgtattttttgggtcgtctttggaacgtacgtacgtcggggaacgcgttcctcgatctctatatatatggaatggaccatcttgctcctacgatcgtcgactcatcacacacacggtcacaccacacagtggctggttcgtcatccatcgagtttctagcagctccatatatcgattacagatcagtcccatgtacgtataactgatatctgtacatactgtatgcgtatattcatgcacagtttatcatcagtagctcgatctgtgatttgcatgtaccgcagtgtactttctgcgagaccaagttttaatttatactccctccgttccgaaatgtttgacgccgttgacttttttaaacaatgtttgaccgtttgtcttatttaaaaaatttaagtaattattaattcttttcctatcatttgattcattgttaaatatatttttatgtaggcatataattttacatatttcacaaaagtttttaaataagacgaacggtcaaacatgtgctaaaaagtcaacgatatcaaatattttgaaacggagggagtacatacatgtgcatgtagtagtgtcgacgatgcccgcatacatgcatttggatcgatctcacttcccaacttaattttgttattattcagggcacctgcttttggagatgggccgcaaggcaaacaaagcaatctcgtgccggacgatcctattaataataaccactactataaaaatcgtttttctgtacaagggggtcggtaggttccatgcgggacgcttgtggcggcgcctgcaaaaaccgcccccccgggggcgggttgattagccgcatgcgatgatcggccatatatgctccttcaggcccgagcttgaccatttgaaaacgaagctttctctctcctaaagcaaacaccaattaggggggggaggttttcaactcgaaatttttacttgaactctatacgaaaggtgaagaactctctatcctgcttcatttggctccatttttgttatatttcgttggtggaaagtggagtttttttaatattttgacaaggtttgttctaactattttttgcaaaatctagcttcaaaatatatgttttgatgggtaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattgatcaggctaaggcgcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatgtcgcgtgaaagaatggttgtcgatgtttccaccgatagtgatgatttcgatggtggttttgatttagaggatatgctacgccatgttgaaccagatgtgctagcggcaggtcacgaggattggagaattggcaggcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatgaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacggggaatgggcccatagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaggacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcgatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggttcctaccacaaagacataggtaccgtaagatggctagattgttcgataatacagtggagaatgacaatgccccagtagcaagaggtggtacatacgtgtatgagataacaaagaagattaaggttgtatatggaaagggaaagaagaagacagtaaagaggaagaaagctgatggtgacaacggtactgcgtcgcctttcaagaagcactcaattttcttcaaatacttagattactggaagaacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtagtgctgccaaatgggaagaccgagattcctcctgcttgttactcattgacacttgaagagaaaaaagccttttgtaaatgtttacaaggggttagagtgcctactggtttcgcatcgaacatcaggaagctagtatcaatgaaggatttgtccatttcgggatacaatgcgcatgactgtcataggttgctaacggtgttcctaccaattgctataagggcagtcaaaccagtccatacaaaggtggttataacaaagttgtgctactttttcaatcgaatttcgcagaaggtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtatggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttagtgattctgtggaggaacttactttacaaagactggcatgtgggccttcaagtattgtcaattcatggcaaggttacgacatcaatggatttaccttgagtacgactacgaaggacatgaaaagcaccgcacaaaacagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtgtggctcaagtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcataacctttagttctcattgtattccaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttagaaaaaaaaatatgagtttttttggtaaaaagatctttctatgcggacgacttaagccagccggatggaaagatctttttcccatgcggccggctttatggcccgcacggaaatatctttttcgcatgcggctggcttaacagcccgcatggaaagatctttttcgcatgcggccggcttaacagcccacacggaaagatctttttcgcatgcggctggcttaacagcccgcatggaaagatctttttcgcatgcggccggcttaacagcccgcatggaaagatctttttcgcatgcggccggcttatgtcaaccgcatggaaagatattttttccatgcggtcccttaagccgcccgcatgcgatgatctgcgcctatatatagggagcgcggggagccaaaattttctaagtcccggctcccgcgaaaccctagccgccaggttgccaaaatttcccaagtcgccgtcgccgtcgtccccgccaccgccggctcctccccaaagtcgccccgccccacgccgtcgccgccgccgacgtcaggacctctc

SEQ ID NO: 81736 - DNA, 10991 bp, Oryza sativa
taatattcatttataatatcatgtttgtgcaaagaaaaatacttgtggtgctatttattttgctcatatgtatctagtataaagtatatagtttgtgttttttcaggatagtaacttcagtttagcactatgcgatcactggatgtttaattactggatatttgaattattatgcaagttcatctacattattttgtctatattactgttaaacggtgtgtttcgtacgaaaactttacagcaacttcagtttagcactatttcgatccgcccctgctggtttcatgctgaattatagaaaacatctgcactgcccatctgtcagtaaaataaaataaaggtctcgtttccaccacaaagagtggataaagttttgaatattcgtggcacgcttttcaaactgttaaacgatgtgtttcgtgcgaaaactttctatgcgaaagttgttctaaaataatagattaatctatttttttaagtttataataattaaaactcaattaatcatacgttattatcaccttattttacctgaaacactttatctttatcttaatcttcaggagatacaaacaccaccaaaatatgagtgccacctgttagcaccactctctttctttccccaacttctctctgcctcacagtcaccctgcgacaagcacgagctaaagctccaccatagggactttaggggcgccatcgtttcgctttttttctaataagccaaaacggcttattagaaaataaaaattgaatttgtaggtaaaacttttatatatgtgttctttgtgatttaaaagccaatgctaaaaaaatctacgttgaaaatatctcaaagtcattctcaaaattaagtttgaaaatttaaaatttggttttttttcttattaggccatccgatgggagcctagggaggcagttgtgtagccagaggttgccattgcaatgaattttctcaagctagctaaagaactgttgctactgtgtttgcacatgatgctagtctacgtgggcaagtattttctacacccaggtgccataacatttaagtgtatgcatgtagttcaaatagttatataaaaaattcataaaatttgataagataaactatgacgatataagactctatataaatatgaagtctaaatttgatctacacatgaagaaaaaataataaattttatctgcgttatacaggttctatttactatcagtttctattatttttacactactacaatagatatttttgcgtgtggttgttttgatttttgcgtgcggtagattcgcccgtttggagcgggctgtctgggaaaatcgtgattttctcgtgcgggtgcttatgtcacccgcacggaaaaataaaaatctgaaaaaaaaataaaatttcaaaaaattgaaatcctaaccatagatcggggcaccctgccgccactgccgcgccggctcccaccgccactggatccggcgtggggtagccgccgccaccggatccgggagtggggagggcggcgccgctcccggacgccttgcgcgagcgttgggaggaggggaagagtggtcaagtggaggcagcggcggtgctgctcccggccaccgcctcctcgtcgtcgtcggcggcaacggccgccgcgttgcctcgtcgtcgtcatcgtcgtcggcagcctccgccgcacccctgagcccaccggcaatggatccgcctcccccgagcccaccgacgatggatatgtctccccgaggccgccatcgttggcgcgagctcgccaccatcgtcatcatcgtcaaggtcagtcgtcatcgtcgttgagggggcgcggccgcggctccatcgctctccgcgtcgcctcccacgccatcggcggtggcacccgtcccgtgcgcactcggtgaggagaggaggggaggagaggaaagaggcagagagagacgagagagaggggaggggaggagaggaatataatagggaaaaaggaagagagggtgtcaaaaaaaattgaagtgggtgagagagaaaataggaagggatattttattttcctgtgcggtccacttaaaaagcccgcacgcgaaaatcgatttttctatgtggtccacttaagttgaccgcacgggataatgaggattatcccgtgcggttggattaagatgccagcacgggataattgattttcccgtgtgggcgtccgcccgatgccggtcgctcgattatcccgtgcggttccactcatggcccgcccaaaagggcccggcgtccatgaaaaatcattcgtgtagtagtgttatttctctagttgtatatcaatctaatcttgtacgtttgtgtatcgatttataacatcacaattaatgttactttttcctataactatctaagtcgcgcgtaaatgatgggtttcatgacatccatgtatagaaaatccttatcatgtacgtgcagttgcctggctagttgtatatatcatatatgagctcgtagcttagcgggatgcgagtatggcgtgggatgcgaatgttagcagcatgccttttctatttactttggcggcttagatgcttagtgatcaggctgttattatacacagagatgacattagttttctttgaaagtaattcattaggttgatgcagatctgaccaataatcgaggctatagctatagccttagttaattgatcacttgttcttacaattcgtttaattgtaggaaatcaggaaccgatataggttagtcaaccatctcgttagtgcaatgagggatataaaagtcaccatataccgaattaatgagtatcatccatctatcatagtaaataattagattcctcaaaataacgatccaatgatcaagtagttaaaatatcacctggttactgtggccatcagttatcttagccggttcctatcaagaaaccgctgagtaatctggataaattaaaacaaattaaattcgaaatttcattaaattgtttctaaatttctgataaccaacgaaacgctagcaacaaattgttttttttatgaaacactggatagaatacacaaagattccattaattttcataattccttttggcaataatttctaattcaaaaaactagctgggtgcagaatgcagagctgactaagaacaagggattgtttggaagagcttttagcagctatagcttctcacagaggccgtgtttagttctttggccaaatttttttaaagtatacggacacacatttgaagtattaaacatagactaataacaaaacaaattatagatttcgtctgtaaactgtgagacaaatttattaagcctaattaatccatcattagcaaatgtttactgtagcatcacattgtcaaatcatggcgtaattaggctcaaaagatttatctcacaatttacatgcaaactgtgcaattggtttttttcgtccacatttaatgctccatgcatgtgtccaaacatttgatgtgatatttttagccaaaatattttaggatctaaacacacccggaatcttcagctcctcaaacggtccatattgttacccaaatttttctaaaaatccatagttgtagaatccagaaaatgaaaaatctaaaagctgaaaaacccagcgtctctaaattttcagaagttggttaccaagcagaagaatatcaaatctgcggctcccctaaacaaggcccaacaatcagccacctattgagcaaaaacagcaagcaaaatgcaagcatttaaactccattgcttagatacaaaatcctttatgctttgatttgatccaagctaacccaccagccatggcggaggttgtacagctctaccacctcatcttgcttctgccgctcttcatcctccccttcctcctcctcctccgttagttgtgccggaatagtaatattttccaatttccaggaattttaggaaatgaaatttcgagggactttgcttaggaccttggaactctaatgattctacgactttatatgagttcttgtatgaatttttgaatggtttaggaggggactcgaacctcgaaatttgaatcttagaaatttaatttaggatagaatattttggtcaagattttgagttcacaaaggaatgaattaattgagatctttggtactcaaacctagatacactcaaataaccaaacttttgaacatagaattttattaaatagtttttaagggtatacggaaattggggcgttacaggatttgcagcgaagcttatgtcttcttgattcttaacctaaaataatgtcttcttgatcctaacctaaagtaaagggattggcaacgtacaaaaaaaatatcaaggacctaaaaggaggtacacaacgatttttttttaaaaaaggcgaaaattagagaaagaacttatctctactattataaaaattgaatatctttttgccagtactttagcactgtcaacgagaaatctcataaaccggatgaatagggtattgtggtaagttggtatgagaatttacacgatacgacatcaagaaaacaagaagacaagtattatactggctcaggcccctcataaggtaatagctctagtccagtttatatgagattgatatggaaaactacatattagaatagagaacaatcaatcccaagattggcggcgagacccctcgtcgagatgatttcgacgagatctcccggtgagtaggcttcacgtcctccggattgtaggctatggtggtggtattggcgctatgattcgatgatctggatccctcaggggatgtatcttttataccgtgaatcaccttagtctccaagtagaactcggagacctacggaccctgcacgatataatataaacccaatcctcaaggtagggctctactattcacttgtccatgaggataattttcatagtctcttgtcattttccttgttgtatatggaagtatatcgtacatacgaaggtatgtcgtatctgtatatttcatatgtcataggatagtaagtatgccttattcgtaactatgacaggtacgtcatccgtatatgagtcggttttaagttcgttctcttttgaaaatacatatccgtatttgagtcagtttttaaagttcgtttattttttaaaatatagaaggagtcgtataagaaatctatttaaaaaaattacatgctagcttgagacgatcggattcctaattgcagctcatgattttctaaaaaaaatatgtccaatcgaattcctatggcgaatttcaccttaactaaaccgtataataatattattattaaaataatcttcacccgttgcaacgcacaaatatttttttctagttatcaaataaataaaaggagttagactttgaaactagaccggctagcctatcatcttatggagctagctataaaacccctgaccgttccgcggattttctcaaactagaaaaacgttgctacgtactgttgtcgcacctagtgctagtcacgtgtagtacgttgcttagctggatttgtataaatgagggtattggcagttaacacctggcgggggatgcgagaatattagcagcgtacttcttatattaactttgggggcttagatgcttagtgatcacgatgttctatgcacaaagactagctacagtcttagttaattgaggctaagattgttgatgcagattggatggagtattcaaaaaataatccattagttgatgcagatcgatctgaccattaatcgaggctagctacagtcttagttaattgatcacttgttcttataattcgtttaattaccaacaagttggtcaactaatctcgtccagtacaaggtataaaagtcaccctactgaattcatgaaataatctcgggaaagatatatcgttcgattctccaaacattacgatccaatgggcgatcaagtagttagaatcatttaagaaaaaaatagaaaagatggcctcttgggttgccttgcgtggggaggctccctagccctagcccgcctcctcatccgatctgctccgcctccaccatagccatcggcactggtgggcggcggatgtagatcggacatttaatgctccatgcatgtgtttaaatatttgatgtaatatttttggccaaatattttgagatctaaatacacccagaatcttcagttcctcaaacagtccatattattactcaaattttttttttagaattcagaaaatgaagaatccaaaagctgaaaaacccagcatctctaaattttctaagggactagcttaaaaaactgtcgagtgttttttgaggggaaaacttttaaatctaactatagtatataatttcactagaactatactataataataactggtacatatatgtattaaaataatatatacaactttatatctaatttatatagagataacaatatagttatagtgtagttacactatagttacaatataattacaatgtaattatagtgtaactacaatgtaactagcatataactgaaatgcaatttagatgtaacatgaacaaatttaccatatacatgtgatgatgtggctagcttatgaaaagagggtttagatccggtagcaaaatatctcagcacaaatcttaaagcgaaatcgacggcctaaaaatttgtcgacagtcatttagcagtttcgattttctaaagttggttaccaaccagtaaaatatgaaatctgcggctcccctaaacagggcccaacaatcagccagctattgagcagcaacagcaagcaaaatgcaaacatttaaactccattgcttagatacaaaatcgtttgagctttgatttgatccaagctaacccaccagccatggcggaggttgtacagctccaccacctcatcttgcttctgccgctgttcatcctccccttcctcctcctccgttcgtcgcgccgccggcgtggcgcctgcggccggctaccaccgtcgccatgggcactcccggtgatcggccacctccaccacctagccggggcgctcccgcaccgcgccatgcgcgacattgcgcggcgccacggcccactcgtgctgctccggctcggcgagctccccgtcgtcgtcgcctcctccgcggacgccgcgcgcgacgtcatgaagacgcacgacctcgccttcgcgacgcgccccatcacccgcatgatgcgcctcgtcttccccgagggctccgaggggatcatcttctcgccctacggcgagacgtggaggcagctccgcaagatctgcaccgtcgagctgctcagcgccaggcgcgtcaattccttccggtccgtccgcgaggaggaggtcaaccggctgctccgggcggtggcggcggccgcggcgtcggcaacctcgccggcgaagacggtgaacctcagcgagctgatgtcggcctacgccgccgactcgtctgtgcgcgccatgatcgggaggcggtgcaaggaccgggacaagttcttggcgatgctcgagcgagggatcaagctgttcgtgacgccgagcttgccggacctgtacccgtcgtcgcgcctcgccatggtcgtcagcaggatgcctcgccggatgaggcggcaccgcgaggaggtgttcgcgttcttggacgccattatcgcggagcaccaagaaaacagagcctccggggaagatgaggaggacttgctcgacgtgctcctgaggatccagagagaaggttgcatggagtccactgttatccaccgaatccatcaggacaacaattggaggaagtactcccatgaacacacaaataactcaaaaaaaagtacaatcgtaatttcacgcgaatagcaaatatcatcgccatctatagttatactctgtaatctctatctctactattacaaaaaattaaagatatttttgtcggtattttggtccgtcatctgtgtatgagttggttttcaagttcgttcgcttttaaaaatacagatccgtatttgagtcgggttttaagttagttcacttttggaaatacagaaagagtcgtataagaagtctttttaaaaagctcgcatgctaatttgagatgaccagatttctaattgcagcttatgattttctagaaaaatatatatcgaaacgaattctcacagtgaatttcaccttaactaaaccatataataataataagataaaaataatctttatccgttgcaacgtacgagcattttttttctagtaataacctgccactttgtaggacacacaaacgagagattttgcttatttcctaacccccacaaatcctaagagctctagctcaataggcacctaaaaagtaacagcaaaattaacataatcatatataatatattagataataaaaataatttgttatgggcttcaaaaaatatatacaatgagctatttttattaaaagaaatccgttgtaacttagtagtgttatgctagtaagaataacgcgtgaggactgaacctacacgtcaatgacacatatatactataattttgttttttgatacaatgatatttttcagcaccataatttttttacagggttaccaagcaaattagcaaaaagttaccatggcttttccacaaaatgtagttacctgaaaatttggcttcatggtacacaggacttgttcaatgggggcagtgagacgacagcgacgacgctacaatggattatggctaaactcatgagaaacccaagagttatgcaaaaagcacaagatgaggtccaacgagtattcattggtcagcacaaagtcacagaagaaaacctaagcaatttgagttacatgtacttggtcatcaaagaggcgctccggctgcacccgccaagaccaccactgctgccacgagagtgtcgaactacttgccaagtgctagggttcgatgtgcctaaaggaacaatagtgctcgtgaatatgtgggctataaatagggatcctaagtactgggaccaatcagaagagtttatactagagagatttgagcatgttgatatcaatttcaaagggatgaactttgagtatatgccgtttggagcgggacgacggatgtgccctgggatggcatttggtctagtgaatttagagctcgtactagcgagtctcttatatcactttgactggaagttatctgacaaaataagtcggtgacctagacatgacgcaggagaggggggccaccacacggcgactccatgatcttttgcttgtccctgtgattcgagtgccgttaccgttagactcgcgcagctagctaggtgctagataagtagcttgtgattttttatttcttgataaagcgaccaaatatattggttcactaatgtttacctatgttcaaaccttaacaattaaattattacaaaactacttcaactcactgtgcaattaattacatttgtacattccgatatgtattttaatatacagtttctctgtgctattcatcttttgttattgttatatttgcagatttatgtgtcatatttattagacgaaaagaagtagaatacaacacaccacatatgtccggcggcttctctggataggaagaaaaagaagcatgcagctacatgcaacttccctacttcctctggatccactttcatggcaaatcttaaactggtgtgacaaacaaggaccgtacgtagtttcttttcctttctccttaatatataaaaaaagtaggatcccatatattatagaatggacggagcgtgtggatccatatatacacccctatgtgttgccagtggagagcaatattcgactgctcttggaatatcgtcaatcacctagactgtggaaaagacactttcatggcaaatctcaaactggtgtgacaaataaggaccgtacgtagtttcttttcctttctccttaatataaaaaaaaagtaggataccatatattatagaatggacggagtgtggatccatgtatacacccctatgtgaaggttgccagtggagagcaatattcgaccgctcttggaatatcgtcaatcacctagactggggaaaagatgttgtcaaagacataagcgcgcgttgtgctacctccaaagctattccaagtgaccagaaggataagagaatcgaagctccggaggataattttcataatctcttatcaatttccttattgtatatagaagtatatcgtacatacaaaggtatgttgtatccgtatatttcataggtcataggataggaagtatgtattatccgtaatcatgataggtacgtcatccgtatatgagtcggtttttaaattcgttcgcttttggaaatacatattcatatttgagttagtttttaagtttgttcgcttttgaaaatatagaaggagttgtataagaaatctatttaaaaagaattgcatgctaacttgagaagatcggattcctaattatagctcatgattttaaaaaaatatatatatccaatcgaattttagtgaattttaccttaactaaaccatataataataataagattaaaatagtcttcacatgttgcaacgcataggcattttttctagttatcaaataaataaaaggggttagacttcaaaactagacctgctaatctatcaccttgcggagctagctatagaacccctaagcgttcctcggattttcttaaactagaaaaacgttgctaccgtttgtcgcacctagtgctagtcacgtgtagtacgttgcttagatggatttgtataaatgagggtattggcagttaacacctggcgggggatgcgagaatattagcagcttacttcttatattaactttggcggcttagatgcttagtactcgtgatcacgatgttctatgcacaaagactacattagtattcaaaaaataatccattagttgatgcagatctgaccattaatcgaggctaactacagtcttagttaattgatcacttggtcttacaattcgtttaattaccaacaggttggtcaaccaatctcgtccagtaca

SEQ ID NO: 81737 - DNA, 33959 bp, Oryza sativa
ttgtaaatatttaacatttaggataatatttttattaaattgtacagagtggccaccaatggtttgtcaagtgtttaattgaaaaagggaaaatggtatatatggcatagatttgttttcaagactttatatattgtatctactagcaaatatgcgcgtgtgttgcatgggatctagtaagaggggttaaatgttccgttccactctattatactccctccgtcacatgatataagggattttgattttttgcttgcactgtttgaccattcgtcttatttaaaaaattttagaattattatttattttatttgtgacttactttattatccaaagtattttaaccacaacttttcattttttatatttgcacaaatttttttaataagacgagtggtcatacaatacaagcaaaaagtcaaaatctcttatattatgggacggagggagtagtatgttttcagtttttcttagtgtgtttcaacttttttttctatggttgttttctctatttttgtgtacgttcaccggtttttcagaaactttttttttagtagacggattgacaaaactctgcttttgcccttcctgcattataggaattacttggagtgaaaagcttggacaccatacgctgatcccttgtggtggcggtacaacacaataattgagaaatccattcaacatataatggtcatgcttgtgcgatcaaagcgtgggctcctgttctactcccatcgtatcctcaactacactgtttcctcatcttcatcaaactgcttccactgttgggccttactaatgcctagcgacaccgaccactttgcctcccattacgagtatctccacactctacatcgctgccttaaatgtcgcgtaggcctacccgacaccaccaacatggcctctgtcggcgtatgggtcaccgtcagcggccacttcaagcttccaggcaccaggcgcttcctcaagaatatattattcaaattatcagatgtattatttcttaaattgggtgtttgttcgttcatgacttcatgtagatcgaatccatgtgtatattaaaaagagtgaacctactttaattaaatattaatttatattttctagttatcatgggtccacatgtcatatggattatgatgcttgttactattatacactttgttatattaatgactcggttatttcctaattcacgagttggcgatcctttgacgtcatttaaattgtaaacttaccgatggagcagaaccaaaataggatatgatttatggttgtgcgcctggcgtgggaaggcaaatgggatgtgctgagtgtggatcctattggattctgacacgtgggatgcttcatcatcgacgtggaagcggtgaattttggtttgggagcaatcagactcgcacgtgttgctagggcgccagtgcagaaacacgaaaatcgttaatgtacgccatacaaccacgaataatagaaacactactagagatggcagtggggtcccgttcaccgtttccctacggtgaattcatctattaggtgacggtgatggttaatatgtatccactatgggggatgaaatggttacaaacttattaccatcgaggatgacgggggcagggacggtgcacgattccctgtccccgcccccgcggtgacccgactttactatatagaggactaattctagactttttatacattttggcccataatactgaagcccatttaataggtatatatataaaacctaaccctaagtcaaccggtcaaactccataatccaaatcctcagatccagtctctcctccagtcctcctgctctcggttgcggcgctgcacctgcgtgcatcgccagttcgccactctgccagccaccaggcacaccgccgtgcactgccactccctagccaccaggagcaccactgctcgaaacgcgcacgccgccgcctcctcttgcgtggcacaggcacgggtgttgtcccgtccctccgtcgactcgctgccgagagcaccgccgagagcgccggtgtcgcgccgcgcagcgcctgcggctgtcgtcgcgccgccgggagccaccaacgccctccatcgccactcgccagcacgccgtccgctgccacgtcgtccgctgtaaccacggggataaattcaccacgtggtgatcgggactggagaaatgtagccccgttatggttgacggggcggggatggtgaaattttatcaccatggggacggggacgtggatgtgacccctgacggtgaattccccgttgccatctctaaacactacaaatattttaaatatgtaaagataaagataaagaaaaattgggatcatgatgaaagaaaatatgaccgatgtggtgagacatgttttcgtctttttttattatagatcactgtccttttttaattagaaatttaaattgtttgtttattttatagaaaccatcaagaaaaaaagagatcggaagggaaagaagcgaagcaagcgcagccgctcagggtggggtggtcttttggtggttagatcttttgtccttctgtgattaggaatttagatggtttatttccactactaaaaaaaacccatatagggaccggtcttataggtgccggttcatttaaaaccgacacctataggccttttccaacctagcttcgcactatgaataaaataaagaatcgacacctttaagcattataagtaccagttctcaagaaaaaccgataacaataatatgagtgccagttctagcacaaaaaccggtacaaatattataggtgccggtttttttaaaagaaccgacacctataatataaatataggtgccggttctacttagaaaaaaccgaccggtcgacgtccttatccactcgcatctcttgatcggtcgctctacctcatccactcgctcctctcactcctcactccatccactcgcatccccctcccctctcgccctctcccgcctcctcctccttctcctggcagcgatgcgctgacagcggcagcgatcgcaaggaggcagcggcagtggccccttctccagcggcggctacccccttctccttgcagcggtaccttctcccggtagcggtggcggctgcaaggagacagcggcggcggccgcaaggaggcagtggtggaggtccccttctcattgcagcggcggtggccccttcttctggtagatatcatgccaacgtcagcgagatgtcagcatgaaacctaggcacagatgccatgcttcttccatgttctcatgttgaaaattcatgccaattatttctatcacactcaatgacgattgcggcggcgaagcctgcaattaacactacatattgccttgtgcaggtgatatcatcaccaattcaccattagctatcttacttgcctcctataaataccctcagccggaagggttattcgtatgcatcaaaaacacacaacgctaactcatcacgagtttgatacacatagtaatcctacgtaatcaagcttagattgtgttaatcaactcaatactgcaaaaaatcgtttttgcaggcggtcaaattagggtaaattaagtgactgtaagctttgttaaacgccatggatttgatgaagagtaatccgcttcaggggagcccatggagcttgttgaacttgctggtattgatcattgtcgccgccatgatctgcggcgagctatgtcgtcgtcgtcgtcgtcgtcgtggcgacgagaatggtggcgccacgaggctgcctccggggccatggcggctgccgttcgtcggcagcctgcaccacctcgcggtgatgaggccgcgcggggtggtggtgcaccgcgcgctggccgagctggcgcggcggcacgacgcccccgtcatgtacctccgcctcggcgagctccccgtcgtggtggcgtcgtcgccggaggccgcgcgcgaggtcctcaagacgcacgacgcggcgttcgccacccgcgccatgagcgtcacggtgagggagtccatcggcgacaaggtcggcatcctcttctccccctacggcaagaagtggcgccagctccgcggcatctgcaccctcgagctgctcagcgtgaagcgggtgcgctcgttccgccccatccgggaggagcaggtcgcccgcctcgtcgacgccatcgccgccgccgcggcgtcgtccacggcggaggcggcggcggtgaacatcagcaggcagatcaccgggccgatgacggacctggcgctgcgcgcaatcatgggggagtgcttccggtggcgggaggagttcctggagacgctggcggaggcgctcaagaagacgaccgggctcggcgtcgccgacatgttcccgtcgtcgcggctcctccgcgccgtcgggagcacggtgcgcgacgtgaagctgctgaacgccaagctgttcgagctggtggagtgcgccatcgagcagcatcgggagcagattagagcggctcacgacaacggcggcgacgacgacgacgcgcatggccatggcgacaaggagtgcttcctgaatactctgatgagaattcagaaggaaggtgatgatcttgatgacactcaccatggcaaccgtcaaagctgtcattcttgtaagtatctacactacactagctactacctccatcaatttttataggacttgctttattttgaaaaaatcatcgatacttttattaatagacgtgaagctatattattttgtatgtagtgcctatatttcaggcgcctaaaatttcttaaaaaattgttactttttcatccctaagataaacaatccaatggttctcatcacttatctatcactacttccatcccataatatagtaaatagtaccatatgataagacatattccggtaccacgaatctgaataactcatgtctaaatttgtagtcctaaaatatctcatgcagtactagctaggttactatggtataggatggagggagtatttattacttataattctcccatggttggttaataaattattctaacaaaaactttacaatattacatcaaaccaacttataactcattaaaatttacaaaattgcatgcaaaaaaattcagaaaaagacgcaaataaagtaaaattaatcatgtgtaactccaaaattgtagttaagatgaacttaaattccatattgaataaggcttagtaatatgaaattttaggttaccgaaaatatacaaatttttaggcatctaaaatctagcaaatctctatttaatttctaagagtcgtttgcaatatgaatctattggtacactaaatatacttgcaatttgacaaaattattgacaacataaagtggcaagtatagatttgtgtcttgaaaagaatttcataatctccaaagatttattagatttcataaaattatccaatatataaaattatggtcaaagtcacactttaaataccgtggaaaaaactccaatgtcaagtatcttttatcagagggagtatatatttatgtatatatggcttcccgccttgtgctttccttcctatcctccatcaacagaatgtataaattttatgtagcactgtaaatatgcatgtttccttttaacatgcactaacatatgcatgacatgcattggccaggacatgtttgcaggtggaagtgaatcaacatcaacaacacttgaatgggccctgtcagagcttgtgaggaaccctcatgtgatgcaaaaggcacaagcagagatacgacatgctttgcaaggcaggactagggtaactgaagatgatttaattaatttaaagtacccaaagaacataatcaaggaaacactacggttacaccctgtagcacctctacttgtcccaaaagagtgtcaggagtcgtgtaaaatcctcggctatgatgttcctaagggaacaatcatgttcgtaaatgcatgggctatcggcagagaccctagatattggaacgatgcagaagtgtttatgccagagcgttttgagaaagttgcagttgatttcagaggcacaaactttgagttcaaaccatttggagcaggacggaggatgtgcccaggaataacatttgcaaatgcaacaatcgaaatggccctcactgctcttctataccacttcgattggcatctccctccaggtgtaacaccggatgggttggacatggaggaggaattcggcatgagcgtttcaaggaaaagggatctttatctacgaccgacactccatatgggacttgaaacaatatgatgaatacacgcgtgttgtcatggaaaatgttgataatagccgaatggtgtatgtacctagtagaaaaaaaatactttctgcaaattatagtacctatacttacaagatgtttgggaggtaggaactcctgagatattcagatattccagagctccgagtgcattagtatagaaattcatgcacgaacacaatatatataaggcgttgctgtcatgtacaagagctgtgttttttaaagataaaagtactgtacgtttccagttgtaatgtaacaaaagtttgcaagatatatgcaccttttgaaaaattgaaacatgagtactgcatctcaacgtacattgcaatataatttgtcttttatacctgaattaatttgtgcctcaagctagtaccgcgtgaagaaaatgccatgtggatcgatgagaacagctgatctcctacattaaggtcaactcttagacttaaaaaaaggtgatttgatagtgaatcaccgaactatactatatattgtgtgaagtaatactcaatccaagaagaacggaaatttgggtaataaagacaaactcgtgtgttaagtgcatgcatacgtaattaagcaccgatgaaatagccgcttaggagtcaaaatgattcttttattttgaagaaaatttgaaacgaaattctaagttgacttaaaaagctgactctgtttttttctgactgctgactctgttaattattttctatcaatcacccattgttttttatctaaaaccaatctctgttttgaagtaaatgcagatgcagaagtagcatagtacaggtttacaggctcatggagtatacaactcagaaaacacaattacaagggtctaagtaatgaaatcatcaaaagctagtgttcttatcttctaaaaaaaactagtgctcttttgaaagtcaaaataaggacaaatttcaacttagttcgtacatccgaagccaagaaatttgattgaatttcgacaaagaaatcaaccgtctcatctagctcgtctccgtgttaggaacaggaacactaacagtagcatgcagccacagatcgctcttcctcctcgccgtgatcccgagcccctccgccatgtccagctcgccggcggcggtgcctccggcgagctcccagtcgaagtggaagaggaggctcgcgagcccgagctccatgatggcgacggcgaatgccacgccggggcacatcctccggccggccccgaacggcacgaactcgaagtccgtccccttgaagtccaccgcgccgccgtcgaacctctccggcctgaactcctcggcgtcggggccccagaccgcggtgtcgcggcagatcgcccacgcgttgacgagcaccatggcacgctccggcacgtcgtagccgagcacgcggaggcgtggctcctggcactcccgcgggaggaggagtggcaccgcgacgtggaggcggagcgtctccttgatgacgaggtggaggtagtggaggtccgggagggcgtcctccgtgacgtgggagtgcccggcgaggacgccgcgcacctccgcctgcgccttgcggagcgccgccgggttccgcatcagctccgccatcgcccattgcagcgtcgtccccgtcgtctcgctccccgcgctgaagagatcctacatggtggacggcgacggcttgtcaatttcgtcgaacaccttggagggagaagaatttggtcgaacacttgtggggagagagggtgggagagcttacgatgattatggcacggatggtgcccatgtcgagagggatctggaggccgccatccttctggatccggaggagcacgtcgaggaggtcctcgtcttcctcgtcgcgccacccggtggcggccctcctctggcggtgctcctcgatgacgccgtccatgagacgggtcatctcgcggctgtgcgcctcggcccgccgcgccgtcccgctgagcgcgcgggcgaggcgcgacgacgggaacacgtcggcgagggtgaacccggcggccaccttgacgccctcctccagcctctccaagaacgcgtcgcggtcactgatccggtcacccaccaccgcccgcaccacggcgtcggtcacgtacctggcgacgagggagctgacgttcaccggctcgggcgtcgtcgtcgacagcgacgcgacgagggcggcggcctcggcctcgcgggcgcggcggaggcagcggacgcggcgggcgccgaggagctccgtgacgcagagcttgcggaggcagcgccagtgctccccctgcggcgcgaacgcgacgccgaggccgtcgcgggtgagcgcgcggagcgtcgctgtctgcggccgcgtggcgaaggcggcgtcgtgggtcctcatcacctccctcgccgcggcgggcgacgacgccacgacgacggggagctcgccgagccggagcagcatgagctcgccgtggcgggtggcaaggtcacgcagcgcgcggtgaggaagcgcgccggcgaggtggtgcaggctgccgatgaccggcagctgccatggccccggaggcgggttctcgccattgttgcgtggcctgagcttgacgaaggcgagagatagtatcagtagagtggccaagaagagatactgctccatgtttctctgtttcagctttgcagtggttgcaaactttgcaatgagaaagcaagctttataattttgcaatgagaaagcaagcttgagaagatgccaaaagaaaaattgaaatcagaatgacgcccaattcaaatgtttttgtatttctaaattcaaatttccagctgattaagggtatcgaccggtaaactcagaactttcagatattttgttcaggaattgagtttttttttcaaacggctaatcagattgacggcgttatattaatagagggaagtttagttatacatccaaacgctaaaagtaaggaaaaaactgtacatgtgtaactgtaacatgcttgcacgtcaatcctccttactcctcgtgacaacaattttcccatgtgttttgcactggccaaaccccagcatcatagctcatcatcttggaaacgaataattatttgatgatttgtagcttccttttctctaaacattctcgcattattcctttctttccccattttccagtcaatgagaaaaaggctgatttaaggcccttttttttccccttcgggtggcttgtctcatgtgtccttcaatccaataaatctctactgctgttccagcttgggatgctctatccaaaaatatgtgaggatgtcaaactagatttgctttgagattgggcattattcgttcaggaatagctagccatgtcacaagctagctggatacacgaccagccatattaaacgagcaggagaatggcgagtgattagtatattactccatatggagacaagtagtcaagccctgcagcaaaggccatgtttacttagggatgcaattattttgaaacctaagccagcttttgctggttttataataagagagggagaaactgtacaaagggatgcaatttcgcttgtgcataaaccttataacatgcagtagatgctttgaacagattattaattgtttacggacgatattgtatttaaacatgcagtacatgctcggaacagattgttaattgtttacggacgatatcgtatttaaagatgagcatgtgaattgcgattggactatagtatatcatgctatagaagattagtattcagatcaagaagcattgtggcagctaaaacaaagggcatacatatattattctgtcattttacacagcattaaacaattctccactacagttgtgccatgcttattccataacaaacaggactctgtgcatggcacgaggttgctagcagaattcagaagataaaaaatgtcctttgttcactcgatttcggttcacatagacgaggtctaagtacagttttcggaagatcaaaatgcgccataatctgattacaataggatctttctcagcttgcagcttcagtatcttgctatcttccaagctcagtatcttcagtgcggtgtagatgacaagttagcagttgtagcagcactatcacctagaagacgtctggattgcaatggccggagataatgccgtgttgcgtcgcttgggcaagatgtaatgacaggacataattcctatgctgcaagataagagatgaacaaccaagattcttgttagaacaagcattagaaataacataaaagaactgaaaattaatgaatgttgtgataaacgcacaaacctgtagcgcctttatctccttttcgtacgtgtcgataatctgcgaccgctcctgcgacattttcttttcataatcattgagccgattgtgctgtttaagaaatgcgcgcttcaggacaccgttctgttcgagaaggcctcctaacatcagcttcagtatcttgtgttcctggaagtatcagtcaagttgatcagtcaagcttccataactttcataactggaagatattgataattcaagacgacattattataactggatggagtagtatttggtacctcgcgcatcttccgcatttcaactggactgatacatgctgcagtggatttctcgaataggtcaagtaacctaaaggctcggttcttggcatcaaccaaatctagagcagaggacatctccttgacaactagctcagcccattcagacccattggatgggatgttcatcgctgacaaatcagattcaactgcaacaaccatcagtaaaagagagtttcagatttccgcaaaattaactaattggtctggaagggtaatcatgaatgaaaggaaaacaaatgttaccatacctttaggagagaccacctcgtttcctgtatcaccggaagccgcctctgtgatctcagtatcagtatgagattgcaaacgatgcttgaatcccctaattgcagcgtccaacacattaccggacgcttcaaaaaagctcttcaggagctacaaattcaaaaagagataaaaaaaatacagtatcagacaaactggcacagagatcaaattagatacaaacacaatgaacaatgatgaatcatattcaacatcaaacacaatgatcaatgctgaatcgtattcaataccaatatgatgtaacatctaaagtctcatcagtaaaatcaggattcttaagtcttaaccctctacttactaattaagtgcctgtgcaagtgcaaacatgaatcccacaaaaataatagatgcgtgctaatttctgcggctgatgattcattcataaatcacaatcctttcatctacatcgtgatcgaatagcgctcctatcctatggtgaagaagcttaaaaaaaacagagcaaccagaaaaaacagaacagaaggtaaacaaagatcgatggatgaatcctgcaatacctgcggatcttcatgggggaagatgagctgcagcacttcgatcgggtcgaactccaaactcaccccgaggtcagccgcggaggcggccgacgacgagcaccggccgcgcttcgccaggtggtgcgacgggagggggaacgggtcgtcgaggatgtctgcgactgagaacccgcgcttccggctgctggcggcagcgaccgtggccgccattggtgcgggcgatcggaggggagagggtgtaccggcggcgaactcctcggatcaaaggcggagagtgattcggatggaccggcgttgcggcctcgcggcccgcgtggcttgcttttataggcgagaaagccaggggaattcgagatcggagagccgagtccgattccgaagcggctcggtaggggcagatccaacttgggacatgggggttcagttgagccccaaacttttcggggggaaaaaacaaactgttacttgtattaaggttaaggctttatttagtacccaaattgttttttcctaaaaacgtcacattaaatctttagacaaatatatagagcattaaatatggataaaataaaaaactaactacacagtttgcatggaaatcacgaggcaaatcttttaagcctaattagtccatgattagccataagtactatagtaacccacataagctaatgacagattaattagacttaataagggtctgctcagattgtagtcaaaataaaccttaccagatggcaatattgtcaaaattttagcaggatttcttatgtattgattaaatttggcaacaaactagacatggatattttttgacaactttattaaaaaatggtatggttgaaaatagcatcaaagtgaacaggccttaaattcgtctcgcggttttcagatgagttataaaattagttttttcattcgtataaaaacatcttccgatattcggtcaaatatccaatgtgacaactaaaaattttattttcgcaaactaaacaaggcctaaggctctgaaattaaaagaagagcctcttccagctctcgaagagaagctagggttaacgaacgaacgcaaacaatatccagacaaaagtagtcacgatgggagagagagagatgaatctgctctgctctgctcgccagatggagatcgccgcccctgtcccttgttctgttcagccggcactcgtcttggcagcgcagggagcggagacaaagagacgggagattttctttcttttacgctgccaaggaagatattctactcggagaatatttaattatttgtcatccttactactggtaattaagaatttgtcattaaacctacgggcctgtttggcacagctccagctccggctccacccctcctgaagttggagctcagccaaacagtttcagctccaccaaaactgggagtggagctgggtggagctctctcacaaaatgaacagacccagacccaactcctggagttaaattgaggagttggagctgtaccaaacaggccctacgtgtcataaactgtgagtgataaatttttaattaccatatcttaaaagtggcaaaaagttaatacgagtactctcacatttatctcaatatttttactactttaaaattagctatttctttataatgactagttgcccacgtatcaaaaattaacaaactcgattagcgatcgtatcgacaacaaactcctcgtaccaccaacaactatcactccacgcatcgccaccaccgctctttctccatgagccaccatcgttgctcatctccgcctttgcatgtgcaatcgcaccctcaagttatcctccatgggtcacccttttttctcgtcccctctcgtcatgcacactatcattatggtcgccattaaggtcggtggtgtcggtcttacagagacacagggagtcaaggaggaggcaggagtcgacccgatgaagagcgaagacactagatttgggctccttcttgctgaatatagcggttccccaattgttggagggaaaaagaaaatggagagagagagagagttagtgtgcggagtggttcctgagtcactgtgatgtgaccatcaagtatatgtaaccaagcataagaaatataaaacattgtcaaagaatgtatcggatgaatagaggatctacaagatattcaagtccaatgagttgtggaatatagttcggtctccggagacaacactaactttaaacagacctagcatcttcatgccaactccgatttgggtgatcttcgacttgatggaaagcttatctcattacctttcaaatgcatccagtctcatatccaaattcattccgagtcaacgggaatcatcaaaacaaggcagtgttgttgctgaaaccgaacttgggctttcagccttgtaatagactaggcccatctcggaagtgtctccgtccacctccacgaattagaacataaccctagatctattttcctctataaatgtctatgcacaccctttagaaaaattgggttttgtttagttgaattttgccaagtgccattcaccttgtctctagtcctcgctcgattagtcggtgactataaatttagagcccccaatagttggtgtgttgatttgccgggtcgattagatctaccacttcaatcgcaactattcctttgtacttaattacctattcgcaatatttagattgcatcttatcttgttcttgtagtgttctctcgtttgcattgtagggatcatcaaccgtgtgccacggttggtacgacatcgtttatggtgtagcgattgcacagcgtcctagacttgttctggttggtagccacatcgcaaacgtcgcactcgatcaaagtgagagttatccccctcatcagaagatcgggccacgagagagagcgtcgtcacaccggacttggatatggatggaatagggtggtccaaattgaaatgtaaagttagctcttttgtaaatgaaaagaatggttaaagatgacatagtatgaaaacttttaagaatacatagtacgaactataatttactttttttctttagcacaattattaaagatgagttgtccattgcccgatactactgtgatatactaagtctttagcataattaaagatgagttgtccgggattacccgagagtcgacttgtgatatactaagtgtggttgggtcggtgtacttagctattactaataatctcatgatatgttgatgcatcaagatatggacttctactaacacgggttaattaattatggttagatagattaagctaaaaaagataaaattaatgccatcaattacgctcaacaataaagcattcgactctggtctccttttctcactacgtgatatacaatgattatatcagtaggcatttccataattctatcatattaaatttttttctacatatacattaatttggactaatatttttctcataattaaatagataataaatcattttttatatttctcctataaaatgtgaatagggcattgtataatgcgaaaattatattatatgcatgtaatttaatgtgtaagatatggactatttaactttttctaaaaattttgcacaatagtagataggtaatgaactgaacaaccataaaaaaatatatagagaatccattgtgtgttactgattttgtccttgttctacaatatgtcactaggtttgccaagttctagtatgccatcgcactatgcttaacttctataacataccatcgtcgtctagcttccgttagaattgtacaattttgacataatgaccgaaatacccctaggacgaaaaattacaaatatcagattgtaacaaagtttgagatgcgcaattctctgccttgtttataatgacatttcggattttttgccaaattttagaatttccgtcccatggatatttcggtcattatgacaaaattataccgaactaacggagtctaaatggacggcgacggtatattatagaggataagcaaagtacaatggcatattgtataacttgacaaactcagtggcatattatagaacagggacaaagtcaacggcacacaatggattctctctaaaaaacaatctagtcaaattgtttgtttatctcattcaaaacaaaacattttttttatcaaacacgttaggagaacttcaaaagaaggtaagaaaaagaggaggttagtcactagctcaaacacacgtggggaaaagttactcacatccatggtatggtatatgctcacattaatcgataatatactaatattattaaaattgttcttcgtcgtaatacggtgtgaaactaaaactttaaccttatattcttatgttgttccatcttcttcttgttttctcattcttattcttttataataatattgccacaaccaacactattatttgcacatgaatattagtagctaactcatgtgtgtgcgctccgtaatatatattattgttgacgcgaaaaacacgcactggcctgagagatctgcttaactctagtgcaggtccaaagcgattaccttcgggttctgagtgtgccagttggtttgatcctgcaaccaacaagaaataaaaagggacaaagttaaatccgtcaacgatagccgatcggctggattgacaatgacatatcgtttggagccaagtcgatgtaacttgcatcagatcggcaagggaagataaagcgtagagattattagatctactcgatcggttgaagatgtcaacgatacacagtctatctaatgaaatacatttaaaccaagtgattggaatagatcggacgatgtgccgagataatataaatcacttaatatctaaatgtgcctcaaagtaaagattgtgtatgctcgcagcatagccgatacagcaaacctagcatgtatcggctagtactccagtacgactctatactaagataacagggtaaatgaaatatataaaacgcagatcaatctagcaagtaagatggactggcagactgataaagagcaagatatgcttcaaataaacgagatcttaatataaagggcagatttagaagatcgagaaccataaaaggcacaagacaactaaaccagataagatcagctgaaaccccgatgctatctctattagaaatcataggaaaagctagataaaacgattcaagacatcacttaacagatcgaacctaaccgatgcagcattatgcgtgaaaagaaacataaaatctaaacaaatcgatgaagactcattcaagatggtagatacgctgtataatctagctcaataccgatatctaaatctatcggttcttttcgatgatagaggctggccgatgaagttagatgacgggatcgatctaggctatacagcatatatgataacttggcgatttacatagacaggattagagtgttatagagatgtaagcactaatcccgataatgcaaaccgccataacaagctttacctcttcgtcggagatcgaacttgatgcagcccaactcgaaagcaaagaactcgtcgaaacaatagaaaaaaggtggcgatgcgccgaagtattattgaactgtcgtcccatgattacaaggtgtcgggtcatatttatacccgaggtacataacatgtccttgctggacacgactcttatctctattacaatttaaaatatgaacaagtcccttaggcggactcttaccaaaaatatctctaaagaaaagcgtcatcggcttgtcttcatcggatttagcgtcagccgatacatacgacaggcgatgccgcctgtagccgattcatacggcagccgatgatgctcatagccgatacgcactctcccttccttaaacagaattcctccaaatctggctttgactctagctttgaacccagcccatggccttaccaaatttggtcgttaacaattatctatgtttttacatgtgtaaacaataattattatctttattaatattattatatttatataagggacctgactagttttttaataagtggaaagatatttttattaaacataatctagaatgctataaagatttataatattgaacaatatataattatataaaaaattttatggatgaattagagattgacacttgttataaatccaattattataatgttatatatatatttactagttacatgtcaatgcattacaatgcgatctagagataaaaataagatttagtttatttctagtctaatttttatgatatattgggttttttatatttctttagagaaaatattgtacaacaattacataatttattgttttataagtagattagtttatcataccccatttataaaatcctacgtccgccactgcggctcggaatccgaagaggcatcgcgaaatcgtgacgtgattgtgtttacatcaagtgtaaaactttggcatgtcacatcgaatatacggagacatatttaaaatattaaacgtagtctaataacaaaataaattacagaatccacctgtaaaccacgagatgaatttattaagcctaattaatccatcatgaatttattaagcctaactaatatgtcattagcaaatgtttactgtagcaccacattgtcagatcatagcgcaattaggcttacaagattcgtctcataatttacacgtaatatgtgtaattagttatttttttcgtttatatttaatactacatgtatatgtccaaacattcgatgtgttggtgtgtaaaatttataagtattatacacattaattataagtattatacacggacaaaaatcccaagcatccaatcttacataaacacttaacataatcagttttccattgttttacttcacaaggaaacataatcgaatccgttgaataacacaatgcaaacacaaggttgacgctacaaaaattataaaggtggaagcggaaacacataaacaagtaccaaatctataaaaaaaactaatctttcaccttaatttgcagcacctcacgatgtggcaaatccggttgtgatctaatcagccgcggaggcggccgacgacgagctccggccgcgcttcgccaggtggcgcaacggtaggggcacgggtcgtcaaggatgtccatgaacccacgcttccggctgctggcggcagcgaccgtggctgccattgataccggcgatcggaggggaaaggtctaccggtctagggtttcggcgagcctcgcggcgaactcctcggatcaaagcagcggaggcagagagtgatttggatggggttgccgcgttgaggcctcacggatggcttggttttataggcgaaaaagccttgggaactcgagaagaagcagaactcgagatcggagagcgtgcgagtccgattccgaagcgcaggccgctagaatccgaagaggcattgccaaatcaacgtggttgtgtttacgacatgggtgtaaagcttcggcgtatcacatcgaatatacggacatatatttaaaatattaaacatagtctaataacaaaacaaatgacataatccgcttataaaccacgagacaaatttattaagcctaatgaatccatcattagcatatgtttattaagcctaattaattcgtcattagtaaatatttactgtagcaccacattatcaaatcatggcgcaattaggcttaaaagattcgtctcgcaatttacatgtaatctgtgtaattagttttttttgtttatatttaatactccatacatgtgtccaaacattcgatgtgatggggtgtaaaattttgccagggaatctaaacaggcctgtagtaatttttctgtcacatccacttttcgtccgtccgatctaggctgtgtaaagttttggcgtgtcacatctgatgtatggacacacatttaaagtattaaatgtagactaataacaaaacaaattacagaatccgcatgtaaaccgcgagacgaatttattaagcctaattaatccgtcattagcaaatgtttactgtagcaccacattgtcagatcatggagcaattaggcgtaaaagattcgtctcgcaatttacatgcaatatgcctaattagttattttttcgtttatatttaatacttcatgcatgtatccaaatattcgatgtgacagggcgaaaatttttaccaggagatccaaacaggaccctggtgatagccttcgttatgtacgaattacaagacacaaaattaaagtatcaatctaaatccattcaaacaatcattaattataattattatacacggacaaaaatcccaagcatccaatcttacataaacacttaccataattagttttccattgttttgttttaaaaaaaaaaacataatcgaatccgttgaataacacaatgcaaacacaaggttgatgctacaaaaattataaaggtgcaagccaaaacacataaataaataccaaatccataaaaaaaactaatctttcaccttaatttgcaacacctcacgatgtggcaaatccggttgtgatcgaatcagcccaaagatcttcataatagccatggagagccaatcgggtaagcactaaaggttccaaaaaaaaaagtcacaaattttcaaaggacgagcatccaatctggctgccgaggcaaagaacaaatttccgttcgtccgtctgtttccatgtcccgagcaagttgtgtgaaccgtgtgcatagttcgttgtgtccaactcggttccatcaatgaaaaaaaattgatgagccaaaaaaaagactcagatcaaaatcaaagatcgatgagatcaataaaatcatcgccaatactaacagaatgttgagattgcggcgatgccgctgttgcttgtcggaggtcgaggccactgctcgtcggggtcgctgctgccgccgggcctaagtccgtggccatcgccgctccgctgctcgttgcacatcgacgtcgaaaacgccaccgctcccgctgctccaatgcctcgtcgacgtcgaagacgccgcacccgctgctcgccgacgacgacgccactcctgctgcttgccaatgacactgccgctcccactggtcgtccatgccgaggccatcacacctgctattcaccaaggacatcgtcgctctcgttttgaggacgatccgatgaggcctgcatgaaggagagatgagagaaggagaaacgatggaagagatgtggatagtaggagatggattcggatcctgtgacgtgcaagagcaacgtcagaggcgtgcagttcctcgcagggttttaaatctcccgctatagctgccgctatctcccgctatagttgtttgaaaagggttctaactattcgctctcatgtacaatttaacagctatagctccatttagcccgctatagctgtttaagaagctaaccgctaaatggcttagcccgctatttaaaacattggttcctgcacatccaccgtccaatctcatctagcggctcacaatcgttcccccaataatcttcttcctcctctgtccactgaagcgtgttacactgcctccgccatggctcttgacctctccatccaacatgccacagacagcagcggcatagagaagggggagaacggcgaggagcgtggttgttgtgtcgctcccatatgcgggtctcatacatggtttatgcagcccagtgcagaaagttctcccagcagaacgagtatgcgtgtcgttgagtttcattgtagtgatgttcaagtactacggtccatctgaaatcaacaacataggaagaaaaatatatgatgatcgactgagaatgaagggagaataatatgttttttaccttcaatttagcaaaaattcgccccccctaccctcccaaccgatttgtgcacagtaaactggtcgagatggaaagcagttggcagtttggggagtatttataggcccaacacacctcaaacgggttaggtacacaaagcccgtgaaaggtgttgttcatacctcaaacgggcttaaattgagttgcccgtcacaagtatcgacctacctgtgactggccagaaaacaaatccgtcacaggtggcggcccatcacctgtgacggcttataattacgcggcccgtcacaggtgaggtgataccagtgatgggttggagggaaaacccgtcactgcctcacctatgacagctttgtcttttggcccatcacagataaggtgatacctgtgacagaccgcagccagatgcctcaccgatgacgacatcccgtatgacccgtcaaaggtgacggtcaacacctaggaattgagtggaatcataatttggagttctttcagatgattgctctagcaagactcaagtttgctcaaaggggcttcctggaggttttctttttggcagcctggcacatttagaagaagaggaatggtttaatctttaagagcattcagccctccttccaagcctagagatctctttttgtgaaagaagttcttttgcatatgtgcagaatgaaggatcccttaaagcaaattgtttttaattggttacaagctttatagttttattcagtttcttcttctgtaactttgtaaatatttttcgagttttataaaattacactgctgggcaaagtcctggcagtaattccggtcaaaaaaaaagtgacggtcatcagtgaccaaatcgtttgctcgtcatagatatcccgtcagaggtgtgaggatctggcgtagtcaggggcggatccagcatgggggcggtggggtctcgagcccccactactggcgtgaagactatgagagcccccacaaagatcacactaaaaatttttaccatatgtagataggagagggactataactctatctagtttacttagaccccactgctatttctttctggatccgccactgaggcgtagtgagtgaaacacctgaagctgggacaagacaatattgctttcttcaaagcatatgcctctaaaaattttagaaaatcaagaataagatcgatcaagcataatggggtagaggtagctgaccataatggaaaattccaacttatgtactcctattacaatcaacttctgggccagccttcttgggaatttgatctacaacaactatatacagacgaagaaagtgattcgaaccttctagctggacaaggactgcagatcactcaagaagagatcctaacctcaattaaaggtatgaattcaactagtgcgccaggaccagatggatttggacctagtttctaccgtgctgcttggagctggatcaaagaggatgtaatgaggttggctaggatctttacaactttggggctaaccttgagaggattatagagccttcattgttctaacacgaaagccgggaaaagaaaacactgtcgattgctacagacctatctccctgcaaaatttctcactaaagtttatctccaaagttcttgcgactaggctccaaaaagctctaatgaagatgattcacttggaccaaactggtttcctccatggaagatgcatctcggaaaatctaatctatacgactgaattgattcaagcttgctataaaaggaagtgcccaactgtaattataaagcttgattttgcaaaggcatttgacttggtcaagtctcttccaaatacttgctgtcacaggattcccagaaatctggattcaatggattcagagtttactctgctcctcaaaatcttgtcttgatcaatggagtgcctgggagatggatctcatgtaaaaaggggctccggtaaggagatcctttgtcgccatacctgttttttggttgccgatgtgctacaaagaatgctcgagcataaccaggcaatcagacacgccgtctaccaggatcgcccttgcgccactatacggtacacggatgatacttaatcatctgtgtaccgagtggaagaggaggatgtacaagcacttgttggatattttgtaatcttgagcattttatatttctgttttgcatgaacgtagtggctggctgaaggttgttttggccggtcggtagaatagctgtttccttctgcatgttgtcagttttgtttagctgccgaatgacctggtttcagatcgtgggatggcgcggtcagtagccgatccgggttgctcgttccgttcagttgtgcatgtaacaaactccgttttggtggaggagaatatagagtgaaaacagaaaagcagcagaggttgcgctgcacaaaaattctactttgttcttcagttcttgacgtttcccgaacttcttgaggttactatcgttgtccggcaattttcagagtgagcgagtgtgagcgatttcagagtttgctctttccgttttgctgacaattggtatcagagcggtaccacgacggtcctgagacgatgtctgatgatggcgggcgatacacaccgcccggacgccgtggtggcggtggcggcggcggaagcggcagcgggcgcggaggcgcaagtggcagcggcgcgggggatggcgcagacggcgcgaaccttcctctcgtgccacaggggagagatgctgggcacactgctcgcctcccggtgctgtcgaggaccaattatccggattgggcattgttgatgcgtgtaaacctacaggcgcaggggttgtggacggcgattgaacccggatacgcggagtaccgcgacgatcgggcggctctctcggcaatccttcaggcggtgccgcgcgagatgttgcgcgggctggcgaagcatgacacggcgaaggcggcgtgggacgccatcaagacaatgcgggtcggcgtcgaccgtgtgcgtgaggcgaaggagtagggcttccgtcgccaattcgaggcgatgcgcttcaaggatggagagacaccggaggagttcgcgatgcgactcactgccgtcgtcgcggacattcgcgacatgggtggagtcatggaagacgaacacatcaacaagaaactgctgcgcgttgtgcccaagaagtacaagccggtggcgatttccctcgagcagcttctcgacgtgaaaacgatggcccttgaggagctcgttgggcggctgtcgatggtcaactcatacagtgatgatgaggaggaaggtggcggcgacaagctctacctcacggaggaacagtggcaggcacgcgcaaggaaacaggagcaggaaggctccggcggcagcagcaagagcaggggcagctctggcacccagaacaaccgtcggggcaaggccggtgggtcaccgaaggggaaggagacgatcaacagtgggaacaccagccgtgactactccaaggtaaaatgtttcaattgtgatgagtttgggcattttgcaaggcagtgccgcaagccgcggcgccaacgtcgaggggaagtaaacctgacgcagggggaggaggagccgaccttgctcatggctcacgtcatgggggtgtctctcgccggtgaggagacactcgggcgaacacctggtgtgcatgaggtgcatctcactgagaaaaaggtgattctggatcatgaggttgcagaagaggaggaggccggcttgacgcgcgtgactacgatgctcacatataccatggtgtctgcacgctgcgtgatcctgatggtctactgcttgccaaggtaaagcgctccccaagcttcctgtacattctgaagttgaacatggcgaggcccatctgtttggcggcgaatggcaccgagacggcgtggcgttggcacgcccgtttcggccacctcaatttccaggccctccggagattggcgcaagcggagatggtccgtggactccccgtgattgaccacgtcgatcaactgtgtgatgggtgcctcgccggcaagcagcgacgagtgccgttcccagacaaagccaggttcagggcgcaggatgcgctcgagttggttcatggcgacctgtgcgggccgattgcgccggcaacgccaggcggcaggaaatatttcctgctccttgttgatgacatgagccgtttcatgtggatacggctcctctccggcaagcacgaggcagcggctgcgatcaagcagttcaaggccggcgtcgagatggaaagcggccgaaaactgcgggcgctgcgcaccgaccggggaggagaatttacctctgtcgagttcactgagttctgtgccgatcggggtgtgagtcgccagctcacggctccatactcgccgcaacaaaatggggtcgtcaagaggcgaaacctgactatcgtcgctgctgctcgctctatgctcaaggcggcggggatgccggcacatttctggggagaggcagtcgtggcggctgtgtatctattgaatcggtcgcccacaaagagcctggatggtgtgacgccatatgaagcgtggcacgggcgacgtccctcggtcgaacacctgaaggtgtttggctgtgtcggctacgtcaagacagtgaagccaaatttgaggaaacttgatgatcgtggcacacgaatggtgttcattggttatgagcagggctcaaaagcctatcggatgtatgatccggtgtcacggcgagtttatgtgtcacgcgacgtcgtctttgatgaggcggcaatgtggccatggcgtgatccggaggtcactcaaactggaggcgaggaggatttcactgtggagtttttttccactccgctaggtggaaatcgtgttcctgacgtggttgtggaacatggaggcgcacgggaaactgaaaccgcaccaagtccgctggccacgcccgacgcggcgcccgtgtggtctccagtgacatcaagctcacctgccggtgttgagttctgtacaccaccatctgatgccagtattgaaagcgatggagctcctccccgttttcggacggtgaacaatgtgctggccaccacaactccggtgctcgatttcgactacgacgacgagtgtctcatagcggagcaggagcctttcagtttcaaggaagctgagaaggagcagtgctggatgaaggcgatggaagaggagatgagctccattgaaggtaacaatacttggttcctctgtgacttaccatctgaccatagggcaattggtctcaaatgggtttacaagatcaagagaagtgccgaaggtgagatattgaagtacaaagcaagattggtggcaaaggggtatgttcagcaacaaggcatagattatgaagaagtatttgctccagtagcaaggatggaaactgtgaggttgctggttgctttggcagcacatgagggttggcaaatacatcacatggatgtgaagtcagctttcctcaatggtgaattggaggaagaggtgtatgtagtccaaccacctggttttgttgttgagcacaaggagaacaaagtactgaagttaaaaaaggccctatatggtttaaagcaggcgccaagagcttggtatgcaaagctggattctacacttgcaaatctggattttgtaagaagtgcaacagagaatgcagtgtacactagaggggaaggtaatgccagactcatggtgggggtatatgttgatgatcttatcattacaggagctttggggacagaaatagcaaaattcaaggagcagatgagaagtatgtttagtatgagtgatcttggattactgtcctattacctgggaatggaggttaaacagactgaagaaggcattacaatgtcccaagctgggtatgcaggaagaattttagagaaggctgggatgcaaggttgcaatccttgtcaggttcctatggatgctagactgaagctgaaaaaaggagtagaagattgcattgatgcaacacagtttagaagcattataggaagcctgaggtatttggttaatacaaggcctgatctatcctactctgttggatatgttagtagatacatggagaatccaggtgctgaacattgggctgccatgaaacatattttgcgctatgtggcaggaagtctgaatattggtctcaagttcagaaagggagaagagaaatttcctcggctagttggctatagtgatagtgatatggctggggatgtggatgatagaaagagtacaacaggggtgttgtttaagctgggagaaaacttaatcacatggcagtctcagaagcaaaaaatagttgcattatcatcttgtgaagctgagtatattgctgctacaactgctgcctgtcaggggatttggttagcacgtttgctgggagaactgcaaatgaagaagccctgttgtgccatgttaaaagttgacaacaaatctgcaatcaatctctgcaagaatcctgtacttcatgatagaagcaaacacattgatacaagatatcatttcatccgtgagagggttgaaagaaaggaggtcgaagtggagtacacaagttcagcagaacaacttgcagacatactgacaaagcctcttggcaaggtccgatttctggagctgaggggaaagctgggtttgtctccagtgtgatgcgtcaagattagggggagaaattgttggatattttgtaatcttgagcattttatatttctgttttgcatgaacgtagtggctggctgaaggttgttttggccggtcggtagaatagctatttccttctgcatgttgtcagttttgtttagctgccgaatgacctggtttcagatcgtgggatggcgcggtcagtagccgatccgggttgctcgttccgttcagttgtgcatgtaacaaactccgttttggtggaggagaatatagagtgaaaacagaaaagcagcagaggttgcgctgcacaaaaattctactttgttcttcagttcttgacgtttcccgaacttcttgaggttactatcgttgtccggcaattttcagagtgagcgagtgtgagcgatttcagagtttgctctttccgttttgctgacagcacttaggccttgtttagttcccaaaaattttctaaaaacatcacatcgaatctttgaaaacatgcatggagcattaaatatagataaaataactaattgcacggctatgatggaaatcgtgagacgaatcttttgagtctaattattccatgattagtcataagtgctacagtaacccacgtgtgctaatgacggattaattaggctcaaaagattcgtcccacggtttccaggcgagttatgaaattagtttttttattcgtgcccgaaaacctcttccgacatccggtcaaacatccgatgtgacacccagaaattttcttttcgcaaactaaacaaggccttaaggatacccttctaaagttctctaatgccactgggttaaaagcacagtgattaccctgaatgtcgatcagaacaaggagttgatcttgtcaggactgctacagtgcaaactggaaaaactgtcgatagcctatctcgggcttcctctttatgtccataagctatcttcagctgacctgcaacctctggtttccaagttagatggtttcttatctggatgggaagcctctcttttgtcgcaggcagaacatctagtactgataaacgcgattcttagcagtctcccagtctacgcgatgtctgcattcagattacccccagaaaccatagaggaaattgacaaacgaagatgggcttttctctagactggagacgatgtctgctcgggagcacaatgcctggttgcctaggattcagtatgcaagccaaaggcacagggagggctcgaaatcaaaaacctaaaaattcagaatgaagcgctccttcttaaacgcctattcagtatgtacaactagggatgaaaacggagcggatacggacggataatgctcatactatattcgttttcatatttttttgccggatacggaaacgaatacggactatctcgaatacgaataagaaccgaatatgatcggacacgaatacggaaacaaatttttctcggaacacgaaaaccaattcaacttctaatagaaacaaatatcaacatatataattagctcattttatataaaatgtagtataatttataaatacgatccgaaaggtatccgtatccgatccgaaaggtatccatattcatttttatccggagcggacggaaactatccgctccgttttcatccctatgtacaactcaaagatctcatggacaaaatggatctggaaagaacactcagggcctgtttggggagctttagattctgagaagcagctgtttggtagccaacttctaagaatctggaaaagctctgaaacccagctctccagcttctggcttcttagttcatttttcagaatatgtaactacagattctcagaagctgtggactgtttggggcagcttttgggaaaagctgcagctgggacaagctcccccaaatagggcctgagatactccgcttctaacatcttttcgacttgggcctcactggacctcaatgtagaaactgctgcctgatctacaagccctaactgaagtcgacgttggagatgggttgcgaacttccttcttgcatgatcgatggataaccaacgagactttagcgatttaattcgggcccctttacacccatgcaactagtcgtcaagtttcggtcaaagatgcctttcaacgaggaataacagaagattttgttccaagactatctgaaaacagctagagcggaaatgcagtgtctgcaagttttgctacagatcgaacttctccctgcgagatgagccggacattcgacgaagtggaaaattgggcaagctaacgacgaagaaaatatactatgatgcaaggttatcccctggcatatcgtcaccaaactggggtttaatctagcagtgcagagcgccgttgaaagtaaagatgttcgcttggggatcgcctttccacaaaaggaaacctgctgaagaaaaagatagtgcaaacgtcgattttgcacagggggaagattagagtacaaccgcaaattcaagatgtgcagctcctccaccaactgaaaccagctcacacagtgccagcgcttcactatcaagtaatccctatattctaaattaatctacatatatttcataggtacatcaagaccaagaaaaactaataactctctcatactatatttactctagcaacaaactcaatgcatgcaccatccccactattttctagccaatagcaaatcaagatattgcatatgggttataaatatttgtgtgcatagatgcatacatcaatgtccatttactccaatgcacaaataacgaatagacttaatgaatgaacataaatatgtagatcatttagaaataacctcaaaaaaaactatatgtagatcaatttggaatggagggagtattttatctgctctgtatgtgggcgatctggaatcatcgtcatgatgtcattttcaagaaataaaccccctcgattggatcctgcctgcaacgttgcatccgcgaggcagctctctgggcagagaatcttaagattgaagaccgacatgtagtctccgtttggaaagaaattttctcctccccactacaaactctaaatatgttgtaatgaacttttcatcctctatgcaatgacaaaattcaggtggggaagctctcccccctggtgatttagtctaaacaagtttgatggtaaattcaacggtgtaataacacgacaattttgatctcctatcgcagaggcagtaggcaatttcccaccaacaacacaacacatgacatcttcagagattattattcatttcccaccaacaacacatgacatcttcagagattattattctggacagaccgtcttgcggcaaaagttagaagacgtcaggattgaagtgcccggggatggagttgttctgctgagcctgcttcagatgcatcgtcagcgcatagttgtttatctgcagcattttttaccccagtagattcttcatcagtatgtatgttaggcagaaaaagaaagaaacttgcaaaaggagataggattgtggttgccacctctagggtcctcagttgctcctggtactgcacaacaagttgcttcaaactctgaacctcctggctcctctcgtcgaactccttttggcgctcatgttgaatggcgaccgctcgcttgaggacagcgttctctcgcagcacgacggtcaattgctccttaagcatcatattttcctgtacagaaagaaaaatatgaaagtattcaatgttattgttactcctaaatcatgcattgatgcatgttttctacatgccgaattgctgaccaaacactacgatgttttttacaccctagagaagatagacacacgtgtaccttttgcaagttttgtgctgcatcagctcctgtacgctccacgattgacttctccaaaacttctaaagctcttgaggcgcgagcacgcgcatcgcccatgtcagatgcatttgtcatctctctgacaaatagctcaacccattcagaaccattattacctgtctggcaactatctgcagcagctgggtgttcattagctgtactcacaccaccattattaacaatacctgccaagatatgcaaaatagttgctgttgtcatatatacagtatgctacatttgcacaagggagtgagatgcaaccgattcatgtgttgtgagaggaaacgatagtttagaattggcttgggttttcctttctctttccttgtaatcgttctgtaaatattttattcttttaataatatagtttaacattgctggacaaagcctggcagtattttggtagaaaaaatacaaagaacttgggtagtatatagccagaaaatgcaacgcgagaacttgacagcttggggacacactgagaaggaatacacaactattctaaatatggtgaatacaaaagaatggaagatagaagatatgtggatgcagtcatcagaatttatgtctagttaatcatgcacactccatataacataattgactgaatcgtgtgcagtgtctttaattgaacagcgcattacgttgcagaatataaacataagacagacatcaaagaaactgttgcagaatataaacataagaacagacatcaaagaaaccagcaaggctagagatctctgaataatattgatagacaatttgaaagagtatatcatgacccacatggatcattatgatagattggtactgcggtgtctaaaatttaagtgtgacaaaagcaagaagtactagtgcatgagaattatatgcacagatcctagaaataaaaagcttttggttaaaagctgaaccttcaacagacggataaactgctgtggggagcccattttcagatttgcaaccagtagctgataagatagcctctgtagactccaagcgcagattgtttaaactctttattgctgaatccaaatcatctccagaagcatcaagagctccttcgagcaactaaaatgaattttcagaaaccatgatcagttagttatatggcatagagataatactgtgcacaaatacctggcattactacaaaggataaacattacgcagaactaacaaaggatacacgcatgaatttgcccatgcaacaatcatttgatatagtgtagaagaatataaacacagctgttcagtgctcatcaaccttgcctagtctctgcaggcaggaaaccacaactttctcgaatgagagagtgtagctttgcaaaactccaagaaacattacatgtagagatgtaatctctaaggtgtactcatagtcatcggcatagtggtgcccatcatccagtactggaaatgataagcatgtataaattgtgccatcaattgatttgatgatacctataggtggaactggtatgttttccttatctaaaaggatctgaacactaaatccataggtaaagggtggtaaacaaacacatacaggaaagcagtagattcaatgctatcaaagaaaacaccaatgcaaaaagcatctcccaaagcctccaagttcgctcctttttcctccccagaccgcagggcagcacaagcgtcacaagatcatccaaccaaaacgccacaagagccctaattctgattggcatgcccttcgtccttacacctccacaaaggaagtgaaaatgcccactttctgatgaaaaggatccagcttgcagcaatccatacaccagaacaacaagttcgacccccacaaaacaacccgtgaagaccaaatgggatcacaaatctaagccataaagaacacgcattttttttcctcatcttagcccgcccaaattagtcaccggtgatcacacgcagaccaggaaaatttacccatgaatcatcgtcgccacaccttaacatgcacgcacccacct

SEQ ID NO: 81738 - DNA, 2824 bp, Oryza sativa
ggatctgcccactcaaggagttcccttctagagaaatcacctgaagattgtgcagatgcagcaacaactctggaggtatctgaccggagagttggttgctgcctaattcaagaacctcgagccttgctaggtttcccaggtcaggaggaatcctaccagagaggctgttttcacctagacagagatgtctaagacggcgtagcttgccaagatcagctgggatggaggccgtgaggttggtgtcggtgagcctgaggaaggagagaaacgagaggttaccgaggagaggagtgatgggtccatggaggggcgtgtgtggcagcgacagtccagtgacacgacgatgtcggcggcggcggctgcaggtgacaccaagccagtggcagaaagaggtgctggtgctccagttgcttgtcagaacgccgagggggtcggtaagctgggacttgaaagccagcagggcggcgagatcggtgtcgctgctgccattggcggtggtcgtcggacttggagaagaatagcatgaggtggacgatagcactactactagtacagcaatggaaacgcatgctgatgatgtagtagccatttgagctctgctcgatcgtgtggctgtacatgttctcgtgcaagcagatactacaccagaaaaaatagtgctcatcaatttatatggggaacgagctagcgcatgtggttgtgcacacaattttttctgtttatttcaacatgtggaccgtacttgcccggcaggctgcagtagccgcatggcaagggatagccaattttaatgctagagcctagagctatcagttaatcctagacctgagtgccactgaaaaagaaaatgagaaaaacaatgcccacaactaggggtgaaaacgggaaacggacggaaatcatctttatcgctttcgttttcatatatatttttttaatcagaatcggaaaccccagatacgaaaacggaatcgaatattatcgaaatcgaaaacggagcgaaaacgaaccggcgcgaatatggtaacgaaaatttatcggaataaaaaaacccctcaaactgataaatccaattctcaagtctcaacggtcaataattcaacataaaacataatcatataagtcaaattgttaagtattaatagtacatcacaaaacacaatatatgaagcaaattagtaatgctgttgataaatcccaatgcaggtaaaaaaatattcttatataattttagatttgcataacaaatattttttaaaaaaataatagccaaatatcatggtattcactattcagtgcttaaaaaaataattcaggatattttgtgattctggaaattccgagaaaatttctggaaagttttcgacagattccgagttccgacgaaaactacccttatcattttcgattctgtttccgaggaaatatttacgaatccgtttccgtttctaaaaaattccgatcgacagattcgttttcgaaaataggtccggaatccggaaagtttatgtaccgttttcacccgtggcccacaacgagaccaaaattgagggtgttgacgctgattcaggtcacatttttactatcaacggagggcatgcatttacaacacgaattgatataaaccatctacaagagatgccaactactccctccggtttcattttaattgacactttggacaatgacacgctctacaagatatacctttgaccttatttttctattataatatatacaataaataaatgcatgtttacttttattatagtgttttgaaagacaaatctatatatgtttttctagtttctttaaactaaatatttttaaagttattgatggtctatatttaaagttattgatggtcaaagctataaaagtttaacctcaactttgtccaaaacgtcaattaatatagaaccagagggagtagacaatttgatgatatgtgggtgtgtttagatccaaactttggatccaaagtttgcaaaattccatcacatcaacctgtcatacacacacaacttttcagtcacatcatctccaatttcaaccaaaatccaaactttggatggaactaaacgcagccatactaggaggttctgatgcttcttcatcaccggctgcttccatgttagttgttgacttgttgtggacctattaaccttacagggtcccctccttcatatgcataaccatatgatcacaccagcggtgcaagctggaatgttcattcttgcaggaagccaggaaccctggaggccaactccagagttgatgtaggagtactattgattactggcatgctgccctatagccaccgtcacaggtaaatgcgcacggataaatggcacagaacgtacccagctgtacagggaagtaatcaataatgttgacaacgaggtgctctccaatgccctgttggaccgaacttccaagaaattctaagaaccaaccgtatcagtccaaccactgagagtaagtataatactgagctataaacctactatagcttaggtggaggagagagatagtaaataagagctagcttatcacaaactccaaaacaaatacattaaatatataagtgagagataaagagaatagaagaaaattataaccaactttatggctaatctattatatatgttgattttagataagctaatagtaggaattgagctatactattattcttgctctggcatggaaacttgattgagttcagtcgcctcatccatggtccaaccattcaggaggttctacgcatgcgacgcctcttctataaatagagcagaggtcgcacagctgtcttcgcagacaa

SEQ ID NO: 81739 - DNA, 3315 bp, Oryza sativa
ccatctccaaaataacatagggacccacatgtcagcctctgctagccccttcttcttccttctatttcttcctctcttcctcttctcttttcctgttagggcagtggacgagccggcgacgggaggcggtagcaaggaagcgggacggcgtagcggcagctgccggcggtaggaatgacccaacagaaggcagtggcgccaaggacggcgtcgatagggaagacggcggacacggagcggtgaatcaacgcaggtggcagacgtgggacggcgagcgacgatggtaggagagaggctggcggcgccgaacgcaaggccaaatccgcacaggggcggaagcaccgaaggcctctagacgacagcggctagcgacgacgacctcggcgaagacggtagcggatggcaacctcgatagcagcaacggatggagacggctcagacgacggctggtgacagcggtgtcaggcgatggcgacctcggtagcagcattggatggcgatggcgacctcgacgatgaaggtagtggtggcgctcatgtatttgggtttggcaacctggtttggccagccggatgacttggccatccggttggcaaggctactggagggcattttttctatcaaactagccaaattttagcttggatagtccattggagagtctgttagagatgctctaagtggtgatctgcatatgatgcaggaataagttcactttactttcctcaacttaaagtccggtttgaatttcatacttcatccacaattccagatataatatgttgctcaacttacaataccaatatatactttatgtcccaagacaatatactctcaggttttggctgacatggcggatgagtcaacgtgggacccacatgtcaatggctcaaacattttcccctctctccctctcttcccatctctctccaggcctccatgctccacggatatgttgcgtttgagataatatggacttctcttgaaaattgtattaattaagtataatctgtctggttatacctggtgtaataatttacacaaattacaatattgctatttgtatttttaagattgaatcgcacaaacttgcatcacggtagatcctattgagtttcttttatgagtttttttatagtccatcagatttttggtacctcccggtacctgcaatcagagccatccatcgagccagatccaacggattaaaatcctcgttactgcgcggtacccaagtcccctcgatggtacctcctcctccgcccgtagagaaaattgtgattttgctatcgcaaaagaatggtttcgctggaatactatcccttcaaagtgattcattaaaatgctatcctaaactaggggtgttcactgaaatgctattttggatctttttgttagtactaatgtttttactctcttttattttttctccggaccaaaatgccctcgcctctatgtcctcctttcgcccaggataatggcaggttgacacatgctttgattgctctagcaaaatatattgctatatatttgtgaaacctatgcacgcctcatgctccgccgcgtgatatgtatatactaattgatcattaacactaatacaaagctccagtacactggtttgaaagtcaaacaacacctctttggttttgacacatgttgtgctagagcaatatattttgctttcacatttgtacaataaaaatggtgtgtagtccagttcagccacaagcgcgcatacacatcaagatataatggagaagctagcttaacccataaattttgggcatgaaaaaattgtaaaaacaaaataaaacaaatttggacagcatgtagacataatattgaatagcatgtggttcacaaaatacctcacataacaatggttcacaacataacagtggtcacaatataacagtggttcacatgcaccatggttcacaacatgatagtggttcacatgcaccatggttcacaaaagacctcaaatatcagtgcctcacatgcaccaccaacaaaggtggttcacatacaccaacatggttcacatacaccaccatggttcacaaaatacctcttataacagtgcctcacatgcacagcacacaatcaagtaggcttcattttcttgggtgtgagcttctttgtacatgtcctctttgatggagccggctgtgagcttgattcagcaatattcaacctccttttacatgtcacttgtgaagcaagtgccggttgtgagcttgtccctccttgttccattaacattgcaagccggctacaaggaaattgttgttgttaagcaaaaatacatctaggttaatgtaattgtagttggttgtactaactgtcttgtcacaactgttgggctttcttgaataatggtttctacagtaggcctagttggggtatgtggtataggagcaggagcagcatgagcagcaggagcatcaggagcatcaggagtaggggcataaaccacatcaggaccattaggagcaggggcataaaccacatctatctaaccccttacttccagcaaatcaatcgtgcaatcatgtcactgaaaaaaaaatagagaagtgcatacctcccaacaatctgtagccaggtggagtcatccatggagtcaaaccctaaccacacgttgagggagtggagggcgggaagagctgaccgaggggcagcggctgatgggggtggcggcggtggcggcggatgggggtggcggtggcggcggaggcggatgggggcgggggaggcggataggggcggcggcgctgactgggggaggacgaggtgagggagtggcaggggcgggggccggcgccggcgccggagatgaagccgatgcggaggcacgctgctgtcgcctctgccgatgccgctcccagcttctccatcagtcaacaccggtgctggacggctggagagatcgattcgaactggtgataaggacacaagggtattttggtcagaacaaaacttaaaatagagtaaaatcatttctagcaaacaaaaagatccaaaatagcatttcagtgaacaccccttagtttaggatagcattttaatgaatcactttgaagggatagtattccagcgaaaccattcttttgcgatagcaaaatcacaattttctcccgcccgcacgccctaaacaagtggaggggtaaaactgggttttcgcatggtccgttctcgctgagtccacaccgctcatctggtcctccccgacgcccgcaagccgattctcccgatctcctccccttgaggcacctcctctgcatccgtcctccatggtggaggcgtggc

SEQ ID NO: 81740 - DNA, 7643 bp, Oryza sativa
aaaggctccatgtttgccgacagtgtgacgaagcgatgtgggcagaatacaggacaatgtaagggagacacaaataactactaaatttatttacctactctctcatttcatattataaatcgttttgactttatttttctactcaaaccttttcaaacttgataaatttataaaatgtttagcaacatctgcaacaccaaattagtttcattaaatgtaatattgaatatactttgataatatgtttgttttgtgctgaaaatattactacaatcttttttgagcttggttaagcttagaaaaatttaactagaaaaaaaaataaaaaaaaatcttataatacaaaacgaagagagtagctatctatatcattctagcttctctcagttcctcagccaaattcgttctgtggggaagagctcatcatgactcgaagattgatgaccatggcagctggaccatgtaatcaaccatatttatttaactagcaaatttaattataatttcagttttgttccccagccaattttcccgccaaaaaaaaagaatccccaggcaatttatttaatttgttgttctttagtggaccatggatcaacgtgggctgatgctgatgtctagtcctccagttaagagagacgccaacgaccacatttatttagctagcttgttaattatacgggaacatatcctatgcatgtaaattttccatgcgcaccaactagtaattataaaaaaaattatagaaaaaaattgaacatttacttctaatagtattacatatatatgcaaagctcatgttaaaattcattatattttcgccataacaaaaatatgaaaaatctaacagttttaagagtaaaaatctatcaaaatattgtctttttttaggctaaaatataatgaatttaaagataagatttcgcacataggtgtaatactattagaagtatgtgtctaattttttctaaaattttctgtgatatttgctagttagtatgtatgaaatgtacgtgagaagtttgtgtgtatgtatatgatatgttccctaattatgctactacaaatgataaatattaggatactaaaaagtaacttagcacctgttatcgatagagaaaaaaatgttaagaaaacgtggacatgatcaagtgggactcaaacctaggctggtccaagcgccggtatagcgctcttaactaccactgggcatgagaccggtctcttgtactacttcatccattccaaaatataagagattttaaaagatgtatcatgttctagtagtacgaatttgtatcaaattttactactacgaatctgaattgttactccctccgtcctaaaatataacaacttttaaccctcatgatttgtcccaaaatataactacttctccatcaacattcttttcccaaccaatcacaaccctctactattcacttttcccacctacctccattactcttccaatgcaacccttcactactcacttctacctactttcttaataaccgtgtccaactctaaaactccttatattctaggatggaaggagtatatcacatctcactaaaatctcttatattttgaaacatgatagtactattttagtacacatttgtggcagattaggtcacatatcgtatggatccgtccattcatatagtttgagtttaaacattgaattatcatttcccccgctgaatttgttcttattcatgtggaactgctgcagccaacaaaccggttccaccagtacttaataaaagctcaaccggggagaataatatccagatcactgtggaaagtactagtggggaaaagaagacaacaggtagagacgcaaacaactattataattttactttctaaattccctatcctagttgatttttttaatgttttttgtacgatcattattacctgaaaaacagagcatataatcctatataatttttgccttcacataacgccaggtccgaatgggaaaggaggaaacatgtaacctttaatcgacgagctctgcgtatccaaacttgagtggacagaaatatagtccagctggactatatacatctgatgttctgcacaaaaaatcaagatcgtagagctccaattcccagtttggccagtcatacatggccatctatgtatctttattatatattataccttgtggcttttcttccttgcttgatgtgattaaggtgtgttttgattattgatgaacaattcgcataagagatagttggttttgatatttggtggattattgtcgaagttgtgctgactgtgtgggacccagtcaaactggcatgcggtgcatgattagaccggccggcccgatggtctgaacggctggctctgtaatagagtcggtttcgagttttttaattggatactcgtgattatttcatgattactatacttatgcaatactgttgtgttgtgtgttaatgttgagtcaacaattgttgaaaaacatgtgctcgcatatggttttttgtttattcatctgtaggtgtgttttgatacctcgggagagcattgctggtgatagattgggaggcaacttgagagaagatggcatccagatgattaggaataaatcatgtagtatacttaggctaaacaacaaaataaatatggtggtgaagatttcatgcgtcatacaagagggtcgtgtacatgtagaatgcagagttgaatttgggaggagtccaaacttgggaaggttcaagtttaaattgaaaagaaataagttagatacttgtacaggaatgttttctagtggattaagactacttgtacaagtagtattcatggctttgggccaatcacctctaggtataaatggaagagggttgaccctctcggtatcgattgtgtaagagacaagataagagaaaagttagggtttagcctatattttgtgtttaatcgaatgttgagagagtagtattttttttacactttgtaaacataaattagaagcaataaagttgatttgctttcagagagttctttgattatgtttttcttgatcttggcaattagaccaatgagaaaccggcggcatctaggcggttgcatcagcatcttcaagaggttgcggtggcaaggagggtaataggaccagccaatccacaccggttagatcggcagctagggtgcagtcagcccagtgtgcacacagcagtcagatcggactccgttgtggacttcgttgtgatgacccgtgccgtcattaccaaaatgacttcactagtccatggattattatttgccatagccgcgctttagcgaataattaatgatccacatcaaagatagcagtagaataatagctgtaaggtttagataacattacaataccatgccacgcagggctaaattctgaaacagggcattacaagttcacccatttaataatacaagttctaataagcagtagctatcagtactttagtcattacatgcttcattatcccaggttctctgacatagctaggatcggagtagctactagaagtaccactcccctgcataactcatcccatcctccataatacacatcacatccccttgattttcagcacaccaaggggcatagcaccgatcctccaatctataagtatcatttaactcaatggcttgcccaaaattgcttgcgtctaaacaaggaaggttaatagcaagggtgagtacaattacttagcaagcagtattaatagcaaggatgtatggcatgccatttcataagtcatatcaaatcatcatttcgcaattataatttctttaaaaaatattattgtaagaagagtccatatttaatttataagaaaagctactactcacttgcactagtacagatccttccatctgtgacggcccataacaagactagaatttgcgggccgtcacaaggaagtaaaactaaagtactgtgacgtgcccatccgaagttttgcccgattgagatatggtcgcacagccatggtatatcggcataaaactaaagcccgtcacggatgacacttatctgtgacaggctatagttgaggcccgattgacatgagggttccatatctcaatcgggccctaaaagaagcccgtcacaaatgagggtcatctgtgacgggctccaactagaggcccgattgagataagtttaatgcccgtcacagatgacactcttttttgacgggcttttattaaggcccgatagagattacttgtatgcccatcacggttgattgttttagggccgttacagatatttgttgcacagtataaataccccccaccacctagtgtaactgtatcccactgttcactattttggtgggaggctgtagggggcgattttttgtcctttttccaaggaaaacagaaattaaattcccaaaaattgatcaaaatggatcaatcaagtgagtaatattattcattaattgagcaatttcatcatgtcttacttttgcaatactgatcttacaatatgtgcctctaatttgttttttttttattttgcagcaattgatcgaagttggatgtatgagaaaattttgaaacgtcattctatggagtacagaaagggcgtaataaattttatgaacgctgtggaggaggatcggaaaagaagaaacagtgattatatgtgttgtccatgtgcagattgcaagaatgagaatatgtttgatagcggagaggacgtacacggtcatctgatacaacgaggattcatggtctatacatgttgggtgaagcatgcagagcaagaatcaggaattggagcagcagcagacagaagtggtgcgcataatcaggaagatgaagatgagcatgacatgtttataccttctccattgggtggtgaaatggttgatgtgaatcacgatctgctgcaagacatgttacgcgacgttgaggacccagcccagaatgagagatatggaatgaagttcagcaggttggtaagtgattccgagacgcctctgtacgctggatgcaaagcaaaacacactaagttgtcagttaccttggacctaatgaaactgaaggcaagtagtggatggacagacaagagtttcacagatcttttaggaattttgaaggctatgcttcctgttgagaacacattgcccgagacgacatacgaagcaaagcaggttctgtgtccactggggttagaggtccgtagaattcacgtttgtcccaacgactgcatattgtaccacaaccaatatgcggacttggatgcttgtcctgtctacaaggcttctcgatacaagcgaaagaaaagtgctgacgaaggaaataagtcaaagaggggtggtccggcaaaggttgtgtggtatctacctatcattgatcgtttcaagagaatctttgccaacccgaacgaagcgaagttagtacgttggcatgccacggagagaaggaatgacggtatgcttagacacccagcagattcgattgaatgaaggaatatcgatcgaaaacacaaagactttgctgtagaccctagaaacatgaggatatgtctgtgtacggatggcatgaaccctttcggtgacatgagtagtactcacagtacttggccagttcttattgcgaattataacctcccgccatggttatgctttaaacggaaatatattatgttgtgcttgttaatctatggtccaaggcaacccggcaatgatatcgatgtattcctagagcctgttatcaacgatctagagattctttggaaagaaggtgtggaaacttgggatgcatatggtcaggagaacttcaagctaagagttctattgttctgcaccattaatgactaccctgcactcggtaatctttccggataaaatataaaaggaaagaaggcatgctccgattgcaaggaacatacacgaagccggtggctgaagaaattggggataggaccctcttggaccgtagacgcatggcatggatacgatataaatggatacacattttacaccgtcaaacaagatgacaaaagcacagtgcaaaacagcggcgttcgtatagatgcattccaggatcaagttgggtcaaacacatattacgcccgcattgaggatatctgggagctaaactacatcaagttcaaggttcttttgttccgctgccattgggtgaatatatgcactggtgtcaaagccgacaaggaaggtttcactttagttgatctatctaaggtgggatacgccgatgaactatttgtacttgtgaaacaggtcgagcagatattctacataaaagacccttcaaacaagaagatgcacatcgtgagggatggaaagcgccgaattgtaggagttgaaaacgtcgtcgatgaagaagaatacaaccataatcttcatgtaagacctcacattgatcttgacgatgatccataaccttgtaactgatgcatctatacttatctattgtaatgaatgaagtattttatttcactgcaaagacttgatatgtgtagtcattaatatggctaattttgttttattacaaatgaccaaaataaaagttgtagatcctgatgagaggatcaaatttgttgttgaccatatttcaatttgaaatcacttagtatttacaaatgctgttaattagatttgtcatattgtcaaaatcaatttcaagttgttgggaaaaaaattttatagaaaaatgaccaaaataaaactagtagatcttgaaaggctctacaacttttttgttgaccatatttccatctgaaatcttttactatccgaaaatgtattctgactaataaaatgaattattacacagctactatatattttgcactcacaacaaataaaagatggaaaatgagtcatcgatgacgggccttagtttacggccgatagagattaatctatctcaatcgagctttgctgtagggcccgtcacagatgacgcccgattgagatgacattcaggcccgtcacggatgagtcatctgtgacgggccctatgataatgcccgatagagatagattaatctctatcgggcttgaactaaggcccgtcactgatgactatttttccatttttccagataagtctttatatttgtgagtacaaaatatatagctgctatataataattcattttatccgtcataatacatttttggatagtaaatgatttcaaatcgaaatacggtcaacaacaaaattatagaggttatcaagatctacaacttttattttggtcatttgtctatataactttgtttccaacagcttgaaattgattttgacaatatgacaaatctaaacagcatttgtaaatactaaattatttcaaatgggaatatggtcaaaaacaaagttgatcctctcatcaggatctacaacttttattttggtcatttgtctatataactttgtttccaacagcttgaaattgattttgacaatatgaaaaatctaaacagcaattgtaaatactgcatgatttcaaatgggaatatggtcaacaacaaagttgatcctctcatcaagatctacaacttttattttggtcacttcttcatccgacaaagtgatagttatattattcacaataatcacatttctctcatctggtttatagggctgcagga

SEQ ID NO: 81741 - DNA, 16423 bp, Oryza sativa
  unsure (1)..(16423): unsure at all n locations
cccatcaccgatgagtcatcgtgacgggccctacggcaaagcccgattgagatgactcatcactctactatatctagggtttctcagatcggatcgaaaatttttctaagtcccactacagtttcccgcctccttagaaccctagcgccgccgccaactcctccttcgccgccgttgtcctccctcgccgccaccgccaccgagcccgccgcctccaccgagcccgccgccgccgccaccgagcctctacaccgaccagcgtcggccttcctcgtcgtcgccgcctgcctcttcaccgacgcgaacagctgcccccaccgaggccggcgacgtccttcctcatcgtcgtcgcctactcctcaccgacgcacgacgccgcccgcccgacgccgacttgcccgaccggcgtctacaccgaccgccgccgccgccgtgaactcctccttcgccgagcccgccgccgccgccaccaagcccgccgcctccaccgacccacgaatccctccaccgagccctcccggccgatctcatgtgagtcctccatcgcgcctccctctgctacctgcatgtggttgatgatgaaaatgtggatgttgggatgaaatgtggatgttgggatgaatttagtgatagatgattttagtaattgatgacttgatgatgaatagatggaatgtggtgcattaatgaatttagtgatagatgattttagggattgatgatatgtggtgaacgaatgattttagtgattgatgacatgatgatgaatagatggaatgtggtaaattaatgaatttagtgatagatgattttagtgatagatgattttagggattgatgatatgtggtgaacgaatgatttttttgattgatgacatgatgatgaatagatggaatgtggtgcattaatcaatttagtgatagatgcatgatatgcggatgaatagatggtatgaggtgaatttatgattttaggatttgatgatatgtttaatttagttatatgtgccatttaattttttgttattttgaaaaaaaagtagacgatgtctcggcaaggcgaaccaatgtcgacgacaactagtgggtcctcaagagcacgtactcctaggacagggaacaaaatctctaaggaacggttccgcataacatcggtggacgccgtagggttgccaacatctccaaggaaaatagtgagccgatttaggtctatctgcagggtcatagggagacagaaattcagtattctgcaagatgacatcaacttcgtgccggccgcagagaaggacattgcttggctaacgttcaagaagagctgtcacgaccggaaataacccaacgggcgttccttacgtgtgtgtattattccttgtcccaggaggcaaggtacaccaaaagttgatacatttcagagtttatcaagcgaaagcgtaaatagttactttattacatgggcggcgaaggcccagcacacacaaagacaaacgggaaacagcggaagactagggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcagaataaatgcaagggagtacaagggagccataatatagggggggttagggtttgcagtaaacagcactaaatgacacttagttgctcaaagctattttgtaaacacggtcctagagctatacaagattattaatcaaggccgtgaacccacacgaacctgccttaacccaaggcctacgatgattcagaccgaactggcaacccgaccctgggtcccagctcgtcccaagccaacccaggccagccattccacattttagttgttaagcaggttttaagaattaaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggatggaagacatgacatagtttccaacccatcctagccataaacaagagtaccgacccaaccccacctacggccgaaacccccgggacaggtaggcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccaaagaccggtccttatatggccgaggtgctactgtcaaaactatgcaccccgagcccagcctaaaaccattttgagggttttgaatagagggggaggtgtgaatccaattccacaataatcccaccattccatagtgtccaggtgatatgaatattcccaaagtctagagttgtaaaaccacctaatgttgcctaattaaccagcgaagcatctacctaaaatcatactagtggtaccatgagtagagtgtccactagttggtgttttgtttattctagggtgaacaaggtaataataacaataacaataataaggtcataacaaaggtacataggcatggctagataaaacagtgataacgcgggaatttaaataaagcgataatgcaataatttaaatcaaaataattttataaactaggattcaatatgttcaaggatgatgtgacttgcctcgctcactttcccaaacgtcggcttcaacctccacaaagagcggatcttccgaagctgcaacgtctacacgaccaacggaaaagaaaaggcttttactctaataaactccatataaccagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgaggggagggggcgcgcggaccgggtccacgggagtggggcccacgcggcagcctcacggtccacggtggaccgggcgcacccgggctcgcaccggccggcgccgtgggccccacgcgtcagccgcacccgagggccctggcggctgacggccgggccccacgtggcggccactcggcgtggccggcgggaggcggcgcccgcgcccctatggtcgccggcggcggccataggcacggcggagcggcggccgagagaggggaagggaagggggaaaagaggcggcggtccgcggctcaccttaggtcgacggcgacgacgaaaaaggcggccggagcggaggaaggcggcggcgcggctcgggtcgtctgggtcgacggcgttccggcggtccgcgggctcgacgaggggttggacggggtcgacggcagtgcggcgaagccggaggaggcgacgccggggcgggagacggtcccggcgagcggagaaggccggccggaggtcgtcggcgacggaggagagagagggcaatggcgcgagctcgattccggcgaggagacggtgcggcaagggcggaaacgggcgagggaggcgcggggagggtttatatagggttggaagggggagagggcggccggaggggaaggaaaccggcgcggcgctctcgggctccatcaatggcgccggcgggattagagggggggtttccaaacgaatccaagggagaaagggagggaaaatagggggaatgggagagggaatcacggggaataattcccccctattgattgcacgcggggaggacgggatgcggcggattcggcagcggcggcggcgcttggcgcgggcggagcagcgggagcggcgggaggaaggggatgacgggtgggccccacccgtcagcgagggtggcgggcgggcccgcccgtcagcggcgcgcgcgcggggagaggctagatgggccgcgggggagaggagaaaggggcagggagatgggccggattcggcccaagagagggaagggggatttttaaggtttttctttttataaaaccttttcaactttgtttatttcttaataattattatttgtgctctgaaaattccactaaaatttatttacgcattttaggcttttaggaaatttacaaaaatcctctaagccttatttggcttttaactttgcacattttaaatgttggaagctttcacacggattttaattattctaggcataatttaaaggatatattttagggtcgttttgggacgtgacaagagctttgattatcctgtggagcatgataaccgtctcaggcgggctgctttcaaggttatgggcaatgcttggaagaacttcaagactaagctaatcggcgagttcgtctacaaccaggcgaatccagatccaagagagaaatttccttggatcacggcacaagtctgggaggaattccatgcgaagaagtcgacccccgagtatagagctagaagcgaggcatatcgcttgctctagatcaagaaccagcatccgcaccggcttggcaccgccggatatgccggtaaggaagaggaatggcagcgtgaggatgaagaagcggaggaatcgtgcacaccgctcgtgtttggcgatatcccacaccctcgggctaggaactaggccagggccaggtaccagaggaatgatgatggcacaatcttcatgccaaatgcagaagatcaacgagtatacgaagctatagtaagtgtctactcaaactagatgttcgcattgtttcccatcgtgcagtttatttaaccccactaaattgtaatgcagaaggagttggttgccgagcaacaagcctcacaagaggcctgctctcaaagacgcgaggacgacctcctcacgaaagcgttgggcaacaaggaacactatggacagacacggggcgttgggtcttctgttccctagaagtatggatttccagactacgcttggcagtacaagaagcggacttccaaaaaggcgaagaaagatgcacgccttgaagccaagatccgggcgtcgataagagctgagctgacatctgaattcgacgaaaagctcgagtcgatgagggccaagattaggcaagagatccgagaagagaaacagaacccccaggccgccgctgctgctgcgcacgaagagttaggaagtcccacccaaaaacacagcagttgcgcatcaactgagttggcggaaaatccaacatcggtcgacagcgccgtcgaccacataatggtaaccgtgaacttacttaatacatgaaagacttaacaaatccatatgatatataatattctaaaaaaattgattaatctatcacaggaaccaacgagctgcaccctcacagttagggtgatgccgaccttcacggttccagcagccaagggacttgcgtacaagccgaccccagagacaagagtgcatggagcgcaactcaggacggactgtgcaaaagttcaagtcgactcggtgaagcccgaatacgagctgttccctctgaagtatccaccgaacgatgaggtcctctcactaggaaatgcccatggtaccttcatccaatggcccaaggacctcattgagatcagggttacagcgaggccaaccactgcaccaggcggtcatccaccaaagagacccgcctctgctccttcagcccctgctgctcaagattgtcatgcacaatcttacgatgtgcagttgcagtacgacacggattttggggaggaccgaacggaggccgacagcaaggcgattcatgaacccccaccgatgaagaagagcaggaaggcacactcttcccctcagagaattactctcgataaacccgaagcaaaggggagaggaaggggaggaaaggtgcagaccttagttctggctccaaggaagctagatctgggcaagggccaggaagagactaagggcaaagaggtcaagaagaaatacgtcgctccacaggagttccaactaggcatgcaattggttggagatgacgtgcttgccgcaatgggcaccgcttgcaagcaccttcacttatagtacatggagaaatctaacgccaggaagccaagtaacgctaccgatatccttggagagcacgatggaaagccattccttggtccaacaaattatatcgtggtcaacttcaaggatcttttcgacctctacaggctccgagcggtggacacaagcctccttaagtgctactgcttgtaagtattgtcgcccaactcaatctggtaataacaatcggtttaacttgcttataagatcgtttatcttgtgtgtaggttaagttggcagtggtgtcagaagcatgcaccagaagttgccttccttgatccacaagtggtcactgtcacaaatctccagaatgaccgtctaggaatggtcaactacatctacgacaccttgtggtcccgccgagacaaggagtacattatgtgcgcctataatcaatagtaagtgtgttaactaaatatacacaacggcatgacacattccttgagtacttaattaactttcactatattaatgccgcagtgcccattggatccttctggtcataacacctaagtggagtacatgtcactacctgaactccagaattgataagaacgcatatgattggaccccaattcaactagcgatagatgaagcgtgggcccaatacgtgcaaagaggaggcctcaggaagataggacatgacaccctcatccacaaaaaagacttcctggtgaagcaacaaataggtgaccagtgcggattccatatgtgccacaacatgcgccttctgtatagagaaaaggtgaagactttggctgagtttgaggtcggtagtctcaattgtgatagactaactacattttagtacttatatatgatcgatcaactaatctggaattatgacaatgtagggcacaataaccaagtctctgcctaccagctttgaagaggttcgcgaagagatagccagcttcatcctccgcgaaataattaaccccaaaagaatgtttaggcttaaactaaaatgatgaacaatgttgaacttttatgtttaggcaatgatgaacacttattatgcaactgtgatgatgtatatatttcatatgtttatgttaggacttgctaaataaatatttgatccaattaactcggttttgcaggtgaaatatgataaatatttgaatggatgtgaaatatgagatggctgtgaatgtgtgtttgtgtgaaatatgttgatgtctgtgtatgtgaatgcatatgtgtatgaatgggtgatgctggggagctggggatattggatatctgtgtttgtttctgtcatttttgcagcgggcatggctagcaaaggcctgaggctagccaaaaaaacaaatttttttttgtggattatagtcatctgtgacgggccataactaaatgcccgattgagatgaggtcatctgtgatgggctctaggttaggcccgattgaggtcagtagtcatctgtcacgggctctagtttatgcccgattgaggtgagtagtcatctgtgacgggctctattttaggcctgatagaggtcatcagtcatctgtgacgggctatagtttaagcccgattgtgatgagtatcatatgtgatgggctctagtttaggcccgataaaggttagtagtcatctgtgacgggcgctagttgtggcccgatagagataggtcatctttgacggactatagtttgactggtcgtctgggtcaaagctatcggtgacgggcttcacttagggcccgaatgagatatattcattcatgacggccgtttgcccgattgagataactcttcacatcagtgacttctagcctgtgacggacgctgtgcctgattgagatggggcttaccgcccgattgagatgagggtatcccttcttgtgttgtatagtgagaaagaaccacaataggctccgatatcctctaatctaagagacaggcgtgaatcacaatctatttgagcacgcactgcacaagcttgtatcactgtatccattttcactccatatattataagtcgcatatttgtaatatttagagtacaacgcacttctcttatttcagcacattacactccactccactacgtgctactgtactatcttgatggggtttatatcatctcccatccaagtactaacgttttatggggtttatatcatcttccatcttaccactatatctatagttacgcatcatgcggagtgtaacgacttgataagatatgaagcgttgctcgtcttgcgacaaggatatcgttgacacgacttctataaggcacacgtatacaagtgagagtgattttagtccctaattatattatatccgtatgtaaagggtcccgcttccagtcaatccccatccatgggcaccctctacccttctagtaagtgttggaaggtcaattgctccatcaactgcccctcccagtatctatcatcatccttatatatctgacttatattttggtaaatccattttatgcaaggtaacagtactataaagcaaaattaggtttacaataattcaaatcatcatgataaaaggattgctttcctgaattctcgtagttcaaatcaaaactagctagtgctcccaactgacctgactccgcctctagttcctttccgcattcggtcaaatgtgtcgagatttaattaaactatactattagaaatacaataatttacaaatacaaatgtgcttacaaatttatctatctatctatctgtatctatactaattagacactttatacgagcttccacgttaactgaaaagatctaacaattgattaattaggatattaaaataattgtgaccgtagattaaaagatctcatgtgggccattatttaaagccgatcgtccaacccttcccgtatcaatctcctgttatccaagaaaacaaaaggacagtatatatgtatacaatcatatctctaggacgaatcgctctcaattcccaagcatataaacacgaatatcgatccattcgacgtagacacatagtagtcatcgtgccgtctgagatcgacttcgcatgtggctcgggattggggaacgacgacgcaacacttgatgatcctgttagctgatgttggacgcctgcgacgagatcagtcgcgtgagagcggaatcgacacagcgaactcttatctccggcgagggtgctcagtgtccgctctaataaatctatatatacctgctggactgatcaccctgctggcactctctaccacttcgacatgcgccggcggctgcagcgtgtgcatggtacaaacgtcgtggatgaggaggatgatcctctacacgtcgagcagctcgcctactgtgacgacgacggccgaatcaaacgtggctacgtaccgggcatgcatggtaaatttgctttcggctccgcggctaatatattcaagtgcaagtgtaagagcgccgtctcgactcttaagctagctctgagattactttctccatcaagttatttttattcaaactgaaatatcttgctcggttaatttgctattttcttaatcaggatgtgattatcttttttccaattcaagatctatctgggccaccgcaggaagctatatatgatccattgctttttaccctaacaaattcgtatgtccctttgttggtctagctttcaatgcctttagactaatccacgtgtactgtacaatagatccgcatattattgatgattatgctattatattttcaaaatattgtatgaaaggcatacaccatacgttcttacacaaccgcaaatgtctctccactggcaaatcttgactcactactttaggtttgattcataatgacaccaccttcttagcttgttatgcagatattatttctttagcatcttacatatccaagattgaagaagaaacacaaacaagtcatggcataataaaattcgtgaaaaataggctctgaattgggtgagttgagataaaataaattagtatatgaaagtattagctatatttattttaactatcaattcagtttaaatgtttagaaacatattataacgtgaaaagtgaaactaactgaaggaaattcaccgccacgtgttaagcaaggttgtcattatcccgattcgtatcctatagaatctatagaatcttacgatactacgatcctaccaagccgaaacgataccgatctcacatctatacctaattaaaaaaaataagcaaagcttccggtaaaaaaatttccgtccgtcctttcctttttcaccgttttcctctttttttcgtttgcttttcattttcctttttttttccgttttctgttttttcctttctttccgtccactttgtttcccattttttctcgcccttttttcctttttttttctctgcccgcttatttttccgtttctctccgtccctctattttttccatccaaaattttcaccttttcctccttttttcggtttttttcatctgttattttatttttacttttttcagtaggatttgtttttctatctgccatatttttttcgtcgtcgagccaaaccctagcgttgtagtcacgtcaatttgtctccccatgcgttccccctccaattagttgtaaaaatcaattccccactacgctctcatcattttcccatgattttcccattcaattccgctttaattcaccgaatttaatatctaattgaaagtcactttctttatcaagttttgcggattcactccgattttgataaaaacaaaaagaggagatcgagtatatcaaaagtcctcaatcaatcttagaagatcgagatagattcgactgaatttgatggggaggatcagttttagcatcgtatggatatgagactatcttctggagggttggctatgtgagctggaattgcagctaaacttgtgggttaggtcttagagaggaaggtccagcagagggaggtagtgggctgggctaggactataaaggaaagaaggaatgagttttggtcgaaaatcaaagagtaaaatgtatagcgatccaaaaataaatttacccgttgcaacgcacgggtattttttttctagtagtatcctaattttcatagtatctcgatcctactattcattactacacgatcctatgaaatcttagggggtatgccgattctacggtccccacgatactacaaaatattatttaaaataacatggtttgaaaataatgtaaataaatatgctcaaatttttataaaagtcagttaaatatatcaaaaccaacgtggtttctcttgataaatgtctctatttgcatgccatatatcattactacatttttttatatagaatggctatatataattaatataaatattaattaaacataaaaaaataaaatctcatagtatcccgatactacgatacgatccaacgatacgatattacttttagcaaacgatactacctagtatccaggtcctgacaaccttggtgttaaggtagtcccatccacagccattaaaaagatccaaaggtatatatttattattttaaatacattgcattttttcactagcatgctttgcaattgattaaaaagactaataatattacctatgtgtaggttactattattaaacaatgataatcaacaagtgcagcatagtggatattcctgaaacagtagagcaatggaagaggaatgatactaaatgcccaattatggtgagtcaaatttccagtctccactaaatgccattatcttataattacaaagttttgcatttatctgggtggcacaaaattaaaattataacaagtaacatcacatattagaagagccaaattagttttggatgagaatagtatcgaaagaatagtatttgcatataagacaccgagtgtttctaggtaagatgataagaagactttgggtggaaagacaggtcatggattcaaactttcaagccacatgcacgctaacgtggaaaaagaatcttgttagttatttgaaacaaatagtaaaataccaaatatttttttagaatattttttgatgcccaccaaaataaaaaaaagggctgcaccctacaagtgtccgctctaaatttagaaccggcacctataataatgccattgtgccagttttagaactggcaccaatgaggcatctcaacatgacagcctgaatggtgccagttgctcggcacacgacactttctgcagtattcactactagaaaaagagtttttcttgcggcaaaaattgaatttcgctgtcgtcatgcaatgccaaccgccagtaagcaaaggccagtgaaaataatgaattttcactagcgggcagccagccgccaaccaaaatcgagtttcacaggtggcgtgttaagacaaccgctagaagaaaaaccgtctttgctagcggttaagtttagaggatctccagtgaaaacattttttaggtaaaaaaaattgaaaatcagcaccgctagccaccacggccgcatgcaccgcccaacgcctagccctgccacggtggatcccttgccaccgctgagccccatccccagccggtcactgtcgccaccgcggagcctagagaggaaaggctcccctgcgccacctcactaagataagcccgacagtcgccaccagatcaatcgcccgcaggagtcccccctgctggttcgcctcctgcacgagtcgccgccgccgagcctggagagaagagactccccttcgccagagagaagagactccccttcaccaccccgctccagatctagaaaggagagaagctaggctcccctacaccaccccactccgctgagccttgccgcctccctaacgccctactggggcaatcaccaccatggacaccgccttccagatccactctcgcgagggagagcttggccggccggtggtggatccgccgctccttggcccactgacatcggatctggagcccttcatcgcctccctaacaccctgccggagccgtcgccgtcatggcccccaccctcaggatccgaactcgcgagggagagctcgagtggccggcagtggatcggccactctgtagctcgctgacgacggatccgcggaggccaatcatgtttcgttgctgctatcgccgccaccgagcggcatcaccgcctagcccaaccatgcaccgccggttcagccccacgcgtcaccaccgagtcccctcctcgctgccgctgccggtggacctgccaccggtgggaagggaggaggagatgggtgcgatgaccgacagtgggtgagcaaggtgctgctggtgctgctggctagtaagatattaaaaattgaagtttatgacaagtaaaatttcttatgtccaataacaattatttattaaaagtcagtctataaattcacactaagtatgatcctgtatgtcacgtctgataaattcatcccgaattaaaaatcattctctaaaaggaataatagaattaattaaaattcgaaaagaaattggcaaacactaaaatacgtacaagaaaaattcgaatgtggcccggagaatttttgttaaattctccttggtctaaaaggagccctcaaattttacttgaattttcagagcaccggaaataattattaagtaacaaaaacaattatcaaagtttattaaaaagaaaaagctaaaaataatccctctccctcctttgggccaagtctggcccaaagcctccctctctctccctcggcccgcggcggaagtcctctcttcctccctctctttctctccctctccttctctccctccttctcttgggctccccttcccctcggcccagcttcctcctccctctctctcccgggctgcctctccctcctctcctcttgggccggccgctcggcccaagccgcgccccctgcccgagccgcccctccctcccgcgtgcacgcgcgtcgcacgcgcgctgagcgcgcgccccgcgtgggacccgcctgccaggcgcttcttcctcctcccgcacagctcctctctctctcccgtgaaccctagtttcttgctctctcgaatccgcgcgattctagcgttggattccaaaattaattggggggaattaatcccctttccttctttttggattcggcccggtttccccttggaaaggcgcccctaatcgtcggaaacggccgcgcttttcccggccaccaaccatggccgccggccgtgtttcccgtcgccgtccgccctctcccgtgcccggctccctcccccatcctataaaatggaaccacctcggtacgttctccagttttagccccctcccgcgctctctcgtggccgccccgcctctccccgccgtcgtcctctctctcccgtgccgccggccgcctccagccgcctctccctcctcgccggagcgtcgtccggtcgcgccgtcgccgccagcagcgtcgcagctgcttcccctccactggcgtcgcctccgtttcacgcggagaccaccggagacgcgtccccgccggcaaccagtggcattggtgccactgtactccctccagccggctgctgtccctcgtcggagcgtcggccgacgtcgtcgtctcgcggcgccgcctccgtcatcgtcatcgcagcggcgtgttccacgtcgtccccgtctccgtgcagccactgccggctgccctcgtcgcctcctcgccggacccggtcgtcgncgtcgtcgtcctctcgtcgtttccggtcgtcgtggcgttcatccctccgtcgagacattctcgtctgccgcccgcgtttcgtcaagtgtgcagcagccccgtcgtcatcttcgtcctcagctccgcgtcgtcaagccttgtgccggccgcgtctcgccttcgtccaaggatcgccgccgaagtcgttccctcgccgttcgcctccatcgtccctgagctgtctccgccgcgcccgttcgtcgttgtcgttcccacgcctcgtcgcgtggtggtaaggatccctctccctcgctgccctgtcctcgtcctttcggtgtcgctcgtgcccgttgtgcggttgtcggccccggtacccgtgtatcggtgtcggcagtcgttcgcttgtgcgcgtggtgaccgtgttagtgtgtccgctcggtagccgcgtggtttccacgtgtgcagctcgcgtggtgtctagtggagtccgtttgtcggctactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacatgttttatggttgcaaagcctaattataataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttctcgaagcgtggtttgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgattaattaggcaacattaggtggtttcataactctagactttgggaatattcatatcacttggacactatggaatggttggattattgtggatttggacgcacacctccccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggatgaagtcgggggtcgatggacatctctaagacaaatgaaggctacac

SEQ ID NO: 81742 - DNA, 10046 bp, Oryza sativa
  unsure (1)..(10046): unsure at all n locations
tgtgtcttgtgggtaaagatgtacacctctgatcagagtataatctattcgaatagccgcgccctcggttatgggcaagccgagcaatgtacccaagttagtgtttaattcttaaaatttgcttaacaactaaaatgtggaatggttggcctgggttggcttgggacgagctgggacctagggtcgggttgccagttcggtctgaatcatcgtaggccttgggttaaggcaggttcgtgagggttcacgaccttgattaataatactgtgtagctctaggatcgtctttttttaaaatggctttgggcaactaagtgacttttaaatgctgttttctgcaaaacttaacccctatatcattaccccttgtacccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataaggtaaatattatcgatataataaagatgtgtcttttatatcatgtttgtatggtgtaccctggcttttcctgggacggggattgatacactagcgttcgggaaaatgcaattttctcggtcgcgacactgtatataattgccaccatataatcctaactttagaatgatattgggaaagtgtaatcgagactgtaaatcgattactgctcagtatttattaattctaaatttcagaattattatatcaagaaaagttggaattatatacttactaatacctaatttccaaattaaattatacaaaatagtaaattaaaactctaacataagtacggattggctctttttagttttgaatattaaaattattaaattaaccaaacagaaagtaacatgaaggattctataggtatttgtaaataataattttgatattttctgacctgaaatagaaattttgagttttgtaagtacaaatgaaataaaaccatttgtcttttgaactttaaaacaaactttgcatatatacaacttttaagataatttaaaatagttagcctatctaataatttaatttatatggtgcttaagtaagtgcaacgcactagtaaaaaggattgtggcacaactacagaaataaagattggtgctggttaggaacccaacaaatgtgccggatttctgtaccggcacctagaaggtagcactgatgtgaagagaaatgggtgccgattccatgaatccaaaaaaaagctggctcaatgcatgcatttagcatcgagcagccccttctcccacatccgcatatcatcatccatccattccatatccatcttgtttacacccgaatttggcgccagattcgaattgggaaaatattgccaaaatttggaagagtcttggcttcctttacaaagccggtctgaccgccgtatgttggccagtcagaccactgcttgtgggccaatctgaccggcggcgtgtggctatgaacactttcgaaaaactggactgacatatcttgagattgacgaagttatcatgagcgttttgatatcgactggtagttacctaccactgaaataataattagctgtaaatgcgaacacttgtgtcaagtctaggacttgaacctggtggattagttgtaccataaggaaactaactagtggagctacactcaatttgctaccgtttagtttttttttttaccagagtcataaataaaaagtcctatagagctatctccgagtcactaaccaacctgctgaacttcatggaatctttctcgttgtaagatgggtcctcaacgtcacgtaacatgtcttgcagcagatcaaggtccacatcaatcatttcaccatccaatggagatggtataaacatgtcatgctcatcttcatctccttcttcatcattgtctgcaccacttctgtctgctactgcaccacttcccaattcttgctctccatgcttcgcccaacatgtgtatcccttcataaatccccgttgtatcaagtgagagtgtaaatcgtccactctgctttcaaacatattcttattcttgcaatctctacatggacaacacacgggcgaagctagagtgaaatagagaggggtgccacatgcttgctttactctgttttggatcaaatttaagctgatatgaatgtctaactttgcactgagggggtgcatatatggtgaaaaaagataaactatagctaaaaaaatttcttgaccaggttcctgggtacctcctttgaacatgttgctccgcccctgacaacacatgtatttgttgtttcttcttttcctatcctcctccgcggcgttcataaaacttaatatgccatctctatactccttgcaatgaagcttccaagtagtcgcatatatccaacttcgatccatcgctgcaaaaatgaacaaaatattagttaacatcttataagataagtactactaaattaataagaaatgattagtactacaaaataagtactacaaagtactacaaaatttgcccccttctacctcccaccaaaatagtgaacggtagaataacttcagacaacaggagagtggagtatttatagtgtgtaaaatatatctcaatcaggtcaaagaaacgatatctctaacggcggcgcacaattatctctaacggtcataaatgaaagcccgtcaccgatatgaactattggtgatgggcgttaacctcatctcaattcgggccttatttggagcccatcacctatgtcattcatcgctgacgggtttagtagttgggcccgattgagatatatgaggtaatctcaatcgggtctaacggtgtgcccatcacagatgagtgtcaccggtgacgggctatagatatatgcaccttgattatgtctgtacgagtacatctacaatggtgttaatttagaccagattgagatgacttcgttctgacggcccacgttgtccaggcatgtaaggggccatcacagatgagagtatctgtactagtgattacattttttttcagatctatttttgccttacaaaattttagtaacttaaatagtaccaaaaatagatgtttggtttgctataaggttttgcccatacctgttcaaattctatcttaccaatttgctagtgctaaaacttgtcaaagtttttacattacaatattttggtaattttgatatggtaaaaattggctctaaagccctaaataactgtacacttagtatggccatcatcagtatatgagcccaaggcgtagtgatgtccatctggtgacaaaaccgctgattagtggtggtgcgccaggaggggcaaggcacgtgcgtgcggttttttctttctttttgtctttttcccgttttctttttcggtttttttttgttaatttttgtttttccaggtttcttttggttttctaatatatatatacatattttttaatctataagtacacaaagtttgtatatgtacgtatacaactttatgtgtgtacatcgtatataaaatttatacacgacatatataaactttgtatatatatgtacaccatacacggctgtcaatggtcgaggccgggctgccggcgttctggtggaccagccagtttcgacctaatagtgggctggcgagcggcggcaccccagccaaggatgagatggcagcaatggcctgaggatgacggggtggagatgatctagtcgaggagaggacgagccgaggggcggcagcaccagccaccaagcgcatagccgcagatgaccagatatctggacaggacagggagtctgttgctgccgcacagatcaggacgtgagcgtggtagttttcagattttttttttcctttttttttttggttgttgacggcgttttcaggattttttttcttttgcaaaaaaaaaaaagatgtaaatgtaggacgatatataaagcgtctcacccaacgtctttactttcatggtgattttgaaaattgagacgactactgtctagctagtcttaagagaaatgtctttatacattcatcttgttgtagtgagagggaaaagaggaagatgtattttcgcgtgcgatccactaagagacgcctcacggagggcagaaatcgaatggaggtggataaggtggtgctcaacaatggagaggagagctcctaaaacagtccacgacaagtatatggatgtagaaagtgtaaaaaaaaaacaacagtaaaaatataatattttaaattctagagactacatacagaagttttcaaagtcagtattaattaattaatcagtcaacttatatcattaagcgcgcagagttatataagttcacacggatttggaaattattgtgtacattattttatcccaaaccgtagggaataatgtctcctattttggatcaagtgggggttagcaaacaactgtttcggatctagctcggagattagcgaagtacctgacaaaagaatccgattttaaaattacgtaacgaactactgcaagactgactcttcattaattaactacaaacaaattaatgtctatttcgcgaacagaatgtgatattgtacgtgcgtacaaatgcaattattgtgtttgaacatgtcaatatatacaacccaacattgatggatggactgatcgactacttccgagtcaatatatatttgcgttcgttcgaatgtgtgattattcaatgtgcaatttttaaacctaaaatttaacttcaaatttgtaattaaatttttagtgacataaattgcacattcctaaatgttaaatttcaatcatatatatttaagcattttttgcacgtaattgtagcttctatgaatagtaagtttatttctggtaattagttaatttctttatgttaaaattttttttcatccttttatataagaaaaaagaggggaaatgagaaccactggactgtcatctagccacgaaaaaattgactaaaatttcagtacatcacatgaaatgtagaaactccaattatatttaaactacacgagtataaatatgtaatcggagtttctagttacattattatttgccaatacattgaacatatgtaatatagaacatatgtatttactggatattagacatccaaaactgtgtaacggttaattaaccaaaaaatacacgttggcaagtccaaaattaaagttgaacatgcaaatcttttagttcactttaactacaacttttctttatatatgattttagttcatatgttatccatgttttatttttatattttttatgaattttatgtttatttcatgttgaggttagaataatttatttgttgtttatccttttatatatattaaagaatatactttgtttaaaataataagtatagggaagtgacaagatttagtcgatttccattcaagaaaatacaaaattctgagtcgactaaaactaaatatatattaacctatgcttttcccaaatggcccggatccatttctgcatgaaggcggaccagccgtctatagcaagcaagatgtttgtaaaaatcacaattttctcaagcgggaacgatatccgcatgcaaaacggaattttgcaggcaaacaagttacgacgcccgactacgacatgatttttggtgaataaaatataaattcaataaaaaatctagaaattctagcccaatccgagctaaaatcagccgctgcgacggattattgtagccaacattcgtaccaacggatccaccatcgtagaggtcccaatgctgaatttggtgtcacccagctcctttgcacgcacatccgcccatggccaggctccacacgttgaatctgccattggcaagttccccatggcccgattccaccgccgctgagctcacagtgctgactcngtgattgtcaagcttccttgcactagaaacactgttgccatgctcccagcatcggatctgtgtcgccaatgtccctgctactggatctatcgttgtcaagatcctcgccaatcgatccgcccttccctaggccggcgctagcgttgctgccactcactccaatgctgaaggcagatccaccctacgacaattgcgagccttctacagctgatctcgagcccgccgcgcgaggataattgtgagacaaagagagggagggaagaggataagagacaagaggtaatggggggtaaaggagaggataggggaggtgtggaggagataagtctcatgggattggtattcatagtttgttacgaatttgacaaggtggccattttttaattccaaggcattccaaggcagaccttgcttgcaaaaatcagatttttacatatgcacgtctccttactaggcttgcttacaaaaatagccatacttttacatatggccgtcacaggatgaccacttgtgaaaatcaagtttcccaagcggttcttgacccgggatttctatgcatttttacaaacggatcttattttttcccacttataaaaatggagggtgtctataaaaatcattttctggtgcttttaaattgccaagaacctattttgacgctgattatagccaataaaatactaatatcttgacattatttgaactagcaaatacaacaggattacacatatgacaaaatgctaatgtttagacattaattaattacggtctccttgtcacaaaaaaatcgttcacaattaaatatatacacacatgtgtatatttctacgtataaacaaacacatcttcgtgcacattatacacagatatgtacactctagctgatttgtatgaagggatatatctaataatcagcaagcgggtttatcgatgaattaatgcatccgatggtcaatattcatcgttataacgattctaattaattaaccgtctaattcatcactaacaacgaccataattatcattgatagcttataatgatgaacagttgtagactaactaggaatttaggctcaaaagctgtgactggattactacgtagccgcaaaatcactgacccaatgtatctaattaactgtttttttataatgacctaacgtttaactgttaagattacacagtattatttcgaaccattaattagtgatcaagtttgcaataaatatgtatatatttgagtgatagatctattcaagatgcaagagcccattaattgagaggaactcccatgagaatgcagatataatgtgtttccataaaacaatgacccaagctatagctatatgccaaatgtgtcatatacataaccaaattaaaccatattagatatggttggcagaactgacaaacatatacctgttatacattgattacaacacagttgactcaaggttccacacgcaagtaactcgacaccaatgtatttccatgggagattaggaggggtcaacaagacttcattcttcttctttcgtacagtaatatatacatcaagtaaacttatatagcatgaaaaccgtccaggatgtctctgctcttgttcccctttatatgttatatatatggagtagttaattagaacgagtaaccaataaaaaatgtcaatcatcacgcgtatatgtgtgtgtgtatgaaagaatttcgttgagattatattacgaataaaactgaacgattacgtgcacaaataaaaaaaaatattttatataaatatgtataaaagaatattctgtcatatgaaaagataaggcaaatattttagaagctttttttactcaaaatttttaaagtttaacatcagtcttatttaaaacgatagttattattttcaacccacatagagtactgctttacaaatttcacaagtatatttattgtatttatatttttgcgttacgtggaaaacgcataataagtatataattcttcagtactcacacaccatatgcattgctgggtccacaattatttctctctcttggatgacaaccaaattaagagctcatgcaaggtggttgatacgacgtactgcagcatggcgtacatacctaatgcaacaaagaagtttccgtatatacacacacgtaataatggttgtctcgctatagaccggacaaacatcaaattaattagtactccataccaacgaattaattaaggagatctaggcagtagtgacaagaaactaattaactaacgcaaataagatggtacgagcatgcgcacctattggagaagcttctacgcatgcatgcatgaagttggtacgtatagtacgtagctagctctttcaaattgttgtggaacgaatccatccttccgagttgaattaggtttcgacctgcgcgcgtcgagagaaattaaaatttaagagaatatcaaataagatatagttcaaattgttgtgtatcgatcgatcggtatatcaaataagagattatagttcgttagctagtacgtacgtcgcggatcggaccgcgttgctcgatcactatatatatctgtcgatcattttgctcctacgtcgtactcaaaccaaggcaaaatctagctctccatccatctctctttctgcttgcattgcgtcctctctctctctctctctcgctgcttgcgatttcattcctttcctgcttcaggcagctgcaattaatatcgtcgacaccaggatataaagctccatgtacgtatatccaacaaacatctcagtaaagctgcacgcatgcgcgttcggatcttacattttctgtacgttttttatcttcagggcaaatgctgatggcatttcctttggagcgggtaggggcagtcaaagcacgaggcagcacaatgctagtaattctcattcctaactatatatattatgttgcttagtttctgaattctccgggcaatttattttgtttttcagtccgaagtgctacaggtgggcagtttactatgccttcaggtatgacacggtccgatcaaagccagatggcccggttgcccaattctcaacgtcatgggcacaacgagatgacagaacgtaagaaacatatcaataaacatactccatcggtatgtaaatatttaacgctgttgatttttttaagcatgtttaaccgttcgtcttattcaaaatcttttgtgaaatatgtaatatatatatatatatacacaaaagtatatttaacaatgaataaatgatagaaaaacaattcgtaattacttaatttttttaataagatgaatagtcaaatattttttaaaaagtcaacggcgtgaaatatttagagagagatatagtatttattaacctatctatttcattttagttactcaatattcctaccttgcataaccggtttattttattaattcttcagtggaaaatgtagctcgagcctcggcgagtactgtacatggtactggccccgaatcacacagccgtcaaaacaaccaggaggtgccgccggcgtcatcaggcagggactacgacaccggtttaactattttatacacttgatgactatgttttgtgtgcaagctagtcatatcgtttgtatatatcattgactaactcgtttctctttttttcccttgtctatccagatttcaacgatcgaccatttaataagaaatctaaaaagaagagtacgtctcattgcattttttaagccaagtacgtcattatcttcaaacacagtatgttatcacatagatagttgatgcatgcaagtttacggatcgatctacacacatgtgtgctgacgaaacatttaattttctttctcattgacattacgcaggtgatttgtgactagtgagaggatgcaacaagtaaacctttaatcgacgacctctctgcatatatacaagctttgtgagcataatggccggaagttaattatttggctgtcagcaaacccccccccctcccccccaaaaaaaacacatacacatacacacaaaacatacacacaaaacgtagaggacatatccggtgaaaa

SEQ ID NO: 81743 - DNA, 7618 bp, Oryza sativa
tcaccggatatttccctgcttactttctacttgtgttgtccggccattttatattatctgttctgtcagggttaagtgtagtagatacaacagatgggtaaaatgagctactttctccgttccacgatataagattttctaacattacccacattcatatatattgatttattaatatctatatgaatatgggcaatgttagaaatattgatttattaacatctatatgaatatgggtaatgttaaaatgtggacaatgctaaaatgaaataggtgccggttctaaacatggagccgagcatcccctcgtctactctactcattgagaacaagcacatccgcatcacattcatcaagaacaagaatgaacaagaacattcatcacagcaagcacatccacatccaacattcatccacaacacaagatttggactcaaatttatgcaataaaaaaaagaagggattcacacctcgtcgtgccacctcccgtcggcgagcccgccgcctccctccggccagcccggcgctgcgtctcctctgtgaacccgccgtggcaccgcctgccgccacctagtcccggcgagcccgccgcctcccctcccgccagatctggcggaagggaggcgtcgcccgccgctgccgcctcccgccgccgcaactgcagcctccctcctaccgccgcaactgtagcctctcctcccacccttgccgagcacctaccgggccgatgccgtcgccgccgcccttcctcccgccggatctggcggagggaggcgcctccgggccgccgccgctccttccgccgcgcaccgccgaagccgccgacgccgcccctccagccgccgtgagcgagaattataggggagagagagcggagagaacgggagtgctggctcctcgacactatctcctcgatcttatctcgatgctagtggtggggcccgccgtctcagctcatcccggctcggctcaattagctggtgccgcatctataacaagtcataggtgccggtttttaatattaaaggtgtcggtttttaatattaaaggtgccggtttttttaaaaaaaccaacccaaatgtaataggtaccggtttttatttagaaccgacacctataattactaaaaggtgtccgtttttacgatttcagcccgcactattggaacctatagtggcgacacatatttgatattttgtagtagtgcttctataatccaaaaataagtccaccatctgcctggcacactatggggtataggtatggcatacaggtcagcccccgtttgatttttggttcctataggtatgtccgttacgcgtggtgacagtttggccacatgccaatcgtcaccaatttgagaaaataacttttcataaaaatataattgtggcctctcacatgcaatcacatgtcatccccttatatcttcttcttcctcactctccctcctcttctctctcatgccaccgcctcatcatgcaacctgctcgcctgtgcttgttgtggaagaaaaggaacctccacgagtgcgcctggccaccgtcgagctcttcacgcgaccatcctccacgagctagccagctccactcatcactcgtgtcctttatgaactcgatggcagcagcccactcgctagcacaagccaatatatcaagctcctaacctgatgaggaacacgcatgcccacgtgcattgagcaggctagaaagaaacaaacggtccagagcacatatttgttgaatagtatagggagataggatactatgaatattggagatgttgtatctgttgtttttataagcacataatgatttaatttattccataaataaatcataacattgcagatgtaaactagcatcaacacatcattagatttacatatgtaaactaatcagtaaaatatgaacaaatcaaatatgcgcaacatgttgaacacgtaccgagggttccggatgaccgctgccatgccatgcgaggcaaggcgagcacgtgtgtgttccccctcttctctccacctcacatgcttaaagtggtaaggagggcatcctcccttttaaggaggtcccctgtctagaatgagtaaggaggttctaaactcaccatgcatgccatcccatgaggtgggcttttgtgattttctaaagaattaatcttcgagtgggctaaggcccatctattaattccaacagtattgagcctccgaagccagtatatatagaagtacatatggagtagataaggaaggattacaaatatggaagaaatctactacagatgaatcatatcctaatatgactctaccatacactctaacaatattcacatcaaacagttcgaatggctagaaaataggctcaaagcggcgaccatgcatgtcttcttagactaccgctgccatggaaggagggtagcgggatctagctacaacgaggacgtaaggagatcaagcggagagagatgggatacaaatggttgtgtgcagtgctaaagagggaaggatgccgacggagacgacgagctctgcgcttagctcaccggtggccctctcctccacgtggctatccgatcgggtcctacccccaacagggacggtagcgaggcagccaagcgagtaggcccattatttatttataattttagagctgattgtatatcacatggaacggaaatcactttggagtgaatcaggggtataatttgtccagttaaaaaagtttgggggtatgaaatatcttgtattagactttaggggtataaatcgaactacgcaaaggttagggaggtaatttggatttttttttccccaccacaattccatgagccctgctgcaaaagaaaaaaaataaagtgggacctgccataatatttgttgatttcgttcttgcttgccagtgataagtgatcccccaactccaccatctccagagatgccattgtcgtcctagtcgaccaccgtagtctttagcacccaaagaagggatccatcgcgttatgccacccatgcaatagttgatgccccccgtatgcccagtagcctgctagtggattgggtgggaatgggtttattggattggatttcctcttggattgtgtttggatggtttgtaatgggctgaggaaatgtgggttggtgtggtttggatttggtcgccgtttttctggactagaaatggtttcaatccatgggtttctattggatggcagaatgggcacaacccaaaatggttgccgtgcatcgtcaatccccaattcctcttctcctcgacagccaagtcaacacgacaaatcgctcgatgcaccgccgctgtgcttgccaatgctttcctcgctgccgtggctcgccggcgagacgcgcaatctggggcaagcacatgtggtggcgaggtgagggcgatggagcgtgcgcggggggcgtggaaggaggtggagctcctggacgagcggcgtgactagcggtcactgctgcaccgacggtccagccaccgcagctaccttttgctccgcctcttccgcgccggcaggcagccgttgccatcggtgacgatggcgccatggagttttgcttggaggtaattgtggcaccatggattagcctatgccgcgcgaggaagacgattggttcgtcaaggtcagcatccttgttgatggtcaatggattgaaatgggtttgagtggtttggaaaggtggattgaatccatatgaggggaatggattggcttggtttggactgaggtagaaaatgggttggaatattggtttgggttctaaaagttgatttgtggactggattggtttgggctactttaactggttgtcatggtttggactgggaatggtgcgggttttgatccattggcaggctttattgctcacatcccatcaccatcgatgagttgctgccatttcgccaacctcctattcaagcttccccgcgtcactctcctccatctaggagttgattcttggatgctccgacacaattgattttttggatcagttttctagttttcaaggatctagtagcgagaaaatatcttggattggcttcttaattagcaacatgatttagaatattcaaggatgtgttcgagagaaggggaaagaagaaaattgagaagatatgcataacgagataaaccattaatgcatgatctattacatattaattattttaaacataaaaatgattaatataatttttaaaacaatattttttttattttttctaaaaaaacacattgttagtagtttggtaagtctgagcgcaggacaccagctatttctcgtatcgttcaaataatctgctttgggtgtgtttagttcacactaaaattggaagtttggttgaaattaaaacgatgtgatgtaaaagttggattgttatgtgtgtagaaaagttttgatatgatcgaaaagttgaaagcttgaaaaaaaattttgaaactaaagtcagctttattagtactctgctgataatctgaatctgcagcttaaggtgacctatgtgcttgctcttgcccgccgccaacaggagctactcctactcgacgtgtgcatccttctcctgcgcctcaacaacagtattgattgagggtgtttttgattcatggtcatgtatggataggatatagccatctatattttattgaatatggtgatttaattttctgtttggtttgtatggatatggcgatccaatttcttgtttggttcgagggatatagcatagatgagaaaagccaaaagttagtaggacccatttgtcatatatatatatatttatcaaaatataatcatccgagatcttgttttaaagatttaattacaaatataatggtgtaatcaaatcataaattagataaatggtttagaagaaaaaatcatttggagcttgcttaagaggacaaccacagccaatcggaataggacacttcacccagtccaaaactggatggcttcatccagccaaatcggccggatgcactcatccagcatagtaagggaatactctctattatgtaccgtctcatccaccctgacctccaaccaaacaccacagaaactcgagcggtcatctcccatccagactcatccacccaaccaaaataactgatgccgaccatgtaaagcagcttagcagcgacgctctcgttctcgctgggtcggttggtgcgtcacggtgcgagaactccgggcggggatggccctgggcgtgctggccgaacggcgcgggaggtggcttggttgggcctactgaagctgctcggtcgtcaaagcgagcggcgcgacgaggtgcgattcaggcaccgagcacatttcgagcgcacacgtgcaacatgcttgccaggctgcctagctgggccggcctgggaggaagaatggagtacatttggaataagttcactttagatccctcaatttgtcatccagtctgatttttatccctgaaccgcaaaaccggatacaacgcatctcccaacttacagaaccattgcacataaggtcctaaggcggtttggatggcggttttagctgacgtaacgcctatgtggctagtttgactttgtctttgtcctacgtggcagtgacatggactggaagtaaaatgtaaatttttaaaaaatgtgggtcccacatgtctgtcatacaaaacataaaattagtggggcccacatatcagtcaaacaaaacacaaaaaaggtgaggcccacatgtcagtgggtcccacatgagcaggtggaggagatgccatggggagacacccctgatttccagctgcatgtagccgaggaatgttagaaggggtcggagagacttctacaggttgtcgagcacaatctcggcggtagacttgatcggggatgtttccggcgggaagaacaggtcgtggatcttcacaaggacgaagaagggtatatggttctccaggaggtagaacacgtcacggatgtgctcgatgttgtcctgcgcgcacatctcgccgccggaggagctgcttcctcccccgaatctgccgataccaaagcaatggaggatgtagaacccatcgaccaacaacagtttcgacggcgtcaggtcgtcgaacttattggcgccgtctgcgtagtatctcctcacttcggcaaggaagttggcggcggcgatctcacccaggtagcggtgcagcgtggaccgctgctcctgctcgtcgccggggagggcgccgtggagcgccgcaagcttcacgggttccatccgctggtcgggattgcggtggtaggggccgacgaggatcgagtcttgggtgtactgggaactgtcgacgttgcgaatgcctctcttcaccattgagatgtggtactctgaagaagggacgattcccttaaccttcaaatcaaattgcgcatgctctcgtacaaaccctcaaccaatgccttcatgtcgatgattgtttgcggattggggtttcctgcaaatcaaattaaaagagcccgttgctaccattttagaccagagaggcagagactatctaatgatatttacttatatactatttacatcgtcagatttttttctttttcacaataatattattgaacgtctacaaattatatggtaaactattatatatacaacaaattaacgcttggacacactgagagataagagttagcacgggcattttaaaattgaacaagtgaatgttattttcaaccctcccaccccctccccccctcccccgggcttaaccatagaagtcaaaagttcatcatgtacaaacgtagacgctcatagcgcgtcatgttaattatagccacaagtcatgctttttgttccttgcgtaatttctgtgcatatgttttcaggcatatcattaacatctgatataaccacaacgtcattcattttatcataagaccacatataaaaaaatataaattccttttggaatactatactttgttggattatcacagtacatatttttaggatgtgtcactattttagtaaaactagatatgtatcctgcgctattgcacagaccctgctatttttctaaatgttaaattgttttttggtaactaaaatttattagtaattacatatttatatccgatacgattttttatatataaggcaatcatacgtcatttaataaatccatcgaggcttgcttgcaggggaagaattggagttcttgtttgcatgcatcaagtttaatatatactactaaaattgagatcttagataatacaaactaattattatttgaaatttgttttttcaatgttttccttagcgactagcgcatgtctcatggctgatagtggtacctaattggttgttcataacattaatatcaattccaataattttaactagatatggagctcctcggcccttttcaaataaagatgatactaataataatatatagatatacaaagttcaaaaaaggtttagtcatcacaaattagttgtcaagggattccattgttgtcatgtgttggtggctcgttgtgatctttgctggactcatgtagtattgtggttggttgactagaaacctaatgcaacttgaccctagtcatcgtcttctacaaccctactctccttgtgacggcttaata

SEQ ID NO: 81744 - DNA, 14503 bp, Oryza sativa
catattttaagaatttttcataaccatttaacggacgaggagacatagggcttgttcatattgatgtcattttcaaccataccattttttttataaagttgccaaaataatatacgtttagtttgttgccaaaaatttggtaaatatggaagaaatcctagcaaaattttggtattggctacaatctgaacatgcccatattcttaagaaatcaaaacatttcttttcctatatggatgtaacaccatacactatcactcaactcaatatattctttttcaataatcaactttcagtcctcaaagaaataacaatcaaaattctcaacgtgagatgcgtgtggagagatctgtccaagtctaccatccagtctctcgcccgccaccgcgcgacaccatcttaccatcatatccaaacaacgtgctacccttgtcgatcgatcagtgatcgatgttgagaccgacagatattatcgcaggtacatgcacgacatcgagcacgtacgcacccgcgctcgcaccgcatcggacgtacgtcggcgcacgcgtccgtgatggcgtgtgggggcatgtacgtacgttcagggtaagttttatagtggaggtggatgtcagatctaatttggaccatgtcatcgtcttcttattaattaaaaggcaacgcatacaacatatcacatctaatacacaaaccaaaatattagtttactctcacatcatttttcacttttcttggagattgtgtagagcttgccccttgtataagagcaagtttaatagtatagcatactactagcttcaattcatccgtagccaatctaatagctaattcatacaatagttgcttattatacttttaatatatggtcccacatgtcatatacatattgtgtcttggagtccgtgctgcagctggctacagatctgtagcccgttgttcttctctatcatcttttatcttattaaaatatgtttatagctagctaatagtatactattgtacctgctatgagggatggcttattctctctcttcttcacctcattatctaccggcagcagagccgcgccgcggcggcctatcctcctgccaatttttgcttctccaaaaaaaaaaaaaaaaagcctctctgcaaaccgcgcggtattgtcgccttgttcaggctaccccatgctagcttagctctactaactgcacatatcgccaatctatgggcgcagttttccgtgaaggcgccgtgggcgtgctctcgcgctgattgggtacatgtggttctctcaaggtaactcttttttttagagggaactcttgttcagttttaacttcagtttacaacattttttaaacagtatttcaccactttgtttggagaccacatagttcatcacgtggattatttacctgtggtacagtctggctgcccgctgtgtgtacatgcatgtgaaatttaacatcccccaatttatttcttgaggttaattactccttttattctttttgcgagcattttttttaaataaaaacgaagccagacttgctgctgttatattaaataggaattgagtatatttacatattcactaacggcgcaaagaagaaaggaataaaaacaacaaaaatacatttatatctttgcataggcactagatatgaactaaggtataatattcttgcgatatctttggcgccatacatatatatatatacctcacacctagattaattttatctatgattttaaccattagctgttgcattggagtttctttatttctgaaagcacttttgtttctttcacaccaaatcttccacacaatgcaatcagcataggtagtgacttcattgtcttagtcttgtgtttgcgaggaattaatcttatgaatcactctagctactcctagcttgctagtcttgcatttaatttaccatctctaattgagggattggataagcatccaagatatgtcttagtagctagaaattaaactagctaaaaaaatattgtatatatttatggtccctaaattaatccatatcctgctactgagctgtaatgtatttggatgtttgcttagaagtctatgcttgcatgagttgctctaaaaaaaaaatatcagctctcttcctgataatagattttgggcatgtgctgcagtccatgtgctctcctctgtcttggctaggccgcagaaatcgttcagagatggagtaggtgtgaggtgttcttttgtcatgacccagctgcctggcatttgcccatcacagtaatttgtgcggtacacgatgctatatagctctagttgacaaggacaaactttattcattgcataggcaggcgtgtcatgtcaccttgtgccacttgctcgccaacgacatacgctctcaaatctttgtgtatatatatattctgtttgtttttgtacacgtattttgtcttcactaattaatctatgtttggtgaggcacaagaacacatgtttgattaattacagtgtaataagtcatatggacacaggagccgagaggcccgagagtagactatgtcaaaacgattgagcagaattacaaccacaactttaattctacatgggaacaaagatggtgcacgtatgatttggttaacatatatggtcgattttgctgcaaagcttgaggataaaatactagctaacaagtcttttctttaaaagaaaactgaaaggggatgtgctctatgtaaagactaagatatcaacactgtaagcagtaaaggttgcacaatcctcgcaatgtctaacaaaatttctgtttgtgtagaatccacagtgtatagacaaagctagcgcgagacaactgatctatttctgaattcattctcagtatctgttagtttaattacaaaccagtttacatactattgcgtttaacaatttttttcttcgatggagaatgggaaaaaaaatgtgccaaatatggtctttatcaatgcggaccatgcatgattcatccgaattttcccagcgtagaggacttatctggctagggagggtacttctgttcactatataaactgggctggaatgttgctacaccatctttcataccaaacctagccattgggcccgagagcacttttcaaatagaaaacacaaaaagccactgtgcacgcggggatctcccgttccacctcatttagtcccacctcggaaaactagctccacacatcgcagcataaatagccggattgcgccccttgctgtcgccgagctcagcagcgcgagcttgtaacccgagcgggggcattaaggtggtgtggacgttgcggtacggctgcgggcctgggtcggcattgctacagatggctcgcccgttccaagttgagtagtgggccggcggggcttgtgcgaaagctctggggccccacggttcctagagtggcaggcatggcgtgaggctggtttcacagagcagcgaatactgcccgcttccaacggtggaaggataacgggccgccgcactgctggcccgcttgggtctcgcatcctactccaacggaccaccacttttttatttttcttagaaaaataaaaacttcgttctgtttttccagctagctagtccgtgcacaaaatctttttttttttggttaaaaaagaaaaacttctttctgtttttgcggatagcaggagaagtgtccagttcgtgacttgaggtctctttggacttggaagtacaagattctcatagaaaaaagaaaatagaggattgcaattccttggaattttttttatacatgccatttgaaaaagggatttgagctcaccaaattcctatacatatgctaatagtattacaagtagaaagcaaatgaattttgtatgaaatgttgtttggaacacatggttgtcctgaacacaaaatttagattctatcctacgccagctagtgaaaaaataatgttgaatgttcagaaatccttccgaatttatatgtttttatggaaatcaaccaaattcctatgtatgattctcatattcttgtgggattcggtagcatatgacattctaaggattcctttggaacaaagaaaaaaaatagaggaaatctaaagtgttaaaatcttatggaaaataatcatacttgatcctctgtaacaaaggataagcatacgcaaaatcctttgaaactcccattgaatgactcatttcattcatgggaaatttggaggaaagcttgtaagaagtatagcttcatgttttcccttgtgtcttagattcctctaagtttcaacagagcaagatattctgttagtagttttttttttccaaatcctgtgtttgaaaggagctaatcctacgttgttttctattcccttgaaagaaagggaaaacagaggaatttcaaagaatttgaattcaatgaaaaaatttcctatgataccctttggaatagaggattagatctttaaaatttctttgaaattcgtatggaattgctgcttgtaaattttagaggatttatatcctatggaatagcatgtttcatgtgaattttagaggatttatagtatgggctccaaaacctcctggaatttttcctttgtccacctcttccaaatcctgtgtttgtcatgtgctccatccaaacagcttcctctgtagttttcctatgttcctcgttccttgggatttaataacagttgttacatggctaaaaggattgtgattgtgatgttttagtgcacttgttttttctgtcccaacaatccaacatgcatgcctgatgcctggttagcatgcatcatcaaagccccatgcagtccagatttaaaacgaggtgatcaccaactgcgttggagacttggagtctttaaagtgaagagaaaaagcacaaaggccatcacaggacactggttagcagataccagcagccatcaggcaaggcaaagttcctcacaaataatggggcggctaccgaatttgttcatggcattaaagcaaggaaaacatcccgtgaaaagatggacaacttcaacatttctgttcaaacgggcaggcttaggatacagcgacacagagacgttctcaagctcacatattatggatttgtatcacacagcaaggttttaatgaagtccacagatcccatatgggatatcaacacacgcattttagcataacagtatttacgaatctaacaaatatgagtagcctttgacgtgacaatggctcatagcagcttgagaatcatatctgcaaaatgagatacggtggaagttagttaacggggaaaaaggtttaatgaatcaatgcatataggcataggccatttcccatatatggaaagtgcagtgaatatgtaatatgcatgcattaaagaatgcatttagtgaactcaaatttgtggcgtgcatttacgctttaagttagcaagcatgtgaaaatgcgatacagtaaagtttgaagacatttgtatacccttctatgattttgcatgaaaatacaaattggccttgaaagactgcatcgcatagagaaaaggtatgcgtgcaagtcactctatacacactgtctcgataaatgcaacaaagttcactatgtcctgataaatgcaacaaagttttagtaacgttcgtccaagtgttagggcttgtagccattgttaacctccttgtcaaaattttggtaagatggtttgatgccaaattttttttggcaaagatactttaaccttttgtctagccttcccaaagtattggcattgtgaatttttgcaacagaccaaatgagcctataaaagctttgccattaccaatattttggtgtggttgggttgagccttatatggtgtttggaagtaaaatcaccagaaaatgcagtcactccaagatgtagcactaagggggtggtgtttcacataaagggaaggtcgacacaactacaaagggcaccacagcaggatgttatgaaagccagccctttcaacacaaacaagggtaacaatagtaatcaaattacaaataaatggagatgagatttcatcactgaggaactcaacataaaaaatacatcatgaaaaatgttactttatatattcggtgaagagcttgtgctacttacattaacaaatgaacattctgtgagtaggattaaataaacaaactgatagtaggattaaataaacattttgtactaccaatattctgtgagtggcttcctggcatgtaaggtgcagaaaactgcttgcgtactgatttaactgtcaaatatacaattgagaaggcaacataaaaacaccaaaaaccttttaatctaatagctagcccagagagtttaaacataattttacatccaaaacatgctgaacattcaagagtaaaaagacaacttttatgtttcagcaggtaaaacaatacaatttacacaaaatgaataggtgttatcatgatatcatctgagcacaccaatgatcactggtctcacttcatacatgctgttaagggtgctcctaagttaaagcagaataatattatccttgttatttgctatcctcctcactttttaggtagtacaagaagagtaaatcattatcaaaatatcaattccgtagtaagtcataatataggactaccgcatgttagctgttaaaaatcctgaaagtcattttatgtcctatcacaattcacaacactacatacctcccaagtaatcagccaacagaagagatgatttgccgcatgtatgatgctatttgatattggaatacacagaaatttccattggtgaaattaaggctgtttggctgcctgggctgcatctgcgccacagacaacagcaacagtgctgcaagcagcaaggaaacagcgggcagcagcagccgcagccacagcccaggtagccgaatggcctgattgttaggtcagtgataacagcatgactcattgttttattggcatccatgttatgcaatgacgatgtcttcagcacagggagcatgacatgaatatgcaacacctcagtaaccctcgccatttgacaggtaagatgtgaggtatggttagtcttatgtttccacaaatcttaaaccatagcagcatagccattatttttcggtgcgcagctgcattcagaaaggccaaagtaggagtataactcaaggaaacagcgtggtcttgtagatactagatacacaccacataaccaccttcacattctccatcaaattgataaaaactaaaacaatatttcacaagtgcaacagaaggtaagtattcatgtatgatgctaggggtggctatgtttatcacctgaagtgaaatccctcagccgcgggccttaagctcagccaggcggcgggagaggtcgtcttcatcaacagccttctccttctccttggcagctggtatggcgtgagcggcggcctgcggcaacccaacggagacctcaaggccgtagtcgtcggcgacttgctgcatgaggctgttgacctcggtctcgggcgtggagagcgaggtggagccggccatggcgccctccatgaactcggcctggacctccatgttgacgaactggcgctcgaagttgtccatggtctcggacatcttctgcaggttccccgtggcgagcgcggagtcgagcgacttgacgatgttggccatggacttgccgatgacctgcatcttcgcctgggtgtcgaggcgcgcgacgacggcgtcgaggcgggaggcgaggcggaggtagttcatgtgctcggtgcgcttgcggatggcgttctcggcgtagatccgcgcgccgtccatgttccccttctcgatcgccttcttcaccttgagcttctgctccttctcctccttctcgcacttgcgcgcctgccgctgcagcgacttggaggtgaacttgaggtcgaagatctgggtcatcagcttctccgggttccccatcgccgccgccgacgagctagccccgatcgtggatttggctagggtttgacgaggaggaagaggaaaggcagatcggattgggggatttgggaacgcgtcgtatttgcgaggagacgagacgcgaattggggatttttattattggggagatgggattcggttccgtttgatttgattcgaggaggagacgaccagtcgaccacgcggtttggtttagtgtacgccttaacggcgaagtaatccccgccgtttgtgtgtcgctgcgtgtggggtcggcgtgtccaactccaaccagtgtcgttggcgtcaccgacgccgtttggataaagcgttttattgtatctctaattttggaataattaattactagaaaatagatgcggccttgccgcacaatgcaccagccaatatgaaatattccatccgttatatattgatcatcaattgactaaaatcaaaaatttcaagttgattattatgtaatgttggtgtagttactacatctaagcatgaaaattgggtttgcatgcatgcatataggtatttgaggtagtaaagctctcttttcttgttgggggggggggagttaaaagtgtgcatgtttccttattcttcaccaccacttacttaagtttttttttgtgaaaaaactaatcaatatgaaatgggaggaataaataatatctatctactactacttaaaaaataagaggtgcttccatcgtccgtcaaaaaaaccgggtgaaaaaaaaccggaacgaatccgattcatcaacgcggtaaaagaaaaatcgggaaaaaaaaagaatatgtccgattccataaaaataggaaacaaacttccatctgttataccaagtcctattcggttagcatcaccaggagaaccgacaccattcacagagagagagaaagagacgatgccgccacctctcccgcccccgtcggaccgcagccgcctccatgccgccgaatctggcggaggcgaggtccggcccgccgcccctcccacccccgccgggctgcagctgcctccacaccgccggatctggcggaggcgaggcccgaccggcgttccatgacgtccgccaccaccaccactgccgcacctccccaccatgcacagagagagagaaagagacgacgccgccgcctctcctgccctcgccggaccacagccgcttccatgccgccagatctggcggaggcgaggtccggcctgccgcccctcccactcccgccgggccgcagccgcctccacaccgccgttgttcggggagagggcgccgcgccgttggttgtgggggagggcgccgccgccgccgctcgcgggaagagaggcgccgtcgccgccgctcgggggcgcggaggggagggcggcgatgtgagatgggagggagggaaatgggctagggtttcggcggctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctggggaggggaagtgcacttgcgcgtgcacaaaaggccgtggaccgaccggcaagggccggaaataagtctattttaggtccctcaggcccaaaaaaagagaataagttcatttttagtgctcattttttcagaagcattacaattataagttattgaatgtgtttatttcgaagcaaacctaaaaggaaggattttctttctttttccaagtaaataattgttaaatgacgtttgtattaataaaattaacaattaagctctgaaaaattcaaatataatttcaaagagcgtaactaatcatggagaatttaaaaaaaattaaatttaaccatgtcattttatttctcacacttgctttacttgtaaatttatttaattatacacatacctacttaaaaataccaaatatttcaacgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtggtcttataagtacatctattttctctatctatttaatgcttgaaattatggaaatttacccttttattcatatattaattgaaagcagcaagacattgagatgatggacataagttggaagacgaatatgtgcgtacaaattctaaattccaaccaaccaatgtaatgaaactacttattttccctccacatgttccacatgtgtataagaatcgaggaaatccttttttcaaaaaaaataattttatcttcttattccttaaatataacgttctaagtgcataacattaaaaagttcaagttacacagtaaaggaaactaatgaattgattatttgtttgaaaatttggtactcaaggagcataacgtttgcatcaagcgggagcaaaagatgtcggtagcattcttttcccaaaattttaccttaattttcgttagtacacttttcaaacatcggtgtgtttcatgtaataaaaaatctatgtggaagttgctttaaaatatcaaatatatcaatttttcaagtttgtaataattaaaacttaattaattatatgctaatagttatctcgttttgcatgtccgcatttaatctaaatcttcgtcagattcgaacacagtaatctcatttgctagttcattctatcctgaataaaagattgcaaagaggcctggcttttttttattattgtccttcccagtccgcagtccccactcttgagtctcgactcctccgctgctctccactcatcaatctgctcctcgctcgacctcggtgtctccgtcttcaccgcggtgccgccgtgtcgctactacaacggccttcagtctatagccttctttgcatgaagctcgaaggcgcctgtgtttgtaagattgaagttgcgccggcaacatcagtaaagagaagtctgtgatgcgctccctgtcccccacctcctgcaatccctcctgcttctcgggccagcggccggatccgcagcccacgataccttcgccctccgcatccggaagacaactcccatattcccaagccgatgtgattatcggcgcaaaaatctagtagtgagctttggtgctggacaaagcaccagtgagtgtgagttgtgcgatacagctagcgttgcttgcgtccattcacttactctctgcctcttttgctcatttgcatcaccatccagtatcccttagtataggctcggtgattttggtactcgcctgcaggcatgcatgcatgcatcctacttgggtattttcctctctacaagttcaacgaaagatctaaagagaaccaatgatcctagggaagacactgcttgattttctttgctgaaaatatctcaacacgtgccttaatttagcaccaattgcaggtaattttaaccagttctttggtgttctaaatggaaggagtataaataaaggacacgagagggtggttcgccgcggcgtcatcggccgtgacgcgcaggtggcggaggatccggcaggccaccactcactcgcacacgccgcctcctctcctcctccgctagttagcgcccctcccttctcctgatccgggccgatggccagtgccgtccctcttctttctccccgggttcaatggatctggcaagtctgtattggcacgggcgttctcgagggtgactcctgtcggtgagatagaagcgttgaggaagggcggcagcatggcggcgggaagcacaggggagggcgaggtggccaggcgaatgtgaagaagacgagcccaacgccgttgagggagaacatgaagcgggtggtcggccgcaacgcgcgggtggcggaggagccagtggattagggtcgagcaattctgcaaataaaaaatacagtaactccgtagttttacgatgaggtccaccgcaacgaactttagccgtcgatacttaatcaaacggtgcaaaaggagtgccaaggagacacgtggccaggtgttactggtttcgggccctacaatcggtatataagatttgtcactcttaggagtgatgataaatgatttgccactggacccatatgtcatagatacgtgagggctcacatgttatagacagcgagtggcagataattaattgccacatcttaaaagtgacgaaaagttaaatatccctctaatttcacaatcatataaacttttttccaaaaaaaaaatattacagttccttacaagtggttgttggtttggacacttttccaagcttctaccgctatataaacggtgtgttttcttaaaataaatatataaaatttgttttaagggtgtgtttagttatttgggtgtaaagtttttaagtatacggacacatgtttgaagtattaaacgtagactaataataaaacaaattatagattccgcctgtaaactgcgaggcgaatttattaaacctaattaatccgtcattagcaaatgtttacagtagcatcacattgtcagatcatggcgtaattaggctcaaaagattcgtctcgcaatttacatgcaaactgcgcaattagtttttccccacattttgtcagggttatggataccacatacctaatacatacctaatagtagttgactaaatctcggcaggatccaccacataccatgtcttatacggaaactgacctcgaaggagttccagataaggaaagacaaccagagttctacatggaaacgacaagtactactcgaattatatccatattggtttccctagttctacttggacaaggggacacctatgggtataaatacaagcccccctaggaggacagggggacagacatccaccatgaagggatcaacacccaacacaatcgacatagaagccacaacatagaagcctacatatgccaagacacgccgccggatatcgacttcagggataagcacggtctgacgctgtctgttatacaatatcaatttttatacaatatcaattatgcgagtgtttccgatgttaaatcgactacggtctgacgctgtctgttatcttctgtataaatcatgcttgtttacggtttacataatgcctgatatttacatctgctcattatatcctgataattctagaagatccatgcagtttttcgaatacatactcgatattctctgctatatatcctgccttctagaaaatatttttcaggaataattgagcactcgagtaggtcgtggtcgagtacaccgcattatcgagaacgatctcgacaaatgcagaatcgtcgcgcccaacctaccaacgaagaccgacaacctatctcatagcaccggccatcgctggattactcgagaaaaggttgttaacggataattcctcgcgaacgccgtcggcttgatcacccgacatgattgcgaacggacatccggatatgctacaagttgtgtgtgagagtcatgctggccacatgatatgcacatgtaataaaccaactttagcgcccctataggtgattaagagactcctactcctggttctcgaaccagtaagacgcagtgatctctctcgcctcactttaagtggtcgagttacgactactgcctggtcctcgaccaacgatgtagcgtttctcccactacttccacgttaagtggtcgagttacgactactgcctggtcctcgaccagcgatgtagcgtttctcccactacttccaccttaagtggttgagttacgactactgcctggtcctcgaccagcgatgtagcgtgtctcccactacttccaccttaagtggtcgagttacgactactgcctggtcctcgaccagcgatgtagcgtctctcccactacttccactttaagtggtcgagttacgactactgcctggtcctcgaccagcgatgtagcgtctctcccactacttccactttaagtggtcgagttacgactactgcctggtcctcgaccagcggtgtagcgaatctcctattacctctatttcaacaaagttgatagcaggtatacaatatcgccaagtgttttacccagagatcccttaccacgacgacacctagcgttgaaacctatcctattgtccttttacgccgtcttgacaaggcctccgaggaacctaagggaacttcggctggggacacccagagccgataaggccttgtcggatcctgtagagacaaaagaccatgtaagacctggtcgtgtaagagttctcgccgtgcgtattaaccaagccgtgtgatcggaaattgagttttccaacttcacagctgggggctaggatcagtgcttgttcaaccaaggcaggtgtcacaccccgaagttttcctcccaagtcaaaatggtaatttgcaaatgaccctaagaaaatgcaggtgaaatcaggagaaaaccctaaagaaagtaatgcaaataataatcagacttgacatgcggaatttttcttgagttctacatgtcaaaattcattaacag

SEQ ID NO: 81745 - DNA, 21361 bp, Oryza sativa
ccgcccatccccttccttcccccgccgccgatccgccgccgccgccgcgtcccctcctctcgttgggattgggttgggttggtgggtgggtttgggctcgaggcgaagccggatcccggaggcggaggcggagacggagctcgcgatcgtttaacgacggtaacttggaccgatcgcgctgtcccccattgattacgtcggcttttttcctttttttttttctttcttttctttctttctctctactgatactactgtgatgaggcgtgaacgcgctacgcgcccggtgccgacaggtgggcccagatggagtgctaccttttttgtttttttttttgcgtgggccgggtgggcgctttttcttgccgtcgtggactcgtgccgcggaggggcgattcccatcttccacgcgctccggttcgatgtgggtgccgtgtcaatggtgaaaagaccatgtgacttgaactaaattacattcacaactcgtaataaagttctaaaagtaaaaaaaaaaaaactcgcatctccagcaatgtgaccctataataattacattcacaactcgtgtagttctttaagaaaaaaagtttccccggcaatataactcctatataggctttttatttttacatgggtttgataccgcggtgaaagggatgaggtgtctcggtatcagcatgtcctacagagaaaacgttgtctcgggaagagactaggaggtccaagagacaagcacaataggatagtcttaaaagagaagatgagaataggtaagtggaacctgaagatatgacatcacgagaaaaacggtggtatggtcagcgaagattgctcggtatgacgacgatgtggccgaacgatgtcaaccgcccccaccaccggccagtcaaggctgcatgttgcagtggacaataaaatttgacaccaataaacagatcggatttggacactgagaggtagatctgcaaagagcgattctaacgaatcacacgtcgcgtgatgactacgaagcaatttcgagatggttctatgttaacaggatagcttgagtggcatcgtagggtagggagatggaggtgacctggagatagggaaagatcgggttagggtggcgcaccctcaggggagaggaagaggaaatgttgaaaaaggggaaaatgaggaaagtggctaggaaggttataaatgtaattgagtcgctagcaagtaggacaaaagtctttaaccgtaaatacatagttctagaggtgttttctctatacgtttaattaaagtatatttagtaggtttattgccgaaacctagaatagagataagaccgagcgaatacaacacctatctaaacaatgctaatgtttggataagcagcaacgcttaatagcgaaaaaataatgtgtaaattttatatacatatactttgagcaacttaaaaattcaatttctaacgacgtactggtaaacttaagtgcaaacaatggagatcaaatcgttctgaatgatcttgtagttataggccttagagcatctccaagagcctagccaaatggctctctaagttaaaatttggctaacttacacaaaaaaaatctactccaacagactagccaaatgcctctccaagccatccggctgtctaaattccccaccagactagctaaagttggccagccaaaaccggctagccatatgtgggacccacgcctgtttccccctctctctctctccatgcagcagtgcggcatgcacatgtgacgagggcgtcgtcacctcgtcgtcgccgcggccggccaccgtcgccccgtcgtcgcgcggccggcccccgcctccccgtcgtcgccgcgggcagccccgccgccccgtcgtcgccacggctggccaccgccgccccgtcgtcgcgcggccagcaccgccaccgccaccgccgagctccgccctgagctccgctgctgcccccctctagatccgccgtcgaggtcgtcgcgagccgccgccgccgagctccaccccgagcgacatcgaggtcgtcgtcgcgagccgccggcgtcttgcctactgcctccccgcatcgccacaccatcgcgcgcggccgcccgcctcctcgcgtcgccgcaccaccgccggcgaagagagcggcaccggcgggcggagcccgagcagcggcggcggatggcgacgcagcccgagcggcggtggggatggggatggggcggcggcggcggatgggagagggaagtggggtttggagagaaggggagaaaaatgagggagaaggaggtgtcgaagctgacatgtgggcccaattatcatagactcagaatagagaggatgaatagagaggctgttggagtaaaatacagtttgatttgctaaattaaatggagagttggctaaatagacatttagagagtcaaatttagagagaccgttggagatgctcttattcggaactcggaagacctactacagcgcaaacaaccagcggctgcagctagccaatagtagctacaacctatagatgttgaagctagcaagtgtagggagcaatagtttgtgtgcagccgaacgaattggttgtccaatgcagcaagacggctgtaaaatttgggctaccgaacaaacccatactacggagtacatccgtatttttcttttactagaaaaaaaaataccggtgcgttgcaacaaatcatgagatgcagtcaggagtccaacttttatctcaagttagtatgtgagtttttttaaaagatttttttatacgacttagttttatatttcctaaaacaaacgaacttaaaatccgagtcaaatacttatctatatttctaaaagcgaacgatcacatggatgacgtaccaaagtaccggcaaaaacatttttaatttttataatagtagagattctattatctaaaaaagaacatctggataaaaaatttcaggatacgccttttaatcttgtcaagaacatttaataaagtaaaatagaaagcgacttgaaaactctaacgaaagactgaaagtgacatggaaaatattacacaggtggcggctaccatctgtataaaggtacgcacgtaatgatctaaacatcaggcagggtcaggtgtccatgcctgagtaaattacgctcttattaccagctgtatgcaacatgagaactttgagaagttttcagtctggaagaggtgcaactgcatgagtaagaagtactgatttaacagttgagcactctatgggtgaagaagattaatccagagtttaactatagtgtacaatgctttcctgctgggaactcaccatctgaaacatctgtacaaagatacaaccatgcagctatccatcagctcggcaattacaaattgaagtatggtgcaaaaaagggggacccatgttctctaccactccagttgcaagcctccccaaaaccatatgagccctaccgttctcccgctaggaggccaggctcagaagcctcctaaatatattatccttgatcaatctttgtaaataagagatacaacaccaccacatgcttgatctgcatgtaaggaagattttgatttttttttctccactcctgttactcccacattataacaatactcatcatataactttgagaaggccgcataactagaagagctaattcacaagaatatatactggtttttctatctgtccaataaccaattaagcaccgtcttttttggcacggttccatcactaccttctttctccgtcttcacagcagtatttacagcattacggatgagagaattcaagcgcaacctcagttgtgcattgtcaataagcagatcagataacatttttgttgtctcttcatcagtaacatatgcatcttcactgctcatggtaactgaggatttaccatcagaattatcaccatcatcagaagagccctgttcatcatctcgtgacagaagttgagcctgagagattgagagaggatcattatagaacacagattgtgaatgtaaatgtaactaacagatccgctttcatgggcacaaggaagtgagaacttcatgaaaacagaagcgtaactttgaatattcaaaatcaatttctaaatggacaggtacataacactgaaaacaatgtcttctgtaccaagatgaccattacattggtcattggcaagacttcttttttaggtatagtggcgccagtatgtaatctaaagtaaatgcatctatgactgtaaaataggaaaaaaagtttgtgaaaatatagatcattttactcattttgttaaatatagttttactgactctgaaatgatatcactcttcagctgggaagatgaaaactgttccccagagctaaccaaaactaacacctaaaccttgttccaatagaatcaagaatgcagctttgaaggcccaactaggtggctcaaacttcaaacataagcagaggctgaggaaactacaaatcaatttaggccaggagttgttccaaatctgactccagatcctttgaagaatctagtgtcaggtagtgtctgatgtttccgtcggagtttgagctcaactttctaagtgtgcctttcccgtgagaagctagaaggagtttgaatgacaataactaatcaaaagatatttaaaacattacctcagcaacaagcaaacgtattctattgtctgatgtcgtcacaagatctaaagcatcaggcaaagatgataaatcaatagtcatagtgtcttgctcatctgcaacaaacttggcagtacattcctgtagacgctcacggagcagtctgcattcgtgaagaattttttcacgggagaaccttgcacgtgttgaccgctgtttctccctgttaacaatcctctgtaatatataataaatacaattagtagctagagagaatgccgattgcaagaagtataactaccagaagcttgaatttaagaaaacaaaaaatggtaatagggatagattggatcaaagttgttgataaatcagctgttatgagcgttgatgcttgaagcacggacagtaatgcatattgtagaacagaatatgggaagggtttacataccttccaagaatatctattgcctaaataattattagtttcaaagcatgggattggttattttgtaccctatctatcagttaggacttaggaaggatctgatttagctggaaaattaaagatgttttttaaggtacttttacactgtcaaaatcagagtcataagaaagtaatttcaaacatgaatccaataatatccttttcttatggtaaaacctaaatattattggattaatagttcgtcaaagctcttcaaaattggacagtcaaaatacaccttatattcctgaacggaagagtaatgaccttcttgagggtcaaactactatttacatgaaaaatacccacgggtgtgtatagcagcagtcttgagttatccctataaaaggtaaggtttctgcccaaaccctagctaatcaaagcctctagccgtgccaggacaagcccacacgacctgagaagatcgcactatccttggtcttatgatcaaccatatcattagtgtgcaaagcaaaacaacaaaagaacacctcaccccttcattctctctctcaatttctttagttaagtggtgtacaaacaggtagcattaaattaattcaattgtcctccaagagtgattatatatagataaagaaatcgctgttgaatctagcttgtgtagatagaaatctttattcagccggccttgacaaaaggaatcacataaagaatagatggctgtgctggttatataataaaaaagggaaaaggtccatatgtttgttgatcaaaagaagactgttaagctcatcttgtcagataccaagtaggcaagtacaacaattcatgataatattccaaaaatggacaacatgttgcatgggtggtggagatgcagaaatcagggtaataagttagaagtggaaaagcaaacactcaagatggcttgcatgctttcaaaggcttactcttgtctaatgacttttttttttgtggggacttgtctaatgactttgacaagccactttctcttagctacaaccaaaatctagtttgcaacttgtaaagggttatgctctcctggctttgagcaatgagaggccagccatagcaacaatttcacacaatttatagatactatcatagttctgcgagaaagaaaagctttaaatttacatttatacctctaattcagtcttctcctcatgatactgattcagcactttcttcatctctttttgggagttccgaagagatttcacctctttaacaagaacttttatatctgctttagactttgcctcgaattctccaatatgttgctgcaaactctcaacttcttttcgtttagtttctagctcttccagtaacatttctttttcaccgctagcagttgttttctctgactgcacacgagttttctcattctgcaattaagtagaaagaaatgtaagaaaatacttgtaagatggatagtaagaaaccaagccatgatgacaaagaggagacaaagaggaaaaccaacttgttcaatcttcaggtttgactccatttcagagtacttcctgtagagctcatccttatcccattgaagttgggtaattttctctctttcggtcaaaacagcctgatgtagaatctctttgtcttttttcttcgtagcttccaactcaacctccaaatctttgacctgcacagaatagcagagaagcacaagaacaacgtacatcaataaagtatgaacaaaaaaacacaaatcaatttattttaaactcgtgacatataaaacaaagcatatcatgtgtttaagcataatccataggcatcacaaatgaatgtcaggtagaaaacgtaacctttgtcgcaagatattctttgacagccacttcctgatttagtcgtgctatgagatcctccatatcagtttttgctgtcacctgtcttctgtccatgctgatcaaaagtctagtcaacttcggcctttgatcagcaggaaggatgatttgtgcatccatatcatataaaagctgcatatctaaacctgtaaattgttctgtttggctatgtccatcaattccacttggaagatccacaggaccatcccaaagggaactactaactccaggaaccgataattcactgcccctcaaagaactcaaatcacttcctatactttcagcagagtccttcctggcatggccagggttagaatcgtgatcctcttcggaaaccactcccttataagtatctatggaaccattcctaacaccatgttccaaaaagacatggttctttttcctgtgatttgacatgctactagcccgctcattgggctgatctaagatagactctcccagcataccattaccagttgctcctgtcggaccgttaccatgagcaaaggctgaattcatttgactggactcagagagaacacctgaaccatgttcatcaggacgcggagaagaatctgcactactttttgctgaagaacccacttcagaagggcgctgattccaatcttggtaatctttcattcagaaaaatagcgtaattaaacatttgctaaaaatgttaagaaattttagttaataaatggatcaatgcacaatcaggaaaaagtgtcttcaatagaatatgtcaagcggaacatacatgagcgtgcagcagcttccagctcaagaaaagcagcaacaggtgcacttctcgacaactcaatgtcagaaagtagcttttgcatccactcctccaaagcgttccttctctgcaaacaaaacatttcaagaaccaccggtcaaaaaggctaagcacaactgaatgtagtatttgacatcgaacaaagcaaaaattaatcaatatacataacggctaacctcttctagaagcaccctgcttgaatttattcttgaaaaggcatgcttcggtggagcaggggggattccttttctgggaaattcctgcttaagctgcagtacgggagaatcttagaatgaagaaatgatattggattagaggtcgaatggaaagtaataatctttttttctcagaatcatatccaagatgagacttccaaaatgtccacattcattatagaaaccataaaattgcaaaaggtgaagtcctcattatgaagtcaccagcggaagatgcaaaaatctgtaaaaactaatttggcccaggtaagcataccgtatacactaagtcaagatttataataacagtatgttttaaagtatctgaagtctgactacctgtgtgatgcaatgcaccaaaaatcctaagttgcaacggaagtcactggagaagcaagcaattgtgcattcaatgcactagcaaatgtaagtccaattcaaaggtttgattacattttcaaatttaatgccagataaattaatctggcagaccactcaggatacgataggggattattcttatttaaaaatcactggaggttgttcttgaaaggtatgttccaactgaaaatgttagtgggcttctagctcaggaaagaaggtcggtacaatttaaagacacttggcatgtgaaagaagaaaatagcaaagaggtgtctcaacttacatcagaagataactttagaaagtcactaaaccttcgaagaactccgtggctagagctgatgccttctggagattgtataccaacatgtatcctgtaaaactgtcctttatgggcattaaaatgagatcataaacagaacagtatcaaagttcacaacaaacaggaattgcatgatatatgcaacagaattacataagtgtctcttgcccgtcgatcacgactaaactagtgagccaaaagagaggtaagatgcaccacagttaccaaaacaccaaaaagtatatttctgccagtaggtcaccctgaatcattagcacaatacttcctatggcatgtcatgttggcatacaccattgtggcatgggctgcacgtgagttaatgacttcagccatggctattgtgatttgcacttgtcccccatgagttttggccttacatagttctctctcacccccaactcaaaccccctgtgtactgagacaagtgaggcagttgtgcggagagggagaatcacctctagtgtactgcacgtcagcgattggttatcacaacaaaatttgcaccccatacaggggtatgcctcaacacgccatgttgtcattaagagtcaggacagtgtgctaacaaccaaaagtgaccctttagtgatctaaagaaaagtacagttttgtgagtccagcagcctaataaactagtttgataagtatggtggaatattggaaagtgacacgatttactcaaaatgaaagaacaataaaaaggtaatacattagaaagttggcatccactacccaatatgagatagttttgaaagaagctcagttcttcgttgataagtgctgaacttcttttgtcctttttattggtctaacaaggttttctcacttgtaatccactccaagcacatttatgttgtagcatagcggtaataccagagacacaacatttccaatctgtacgtcaatccaaattgactgacaaaaataacgtgatgataatataagcagtactcacaactatggatttcaagaagttgtcagcagtcgcactagcttcaggtgtctgagcgatccaagaaggaatcatcacacagtaactccatccggtttgagggttatgtggccatatggtgttccttccctcctgcagatcaataagcataagccgtaagaagcatcaagcaatggaacttttcatggtatcctattgatatggcatcatctttccagcgaaacctagattgagaagttatgtggtcttcatggaagtacattttctttaatacaaggaaacatcttcaaggaactttcccagttgtttgaaaattactgaattttgttaacgaggcatgtgatttacttgacggtgaaaaagaattgactaggactagtaggttaatcttcatttgcgttctaggatcatttcatgttaaatgtggtaaagatgttgggaaacacaccaagtgcaaagaatgaggctagcacaaggcaggcaggtcaaacaaaagagctaatcttcacaatgggaacaatgatgaataataaaatcaccatcagcctgctcaaatatgtatacgaaatcaattattgtacttatggccttatgcgtaacagtatgaacatgcctaattgcctaatatagaaatccaaagcccttatgtccgatggactcagacaaaaccagagtctttgaaataagcagcacatatacaaccaaatcaatccgcatatcatgaagctgaactgcactcggtttgtctaaacccatccccgcagaagtagtcctacctgaaacccatactcgactccttgcaaaagaaacaggaattcaaaaccctatccaggggaaagctctaaaacaactctgaatcagtagcaacgcaggcactccaaaccaacaaatcccaatgcagatcccaacccacacatgaattcctagccttacattccactactattacacaccacatagccgcgggcaaatccagctcgcgatatcgttacgatcgagaggacaagcattaaaagaaagaaagaaagaaagaaaatccccgacacctcgcaactaacgccgaatctgacgcacgcagcagcaacgccacaggatcgcaagctcccaactccaactcccgaaccgcacgtccctcacagatcaaagcagggagccaacccaaccgaacccccgatcaatcgagcccggatcgaaattagcgggggggaggggggggggggatcgcgcttacccatctcttcgggggcgggctccagtccatgccgaacggcagcccggaggtgccgtcgtggcggtgcttcggcgggctcggcgccttcttcctcgccgacgaaaacgacgacggcgtcgccatcgccgcccgcttcggcggtggatcgagcgggcggaagggtggggtgaggtgggagggaggaatcgatgcgggggtttggaggcgtcgcgccgacgattccgaggtggacggagtggaggaaggggagggggagtaagagggcggcggagatgaggcggacgcggacgcggacggggagggaggggctctcctcccgcggtggcgtctaaccgtcaacgcgcggcggtggcagccaagcgagggcgtcggtccggtccggtccgggtctaggcttttccaccgccgtgtggggtggtggagttggtggtgggccggcggggagttgtgtgggtttttcgcaagcccacacaagtgtaattgttggatgtggccatggctgccgacagataatggtatgcacttcttagtgacgaactggttcagtacatactactaggctgtgtttagttccacactaaaattgaaagttcaaagaaattgaaacgatgtgacggaagagttagaagtttatgtgtgtacgaaagttcaatgtgacggaaaagttagaaggccgagtttagttccaaattttttcttcaaactttcaacttttccatcacatcaattttttctacacatataaacttctaattttttctacacatataaacttccaacttttccgtcacattgttccaatttcaaccaaacttttaattttaacgtgaactaaacacacacgaagtttgaagaaaaaagttagaatctaaacaatatctaagtagaaaaaattatggggttcaatacatctatagttggaggaaacaatgaccaaacacatatttgagattgtattgatgctcgaaacaataacaaaaaaaacatgtatatctctatctcttctctactattataaaaattagagttgtttttgcaaaaattttggtacgttttgagtcggttttaagttcgttgtgtttgagttggattttaagctcgtttgattttgaaaatacaaaaggagtcgtataagaaatctctttaaaaaaactcgcatactaacttgagatgaaatacggatccaagcgagttcccacaaaccatatataatattattattattattattaaaatagcacttacccgttgcaatgcaacgcatgggtattttttgtagtttgagtaaaaaataacgaaggaagcactaacagggtttgcaatactagggtttacagtactgaacgaaaatcgctccatttccatgaaatcattggagaccaatttgtgaaaaacaagcagttttagttagttgtatagaattgaccaaaagtcgtcctcggtttttaccaatttttgtaaagcagccaagaccattgaactctgagcactacaagctatgaactgtagttagtactgtaacttaaaatctgagtcgcaacgactcgcactcagaatagacttcacatcgtcggctccatactcgacaaagcactaacatccatttcagaaaaagtgttgccaagatatagaaacggtgaacgaacaaatgcctgagaagggtgagtatgagtagctcattgcaccacgatacgcgtattcttagctaattaaccagtagccggcttactgatcagtataatcgtcatcatcaaggccaaggactgccaagaagtgcacatctcatgcaacaaatagaagtcctttcattcataggaagcgtagaaaagtaagaaaacaacagtttcttctacgggtgaatgaacatctttgatattacaaggttccctcggaatccacatacaacacggatagtaatgctgagagaccaggaacagcaggcatcagaaatggttccaagaactcttcgcaatgataaatttagtccatcctgcccttgatcacacactcttttacttcggttggtgtcctgaaaacccaaaagaagattatgtaaaagaaacgtattgatgctcaaatgaagtgctgaaacaactaaaatgcggaatgcggtaggactttgagctccaattatatttgattgggaaaaaaatcattactgatgaacttctaccaatttattgcagaacggtagataaaataatggtgcataacgtattttaattcaaaagctgtttaacagaagaaaaatgaagccactcatccaatcttgaattagtgaagtgaacttacacaagcagaacaaagcctccccaaccactgaggcaatcacgatcaactgatgactgcagagcttgtgagatagtctcaaagagttcttcaggttcctttgtcaagaaaaataatatgttgtcatgtaacatctatcattcaaaatagtggtagaaatctaaacagtacaatgcaacagaattataatatattatacagatccaaacagaaatgcgaaattgctatagcccatgatgttatcccataaagaatgttacacgggctaaatgtgatcatacaaacaaacaaatgcataccatgtttggtttgtacatggactcacaagcaccatatagagactccgatgctgtccccgatacaacgaaatccttagctagttccctgcacagaaataaacatcctcaatcagctcacaagaatatgagaaacaagcgttcaaacgcctaatcagacatatcaggcacacggacttagaccaaaaacttaaacaggtggcatgctattggaataatagtatcaaagttgtttcagtacatgatgaagcagatagaaaaaatatatcaaattcagaaaggaacaaaaaaggaatcaagcaaatctctgatagagcaagttaccaatgtcaagcatgcacacatttctctgggacagagacggagccaatcgtgtttgggtgtcatggaattcaggatagaaacaagaatggtgaacccataaatcacgttgttcattcacatggggtcttttgttaatgatgatttagaaatttgggaggtaacctttgttagatatgacaaacatatttataaattaaagatgtagataactccccacctaaccatctaaatgtggaataagactaaggcgggcatattaatcaatgcagtaaattgcagaacatgagcaatggataaccatccagatgtgtatgaatagatccaaaagaaattaatttgaataaaaacaaaaacacaattgaactgatacatactttgcaccaatgcagtccatggtacaaataaatggctcattgtcctctccaagtccagcgataacaggctggcagaagtatggtccaaatctgaattttccatgtatcgaaaaaagttagataaacttacccctaacccaataattgtataatacaaaatgaagaaagctgtttactaatagcacagagaaatcacaagtcttagcatgcaaactttacttactactatgccaatcataaaaaggctattgtattgttaaaatgttgagaggctaatgattatcaatcaggaatttcagctcatatttcccaactgcccagaagttatctgtcaacctgattgatgttgagctaatttctagcttccacatcatcataaaaaaaaatcaagcatttgcctataaatatttatcagggtaaaccaataaccgacataaatctcgattctggtgctgcccttggtgctaggctctggcaacaggctggtgccaagtgcctaaccaagtgggttaagcgcctaagtggcagcctaggtgaacagctataacacagagcacctatttcggcttggtggttgtcaagcggaacactactcatatgagtctgttaagtgcatatgagttactcttttggtgcaaacaggggaaaatctaaaaggttcaaagcatatccatcaatccatgtagagcttactacatcaactaaatcgagagtttactctttatgtgccatttgagcaatcagcaagctagcaaccctgcctacaaacaattatcaaaccaacggcggcagccatggctacaaccacaacattatggctttagcttcttagtatgctcatcgtgcaatatggttatacaagacttaaatgtctaagcataacttgggtggttgtaatgtgttttctgtctgtcacaagtagagcacacatatcctttgaaacataaacctgctgcctttaacaattgtaccttcacatagtcaagttattgtgcaacaagaacaaatctaactacttgacaggcgctttgtaacactataaacagtcagcatatctacaaaattctgcatctttccgcgaaattgaatactccaattggcatttgaatttaactctgcttcatatactactcaattcaactcgcgctgcgctagcaacatcctttagttcattacctcttctcgtagaggagagcggagacgaggctggcgaaggtctggggcttcatgtccctctcctcccgcagttgatacagcttgtgcctgaacaccaggcgctggtacctgcaccaccgaccgaccgaaaccctaattctcccaaaccggatgctaaaccaaaaaagcacaaagaggaggggacaaatctggcgcggcgactcacagcgtctgcgcgtcggtggcgaggccggagaggccgatgtagagcttgtcgtggatcttgaacaccctctggaagtccgtcgcgacggtctgcagctgcaccccgagccgccggtcgctggcgatcgcgaagcagttcttccccaccatcgccaccacggcggaaccattgtactcgaagatctgcgaggcatgggagaattaagatccgtggggcgggcggcccggccggccagggagcggggcggcggggggcactcaccgacatggccggcgcggcggcgagttcgcggcggaggcggaggcggaggcggaggcggatgcggatgcaggcgtcgaggttcgaagtcgaggaggagaatcggaggaggaggagctcacgcagtgggcttttgaggcccaacttgggcttcttgctgagcaagaaggtccggcacagggacgccactggtcgttgaatacaactctaaccacgaaattcaataaaatttgttagaattcgatttttaaatatattttttaaacacttaaccagtttgtacgtggtttcgagacctgtaatggtgtgtttagttcacgccaaaattgaaaatttgattgaaattgaaacgatgtgacagaaaagttgaaagtttgaagaaaaagttgggaactaaaccataaatcagacctaactcctaaggcagcatttatttgagaaggttggagcctcttccatcctgacggtgtgtttggctcccggtcaaggttggatgggatatggcggtccatattttgctggatatggcgatccagttttttttttgagtgaatatggcgatccagttttttgtttgggccttgtttagttccaaactttttcttcaaacttctaactttttcatcacatcaaaactttcctacacacataaatttttaacttttccgtcacattgttccaatttcaaccaaactttcaattttggtgtgaactaaacacacccttggttgtagggatgaaagtggatatggtaatccattttttttgtttggttgggggagtgggatggatgagtggttgcaatcaccctttcattagaggtggtgagtatacccctccacattctcacccaaaaaatatcaagagtaaattgcatccatggtgcatcaacttggcaggtgggtgcaatttggtataataacttaagaaattagcattctagcacaataacttggcaggtaggtgcaatttagtataaaaactttataagtgattgtataaatacaacaacttgcaagataggtacgattttgatacaataaattaaaaagttatgtgacaacttaattatttggagtattttttcaataaattcaatttttaagtacttattttgaaaatatactagcgcatatttgtataagtatatttatatttttatcctaataactaataactgaaggtcaactaaactggatgtagaaatttttatatttcagttgatatttgagaaggtgaagaccacaaaaaaaatcttaaaggtaattggatgtaaattgtactactatgtgtagtataataattcttaaagattaaatttaatattataaggtaatatccatatgattactatgcaataacatactgacatcgtaaaaaaaagctcacctagcatatgtttagccaagttgatacatcaaaatattaaattgttaagttcttgtactagaacacactcacatgtcaagttgttgcattcggacgttcaattctcaagttcttatactatatcgcacccacctgccaagttattgtaccgtaggtgcaatttattcaaatatcaatctactaaaaaaatctagatagaaataaaaaaacagaaataaataaaagggaaaggagaaaaaggaaaaaaaattcttctcgaaatcgccggccgcccctcgccaaaggtcttcgtcggcagcccctcgcctcctctctcgccggcaaccccaccgccgcacttcctatctctcccgccaccgccttgcctcctctctccccggccgccgccgctcaccctctctcgccggcgcccaccagatccggtcgtcgccggctcgcctcctctctcgtcgccggctcgcctcctctctcaatgccgagctcgcctcctcccgctggccgcaggcgccgccgcctcccgccgacgcagctctcggtgcctgcactgtcgtcatcgtcgggtccagatcgtcgtcgtcgtcaccggcatgcatgaggcattaaatgtgtcgatgtttgatgtcgtggttctggtatttgcatggtatggggatcgtcggtgctagggtatatgcgagactgaggtaaaagagatggagacagggatttttatacaggttcgggcccctgaattgtcaggtaataactctacatcctgttggccgaagccggtattgctcttattcatgataatcacaccagtacaatgtttggggtagcctatctaactgttgttgacatggcggtctgacgatctgactcgtagtcaacaacaaggtagcctcccacctcgaatccgtgcccggcgagatcagagatagcgcttttgtctctcctgacagtatccggagacaccgcagggtattagccgtgcttatccctgaagtcgatatccggcggcttgtcttggcgtatgtaggcttctatgttgtggcttctatgtcgattgtgttggatgttgatcccttcatggtggatgtctgtccccctgtcctcctaggggggcttgtatttatacccataggtgtccccttgtccaagtagaactagggaaaccaatatggatacaatccgagtaatccttatcgtttccatggagaactctggttgtctttccttatccataactctctcgaggtcagtttccgtataagacatggtatgtggtggatcctgccgagatttagtcaactactattaggtatgtggtatccataaccctgacagtagcccccgacttcgatgcaaatgaacgaattcatattctcaaccgcgcgcagacattggagtaactgttatcgagctcatgtgacatttctcggtgagtttagagataacgttggacttcctttgtcagccttgtgcgggcaccgaaagggtttgtctaagtcaatctctgatgtcgaccgagaaagtacagagcatacgactaagtttcccgtcttgctgtaatcgagaatttggattgaagtcaagaaattttatctcggcgggtacaccatctcttcattccgtattccttgtcgagatccagcaaccgttctcgagcgatcgagaaggcgtagagtctgcgacggaactttgtcaatatttgtcatactcgccttagtcgatcttggtgtagaaccatagagacatgcgatcttcgataatgtcaaatagaattttcctgaaatcaatactcagaaaagaatattagacagaaatagcccccgagcgaacgctctaagggtgacatgttataatatgtatggtaaattgaaaatgaattaaatttaccgaccaatattttgagtatgagcgtcttctctcttaccgacttcgatcagtcagtttgtagagtcatacactctccctagcccccagccttgtcgtcggagaatcgttcttggaggataaggctcttggacccttgacctgctgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaatgcagcggaaaacaaaagaaactggagctaagccttgactaaactacagcggtacagcgggaacaccactccacaggcatcctcgacggcacggacgaagcctactcctcggggaaaccttcatctgacacatacccgtcctctggggttgggaaaagtagagcaagactgattactacccactgtactcagcaagtcataccggaataggggtatgatgcagggaattaacaaagaagagctagagtggttcatttgcataaatactagcatttataaacaggaattgaatgcgaaaacagttgtaataattaagcagtattaaacatccgctgtccaacgctaacccacgttgcgacaggcccaaccatccacctaaactatccaagttcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccggcatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgagtgcgaccagcaaaaccatgcacccacagcccaccatgtgattcattttaattaaccaacaccagagcggtggtactaatccaacattaccattagaattaacagtctaaacattaatatgattttccccattgtgaactagttgaactaagcatggctaagcaattcctagtccaaactctaatcatgttataaccccaagctaacaaaggagcatggtatcaaaatagtatggctgtaacaataggtaaccatcccatagtaatattgcaaaaccaatgcggtatttgaaagaaaacattaggacatttgcaatataggatcaatatgatcaagtgacaagcatgacttgccttgctctgctgctggaggaacctcggcgactatctcgaagtacaccggagcgtcagaggaatcggaatctagcgacatacaaagcaaacattgcaaacaggctataagactactgaaacagggaacaaaaccatttttaatggattctacacatttttcttgatttactgagacttgaatgggattaaacggagctcggatgaattagttatgaattttagaagattcactgtgtttattactataaaagaaaaaccttaaacaatttattgcgcaatattaaccagggctgacgtcagcacgggggagtgcggcgccgacaagcggggcccaccggtcagcggcacggggaggagagagggcgccgacacgcgggacctacaggtcagcgacccggggaaaaggatggggcggcggcgccacgtggcggccggaccgacggccccgatctacccaagggtaaatcggacggcggcgggagctcgcggccgggatgcgcgggcacggcgcaagccgaaccggcgaccatggcaccggcggcgcggcgctcacgcggcggcggcgcgcatgcggcagcggcgcaaggcgacggccgacggcgaccgaccggcggcggagagcggcggctagaggaggagcggcggctacgcagctaggcggtggcgcggcggctaaacggtgcgggagagagaaaacgaggaggagagcctcaccgacaacggtcgacgacggcgggcgacggaggacgatggcgacggcggaacgagcttccgagcctcctaacgaacaaaaggagaggggttagagagagaga

SEQ ID NO: 81746 - DNA, 139009 bp, Oryza sativa
tacaagtacatggttatgtttcctgactttgtatgccactttttttttatagctcgggcacatgcggaccaacaaactgtgccccaagtacggggaggaccctgaaacatctcgaaatggatgtcaattccatcaggtctcatcctcctgatattgtgagtaatgctcaaataaaaacatcaaacaagaggttggtagcaaaagtttcgtctgaagcttttgaaactgaaggacctgaaagtattgaaaaggctaaacctgtccctgtaaaattcaaatgtggagcacctgagaagtcattggataggaacatgtcaatctcagcttctttggtttctgataaacgtatgatggatgctacagattcgaaatcaactggaaaggttaataagattaaaatatctaacaagataaaatatgatgattatcctcctgatactcctaagccatctgttgtaataaggcctcctgctgaagtggagaaggatctacctcgtaagaaaattattatcaagcagcccaaggtgcttggagatcagcaaagacctactgaacttaggagtggtcaggagcccagaaagacaaggaaaattgttgaattgtcaagctttgagaagagagacagagaggatgataatggtttttctggacaacctattcagatcaattcctcacatgatagggggtggggtctggtgggaaaaagaagcaaaggaataatggaaagtagtgaatcctggagagcttttgaggagcaacgagagagacaagaacagagactaattgaagctaggatatatgatgcaaggagagaggatgagctccagaaggcaaagaagaaaaacaagaaaaagaaaaaacatgaatttcgagatgatgacctacttgatcctaggccatacaaaaatgacagaagggtacctgaaagaggtcgagcggcaaagagacgtaccccagctgatatgacagaatacacaccaccagctaagcggcacagaggaggagaggtacttgttctcaaccctgttttaataggattatgcattgttttagcaatgttggtatgttagacctttttgtaattccgccaccagagatacctgtttctgcaacttattgtttgtagaaattgagaaagggcaaaataattgtatgatagcctttcaaccagcgtcgtgcttggttttgttattcacctttagagagttgggactagtttttctcaactaaactgtcccattgtgttgtgcgttctcaacaaaatagtttgttttgatcaatattcagtttgatcatccccgtcaacatcatcatctttattaattctcttttggcacgttcatctttagttttttaacatatagacacccgcattttgctacaagggatgtgatacccatttgtgagatataggtcggataatgcagataatccattgttgttttttttgcaagactatgaatttaaacttaatttatttgtttgcatactgatgcaggttgagctctccaacatattggaaaaaatagttgaccacttgcggacaatgagctgttcattccttttccgtaaaccggtgacgaagaaagaggctcctgattactttgacataattgagcgtccaatggatcttggtactataagggacaaggtgcgaaagatggagtataaaaatagggaggattttaggcatgatgtggctcagatagcactgaatgcacatacatacaatcttaaccgccatccccacatccctccgcttgctgatgagctcttggagttgtgtgattatcttcttgaggaaagcgcggatgtgctagatgatgcggaatacgcgatcgaggactagtgcacactaaccagatatggcatttagatcttgctatattctaacttagatgctgtaatgctgacctgtaggaggggggaagagcacctgtagaatttttcattttaggctctggctatggtatacctgggatccccaattccaactattttgcctcttgttggtattgggagttgggagttggaatgtacacaaactctaggttagacattgagggcccactgtaactattggcctcttgctgtaaaaatgtagcgatgtaattttttgtccatatccatggccttgggtgtctcaaattctgatgttgtagcattacatcctatgtgaatggcatctaaccatgagtcaaaggtgcaacacgtcaaagcatgtgctaaaggttgtacccggtctaacctgattggtgaaggtcccttcaaatcctgcatgattagaggcttaccatgcaactatgcgaagtcaaaacctgtaattgtaactgtaacgtgagagatggtgtaccggcagtacaagttgtttgagttgctgccagatgatgatgtatttgatgttgcatgctttgaatgagtattcaccgctcaacgatatcattggatggtgcagttcatagtttcatacctttggtttttggtttgtgatgttgtagcaacagaacaacaagtaatcatccattaaacaatcaagtccctttctcctacttgctgaatgtactgatggctcaagaggagttgagtttagagtatagaatttttaagatgctgacctgccaagtaaactatacaacaattccctagctctgaagcacctgctccagatgctcttagctgaaagaaaatctttgaagtgtacgagggctgtctggaccgtccgatcatgacaacgaacgacggcttagtccaagccaatttcataatggcccagatactcaatttttgcatggtcagatcacatctaatataatagtacaaaaaacaactaaaacgtgtactagcatctagcagtacgaaccagcaaactggcatgcatttgtctactccaaaagagcaccgcttaacgcgggacgcggctgctcacgactaaaccatttttataattttattctcttgcttttagtaaaaaaataatggcagtagtagacgaagacctggcaagtccttgggcttaaatctcacgagcatatgaccaattgaccatatctatgcacgcgacaaccaaaacattacaattccacgagtccgcgacctgttctactcacgtcaccccgcatccctgatcaaacaaagcatttgctcgggagcttgagctcgagctccgtaggccggagcagccatggtgtcgtcgtcgtcgtcgtcgcctcgccggcgagctctcctcctgctgttcgtcttcgcgtcgtcgttctttgccagcgctgcaggtgagagggttcttgagtagttttgtttctttgatgaaatggaaggcgtggagattgatcgatcgatcgatggtggcgtgccgtgtttgcagcggcggtgtcgcggacgaactcgtcgtcggcgttcgtgctggcggcggcgcagacgcggcggaaggatccactccgcgggctgaggtactacaccggcggctggaacatcagcgacaagcactacctcgccgtgagctcctcatttccgtgataaatttcagctcgcaatgcgatcaccttggtgttctactgttcttcctgcctggttcttgatgctgacgccgtcgagttttgctatgcttgtcgccgcgcgcgcgcagtcggtcgggttcagcgcggcgccggtgttcgttgtcgcggccgtctggttcgcctccctcgcgctcgccgcgttcgtcgcctgctgctgccgctgctgctgctctggcgccggcggcggcaacggcaacggcggttactcctactcccgcgccatcttcgccgtctccctcgcgctcctcctcgtcttcaccgccgtcgccatgtaaaaccatttctcctctccaagccatttcatattacaaagtacaaaactgttcagattttttttctagtataagtttgatcaaatttatacaaaaagtttagcaacatctgcttcattaaaactagcattaaatatatttgttttgcattagaaatgatactatatctctttataaatttagtcaaatctaaatatattttgataatatatttgtttgtggaaatgctactatatctttttataaatttagttaaatttaaataagtttgataaataaaatcaaaacgacctataatacgaaacggacggagtaatttctaattttggacgccgccgccgtcgctgtgggtgcagaatcgggtgcatcgtgctgtacgacgggcaggggaagttccacgggagcacgacggcgacgctgcggttcgtcgtcaaccagtcggacggcgcggtggcgagcctgcgcggcttcagcggtttcatcgaggcggcgaaggcggccgccgtggagaaggccaccctccccgccgacctccaggggaaggtcgacgacgtcgtgcgccgggtggacgcctccgccgacgacctcgccgcgcgcaccaccactaactcccgcaagatccgcaccgcgctggagaccatgtatgtgtgagattttcttggtggacgccatgacctcgtcacttccatcatcaagaagatctcgtttgacattctgtttgccttcttctcgtgatcgcagaaggacaatcctcatcgttgttgccgccgtgatgctggccttggcgtttcttgggcttggtgagcataaagatttctttgctggttttggtgaattttgtcaaattcgtttgtttctgtattcgagtaaataattgacaaattcttgttcgattttggtgcagtgttctccctgtgcgggctgaaatcactagtatacacgtaagtacaacatcacagaacgtacatagacttgtatatagtacaaaatttttttttactgcaagtttgtaaccttcagttcttctgcagcttggtgatttttggatggattctagttactgcaacattcatactgtccggcacttttcttctcttgcacaagtaagttgttctcccttgttactgtcttgttaaatatattgcttgattaaatataatttgaaaaaaaggtgagattttgatattctaaaatggattgagtaaatttagtcggcaaaaaaaaacaaatttactgaagtggaatattctgcttctgaaaagttaaaatttttttgtatgaaccagacgtactggaacactttgcatctcagtctttacattgactagttacatgcttgtatgttataatgggtcaaccccatataattaggggtagattaggagtcggtatgtcggtgtgttaataggctaggtctatataattagagataaatgatactctttcggttctaaaatatagtaacttttagtttttagaattcgtttcaaaatataacaacttcttcattaacattctcttctcaaccaatcacaatactccaccgttcaattttcccacataccttcatttcttctccaatcacaacacttctccatttagttctatcaactttcttaataactacgtctaacttttaaaatatttatattctgaaacgtagggggagtattacttttcacgtacgcactgaacacgttaggacggtgggatgagaggagaacgactatattttaagatagcagatatcagttaaatctgaatcattaagacactaacacgagctctgctctgcttcgtcgtgctcgcagcgcggtgggcgacacgtgcgtggccatggacgagtgggtgctccacccgcagggccacacggcgctcgacgacatcctcccctgcgtcgacgccgccgcgacgtcggacgcgctccgccggagcaaggaggtcaactaccagatcgtctccgtgctcaacaacctcctcgccaccgtcgccaacgccaacgtccccgcgtcgtcgccgccgtcgccgccggccagctaccgccagtccgggacccccgtgccgctcctctgcaacccctacaacggcgacctctccgaccgcgcctgcgccgccggcgaggtcgccgccgccgacgcgccgcgggcgtggcggggctacgtgtgccgcgccacgggggcggcgccgtcgtcggaggtgtgcgccaccaccggccgcctcacgccgacgatgtacgaccagatggtcgccgccgccaacgccagcgccgggctgacccagtacggccccgtcctcgccgacctcgccgactgctcgtacgtgcggcgcgcgttccaggcggtgacggcggcgcactgcccggggctgcggcggcacagcggcagggtgtaccaggcgctgctcgccgtgtccgtcgccgtggcggccgccgtggccgcgtgggtggcgcactcacaggagcggcggcggcggagcgagacgaggcggttccaggtgtcgccgtacaggttccccatcgaggagaagtcgctgctcaagagcccccggcggccgtaccggcgaggcgacagcggcaggatggcgaggtagaagaagacatcgccatggatggatggatggatggtacagtgtcgaacaccttgggacgctgccacgcgtgttgagcagtttaggatgtgtttagtgcttcgatgattattatattgtactgattaatgatctccatcgaccatacaggttatacattgtacagcttgaaatgatttcgtgaaagaagtgtgtagtttgagaaaatgcaatatcgtgctcgcccacgtcgagaagcactgcctctttggtttctaacatttcgccgatcctattcattagccctagacaacaaaacacaacagggtatccgattgatctggcgcccattgcgatgatcggaaagcagcacaccatggatcacacgtagaattgaatcattagcccaaaacatcgcaaaaactacgggaatcagcaacaaaaaataaaaagaatgcagacgtgaactatggatagtggcaaatgatctccacctaaaaaataaaaaataaaaaataaaggcgtcctctcctcgcagtcgtgccgcggaagattggaccggatcatggcggcggcggccgccggagacggcctcagaaactgcaggacccacacatcaaaaccctatcgccggcagcaggggacaccacgcgtcgagatcgatcgagaccaactcgcacccgaaaaatggcgaaagagaatcaaacagaagcagagagctcaaaatcgaacgcacatggcgacggcacttcgccgatcgccaccgccgcgcggtcctatacggagagcccgctcgatcggccgccggaaacctaaccccgcccccgttcgcgcgctcccatggagatggcggaggagaaggggaaagcttctccagatcgaggaaggcggcggtggaggtgcgaaaatttggactcgactgacttgtgggcctcgagcttttcggcgttctcgccaaatggcgtgggctctattgctttggatcaatctagacgtgggccgtagctggcaggacttggcccttttcgcgttcgtgtgatcacgggacaacgctgggctcgttgacgaaagacgggaaacccgtgacattcgggcctgttttttaagagctccaactcctaaattttgtttcaggagagttgggttttggagtgaaattgtggagcaggtctatactctactctatctctctagcttattttatgataacactctacccagtttcgcttagaaaaggtgggagctagagctggagttgtgctaaatagacccttcccatgtcagactcttagcaactcctctctttgtcttcgaatataacaacataatttgttccaaaatataataacttctccgtcaacatttttttctcaaccaattataacacttcaccattcaatttttcacctacatccacttcttaatcaatcataatcttttatcatttaactctaactactttcttaatgaccgtttcgaactttaaaaattcttacattcttggacggggtaataccgttttttttcagtagctttctctttacataatataataatgatagatataacgatttctttatccttttaattaatggtatgcctgaaaatgcgtagcaaccgtagcattttataagaagaaaaaaatgcattgctttttagggggaagggaaacgaacattcgtggtaatgtacgctcaacacgcatgtaaactggacggcaggatgcatcatagcggcaaaggcggcatgcagcagcagcagctagggccctttgtggatgaaagaaatgaaaaccccaacccccacccatatccaggagatgtagcgagcatggataatctgataatgctagaggccagattagggaccttaattagggacgggccttccaccataaattaatacatgtgtcgctcaatagttgacggaaatgcagctgtacgttaggagtatatataacatatccacaaccacagacaccataacactccatatttctccatctcatgagacaagaccggccacttgtactagtaaccaggttccataattcttcttgacgctttaaatagtaacacgatcttcgaaatatgtgtttaaatatatttttctattataatatatatataataaattaatacgtttttatttttattataatactcataagataaagagtgaattgtactttaagccacttttgtttacctaagtttcatttaatttggatcaccctctatctaatcttctcactttgaactagttttattttttttaccatttttcattttggactgtgcaaactctcttcgcgagcacaacaacagaatcaaacacactctcatggcaacaatattccctatttacgtgcaattcacatctttattaaatgagaggtttgatgttgctatacaaaagtgttagggtggtctaccgtaaaaaaaaaataaccattcaaaaaaaaatggtggtctaaagcacaacaaaggtaaaataaccaagcctaatgtgaaaagattggatagagggtaatccaaaataaaacttaggtaataaaaggtgattcaaaatgcagtttaccctaagatgataaatctatatatgatattggtttagtgcctttaataaactaaactagctgtgtggcccgcgcaattgcgcggctagcacctaaacaaaatcatatatttttagtatgattttacttaaaatttattaaatagctatctcattgtcttaagagtttgaaagaccaaaccttatcattcccgtgtttctaattatatagttttttaaaagtcacaccagttgctaccccttatgacatctccttctttatttgcttgttcgatctaccactatttctattcattcttcttggaacctttaaaaattggatcttatagtttttagagttttttttgtcacgttgggtttcgtttttataatttttaggcgtcccgtcaaacgttgctattatactcctctatggtccgtccactatctcttctctttattgtcattgagattttaaaaatcgaacataattattgtttgggttcatttttactttctagaagtcccgccaaaccgtcagcggctttgccattgtatttctctacggctcgcccgctgtctcccttctttattatcattgagattttaaaatcaaacatgattatcattgttttttttactttttagaagttccgaacctttaaaaattgaaccttgtagtttttagagtatattgtcttgttgggttttattttttataatttttagaagtctcgtcacacgatgccactatgctcctctatggcccgtatgccgcctactctttattgtcattgtgattttaaaaattgaacataactatcgttggaattcattttttatttcctagaagtcccgtcaaccgttggcggctctgcaactatactcctgtacaccccgcccactgcttctcctttttattatcattgagattttaaaaatcgaatatgattatcattggggtttttttttttactttttagaagtcccagcaatcaccttgttcgtttgcttcacggcctttctaccgtcccttgttttaatcgttattagtattctatttggtgttttattaacagtttttatatgttgtatcaaccgccaccactctactctattataggcctgttacttaatttatctcgtcatgtcttttagatggtcttttctttcaatagtctttatttttatcataaactttagctatttataaattgtattccaaattgaaaacttatttttcattttgtaattttagaatttttttttcaaattttaattaatatcgtattgtgttcttttaatatttttattttttattttcaagagaaaagcccgtgcgctgcaacgggtgacaactattttagtcttaattcactgtgagaattcgcttggatctatatatttctataaaatcataagctgtggttaggagtctgtttgtctaaagtcagcatgcgaatttttttatacgactcctatatttccaaaagcggacgaacttaaaaatcaactcaaaggatatatattttttcaaaagcgaacaaatttataaaccgactcatacacggatgacataccaaaataccgacaaaagaacatcttaaattttttataatagtagaggtttcttttaaaaaaatagtagaagtagaagagaagagaagattacggacaaaaagtcctttttcgaggcaatcgtacaggaatcggacctttttatttttttatacggtagaagtttttttttctcttttttttattttttcttgcctttttttctccacagatagtcggactttttttatggagtcggacgtttttttttacatagaagttctttttctcctttttttctgtttttttataccggcaaaaacatcttcaatttttaatagtacagatttcagttgtttcaaaattgtattcctacttgaactctcttttaatttttctaattttggatattatttattttttattctgaattttaattaatcacatattgggttcttatgtggattcttctttcaatattattttttttaattccgaatttcagctaattttaaattgtactcctatttgaactcttttttttttttgctaatttcggattttatttttatttttattcccaattttaattaatctcgtattgtgttcttatatggactcttcttttaatatttcatatttttaattccgaattttagctattttaaaattgtattcctacttggactatccttttttttttaattttagattttattttatttttatttcgaattttgattaatctctcgtattgggtttcttatatggaaacttcttttaatattgcttatttttaatttcgaatttcagctatttttaaactgtatttctacttggactctatttttttttctaatttcggattttattttattttttattttgaattttgattaatctcgtattgggttcttatatggactcttatttaaatattgcttatttttaattttgaatttcagctatttttagattgtatttctacttggtctttccttttcttttttttttctttttcttcgattaatgtaggaatttctagcccctacagcgaacgtggtgcctcctttcaaagttgttttaataatataatagatagatagatagatagatagatatagatatagatagatagatagttattgatagttgaaattataaaaaggtatcttaactttatttaaatcgtaaacaattatggaaccggaggaagtacgtccggtgggctagccgtgtgggccggggccgggccgccggccagcgttcgcgacagcaagtgcgcgggcgcaatgatcctctgggaagccaccgcgcgcgacgcccccgccttaattttgacgcgcctacgcacaatacaacacgtacgccgccgaagccgtacgtcgcgcgactctcgcggcacgcaagtctcgctcgcgcgcgggttgttggtagatgcgcatgggtggcaggatttggcgctgatcgatcactcgaaacacgggggctcacggtgcgcgacgcgtacctgcagctataagctagccacgggcacggaccttaggtgtgtgggtgggagacgacaggacaggcacgctagtaggcttaattcatctcacgcgtcatcgcttgactgcatgcgccaagtgaggggccttcagagcttgtactgctatcatgaaaaattctaaggaaaaattagaccgtctttagttcacccccaactacctaaaactttcaacttttcatcacatcacatcacatccaaaactttcctacacacataaatttccaacttttttttttaaactttcaactttccccaaacttctaacttttttcaggaactaaacacagccttaataacattcatacaaaatgtacatatcagttcgtagcattttagtacaaactcaactcacacgttgagatacacagattttttttatttcttaatgtgtaggtcaaatttaaacttgatttttagtggagtgctaaatacaactatactctatattatcttcttttaaaaaaattaagtttgtaacattatttacattggatttaaaagaagaaaaatacatgaatgacggaatccactatttttttttgcggggaaaagggaatatattactcctcacaatcaatgtgtgagatgaaattacaactattcttaggccaaaatttagacatagactcacatcgtgccttatttgctaaggtatggcttacacgattttggttacgatggcccttgacaattctaatctccctatttccagctaacaagtctttcacctctcggacaagaaaagccaggtctgatttatccttttcctgtgatttgatcatgtgaatagccaccaggcaataagtttctacgatcaacggccaaagagtccattgcaaagccagagctattccactaccctttaatatacgatcatacaaaagtcgcaacctatatgtgttgttaacatttactaacactagtacgtagcactagggtgctgtttgactctcgaattctactagtatcttttattattctgtttagagtatatatagcctcgagaaaatagtacaaagtactacgcaattttcagaattatgaaactcagaaaggtaagatctttttcagacatcacgcatacaaaaacaagcttgcagtagagcggtagtagcatttgtttgacgcagctaggatcaccctaagattccaaccactccctgtttaccaccacacacaaactttgtttactgcacacttaattgcccttttacccatgcctaatgacctaatcttgtgacctttttgaacgctcatagccgagctatagctacaagacagacaagaaaaaggtccacatggagagattccaaagacttgctcagtttaaatttctccccctatacatgctactccataaatcccaaaatataaaaaaattaagttgaatttgacaaatcctaaaaccatgagtctatacagtctcttgagatatactccctccggactgataatacttgtcgttttgaataagggtgaggtcaaactttagaatatttgattatcaatcatttttaaaatatttatctttcaaatatggtgactacatgtatagattagtcttaaaatgtattttaataagatcatatatttgttaatatttttatacatattataatagaaaataatggccgaagttttttttttttgagactatgccattgtccaaaacgataattattatcaacccggagggagtagtactaggatggtataataatactgtagtagtatcagcaaataatactacatcctttcatgtaatttatggcctctctctgtgattttattactgccaatccgacgtgaacgtgtagtaacagcaacagtagtaacaaacatgcagtccctaccatcttctgaacctgccacactttgtcaccgctttattcgcgtcctttcagcatttacgtatgctacctgaccataccatgccatgcgtggtccacataacacatcggccatcatcctgcctccatatcgactctcaagtagtgacattattacaaccaaaaagaaaagaaaagaaaatctcaactgaatagatgagattaatttaggtcttaaatgaaaccatcacgaacttgaaccataaaggccaatgcaactaatgcaagtgctcatttaattaacaaatactcctactaacaaacatctctgcactgatacgcggtagaagcgaaagccatcagatatcgtatagtactcccctttttgcaggggcatgcatgtgatgagcgatttgcatcggatcaggctgacagctttggcgtttttgtgtctccttttggcttaagatctactacttctacacctcgatcgatcgctgctgtccagtgtaccagagttcaaatggcctatttgagaaaggttacagtgtaacaaagtttaaatgacctatttaagatagtctaaaattctgagaagttgcttgttagtaactactccctccgtttcacaatgtaagtcattctagcatttcccacattcatattaatgttagtaaatctatatagatttatacgtttagattcattaatgtcaatatgaatgtgaaaaatgctagaataacttacattgtgaaacggagtaagtagttctttttgtcaaaatctgcgtgaaaagttagattgtttggtgaagtttctgattatgtaagaagccgcaggcctgcacctaacagaggctccccgaaaccggtccaaagacccaaacggttgtgttggatcttgtagtcttgtcaagaaaccggccaagccccatgaaactccaaatagtataaaaaaaaagtcaagatttgccttaaagatataaatacgagcccaatttatttagtagctgccattgcaacgatgtgcagtaataaactagtaatagtagtatagcatgtgagccgagccgtgcagctgcagctgcatgcttcttcctccttcgctatatatgcagctgagctgcacacacgatgagcagtagtagtagtagtataatttggtagtagtgagcaagtgaaactgcaagtgagctaaggtgcaagaagagagaggtggagatggattggtacgcgtggctggcgaagaccgggttggcgccggcgctggcgtacgagtacggccgcctcttcaaccagaacgagctggagcgcggcgacgccgcgcacttcgaccacgacctcctcaagagcatgggcatcgccgtcgccaagcaccgcctcgagatcctcaagctcgccaagaaggactcctcctccgccgccgacgcaggcggtggcgactcctcgtcgtcgtcgtacgcgcagctgatcgcgcgcaaggccgggaggtgcatcgcgcggtgcgcgcggcggctggcgcgaccgcggggtgtcggtggagggagggggtcgtcggtgaccgtggtgccgaggatatgcagcggcgacgacgccgtccgcgtgggggcagtgcaggcggcggcgacgaggaggaggaggagcgtcaagaagatggtgctcatgatcaccgacggcggcgccaccgccgcgaggggcggcgtcggcttcgccgccggccggttctcggggtcgcagaaggcgagcctgatgttccacgactgctacgaggaggaggacgacgactacgaccacgaggaggaagcgcggtgcggcgacggagccgagggcggcgacgaggatgccgaggaggaacggtgctccgacggcggcggcggcggcggcaccgacgtcgagatcaagtgggactccatgttccaggacctgaagccgacgtgattgagttgaggcaatttgattaattcgcgagtttgtgtgtagctttttgtgagagaatttttacatctctctttgtggtgcgagagcttaattaggatggtaatgtgtacgtgtctatttgccatgagtttagacgataataatatcgagcgcaaatgttttgagtgagattaattgaaggtcaaaggaatttagtgtacgcgattgatcgaatacccactgcataactatgaattattttttcaattttttttagcacaaggcaggatctctgtcgatcaagtaaagttaacaactgatgaattctctctcgttcccggcaattggctgcaagcctgcaatgtgctacatgcatgatttattacgttacatattcatggctgttaacgtttgttcatcgcaagattatgcgaaaagtaaccgctgaattacaaggacttgtctaacaaacattcgcatgatttgtgttcctcatgagcttaaatagaacttcaggatgaccgacaaaggcataagcttgtcccctcttaaccagttaacattgcacagcagacatcgttagtactcctatataatgatgtccgtcgatgtaaaggcgctattattttagactaaaaagggaaaatgccatggcatggacttggatgacaccaatctgttggaagaaaatagtatagctcgaaatatagcagcagttgggggtacaatcgttgggtgaccactgaccattgcctacttggtcaggctctctagccagcgcatgttcaaatggcaggccagtatcactggcaaagctactgaaaatgacggttatgaattatgatgctgtccaacagaacggccagtcacgtcaatgcttgacagagagaagggccccacgagggtacgaggatatatccagcttggtaacaacagacaggcatagacggcacaggattcccttcaaagaatgacataaaacggaggtgaaatagtttggacaagttcgatgaatttctccaaaatattcccacttcacacacgtcaactcatattggtgtagtaaagacaattaactgaatgctttaaccgctattggcacaattaaataatcggtgtgtagccacatgaacacgggtgtatcagtattcagtacagcatacacgagttttcgattagaccattcaatatgatagtacccctttcattctttcatggcagatgaaaccacatacattgctttgtgggcacaaatagaatagggcccggggtaaaatgattgcagtaaaaaaaaagataaatcactcaaaattgggatgcttgaaagaaaaatcaagaacgagtagccaggtagaaatctcctgtactaagaaaaacatgttttcccagctggagatcaattggtgggaagccttcaatgaaatccaccgtaatctgtaagaacaaaggcaatttaaggcatgaagaacaagtattctgaaaaaagttcagtagaagttgtagatttaccttgccattcccagcctggaattcattcttcaatctggaaatagaccttgacagtaaatatacttttaatgcatcaaaatgctcacggttgcctgttccatcaaagtagacacttatgttaccatgcagaatataacaaagagaatgccaagacattaacaacgaaaatagacaagtacaccctatcagataaggttgtatttaccagcggcatggacaaggagatcatctgtgaccactggagaaacccttgcaatgtaaatgacaaacgacatgtcttgtacattgtgagactcctcacagatcattacctgccaaaccagacaaatgacaatgagattaaatgttttatatccatttcaactcgtgtcaacaccaattggtggtgatgatagtgcatataacttggtgttcatgtaagaaaaatcaaatcctccaattgatagagataaaagtcagttaacagtaaactgaaacagggagaatatccaaactcactgcatctggtggcgccgccatctttggaattagtggattgccaagagcatcccttatatactgatcctgaacagaattacagtagctttcattaaggatgttctgatttatgaaacaagaaccaattacttatgccaatttagctgacctgtgactgcacaatctctactagagtattcttgccatcgtccataggtttgtaatatacatcaactaagtctgtcggctcaagttgcgctgtctttcgtaacttctggattctgttcacaacctggacagaaatgctcaagaattattagcccagatcatgaacatcaaacttatgactgacaacagagaaaacgtatgcaatcaaacagccgctggaagttcatagcaacatgaagtcagacatgacataggtcaggtaaagattaccaaattcaggcatcaaccagtgcaaaaatactactaacacataattctcagtactccagggtgtcatacccaggagtacacaaatcatatagttaattacctctcgagcaactccagcttcaaacaatgattgatcagctcgaagatccaaaacgactaacacatcacctacatgaaaaaaaaagtaatgataatatgacaaaatagacagatagcatacaaactactcatatggaaacatatttgacataccatctcccgcagcatcaatttcattctctgccacatttgcaggacgtttaaattgccggatcacctagagggtaaaatgtttcagagaattaaagatgcagcaggttggaaaaataagtccactaaatgcaaacctgtgcaaactaaagtgtagcatcatgtcattcatcatgatgatcagaaataatgcccccaaaataaaacaaatgtcaaatctaatttttagaataggtgtgcttgcaaaccatttgctagacagatatgatctggaaatgccaaagcagaacttggaaatgatgtgtttgtattttacaatatatgtaaaaagcaaatcaatataatcttactaacatatcattctgagaacatatactagcacaattaccaaatattaatcttcaaaactgacatgcaagcaatcatttaaacctttaaattaacatccatcagaagcatggaatgttaccttaatatcgtctaacttcaagcaatgaccaaagaatgaaatttctccactttgttcaaaggctaagatctgttcctgtgtcattttcttcacttcatttgacactttgcccatgtcctttcccagtctttttcctagcacactaagaaaataacacaagtgctgagcagtagataaaaaaaaatgcaaagtttctcacgctattaggtacacatacctaaaattgggttctgcccggagagaagcatacaacatgggatcattacatggagtgacagtcttaacattcatttcttccatgacatactgtatattggaaagtaaagtatgtcaagactcaacactgaagaaacatgtccatttataaaataaacactaagtggcaaatattgaagatgaattgatcaatctcgtattctcattgctcaataatcaagattatcaactcctagaaatatgggcaagcagattccttggcaaatattgatctcaggaagggacatgccaacagtgagaaagcaatgaatatggaacataaaagtgtacaggagactttggttacaactaattgcaaatgcagtcatataattccataacagatgacttataggcactgctgacaagtacttataaacaaacctcttttagctttcccgttatgtcttcaagaaattcattgtcaggatgaacaatcaccatctccctgaaactcagattggttaagccatatggcaaaattgaagataatatacagaacaagcttttatatcatgaagcaaaaggaataccagaaacaacacatataaaaatataaagaccatctggttttcaacttcaaccatcttaaaaacataattattgaaaatagcatacgtacttttacgcccatatacacaaaaagatgaagaaagaatgtaaaaccgaactaaacacctaaaacacttcgatgttatgacaaccaaaaagattcctaaaatttcatggccatcgattatcatttcattacaacaaaatgtgtatcacatgtcaatatattatacaacgtgaaattttcaatttcctaaacgaaatatctctagattaaatcattaggaaacaaatcatgagactatgaacatacttcagtggtgttttcaaggctttgttatgccgttcacgaatattgcgggcaagatcaatgatggtcatcattctgtttacactttgctcaacacgctcatctctctgatcatgaagcaaaaaaaatcaacatgaagtcacaagtaatacgggtggaataaagcatagtacaggtttagataagaattacctccccagttgtggaagggaaactgcagaaatgaatactatcctctggtttagttgacacctttcgtaggttttgatagagagtttcagtaaagaagggtgtaaatggagccatcgccacacaagttgttacaagtgcctgcattcatgattaacaaaatgtctttgtgaaatactacaaagtaccagcaaaacatacaatctaattaggatttttttaatgcatagagtacccccaaaatattacgtaatagatgctaaggagcaagaaaagatcatttcaggaggagttgggaacttctccgccccgcgtggataccaaggcgacgcattagcgcatgattaattaggtattagctaaaaaacttgaaaatagacttatatgatttttttaaagcaacttccctataaaaaatatttgaaaaaaacgcaccgtttaacagttcgggaattgtgcacgtgaaaaaaaagggagtagaagttgggaaagggtagcgtccaactcagcctgaagctatttcacttatcaaaattaagaaaaaaaaaagagaagtttaatagcaacaagattatctgccaactggataagcattatacgtccagaaataaaggggaggtacataaaagatgatgaagactccttttggagttctcagaggcaggaagacatgaaaatgtgaacatgagatattgagatacatacagcattgatatttttattctcatcaatccataaaacaaacttaagtagaaacagtgcactgcacaatatatacttacatggtagagcgtcgaaagagatactctgcagtcttcttccccagtacgtccttttaaccgtttacggttgaaacgcacatatatattagtaagattgtcgatgtatttaaccaaatatggcacaacctgcagaggtaaataagataaaactttacatcaagtaaccataacatgaaaataaaaattgatacatctagcaaacaaatattctaagagatctgttaaacattcaaccgtgtaaagccgatatgcgtccatctcctggtgaacaaaactgactagactttcagttgcagagtttatccagtgatctagaacatttgatgacttcagaagtgaggcttgatctattggagaaaatgctgagaatccctcaatttcaagtctcttggcattttgtacaagaaatctatacgcattataccacggcaggaagacatctttcacctgttcaattttaaacaacacaaatttgaagcaatgttattttcctcagaaagacagatagtatccaatatactgagaaaggacacttacaacaccaaaaacaccactccttttgaaccgtagagactccgctcgtacaactggagaatttatcaaatacagtctcaaagcatcctggaaataaaagaaaacaataaattaaattgcaaattctaactcagacataccatgcaattgcaagcctcaagtcattgcatgtgtcttcagacagaaaatgatacagaatatacaataaagcattcatatctttaaaaatatgccacataccgctccgtattcatcgatgacttctacaggtgaagggtaattctttttactcttgctcattttcttaccatcctcagctaatacaagaccattgcatatcagatttttaaatgcaggtttcccaaataaagctgttgataacaccatcaaagtatagaacctgcaggatgacatcaaaccataaatatgatagatataattaatgaatatgcatataacaaagcatcatacacattttagaacacaatacacaaggattccactaatatcattagcaggaactgaatttagtttttgcccaccaaaatctcataaagtaaacgtgataaaagcacaagcattacagaattcttttaatcaacaccagatcattgctaccagttaacccagataaaacataaaatagcataggatactgttttttctcccaaaaagtgtaaaatattattgaagaaagaaaaaactgctatcaaaactactacagacaatccatggtcaaccataataattcatgaataacatcacatgccttctgaacaagcaaaaatgaattcaaggtaagtgtaactaattgttccactttcatcattcatgatctgtataggtatgttacaagaatacatggtacataatcatgaaatatcatccaaggtcataaatgaactgcaaaagaagaaaatgcaccctaaaattattagtaacagacacaagtataaaacagctgtgaaatttcatgaagtgaaacaaaccatccgcgtgtttgatccaatccctctgccacaaagttgccaggaaagttcttctcaaacaattcacggttctcaaatggataatgaatgtaggcatatggcatggaaccactctcaaaccagcagtcaaaaacctgaagacatcacagcagtgttaagtaagaaacatttaaaagaactgatatacacaagcattcatatctatagcagttcagacttcagaggcaaaaacgttcacatacatcacatgtataacaatgcaactaaacaagcagaaatagcgagtgaccttatggcattcagcagttagctactccctttgtttccatttacttggtcattatagcattctttttttttttgtcaaaatacttgtcgttctcacattccaaagcatttttagatacgtctttcccttcctacctttcatcaatgcagtcatactagtactagcactcctcacaaggaattttaatgcttgctttgggaaagatgattaggatgtaagaattaacgatggtagcaatgtaatatgctacagcttctagtttagtgtgagatttgctagagcgacaagtaaattgaaatggagggactatttgtacataaactcaaagacttctaaatgaacttgagtcctacagagtagaaacaacctaagcaaaaacaaggtactatttaatgctacatcaatttattagccaataataagacaaattggtgcaatcagacacaaggatttctcaccaaaacagtttcactgatcctaaaaagaaaaggtaattcaaggaattaactggtacaaacataactaaagaatattggtgacaaaaactgtgatatatttcaaatttcactcatattagagatcactaacagtgacgcaggagtagcactcacatgccatcaggtctattatctcaaatgggcaacaattagacaaatgtgtgcactgccacaagccctaaaaaatatttcaaggacttcgaccaatatggtttaatcctatttcataagaaaaatcaagaatagtactaaaacataactgccaaattgcatccatatttagaggtcactagaaacgatatttactgcaatagtaggaatcctagttgtaggtataaaatacaaagcaatgacttacatcctcaactcgtttgagcaccccatactccggacctctgctagagggaatcgtgataccatcaacatagtgtcggtgaagatcattaacctggtcatataatttcagaaaataatttgttcaggacatgcagaaatagcaattgattattgaagggaccaaaagcaatgttgaccaagcaaaagagaaccatatgagaatataattactgttttctaaaaaaaatatttgcaagagtggatcatagcatagtagagatatcaaccttgacaccagataaccgttcaagtttctcaatggaatccataacaacaatttcttcaccatcttggctgatccacagcggtagtggagtcccccagaatctacttctgctaacagcccaatccctagcaccttctagccaattatggaaccgcttttcctgcatacatttgttgttaacaaatatatcaagttaaatataccagctgataacgtaaactcaacgctcgcaacagctgctaacgtaaactctgcaagtttcatattaccagttcaattatagacattcgatgcaaatattgcaaacaataaatggtaagacatgaaacagaactatcatagaaaataagctatcaatgtcattgatggcaaatctaggtgatatgcaacaaaaaccagtgcaaaccttatccaattttgtaatagagcattagctaattactttgtgtgacaaacaagaaaagatagagtaccttaacataatctggaacccaataggtctgcttgttacattccagcaactggtccctaatcttttcaaccttcacaaacctacagaaaagctctttcaggcatacatttctcaaataaaaacaggtaatggaacaggaaaacaacaatgaccataaaagacagatgaacaaaaccaacaaataggaaccacaaagattcaaaagaaagccacattcgttcatctagatggaattaaaacatgatgaagttaaattgaagtaacttctactatctccgtcccaaaatatgagttttggggttgtacacgggtattaagaaagcaggtgaaattaaatggagagaaggttgtgattggttgaaaaaaaggaagtaggtggagaaattaaaaggtggaaggttgtgattgatttaaaaagataatgtaggtgcaaaagttgttatattttgggacaaattttgaatgttagaagttgttatatgttggggcggagggtacatcatgtacatgtgttacaagtataagatggactgcattaccatttgtgctaaacaaccagatggatagagaattatatataactcaaagggtaaagaagacaccgactaacaaatttgcatggtagcagcagtagatgcttaccagcttgggacagcccggtaaataagaggagtgcccgagcgccagcaaaatggataagagtgttcaatgctccctttactgacaagtcttcctttatcctgttcacaaagtttataatcttcagaatgacatcctcagggatataaaactatccaacatatgcaataaatatgctgctataatatcaaccaaaactgcttatgagttatgatttacgaaggtgcaatccacagagtgcagacatacattgagaaactttatgctatacatctgatttccttttgtgtgcacccacttcaaggtcatccagacaattaacatgataatgcataaaatgcacatacaggtcctgacattattccggtacatactagcatgagaatctatataatgcaatgtcctacggcactaatttattaatcaaatccaaaatctatagataatagtccacataaacaagtaggcaactaaaatgtaaatgtgttacatacagtaaatggtccaaggaatactgaaacaacagcttaccttaacagagttgatgatatccctgtcagcctctttgacatatcgcccactgaactcagatatcttttcaatgaagcagccatcatcatcaacggcgacaacaagcccactggcctggatatgaaacagacatcaggaaaaaaactggagtaaataaaaacaaatccgcatgactaacccaccataaactccctcctctaaactcacactccctttcccaattgttgccaaaaaagcccttagataatttaataaagcttgacacagaaaatatataaaagtacatattctagactacaacacaaagtaatggaaatatggagaatatgcatatttagtagattgataggtcaactgtctcaacctccaaggtcttggcagcatgatagttagtttaaatacccaaacagtaaaggagaatttttccaacctcaatgataccagcagcaagacaaacacggtggtcatcttcaccaaaagcaggagcacaatggacaacaccagttccactatcatcagttacgtagttatccgctatcaccctaaaggcagtctcttggagctccaagaaaaaatcgaacagaggtttgtatctgcaagtaggaaaagtaacagttaaaaacaggaagcgccccagatatatactccaaatttggctatggcagtatggcatgttccgtattgttctattaacatctagaaaacaagtatcaggagtaatcaactaagcttttttttaaaactgaaaaacagcaggggagggcccgtggttaagattttattaatataacaacagacaaaagccaaaaaaaaaaagaaggaaaattgcagattttggatccaatcctctagtgtataccaactaagcattactgatattaccgcacaaaacaaagttcaccaattataaaactaaactacacaagtggtacacattgtttgagtagcaaccaaaatgatctctccaaaagcatagagatatataaacgttgcatgaaaaattcaaataacaagtgatgtggattattcagccctgcccagaaaaaagcaagtccaacaaaaccaaacatggttaacaacttaaggaaaagcatcatctcacacacataactccgatatctactttcagaaactgttcactagttcagtgaaatgcttcctagcacagatagtgttaacatgcatttaactttcataatgtcatgggaaactaataataaactatgaaagtattatatgattaggaagacagagcactcactttaggcctactaaggatgatcctggaaactttgccaataattcatatgcttcagtatccaatccaccctgaacaacttcagcagtgcctcccttagaaggtgcttgcttctttccagatgatttagccttggctggcaattgcccaagcctagattcagcaacaacatacactgctccagttgacttgtccttaacctgttcgcaacacagtacacatcctcaacagaagaaaacatcaacttacaagcagagaagggtgacagttgtatagtttttttctgactaaatgaatggggtggtctagacatggagcagaataggaaacaatagtcgataatgtctttcttctacaatcaatttgatcgatttatcacaaaaaaagaaataagtaatgcaagaatgcatcattaagttaaacaaaaagggtctaaaatgttttttcgcaaacagtaagaacagggcagttgcagctgctagattgactggtacatggttctctatactgataaatatggattaaccggatgcagcaattaaattatttgcgggaactgggaaactactataagatcccaggagatatccactaaaataaggacaagcatcatgtatgtgcagcaaaatgattataggataaacaagacagccacttaatgcaatataacacagaaaccaatgatctattgtgtatagcattatgtatgcattagtttacataacatccagagttcaaaacttctgcacattttggatttactagcgagaagattcctcaagagtatttcactggtttttttgcttaatatatcatcagtgaaagttctgttccttgtaaaatcaagttttgtatgtatgatgttaacagtgggtaaacttgacagctatagtctaaagttaaagaatggaaaaatagcccaaggaaataaaggagaagtactaaccttgacatacacaagattggcattgacacacaaggctaagttgcttggaagtgtccagggagttgtagtccatgcaacaagtgctgcattgtccgcatcaccgataatagggaaagacaccatgattgctggatctgggacagtctatggcatcataaaaagaagttactacaaattgcatagaaaatttatgagctacgacatgaacaaagtcaataaccaaccctatagtcaagtgcggcctcaaagtttgatagtgcagtcttgcatcctgtactgtaaggcatcacctgggacaagaacaagagcccaggacactttaactttcaagaaattcctcataaaaataaatccattaacagaaacaacagataaaaaccaatcaattatttcatgtaatcacaatagcattatctacaaaatgaaaagccacttccatgtaacctaaactctgctattcattcttctcattgagacataccagaacaattccattctccacacatataaattccaaattctaataaaaaatacagttaaccattgcatacttctgaataccataaaatttcaggttccctaccgcctcagcttgtccactttgtagcaactaaatcataataaatatgcaaagcaaaccccgagactcaaaacctaatcaggcgtgagatcagaaatttaaccttgaaacccttgtagacgaggtctttctcccagagctgcgagaaaacccaccaaacggactccatgaaatttatgtccatggttttgtagtcgtctttgaagtcgatccacctccccgtgcgcgtgacgacggcctcccattcggcgacatacttggtgacgatgccgcggcaggtctcgttgtacttgccgataccgaggtcgaacacctgctgccggttggtgatgccgagctgcttgtcgatctcgaactcgacggggaggccatggcagtcccacccgaagcggcgggagacgtggcggccgcgcatcgactggtggcgggtgaccacgtccttgattgtgcccgcgaggatgtggccatagtgcgggaggccggtggcgaacgggggcccgtcgtagaagatgaactcctcgccgcccttcgtgcggcggagctgctcgtggaaggcgtcgagctccgaccacagcttgagcacgcgctcctcctccgcggggaaggagaagtccttcccctcgcagacgtcctccatggcctccgctcctgaggccgcgaccccggcggcgaatggggctagggtttcgggtgaggcggcgaccgcggcgaatggggctagggtttcgggtgatgaggcggcggcggcggcggcggcgggggggtaaggggaggaggggcttggaacaagagagggggaagggtttagagctggaagttcacgtgctgcgtgcgtgcttctccttctcttcgctagaagggaaattttcatttcgacacctctatttgtcgcatttgtacaaattgctctatttttatcgtgttcagtttttgctaactcaaacatgccgtggcattgacgagaaaatggatatttggccacgttcaaaaagcggcttagttggaatgccatcctaaaaacgtgtttcactaaaatgctaatatgaaacacgcaatcatagccactttgtcattttctctattttcgtcattttcaattccattttcgctagaattcagcttgatgagaccaaattgcccctgctcgtcggctgaaaggggatcgagatcgagcgcggcgaggtggtcttcgttgctgacaagggcgtcgacgatggtgtgggacggggcgaggccgagcttggcggcgagtgcgtgcagctggcggccctcgaggagagccgagaggaaggccgctgcaggagcgcccggtgtacgaggtccacgcggcgggatcgcgcgagtgagcgttggaggcggacgaacgaggagtgcgaggtggcgtcccgatggtgggtccacgtggccggagcagaggaggcggcgagcgagagcatggcggcggcggcggcgacgacgcgcagcataggcatggcaaggtccaccgccacttgcaactcaccggagctcgacaagattggggccgcgggcggtggcagtgggcaacgtaacggtggcgccgcatggtggaggcggtcggtggggacggcttgaagggagcggaggaggtggaggtagtgggagattggggcggtggtgacgacttcgtcggtggagccagtgaggaaggccgccgctgagagccaccacggccttgggcagccgcatccacagccggacggcggcgccctctaccaaccacttcttcgacgatgggcacgggcaacggcgcgacctccggtgcccaccgccgccaccttccccgacaatgacgagcttcgactgagttgataaggggcaattttatctcatcacctagtagatgagagaaaatcttttcgaaaatgaataaaatggcaaaaatgccaaagtggcggtagacgcacgcttcatattggcattttatcgaatcgcattttcgggatggcattctagcgaaaccgtgttttgaacatggctaaatatccattttctctggcattgacaatcccaaattttcgtaagtaacaacataaacatgtctcaaatactgtaacacgtcatatgataccaaaatttaccagaattcggtaataccaagttttagcatattttgctggtaccaaattatacagtagcattagatgtatttaggttgatctcttctcaaacttttattatgatagaagtttctgagttacaatgtagcattggtaaaataatctttagtttatcatgttgtatagttatatcttatcaattgttggcattaaaaaaatggcggggttagttttggcatcaaactgaacacaccctatattagcaaaagggtgccctttcacttggatattttactaacagcccatatcactacagaatcgtgcatatcgaactcctcaaaattgcaagaaataacggcacagtgatgcgcgataccatcatctcaagtccacaggatattaggatggacgatttttagaccatgttggatttggattaagtatggtgacgtatatcacgataaaacaatggttaacggtgaacaattagtactgtgctagctgctttagaaaatggcattttgggctatgtgtcagtactataatccagctcgactttttatgagtttttgtttttccaagtcattttcattcgtgttgtcaccttgaaacgagacagaatggctaatcttgtttgaactctccgtatatacattgcaaatacaataggagcagtgcatggtgtttcgtttcattcatgcaccatttcacacattgtatttgatatttgcatcagattgctacgaagctaagaacaatcgctgcattcctacatctacgcgcggttagctcgccggcgtcgcctgcggcggcttcttgatggtcttatcgctattgtgaaccatcagcatctcctgcaccgccgcggagagcagcgactagggccggttcaacattttaaagggccctaggcgaacttcacattatagaccctttagaagttaagaagttaaggctattttttaacttgtaatatctataaagcatctatactatagtaacagaaataaacatttctaacatgttaaataataaatcaaacagtttgcaagttgcaatataacaatttgttctcgataaataatatcgatagtatgattgataacttaaaaaacacacagtagaaacaaagtactatgacctaaaatcagtgagggaaaaatgtatataatcaagggcctaggcctaatgaaaactgatccaccatataccttaatttaattagcttatggacttatggtgcactgaatggttgtataatctcttgaacggttgaacccagaacggtagaaccctaagtccctaatcttggtaatttaacggggaacaaaaaataaattagaagaaccgatcaattctaatcagtgagaaggatcgatggattggatcatcaattctaatcagtgagaaggatcaattctagcctattgggctaaatatctatacaggatccccccattttagcttggccctaggccatcgtccttatggccctactccagagctggccctggccagcgacgccgcgctcggcggctgctgctgcaagccgtgaatagcacccgccgccgccgcgtgctccacctccatgccgagccgagcaaccgatcacgttcctcctcctatctcgcccaaaatctcacctcgcttcgctgctctgagcacgtctgcgctgcaatggcggcgacagaaacatatacgtaggcgcgcgcgcggccatcggctgccgcacgcggcgccgcgcccagatacggcggttcagcggtggattatccgttttcgcgggcggatggatcagggcgcgcggcgttgcggccggtggcgcgcgcgcgcgctcacgcggaggcgtgccggaagttggctgcggacgaacactctgcacgcggcgcggcgcgtcgcccgaacagcaaaaccgcattcacgttaattaccgttctttcatcaccgagctaatccatccgctccacgttaattaagttgggtttcaaacacgtgacgcgtccctgaagggaaaacgggtttaccctgggttgagaaggccaaattgcagggaaaaaacaacagccgcgattaacaggttaaaggagctctaaagcagttaatgtggcactgtatgcgtgtcgccgaccgccgctgacaacatgtaacctccttgtaaccttttcaccccctctgctcgaccaacgacttgatagccacgaaactttgaaaataagaacagcccttgccttgagacggtcacgtacgtcacgcagcccacgctcttcttggaagcatctcgccatgagtgccatcgccgccggccgccgtcgcgtcaccatgccgtactacgcgctgttcggcgaggtggtcatggatgggatcgtccgtgtggaacccatgggagggttcgacggtacagccactgcctactatcttcaggtacatacgaataataatcgatccctttctttccgttccaggatgaactccctgtgtgccatgtcgtcgttggtagtggtactgattcgtggtagttttggggctgatcaaagtgttagtttgttttaaaaaaagatttggtgtttgatctgtcttaggagctgtttggttgggctgattttggcccgttgcatctctttctttccacaggcctagtagaaaaaaaaatacgaagcgcgtgttaaaaaaaaagttgcgaagaacaccctggccagctgcttggattcgccgcgtttttctgatggattacttatctttagcagaaaaaaaaattgttcacttgttcatatgaatggtagtagtagtttaatgtattgtgtgctgtgggacgtaggattctggtggattccgttacttatatttagtaccaaaaatttagcagtttaacaaaaaaataatcaacacactcacatattcaaccttctttgatctagctgttaagctaattaactggaaccatttctattttgcattctccaataaaacatcctccttataggttaacagttaattaggtggtaatatttgtttcatttgatctgcagttgacatgcgacgtctgccgtggggagactgccaaggagatctgtctgttcccagatcacccctgccctcaccatctaggtcagatggcattcgtgatgtgctatccgacctgtgacatactgtatggatgcattttcttctttcatttccatctgttagttgtggtttctaaatttttgcttccatctgtttgtttgaatgtagtgcaaggactgtggctccctgggctcagtctccctcatacccggcaaggggaaagccctcacccctgattccaagaacatggtgatgttaatccattgcgatggacacatccctatcgctttcagcccggcaccctactggattgccaacaaggtgaagttcagcactttagctccagaaattttggtttggctgtgtgcgtccgattagacatagaggccgggtttatctcattttcttaaaaaaaaaagctccagaaattttgatgaaatccattgttcactgatgtttctctgttgacaggtcaatggggatcagcatgagttgcacttctccaaggatgggttcgagggctacggcgacaatgatgagctgattctcaccagtgccaagttcaccgtcgagaggctgaagaaggccgaggtgccttaagtacatctgaggtaagtacatattcagcggatggtttccccaaatgtgcaatttcttttgcatttttcctaattcatctccttttttgtcattggtgcagaaaatgtcattcaaatggcatatcaaggctaaagacagggcaaatcatagactatcacaagtggtcattgagaataattttttgtgcttccactgagcatttgtgagaggctggaaagcgatgttatctggatgatgaatgatatctgtcctttcttttggtgtttgtcatatgctttcagatctaaaaacttcgtctaaaaaaataacttctaaagatgaatctaaacaaatgcttgtccagattcatctctaaaaattagtttttttaaggacggagggatactccacatgcctttgtttctcggtttctgtacacatataaaccactaccatcacactcccctcgtttcgcagccgtctggtaaggccgacagaaaaggcccatccttccatctcgacttcggtttggtttagtttccaactttttcttcaaacttccactttttcattacattaaaactttcctacacacataaactttcaacttttccatcacatcgttccaatatcaatcaaactttcaatttttgtgtgaactaaacacacccttcgattatagatttgacctggtagaatcctcaaacaaaaggcaggtattagcaagatactagtataactgaataaacgttctccattctactatcctgcatagtaactgactatatgacaattgacagtcgaaattggaagccacacgatcaaaaacgaaggatgaaaggtagagccaggtatcttgcaaatttgataggtgttgtctactgtattgaatacatcaggcttgttgtttgttcatatgtgccaatttctcataatcttcataaattccggccggcatcgcccagtggaaaagaaaaaaaaaacaatccagtccatttccttgtactatggcccgtttggcaattgctagacccaagtgccttcttgaacgccacagctagcctacacagacgcaaagaagaatatacacaaatacatagaaacaaattacagcttaaagctgttaaactgaaaaccactaaggagaccataaattttattatgagaaattttaccgtccttaaaaaaatatttgaggtacctaaattctacttaaaatttttggtaatacctagtatctaaaggtactaaattttacactagacaatacaatatggtacctctggtatcttctcaagaatgataaaattactcttttattataggtaccgtaaaattttgcaactcatgttgttagtactcctggttaacttcaacgtagaacaacaatcacgtaaatactagagattaactatataatcttaaagatgaaaaagccttaggaataacaagtttatatgttatatagttccaatagaaattcggcagaatatttgaacaatttagacatgaacataaatgttaataacaaagacaatatagttacatcgcgggaatggaaaaacataggaataggaaaaacatagcattttgataggaatacaagtataaaacagaggattgcaaaatacaggaaaaacatagaaacggccatttgattaggccgcaggaaaaatacaggaattcgaggagagataaaaactcaaaggactcacaaaagatcatcgaagcagtcgagtctgaagaggaagcggggagggtgctgtcggtcgggagcaggaagggcgcgagggggagcgggcagtcgggactggggcagattggcaggaggaaagcgtggccggcgacggcgtagtcgctcaagaggagggcaggaacgcggcacgggggaggcgggggggattcagtgcttgctggcaaaatttaataatagtttgatcctatcagatttttgatagccgttcaagaaatttagttcaaagtcttttcaaaaattggtagcagtctttatgaaaaaaaaaactttcaaaactacccgacttgggtaccatagcattggtattttggtaacattatgtttaattggttatcctatcaaaacttaataacattaaaatttaatagagtttaaagtggcaataaaatgaacaaagtctttaactatttatcacaaatatgccagtcattatttatgtgacatgtcatgcaggtaagatcacgatcaaacaatactttagaccggatgatgtggaaaaccaagtttaataaactcgatgcacgcctagtttgtaaatttaggtaaaaccctgttataaatttaagaactgataacgcaatttactctgttcactttttacggtaaccgtacctacatctaatcatacgtgctaattacatggcaccatgctatctctcatcgtttgccttatataaaatcaacattaactaaaaattaaattttaaaacttaattttaaagttgatgttgatttttttatcgaaatttatttttcagcattggtttttaaatcgttaagaacatacgtagaaaacttttactcacaaattattacaattttgcttgtatggcgtatcatccgtacatgcccaaacgataagggggctaattgtacctgcggctaatgtgtgcattcagcctagctacctctcctgtcgaatactcgaatcacgttcgtgcatcattgtaacacgcgaaaattcagtatccgacctctttgggactgtttgataagtcactcgtaactcatttcatccgatcctaaacatcgtcctatttccattttccctttcctaatcattattttaccggttctaaaaaaactctcggagtatgatgttttatttatagagtggactgaaatactatttttcttcttactattttgttttgcataaggctatgttgggaagtgagttttgattttgctatattctgagcatacttctcgaactattaaacaatacgttttttctaaaaaaaatacatgtaggtgtttattaaaaaaccaaatattttttaaaaatatataataattgttatttagttaatcaacatatttgtcctcagctctatcgaactgagcttggatttggagggaataataatcggagtgaggtgcgggagcgagagtctttccatgatgacatgcgtgtaacaacttgggtcaacgtggctttcttctggctcactcgtactccctccgtttttaaaaagatgatatcattaacttttaactacatatttaattatttatctttttccaaaactttataattacataattttttttaataataagaacgttaaatgtgtgataaaaactcaacaacgtcatctatctaacaacgattgaccccgccgtgggcgcctgtgctggccgtcgatggtccgtactagcatcgtatccaccggcagtcaagacatgatctattgatctccgagtccagtttggtttggagaaaattgatagagagtatatatgggtctgggagctttggatgttcatattccagtacctgacgaatcgaattttgagtccgagtcggaattgggaacacatctgtccagccaatgaatacaatcgtgcagtctcattggtacgtgtacccaaccaagtgacaccaatcgttgatcttaagagaagtttaatattatagcccactattagctccaatttatctatagtcaatctaatagccaatttatataatagttgattactttactactaatatatggtcccacctatcatatacacattatgtcttggaatccgtgctgtagctggctacatatctgtagcatgctgctcttctctctcatcttttatctcattaaaatatatttacagctggctaatagcctgctattgtacctgctctaatttgtctgctgctgccatctcatcatggctggaaaaaagaggcagaacaaaaagagaggagacgtgtcgaagccatcgcaacgacggcaagcaaatcagcgcagtaacgcactacccgcggaacagaaacccaaagaggacctgatcagcaagctccccgatgacatcctcgtgcccatcctgtccatgtgcccctacgccgacgccgagcgagccgccgcggtttcacggcggtggcagcatctccacacccggctccccaacgttcggttcagcatgtccgtgcaggggcttctcgcgcctcttggcgagtcgagcaaaccgcgcgtgcagagcatggcgcgcacgcttcagcggcgctgctgcggcggcggcgacaccgtgaaaacgcttcacattggttaccggaaggacgtcccgttcgagtgcaggtacgcggaggagttcgtcgcgctggccaacgcgacgaggctggagctgggcgtgcagtgcgcgagggggctccccgacgaggacgccggcgagtggtcgctcgagctgccgccggcgaccgccgagctgcagctgcggctgtactggtacgcggtgcggccgcccggcctgcacggccccggcgtcgcctccctccggtggctcgcgcggaacggcctggcggtgctacgcccggagtcgttcctctccggcggcggcgtcgtcttcccggcgctggaggagctgcacatcgtcaagtgcacgcttccggccggcggcggcatcgacatcacgtccgccgccatgccgcggctgaggcgcctcatcgtcaccgacgtcgccgtgatgagcgccgccaccaaggccgggatcgccgtgctcgccgacgagctggcggagctccgcgtctcgtgtcgctgcgacaccgagcccatggcgacgtccgaccccgccgcctaccacctgaagccgcggttccgcgccctcttcacccgctactcgtgcgtccgcgtgcgcgcgcccaggctgcgcgtgttcgagtggcgctgctgcttcgccgacgaggtgcgcgtggagagcgtcggccgcctctcggacgtcgcggtggagctcgccgccggccggctgccgaggctgtgggacgaggagagcaagtctctgtcggtagaagactgcgacaagctgatgaaaggcatcctacgtgggctcctgcctggactgcggccgcgcagctgggattgggttcagaggaaatgcgtcaagcgcgatgaaaggtggcttagctttgagatctcaagtgccccaaagtatgatacttaactgattactgatgataaataatatatattactccatccatccataaatatttaacgctgtttcgtcttaataaaaaacttttgtgaaatatataaaactatatgtatacgtaaaagtatatttaacaatgaatcaaattataggaaaggaactaataattatttaaaattttttaataagacaaactgttcaacatgtttaagaaagtcaacggtgccaaatatttagatacgaagaggatattattattgtgtagagcacttgtttgtgccgagtcacccttcaatctaaccttgtttttcatgtaccacacgttgcttaagatacaggtgggcagaatttaaacgtaaatattcgtagaatgatacaattatcaccacatattgatctattttatcaattttttacatgactaattagatgatatgaaaaacgaaaaacaatccaatgcttgtaaacttttttcgtgactaggctctcttcggcagtggaaaaaggaaagaaagtttgtttcgttttccacgagtatgtttcccgaactactaaacggtgtgttttgtaaaaaaattatataggaaagttgcttttaaaaaatcatatgaatctatttttaaaatttaaaataattaatactgaattaatcatacactaatgacctatctcgttttgcgtatcttctcaatcttgcaatcttctcatctctcgattaaatcatcacatgttagagcccacaagatcgaagagctaatctccttatggcccctaacattgtaggccacaagcccgccatacgggctgctattttaattgagtgttcgatgatagaggttgaaaacccttcatcccttcacgcaaaattgagtggtggattagcgcatgcctaattaagtacaagctaaaaaactttaaaatagattaatatatatttttaaaaaataactttcctatataaaagttttactaaaacacatcatttaatagtttaaaaagtgtgcgcatgaaaaatgagggagtgaaagttatcagtctaaacaataactgtcatcaaacttaacatatactactccgtcctctaaaaaaacgaattcctagctaccaacctggacacacatgtccaggttcgtaggtaggattagtctatttcttgggacagatggggtattggctagtagagggtccaatttaactactccaaactgtcaactgtcgtcaaaaatctaatcggatcaaaccgcctaccgcgttgctacgaatcatggacagggtcatcaaccattgttgtacaacatcaatacatacaactctatcgtcacccggtatctccactgcttagtcgccaatgcctcgaataccatgacgtttgccagcatcaggttgaacgtggtcaccccgtccgccgctatcgccgcgcgggccgacatcgccacggcgcacgccgagtcacgttggaggcgggccagcacgagggacctatagctatggtgttgtccctgctccttcggcaagaagtctcgggagtagagtcgcagagctagcccctcctcatgctcccccacaacctctgtggacatgacggcggattggtggaccgacagagcagtacacattgtgtcgacgggtggtaccgcaactacggtatttggatggtatgaggatcgttggtactagggtatatgtgattgaggtaaaagagatggagacatggatttttatacaggttcgagccccttatcttacaggtaatagccctacatcctgttgaccggagccggcgttgctcttattcatctgaatcacacaagtacaatatttgggataacatatctaactgtcgtcgacttggcggctagataaccaactcgtagacgacaacagggtagtcttcctcctcgaatccgtactcggtgagatcagagatggcactagatccctcttgccggcttctgtaggcaccggattgggtttgtctaggctaaactctgatgtcgagatctgacagcgtattggtttgtattggcttgtggctttgtggcgtgtcccctctcctcctaggggggcttgtatttatacccagcccctttgtccaagtagaactaagtagataaatatggatacgatctgagtagtccttgtcgttttcatatagaactctactcgtcattccttatccggaactccttctatatacgaggtttgtttccgtataagatatggtatgtgatgggccctgccgagtttagtcgactactattaggtatgtggtatccataactatgacacattgtacatgggaaagtgatttcatccctcgaggggatatccctcgtttcatttatgccacctaaatagttataaaattttttgacaaaaatggtaagatagattaatataaaatatatcactccacaaatatgtaagactaaattcaacttctacaaattgtaaaaaaacaacaaatatagctgcaaatgtactataactatttttagcttattttgttctttttgttgcaaatacaataggagcagtgcacggtgtttcatttcatccatgcaccatttcacatactgtatttgatatatatttgcatcagattgctacgaagctaagaacaattgctacattcctacatatctacgcgcggttagctcgccggcggccggcggccagcgtcgagctcgccgggcggcggacggggttgcccgtcgatgcgctctaggtagaaccggctcggcatccacacgctcctgcgccaccgggcgtactcgctgaacagccacccgccgcgcccgcacgcccggggcgccacggcctcgctggtggcggcaatggcgccgccgccgccgcaatgcgaccgcatccacgattggccgggagcgcactggtgcagcgcgcagcgtagccccggcgggaggcgcgcgcagcagcaggtcaggaccttcctcttctcctccggcgacggtggcgcgccccgcctcagcatgctcctggcgaccctcttcgccggcggctgccacgcccgcgccgcgcgcttcggcgctggcgccgtggcctcccccctgtccacgcttccgccgcttccgccgcggcgctcgccggtgacgggcgggaggcgcggcgtcgcccgcggcggcttcttgatggccttattgctcttctgcaccatcagcatctcctgcaccgccgcggagagcagcgacgacgtcccgccacccatcgcaccgggcgcgcgctgcaagccgtgaacaccacccgccgccgccgccacgcgctcgacctccatggcgaactggcaaacgatcaagctcctcctcctcctcctcctcctcctcctcctcctatctcgcgcaaaacctttcctcgctgctgctctgagcctctccgagcgtctgcaatggcggtgacagaagcgggcgccgcactaaacatataggcgctccctccgcccgcgcgcgcgcgcccgcggccatcggctgtcgcacgcggcgccgcgcccgcccgccagcccgcttggcgccacggatggatgaggacgcgcggcgttgcggccggtggcgcgcgcgcgctcacgcggaggcgcgccggaagttggctgcggacgaacgaacgcacgcgcgcggcgtggcgcgtcgcgtcgcgtcgcccgaacagcaaaaccgtcgcattccgccacgggcagaattagcgcggcgcgggcggggtggttagtttgcgcgctaattacagtttttttcatcgaactaatccatccgcgttaattaagttgggcttccatcgtgtagcgcttccctgtagggaaaacggctttcctatacggcgtgtatacggggtgagaaggcggaaacagcgaatacgtcttcgaggtctaagactgaaaaacgccaccaccaacaacacgcgaacgctgaagagataagtcgagagaaccctgcgccgtcgccgacgatggggctcgccggcggggcgcgcgtggtgctcttcgtcgtggcggcggcggcggctgcggctctgactgccgccgccgatcagatcttcaccagttcaggtaatcgcgtcggagtctcggcaagaaatcaagatccgtcgtgcgccccccatggactgtccctctcttcatgtcattctcgatccaaattcaccacttgctcgatgcgatttctcggcgtatattgatggaatacttgtcgatttcattattcattttgttcgattatgattgcctgctgcttgcttcacggtggccatgttcatttactgcctagatctagaattctgtagttgaaggctgttctttgtgtgcttgtatgatctgaaattgctaataactgatgatttgctggacctaactccatttggccatgatctatttattttcttacttttcgatctctaattgctgcaagaggaaaaacaaagcagaattgcactgaattgttgccgatgtcaggtgcgccgtttgggcggaattcgcgtgagccgaggtaccatgttgagttccatcctgtcgatgcgccatttaatccagtaagtttttgctaaattttcctctgttttacagttacaggaataatcagctttatttagttgtcacaaattctgcacactcggtgatcatgtgtacatcttttagaaccgaagctagcaagatctgaacaatcctcatacctgctaatgtagcctactagccttggtgttggtaatataaaggcattgtctaaactgtagtgagatttagtgattagctgtgataaataaacgattccgatctaagcaatgttgattatgtttgttgtaaatcatgtgtttttcattccattctcatcaaaaatttcagttattttcagcaattgtcgctctttactttattccaagaacacttcctgttatcacaatcaaagacttctatggtgtactatgcaggagaatggccaggaatctgtaccaatgactagccacgtggggaaacattatacatgcttcctacctgttgaggaaacaaaaaccatgaagtcgataatcccacaaaacgcaaccaatgttatcatagaaagtgaacggagagttaagccaaaggatccagatgaattgctggaaattctcaaggatcagtgcttctacagggtgagatagaactctttctttatgcggtcagtagaactgcatgtgttccactgcctgattttatattgactgaacaaaaactgattattgctattactattttgacacagcatgaaggttggtggtcttatgaattttgctactacgggaaaatccgacaagtccacgtagagggcgagaaggtaagctgccccatcctgtttattttctttgctcagatcagtcattgtattttatcctctttatgcactatctaaaaaatatctgagatgcgtcaatccaagagttgctagtttttacaggagagacaagttctggccacagttacacactacattatgaaaaataaaatattttatctttgacaataaatgcagccgacagtttctagagcacttgaattgccacgtaaagtttgtgttgtttgcaggttattcaagaatatgttctgggtgaatatgatgctgatgcaactgatgcttactatgaaaatcaaacatctgactctgctgatgaagatgataacctgatagacacctctaagaggtaatatacgaatataaggatatataaagcaaattatatctgtaagctaaacccacttgaatgaatctcttttcttcatgtttcaggtatcatgtccacctgtacacaaatgggactgtctgcgatctcactgatatgccccgggaaacagaggtatgaaaaaaaaaaacgttttgtttctatgtcatattaagtagtatgtttgactgcacttgctactttctttctacaggttagatttgtatgttcagaacccactgtagtgattagttcaattaaggagatctcttcctgcaaatatgttttaacagttcaaagcccaatgctttgcaagaatccgtaagtttcaatattcttttctctcaattgtctttacgccatttcatgttttgagctcattttcctgttctgcttgcaggctatttcagcaagaaaaacgtaccctctccattcactgcaacgagttgctagctgaagctgaagccactgtggatgatgactctcttccaaaagaagctcagatcatcatcccagatccagatggattgcataattatgcagcttatgctacttgattatgcatcattgttatagcatcagacagtgaagaaaatcatcttccgggtgcaacggcaatttggcaatgctaacaatggtataggttgttcgcggagcatattatccattcatgtgaagcaggtttgagatcatcagactaacattgatcatgaggaacattacgggcgatgagtgcttctgtactagtgcaaacgaagtactaaatttcagtgtcaaactgtagacagtaacattttcttgatatatgtttatagaagaaaatcttgtgatgcggaaaagtgcatgtgcaaacatcgtttcattgcgagattatggtattgctctgaagtgaagaaatatcatgtgcattgagagcaaaggtgttcccttttttcttgagtgcagatgacggcaagtcggcaacacaagacaggggatttgcttaatgtaagatgttcatactaagtcaagggatttgctttaatgttaagttgtcacactaagccaaaaagcatgtactccaatttcaatgctatgataaagagcaaatttgcttttgcgattatgttatttgagaatagtacaatttgcaaaataaaggtgataagaggacttcaaaatgccattagaaagcatacagaactaaacaaactattctccaagaaacttcgatctgtactttagtcaactgtagaatggttcaatgaattgacttggcctactatacattttctagtcaaaccaaacatcgataagatcttcggtgaacaccattagtcaacacaggatttggttaagcgttgtacaagtggcgaaattgcctatgcttaccaaaatggcatgatccaattatcctaaattgaattactccatctaccctaaaatataacaacccatatagattcgttgtaatgtagatgaagattaagtaccaacataaaaattattagcacacgattaattgagttttaattattttaaattaaaaatagttttatatgatattctaaagcaaattttcacattaaatgtactaaagtacttagcattttgaaaatcatgctaacaaaaaccgagctaaaacttgcatcttaatcagaactgaacgagcctgatgtgtcccattttatattaattgctatattttgggatggaggaaataataaaattattttgtgtgatatatataaaatccatctaaatttgaggacgtgcagttcagggctagtagtgaatattccacgctgacagacaggtgggccacgcggtaggcagtactagccactgagtgggacccaccagcaaccgctggccaatcagatcgaagggatgtatccacgcctcccatgtggccggaccgcgcgagttgcagatccccaaatgttactcaagcacatacccacacccactgattgcgtggaccccacgatcctatgggcccacatgtcatttgctaatctagtgggtacattgaatcgctgggttggtggagctaactgtactcggaattaacgtaaattgactatcctctttagtttatcggatacttttatgagagagaaggaagaacagagagagagagagagaggagggagaagaaaaaaaataatcgaaaataaaataaaataaagagagagatagaaccccagatctctccacagtttcaacgcctcaaatctctcaactctcgtcccaatccttaggtacacgcctccctctctttcctccaatttttgttcggagggaggacgaatttcagttcttgtttctgtttcgatctccaaccaaatctggcccaagaaaatttgagtttcttgtgtggtagatgccaccaatgtgtgccaagcccctctgagatctcaccggctgatcagctgatgtagtttgcagtcgaattttgttccgtttttgggggcaagattgtgttcttggagctgtagattggttatacatttttttttccatttcttggctcagttttgtccattcgacgaggaatttctcgtcgtgtttgttgttgattgattgatccaatctttgatgcgccaagaagcaagatgaacacgaattactcgtccctcccattgacctccatcgagctccaatccaaccagcgcacatccgaggtcgccaatggcgtcggctacaacggccacgccaagatctccaagcaagattcgttcctggtcgacggcgatgccgccgccggcggcggcggcggcgagaacgacgacctgccgctcatcggcgacggccccgccgggccacccgagggctccggcgtgcccgccgcggtgttcaacctcgccacctccatcatcggcgccggcattatggccctcccggccaccatgaaggttctcggcgtcgccgtcggcctcgtctccatcctggtcatggggatcctctccgaggtcaccattgagctgctcgtgaggttcgccgtgtactgccgcgcgctgtcctacggcgaggtggtgcacaaggcgctcggccgtccggcgagcatcgtggcgcagatgtgcgtcatcatcaacaatgccggcgtgctcatcgtgtacctcatcatcatcggagatgtgatgtcagggtcactgaagcacattggtgtcatggatcagttgatcgggcatggcgagtgggataaccggaggctgctgatcttggtggttcttgtgatctttctctccccgttgtgcgcgctcgagaagatcgattcgttgagcttgtcgtctgctgcatcggtcgcgcttgctgtcgtgtttgtggttgtgtcatgcatcattgcgctggtgaaggttgttgagggtaagatcagtatgccgaggatggggccggattttagctcgagggcagcaatgctggatttgctcgtcgtgataccgatcatgacgaacgcctacatctgccatttcaatgttcagccaatctacaatgagctcaaggagaagacacctcacaacatgtacaagattgggaggatcaccactgtgctatgtgttgtggtatatgcactgactgcggtctcagggtacctcttgttcggcgaagacactgaatctgatgtgctcaccaactttgacaaggatctcgggatcagattcagctcaatcctcaacttcattgtcaggattgggtatgtcatccatctggttctcgtcttcccggttgtccacttctcgcttaggcagacggtggactcgttgatctttggcgagttagcgccccatagcaggaaaaagatgctcaccttgacagtggtgctcttggcactcatctatcttggctcgacgatgataccaaacatctgggtggccttcaagttcaccggtgcgacgacggggttggcactggggttcattttcccggcccttattgcattgagattggacaaggaaggcaagtctttaggtaagggtgagaggctcctgtcaattgtgatgcttggtttggccatggttgttagcattattggagtaattggaaatgtatacagcctgaggagcaagtctgcatgatctatcatgatgaacaatttagtagggttagtgcattgccatggcagtcatacagactgtattagcatggtcagatacagaagacagcagaggtactacttgagcaaagctcagatacattttgtttacctttagaggtgcaggagcatttcttgaaggtttttgtttttgggagcttggactagattgacagattctttgatgtatttgcatttattggtaaggcagcacaagatgataagaagctggttgtgttgtactgcgaggttgttgcctgtctactacatgaaaagaaaagaaacgatatgtttggcacttgagttttcaggcgtttttcataaatgttcgggagtagtggagtatagagcctggagatcattttcaccgttgaaaccgtaggccagaaaattactggtttaatttgcagtcgcttgaatgtaatgaaattctcccccataacctaagataaatgctgagttgcacacatttttatgttttttttggaagtacaagccctcttaataaccaaagtaaacaacgaagcgtcgaccgaaatgtccgaaatattgtactcttgagatctctccaaattagttgtatggatacgaaaactgagcatcatgtaggttagagaatagagagatcctatcagggccatcgccattgttctcgagaaatcaaaagtctgtcacgatagttttgctgaatgctatagcacccaccaaaaattaaaatatcaatcatgacattccttttcttttttgttgcaaaacggtgtcgatacatcagtaattcaatatgttacaaaagaatgcaacaataaataacagaactacaaaattgttgtctcatgatcctgaagtactgctggtgcatatcgttgttaacagcacgcagacgccttgtagctttaccctgaatccctgagtccatgacagacggtatggtaagacagaagagaatggtacagcagccacaaagaagccccacaccaacctgcgagtgacaaggaaataatcgagttatggaagataaactgcagaagaaaccgcctttcgctactactagataaacataatgctggcaggccggtatctgaaaatattttagcaccaactaattaatacaaaatagtaaatcttttggcaaaagcaaagatcaaaacaagcagtatcggtgaaagagacgaaaccatttggcatatcaaatgaaaaagaaatcacctgctactaaaactgtgagttgctgaggaatgtaaccatgcatcgtgcactctgaaacactttgtctatcttctgccaaactaagctctggacatctagaagcttcttcactttgtcctgaagcattgagtgacgccgtatcgtttcaccatgtatctgcttccaggaaaggcaaaaatcaagtttaggaaaaaaaatacataccatatataccctgtgagaaattttcataacagagtttttttattcttttacaaaaataacagaacagagtgaacaatatataacagtgtataccttcaaaaacaatttgagaacagcctgaacaaactcaaagttattcctgcaggaaagctcatgtatgaagtagtccaacagcaatgaaatggattgaagttcaggtctctgctccaaattttgtggctcatcatcgattaactgtagcactcgtagttccatatctaaagatgatggtgataagccttttaggtagtcagtaaatgccgaatctgtaaaacagatcaagagtcagcatctcaaccatgacaagcatcagcagcacaggccacaacactaacaaatatctcccggttttgaccatgcttctgtcggcaaaatatggcactacataacgacttaatagaagcagcaagtgaagtatgtgaagcaacagtatggacagcatctccttgtagtctaatcaatgagctaaaccatgaaataaggtaaacttgagcaaatatgcctataaacactcacaattctttgtatctccacaggattgtaacagccgactaaagtgagaggagaggtcagccatttttttgtgacttgtgtcctcagtactgctgtctgtttctttactgttcgccgcaggctcaaataatatctcccccgaaagggatggaactgtgggcaagaaaaaaggcgccttctcaggtttctttggtggctcaattggtttattccgaacctgaagacgcagaaatatgatgagaacttatttagttgttcctttaaacaaaaaaaaacattataattcaaagtagcatagtgatgcaggttacacaattgtcacttgcaatgtaaaaaagtatacctttataatgtcaagattcgccagactttgccattgactcttgggaagcaaagagagggtgatcatatttggtatttggtgatccattataacataaggtttaactttactttcttttgaatcttctgaactatgaatgggctcttcctcagatttttctgttgatgaaacagtgggcaaacgcacatttctgacatgtttaccacttgaataattatcaacatttgttgatggtgagaacaaagcttgattaaccctgtcaaaattagaaagaaacacagcggattgtatatcagaaagaataaaatacagaacactgcatactatatatgttattcataatagtataatattatggagtagaagggaacagctataagctaccacattcaagtggttctaaccacagtgccgacattcaagcaggccaacgtattttcaagtgaatattacgagaaattatgccactaagagaagtccagttatcaactgtgccacttttttccattggtccatttgggaacttctcgctttgccattttcaccccaccccatctggacaaggggttttgaccagctatggcatgctagctgctgaggaccggaggtgacaggaaggggctgccactagaggcacaatggttggtacttgaggaagggaataagacaaggggtagaatggcactttggaggctctgaacagacagaacttgatggggatggtagaatggtacttgaaggctctgaacagacacgcagacagaatttgatgggatgtcaatactgaggtggtttgttagtggcaaaaacaagaatgggaagacaccattgggaagaaagtactttgttggaaaacaatgtgcaattggttaagttggccccacatgatgtgctaaaaaaccagcacactggagactgacttacgagagcaaattttctcaacgctgtgctgataatatttcaaaaacaaaggtagatcttccaggatgaacctcatcctcttttgtactctgaggtggtttgattgtttacttgcaactgatggtacataatttcagtaccatgtcatcaactacaggatggacagataaaattgtttatttgccaaatgagccatgtcatgattttgcgggagtaataacagatggaaagcttatctaatattttgctaaatgatatctccaaaattaacttagatctgcataaaaggtctacaaaacgaacatggtgagcacaagtaaatgcaaaagaagcttaccaaagatagacaccattttgatcaacatgggtggttgccaacacatccatattaggagacatagagagagatgttatagatacatcgacatgcattgcatcaatctgccttgctaaactgatatcccatattctaagagtcccatccatactcgatgagatgagccattttccatcctcactgaaacacaaatcagtaacacggtccgtatggccttcgaatctacggaccattttcattgctactgtatcaaacaatataagcaccatatcatctgctacagtagcaagaagacctgacataaaatagcataagactgttaattgggcatagaattatacacgagaataatcaaatatgttaaatactaccatttgcccggtggtatgcaatcttggtgacagatttaccaatatccagtctggattttagcttgcaacttttaaaatcccaaacctgcaagaggggacaatcctataggtaagtaatattgtcatggataaaagttcacattatacttgtaaagataagttcaaacatatgcagacaaatagctggtgtttgcagcaatatgcaattccttatggtaggactagaagatcagcattaagaatcaaattacccagctgaggacataaagatgaaacaaagtgcacaacaccactctgtaaaatgtgcagtaaaaggctgtttgtagtttgtataattacttagcatgccacaggatttacaatagaattaaaaagcaagagagcatggaaccttaatatcaccaccgtatccagcactaataagagagccatttgtagcatcacacgctaatccaacaacttctccgtcatgtgcacgcttaattgccaacgatgtatcaatataactgccacgactaatccccgattgcaggttaaatttttcgatccagccaccttcagtgcccaagaaagtaaaatttccacatgcacttattgcacaagcctgtcagaaaaagattaaaaaacaaaataatggaacacttgtaaactccaacttgtgaaagctaattcaaagaaaggtcacattgatctagtctaaaatgaaaattccatacatgcaatttaagaaaacatgcattaccttaattggtgacttgctgcctgatgacggtgtcagaatatgctccccaatgacaaagttctgtagacgccatacatacgcttgtggagtatccgtatggcaggtaacaacgttacaccaatcacgtgagcgtatctcagctgataacagaagcagaaggtttctcagcttaagttatagttttttttttcatacaggcaaaaatataaaaagaaaagggtgcaaatcagcaactagtttacaatgcacagctgccaaacataatgaaacactttgttacacaagcgctaagcaaatgaccagatcaaagatgttggaggacatagtttctgggtgccattttcattccacaaacataaaaagcatttattaaaatattcacattgcaatgtcctaatagattatgaatactgacaggcaatattaaaaggccccaattggaaaatcttcagaggtcacactttcattgactttgacaaaggtcatagcagcagtaaaatcagatagttctgaagaactaaaagaaactgcactatgaaatgggggtcgtctgttgtacaataggcatcctacatcttactacaaaagtttatccacttcttcaactcttatttctgttgccgctgctctccacatgtgctcctttgtaatggcatgtttataatttccagaatgtagttgtttccattggaatacaagcaatttctctaccaaggagaaaaaagggtgcacttccctgtctgatgctactttcaatggccatagtactggtagaatatttattggtagcataaaaatagaaaacagtatcattactgccagtgacttgtatttattcagaaaaacagaagtggaagaacagtatccctatatatgtcattagtaaaagcaacagaagtattgcaaagaccaaaagagtaccacaatcaaatgcaataactggtttcagcttgatctcttcctcctgcatgacagagaagttttaacatcttagagaaggaaaaacaaataggtagggaataaatgtagtaatcaaatccatacctttaatccaagcttttttgccctttttgacacatgtctttgagaaagttctctgctttgttgatcctgtcaacaaatagttgtgtcaatagaattaaatagtgagctaagctaacgtttcctttttctcaaagaggcaaggcatcctgataagaacgtaaacatgcaggattcagcgaaaaccaaacgcatctgatgaatagtatttccatagttcactcaacacctcaacagaaagaaaaacaaggaagaatgtcggaagtgataggaattgaagtttcatttatgctctcactgctatgctcatattgttgtcacacagaaatatccaccttactaatgcaggctaggataaattcaatttttttagaagaaaatgggagcagaccagttaataataaaataatagttataaaggtgtaagtccgctgaaacaatagtatgcctaaaacatgaataaacttataaaaggtcacatgccttagcatggttgatcagaatagaaccattatacagttttattagaccagagagtattgaagaaatgacaaataacagactcagcatcctaattgatgtaaaaacgtacacctagaatgttaatcatgatgtatcactgccatgttcctaataagttcctcgaaagtaggagatgtgcttcatataaaagttaaagacagtgagttacctggacaactgaaaaaaggcgaaaggcacgatcttgaccagcagataagatgcattttccattgccgtagaatctatcgacagaagtatggttactactaataaaatatccaactgattttttttaaaaaaagcaagacatgattgaaacacttgtcacctaatgcaccgtggtggagcactatggccacttcgaaatcgtaacaaacgagcatctccatcattagtatcaaatatccacatctggtaaacagcatattagattactggactatcaagataaactgatataacgttttgcagctgataaaactttatttgacatggtaatgccaattccagaccagtataaatttcatctttcctggctagtttgtttctagtgaggatcctggaatacctcactaataaaaggctaacactgaaataccatagacattcaggagagtacaactggttggtgcagcacaaaggcacgattttaatgcgctgaatcattctcaccgctactaagtgtacagttgatgccccacatctggttaagtactagctgcatgcagctttggacctttgcatgtttctgtacaacagcttttaagcttgacacttacctttattgaattatcagaagccgagctcatcaaaataggctcattcgcgaaaaaatgaagtgaaactatagaagcatcatgggcctcccggataacagaatgaaggcgccttttctcaagattccatatactaataacacctgacgatcctccagaggccagaagaggttgcccatctggtaaaagaatatatgaaacacttcagctcatgtatgaaatctgtatcatagaaaaaaaatgcaacagcagcatttcctgaactgaatctaacatataattattaggtggtgccaaaactgccagtcccatcttaatatgacaagctttctaacaagtcatttgagtattcacagtcaagaacagattacaggactaaaccgacaggcaaggaaaaatgaatatatcaggattttgattggacatttccattcttgtaataatctggtgaaaaatgttaataaaggttctaatttacaacaagtcgatcaaaacacctgttcgaaatgacaatgcagtcacagcaccacgaatttgatgattgaaagacatcaactcttcatcatatcgtatattatgaacatgaattgttccatcagaacatccgactgcaacaacatcaagggcaggtgaagaaacacaacaacatactgatgagttccaacccttaaactcataaagtttcttcttagtgctgatattccaaagctgcaagggaccctcttcgcttccaatgatgacctaacgtaagaccagattagatttattaccagaaatggaattgaatgcacaataaatttgacctctaaactatctccaaagcaaaggaaactccacttgccttatttagataagtatcaggatgcataatgcaagttggtgtaaacttgtctcccaatgatatgttcccaacaggctcactatttggctctgatcctctgaaggaccatataaatacattccccttaatatctgcacttagaatgtattctccaaatgggtataatatattgatcttttcttcatgtttgctccaagtaaccacctgattgaaagagatccagttagaacataaaaaagaattgtctgattgagaggaatcctgtagcagttgatgggcataaaatgtagcatttggatatcctttttgggagtttgaaagaaccatttcattcagaaactattcaaatttccagtttcaaatattataggagcacattatctgactatctccaaaatgtagcaacctcaagtgaaccagtaataatatttagataagaacaccaagcccctgcttttaccagtaataatatgaatggttgcctcaatcgcctaaacaagtaactagtactagtagtaactaacacgataatgcaagatctgctattgcaagcacagtaacgccctcacctgatcagttcgtttgaaaacagcgatatcacttccatacgcagcaaatgtataatccttgtacgatgcaagagcacggatcttcttgggcaattgaggtccttcgatcacataaaaccataaggaaaaaagctatacatgaagaatcttcacatagcccaaaaaaaaaaacagacttaccagaaaggaccaaattcagtttagcacactgcaaaacaagaaataagtccagttagtttctaaaaatgagttagctacatcagaaaactatgcaaggtgagagaggctagcgttaaagctcatatgtacaatgaagcagctcgattgaatcgaggtagtagtgagcaaatcgcattgagctaataccacaatcagtaactagcccctgagctcgaaccatgacttaaatacacaatcaccgctccaaagcatctcaaatcacgcgttctaacttgtaccagatcaactcgctccaccaagctccccgtaagctactccgatttgagacgcgagcacacaaggccaagggtggacggtggtagggcggcgtgggggtgggagacgagcggggagaaagcagctcacgttgtagacgtggaaggccttgccgacgctgacggcgacgaaggtctcggtgccgaggcgctgcacggagaagggcacgccgccggccgtgatgtacccgatggcgcggaacggctcgaagatccccatctccctctctctctctctcccaccgcggcggcggcggttacttctccggcggctgctgctgctgacgatgcttgtcgagggtttggccgctcagcttgggtgggggtgcgccgccggcgagggttttagaggtgggggttttggagcggcggcgggagaaggaagggtggacgctgtctgggtaggtcagtgttgttgcgttgcgtgatgatgaggtaggatgggccgggccgggtgatctggaccacgagggcatctgggtcctggaggctggagctggaccgagcccaagttgcgagttctaaagtttctttctttttatttgtttttcagttttagattagataggcagagatatttcagttttcaatacagggaaaattctgcatgaacttgaaattcttgtgtattttaaatttaagaatttatttataagtgtcggtaacatggaagcagggaagagttgcaaacttctttggtcctctccggccacagccagccatccactggtggggacaagccgacaaggccatccttctcttaaaaatcatgaggtaccatactcctcactcctgaactgaatgttcatgggctaaaaagtgattaactcgagatactcagatacaagctgcaagcaatgtcgtactgccagtgccagatacgttaaatggggaataactggaaaaaaaaaactattactctctctgttccaaaaatatgcatatcgtccgtatacatttaaaaaccatgcacaagtacctatattttcgaacggatgcatcatccattcgtaggtcctacgagagttcataacacgtcaagagttcagatatttgttttgttattacaactttctggactgtcagtacagctatagatcacaacaagagtatctaaattcagaatttgctaataaatttacaattatcttagtttacaactacattttcccacagatgtaagatccagaagctaaaatgctggagttatattgacaccaagggacacagcaatgaagatgtttcatgctgctgcatctgcacaaaattgttgccctcttttcaggagcgacaagacatttctgaactgcggatcagcggatattcatgagcaccttgctaccttcatctcctatgtattcaccacaaaaaatactggatctaatagatctgaattttcacacagctagcaccccaacaatattaacgtaagctagcgaaacctatgtggtatgtcacaagcagctaaataaataatggagcctcagcatgaacacatacaatctacagagagcacacacatgatctgcatataacaaatcacaatgggagaagagaccggacatactgccgggaagcactgtttcgtccaaggcccagccctaggcccaatggtgttctatcggtcttcttactgtggtcacaacactgagatgaacttacttgactgtgagattttgagtgagcatgtgattcagcacaagaatggccagtgccgttaccatggtgggaagggccctcgccattctgagagactgcgtttgtcatctgtatcattcccatttcctcatcagtgtgtgacgtatgatcaagacgttcaatgtcctcattgtatccatttaacaagaattctgagcagttcttgcgcgctccatggtcaaatgggtttctgaatcttccacctggacctcttagataactgtatctcatggaatttgccatctcgtttgttgtaatgttcttcgctatctgcatgggagatggaagtaaggcatgaacacgtcataaaacagaacagaaaaaatgctcctcaagtcctcgtgtccattctgaaaaagttatagctaccagatggaaagatctgtcgtatacagaaacatcacagaaaactaattaatagatcaaataagccagataatacctggcatctactgacttcaactctatcttgtaattggaatatcagttttgctactgaattatgtatcacagcaatttcattgcctaaaattcaatgttacttctactgtatccaaactttataggggatacacacatgaactatataattatgacatgttcatttgacaaatccagcaaggcttcataaatttctggggcaaaccctcataaaatcagcagagaagtttctatatgaaactttgtattacagaacatttactgatggttgtaaagacaataaacatgcttcctggtttttttcattatcaggtcaaaaataggttggtttctcatgagaaaaaaaaagatcaagtagcaagctaaattcaacctttacatacctgagatgcctggactactgctagaactgcaacaccgaagaaaaggaagaggtccattatgaaaaaggaaagtgccccagtatggttaaaagcagaatagctgagccaaggaataaaggatgctggagaagccggatctcttaccatccctgtgacaaaaacagcattgaggcttatggaaattttttttcactccaaattattaaggacagaaccacaaaggacttagcagacaatacttataatggcagcagaaccagtaatgatcattgcaaaaacttctagagtgatgaacatgaagaattcccatttgttcttctgcagttacagtgcactatagatcagaccaaaggacaagaaggtatccggcagggaaaaacattcaaacgaaaagctaccaaaaaagagagattgtattgtagagcacagagctcttcataatgttatagcaactttcttaagatatacatagcaacataatcttctgcattaaaagttcagcattttaagacataagttatccatttcatctccagaagagatgacaaccatgtttgatcactactcaacacagtgatacccaaaagaacgtaagtaccttgccaatgcaattagatacccaaggacagtgatggtcaaactgctcaacacagcgatcacatgtagaacaatgcttcgaacgaacaggtctcacaatctgtagaataacccttggaatcagaggcccaaatatcaacctagcaaagagaaaactaatcgacaatgctgtacttactttgcatgttatacaaagctgtgaccagttaccagacagaagtgcgggattgtctaactccaacttcaacaaaggttcctaaaggaataaatactcatgattaggattgtgaaattttggatatattgtttggctttaagtctggaaatgaatcaaacaagattcacacgagtccaaagagaagataaatgtgcctgtagaaagctatattaactaagctaatatttcaaacttacatcatccctttgattttgtgaatctcgtatatttgctttgatgtagccaggatctttcctgcagatagcataggccaatgtcatgatgcagctaaaggataatcaataaatgctgcatatctcatctggcgatcatgggggtaggtaacagaagaatagcaggctatttacacacagtaaaatgctcaacagataaagaatgcaagaacagaagggcataaccatataagtaaaacatctaccacatttctgataagcaggtcagctgatgtaaaatgcgtcaacatgaaaaaatatataatgaattgtgttactatattgaaatttgtgaagcagtatctaacaagaatcaacatgctggcaatatgtccccatgctatcttgagttttcaacttttaatactaactgccaactaatcttcattttcgtaagtacctgctacatttatagaacatgactaggccagcagttgcaaggaaaactcctgaccatgcaaacagcccaaatggtgctgtcatatccatgatatattgacctgaaagaatgaaatgtagtaaatactgcatcgtgggagatcaaatggagtgagcgacattggaaatggtacttacctgatataacagagtgtatatatgtagcaagcaagccaacaataatacaccaaagtacaggagctagccccagtttcgatagctttccaaaattggtattcccatcacatcctctatcatatacccttttagcattgtcctgcaagcaatcatcaaatcaagtcttgtttctgtctaaataaacaagcatcatcaaaaggatcatcttccagtagattctctcttgaaataccagtaatattctttcacctcaaggtcaatatgaccactcttatgacattagctagattaacaataatgaattagtgaaaaggatattaatctacatgtgcaatcacaaaaagtcaggaaatcatttcggttcccaaactcacaacgaatctataataaaaatatataagagcatataagcatcagcaaagtcacaacaaagagtagcattttgcctccttggttacatagttttatgtcttatgctagtttatgacatttctggtcaataatatcatttccatgtgtagaagtcatagaattttgcagcttcttgtactgaatctacagggaaactacaaagttcagaaagcttatgtatgcaattatgcataatcagtgaattacaccaataacacctcatcatggagacatgaaactcagctctaaagaatttataagtcagaaggaatataaaacctaaaatgatgaagaaaaatgtttcctattagtaaacatcattacgcaaatcatattaagtaacttggcagaatctctagtagatgaactgttaatggcttaatgcattgggctctacaaaagaatggctataatacaaaaacagaaatgccatggttcatgttacttacaagaaaaaatgcaacttgccgatgactcttatcagcagcaagctgtgctggagttagaccagtcttatccttcaccatcaagtcatcctttttgccagcctgaactagcacagtgcatgcctccaggttccccctaatagcagcccaatgtaaaggggtacaacctaggggcagcattgtagtaaagaagtaaatctcatgctctgaagtgtactgatataattggagatatggctaagccattggtttacactgttatgtgcacagcagtacaggtaataatggaaatagataaatttagcacatgccttctttatcctgccgccccctataagcatccaaatacaaaaggagacgtatagaatccgcaaatcccttgtaagcagccctacaaggtaatatgccaaaaaaaaacagagagagagagaaagaaatataaggggcactgaaggtttatggggacatgcattactaagtgcactggtagaaactactactccagtgcaacataagataatgataaatgtagagaacaaggtacaaaccagtgcagtgggcttcttccatcattatcagggacatctggatcagcattccacttcgcaacaatatgataaataaatgctgtctggccatactgcgctgcaacatgtgttgcctgcaaacagcagtatagagtttttaacaaattcactgccatagacaaaagttgttgattcttgcttttcattttacctagagaattcataggttaaatttatttatttatttatttatttatttatatactggaaatccctgatcccctagtgtggatacaacagttaacttggcaaacaaatatccaacaatacttagttgtctttcagaatcatgaaccaacattggacaaccaaagcaacaaaccaggaaaacagggaccaaaatacagaagggaagtcaaattcagacctgataaccgtataaatcagcaacatccaccttagctccttctttcagaagaagctcagcaacttggatgtgtccacgtacagcactccagtgaagtgctgtttgcccagtgtggtccacagcatttacatctgctccatgctgttcaaagaccaagcacaaaatcatagtccggtcaaacaaaattatatgtgcagaatgcgctcactgaatagcatagtgatacttcgtctacatgcagagaataacatactctgactacataccacaatcaagataaattcctggtaccatcaaagtatgcatgttatgtgcgagtttattcatgcacttagtaggcacacaattagtaacctttcttattcagactatactgagcctaccatacactcatgatcttaagattaaaaggaaaagaagacttaaacggaaacacctcaagggcgctgcacaggccagctgaattctcatctgctttatccagcagtaagcatgtccacattctcaatgatccaatggaaaaaataaacatacatccatatgaaaattcagggataaaccaaagcacagtctcactagttccatttctattcaagcctacaacatacaaaatgagatactgaaaaactggcatcatctccaggtcatataaacatccgaaacctactaaaagcacatcaatttccagctataacagcttgcagcagtcccaaaccctccatattcacctaatgcagttggccaccaacaaaattgttcacaaacctggagtaattcaaccacaggcactggtaatttggtatccaaaacaccagccaatgagctaaaagtgaatacacctagccaacacagtataacaacaaacagtccacggttcaaaaacatataaaattgcggctcataaagtgcattggttgatgacgcatcctaccaaacccccacccaaatccctcgctagctagcaaacaacgactacacgaaggccagccaaatcgcgagacgctcgggcgggaagcaggaggggggaaaacctcgaggatgtactgcgcggcggcgacgcggttgttgagggcggcccactggagcgcgtggtagccgaggccgtcgggctccgtgaccgggtggccctccccctccactagccgctgcagcttctccagatcgccgtacgccgccgccgtgtacacgtcgttcttcagcgagtcgtcctccgccgcaggggccggcccctccccctcctcgccgtcggcagcggcggcgggggatggggatggggacgcgggcgccacgggggcggcggaggcggccatcgtggtggtggtgtcctcgagcacctcgatctccgacgccatgggggtggggatcggagttggggagtgtttgactgggtgggtgttttgggggggattcgttggggtttcgcaagttgggtttgggtttggtttgggtggaagcggagaacgagggggaaggagagaggcggaggcggcggagacgaaggttggtggtgaaacgggaaactccactgtgattggctgaaaaaaagaaggaaaatccccacagtgactgcaagtttagcacatcaccgttggatgcataatggaaagggtggaacagggtgggtattcggtgtcggtttttcggtcattttgattcaatgtaaaaatatcaggaccgataaattcaatctcggtctcggttctgaccgaaatttaacaacgtttttatatatgcaaagaaataatggaaattttcaacacaaaaataaaaataaaaaaaccgtaagcacgtatgagtaaagacttttattatgttgcatgcctagaagaagtatggatatgaaaattagagtttaatcctattgaacttagtggattgtaggttgcatttagacatattttgttaattcggttttttcgtctattcacttaaggagactaaccaaattgaccgaacaaaatttggtatttcacccaatttctcggtctcaatctcagtcttttcagttcggtctttttctgcacaactctagagtggataatgagcgactctccttgtcctaaccttaacagcagtaaaagtcttacttggctaggagttaacgagctactccctcctctggtttcataatttttaatgatttagataaggtttaatttaaatttttataacttaaaaatattcagtttaaagacaaatacagtattataataaaaataaacacacatttaggtatagtgaaagacatattttgaaaactatatctttgtctaaaacattaataattattgccgatgtttgagatcgtaactacgatattttgcatactgtagggatcgttgttaccagggtatatacgagattgaagtaaaagagacggagacaatgatttttatacagattcaggcctcttatctgataggtaatagcgttacttctgttggctgaagccggtgttgctcttattcatcataatcacactagtacaatatttggaataacacatctaaccgttgtcgacttggagacctgaaatgaaacttctatatatgtgttcttatcaaaacttctatatatgtgttcttatcaatctataagtaaagactgaaaaataaactttaataaaaaaactcttaaaatcaactttaaatttaagattaaaaattttaaatttggctggcgagtataggcataagccaaaagatgcagtgatcacctcatgcacggctgcacgatggatccatcgccttggagtccaccattccacggtgacaaaacacggcaagtccgcagcaggctggcttggatggatcggatggcattccgttccatcgattacgcgttcaacagctccgatgaaaccatgaacgacaaccagcgagagaaaaaaaatatatcaggaaatcgatttcgcacctggaatcgggacaagtcattcttcgttcgcgtgatcgcgtctctttagcggtacacgatagtattatacacgattattgtggactgacccagtcggccgcctcgtggaatcaaaccagtacgaccgacgtcgtggacttggcagtcagtacgctgccgattccacacccagtttcctatctaagggcaatcacagtgtgtcaccgatttttgccattgctcgtatgccacgtagataaagaacctcgtaagcttcatacttcacagtgcaaatactagtagtgggtctcaccggtgacaaactttttactttttatctctctcctttttcttctcacccaaatgagtactagtactattagcttctctccacacaaatgagtagcttcttccaagaacccggtggcaaactttggacacaaaaacttttttttgggcccagaagcaaacgtggcgtgtgctttttcctttgcagactagggagggcgaggctgaacgtcacgtaagtccaccgtgaacgccctaatcacatagtacatttttcgccccctgttttcctttctgccattccattggcagttcggttctttgggacaaaagttactccctccattttaggttattagatgtttttactttggttaaagtcaaactactttaagtttgactaagtttgtagaaaaaagtagtaacatttttaacacataacaaatttattatgaaaatatattcaattattgacttgatgaaactaacttagtactatatttgtctataaacttagtcaaacttgaaacagtttgactttgaccaaagtcaaaacgtcttataacctaaaacggagggagtaattgacagcctgaaaggaaaggagtaattgacaagaaattacacgaaccaattaaaagctgctccgagagaaaacttgttgtagtatcgacagacatgtactccctccgtctcataaaaaaccattctagtactggatatgacatattttagtgctacgaatctgattctggataaatgtatgtccagattcgtagcaatagaatgtgtcacatccagtcatagattcgttttttctggaacgaaaggagtatgtatggatcattagccattacagcgattcgcaccgatgatgttgttttgtggattctcttttactccctccgtcccaaaatgtaagaatattttgggtgaatgtgacatattctagtactataaatctggacataaaaactgttcagattcataatattagaatgtgtcacatcatccaatatcttttatattttagcacggtggagtagcttgatggtctcggtcaaggcatggaatatgggcttcgtatcttgctcttcggccttgtttagtttgcgaaaaagaaattttttggtgtcacatcagacatttgaccggatgccggaaggagttttttgatacgaatgaaaaaactaatttcataacttgcctggaaaccatgagacgaatttattaagcttaattaatccgtcattagtatacgtgggttactctaatatttatggctaatcatggaataattaggcttaaaaagattcgtctcgcgatttctatgcaaattgtgcaattagcttttttaatctatatttaatgttccatgcatgtgtccaaagattcgatgtgacgtttttaagaaaaaaatttgggaactaaacaaggccttcatctcatcctctgttgccatacgtacgttaggcctttgacattttgtcctcaggttaaatcatgcttggccacaaaaaggaaataatgctgtggagcctccatgttcattattaaggcctcgaaatcaccacgctaatcagagtaaggcattaatctagaacaaagcatgatgaccagattacaaccatgtatgctgatagatgaaaatgtacgagtacgttgtccatcagaaataattccacagcagctacaattactttcaaatggttcgtgtaattgtacgggaaaaccagctggttaacatttggtacggagtatatgtattcactattcagcatacaacctaacacaagtcctcagcatactatggaacagcgaggcttcgtttgtacaatatgcagcagaaaggcttgcacgcacagagataaacaatctattcatcatagagccttgacagtaccatgtagacatgtagttaagatccttgatcggcaactgaagaaaacagagcaccattgtcacgcatgatcactaatttacatgtgtacatgatattaatggcaaaagattattccattaacttacactctgggctgatgggctgtccggttaatatcttcctgctatatactgtcccagcaactgatcagctagctcctcaattttcttttctctctctgtcgaaactaatgctgcatgagattatcaaacaattggtgagtggctattggtaatgaataactgcaacgtagtatagcaattagttacttcgttccaaacacgcacaagaactgcaggttgtcacattgtcaatggaaaataacacagctaatctcagtaaaagcttacaaactcaataattcaatatgatggatgttaatacaagagatcaaagttcatctatttttttattctaacaaaattcatctatgattgcacaaagaaaacacaaggcatatagtatcaagtattaaattgggtacaaataatgtcctagtccaaaagagatgttgctgcctcgtaaggccgtcataagaaataaacaatggtacgtagatgtttcgcattgtcttatacacaaaaaaaaaaaaaacttcctgctgctgttgttttcttatacaaaattcttagcttgagctattgcatggcctacagtggaagcatgaggtataaaaacagcagagtatccggtgtacctttgttttcagcggatgttagaagttaggtacaacttggtgaaatgatctccgtacgcccatttctatctgtaatttgtatatgcggaatgtgcttgatattgatccagtcatctcctgacttgcatctttctttaaacctattcaagcatgttataagtgtcaggctctgcaaatttgtgagccgccggatgcatggatgcaaagcttccatccagtaggtctccactatgagctcagtgagacaggacatctctcccaaccattctggaagcaattcaatatcctcgcatctccgtatctcaagcttctggagggacttccagcccaggatgcactttggcactggacaactatcaacacatttgtctattgttagttctgtgatgtttagaagctcgaggtgcggaatgctcttccatctttcggaagatagaccactggtgttcttgatttccatcctggatgttgatccagggattgatgtccccatgacttgcttgaacgatgggaacaggaacgaacccaatattctacggtaattaaatttatcgaaatatatttcccctgatatgatgtaatgggtgctcctcgggatggatggttggaatcttaaattctcacataattccatttccaaatgctgaagacccgggaataaatttttgtcaccctctcctccttgcacggatatttgtaaccctttgtttattattttggtcatgacaatcttttggagcttcctaagtggttggctacactcgatgcaaaccggtttgttagacttttggctttctatctgtgaaagatgcagctcctcaaggttctgtaactgatgcaaaacgacacactcaaatttcacggtgaagagatacaactgtcggaggttctctaactgaacaaggtggagatgttcaaattgttttttacagagttccagctttgtgatgctctgtaaccgctcaagatggagatgtccaaattccacactggagaatttcagctctttgaggttctgtaactgatcaatatggagccgttcaaatcgctcttcagagagtttcaactctgtaatgttctgtaaccgttcaaggtggagatgttgaaattccacaccggagactttcagctctctgaggttctgtaactgatcgatgtggagatgtccaaattttaggccagagagagacaattctatgaggttctgcagaccattcaggtggagatgcgcaaattgcactctggagagaaacagctctttgaggttctgaaactgatcaaggtgtagatattcaaattgcatgccaactatcttcaattgcacaagatttgggagtaaagacatccaacgagggaaatcaacaccagcatagttctttatgcaaagtatttcaaggctatcatgaggctggagcttttcaaaaacagccctattctgcatccctctctcagaagaggcgtatttatcgctggaatcagcataggcatatgaccactccaaactcaacgaggataactccttttttgtctgtaattctaagttctccatctccctcaagccaatcatacattccagaccaccaatatgcagatcgataaattgagaactagtaacttgctgaagaagcattatatagcttggagtcaagtacatcaaagggacctacaattaggaaaaaaagaagatataaatgatggtgaacttgccgtaatgatgtaagcttgacctgcatctaagttagtttatacatactctctccatttcaaattacatgtcgtttttctttgtcttaaagtcaaatattcctaactttagccatcaatttctagaaatttacatagtttaattaacaacatgcgaaatatgcattactcatatgagagtttctcatagtgaatcttaaactatatatctttctagaacttgatggttaacattaagaatgttttgactatggatagaactaaaacgaaaagtaatttaaaatgaagggagtaggtgtaaatgacctccaatggttaatgttaacatacacacagaatggttggaaacattattaatcaataaatgagttgaagttgaatcaccatagagatatatcatggtagtttgcatataaatagtttgtacatctagcataggatacccaatgtatgctagtcactccaatcacaaattaaatactttaccattttggttatatgattggtcaaatcttataagactccaagtatctaaaccaaaaaactaaagcagatgtgtgccatcgggaactggaccacacgttggggttgacaccatgattatatacatagttaatcatagttgtgatgaaataaagtcctaaggtgtaaataagaacaatggttgtgaacaagtgtttgagtgggcgtagtgcagagcaaccacgatctaacaccaaggaggcgtagttagactggaggtagcttgaggttggcttaggccggtgcaaccggtcatgtaatgatgtttttactatgccattgagtttgcactgattcatggtttgtcatcaactttgtcccttctataatatactaccaagtttatccatagtttctttaatatgccatataccaaataccttctaaaagaaagcctaaaatgccctaatatacgtgtaagagttgacaattggttgaccactggaagattcaaaaagctgtgaattttttttatctagcctactagcacataatagaagtttgtgcacacgttttaaaatttttgcattactatttttttataaggcaaattttgatacaaggcgttgtaacttcgtagttttagctgaaggacactgtaagtgaagttttgggggaagacgctctcaagttggatatttgatggtggacactgcccctattaaaataatcatttctggttggataggaaaaaaatcatgtgaattgttagaaatacccttggtcccacatgtcaactctcccatatctcttctctctatcccctccatccacagttccacactgctccaccgatggaattgcacctctacaaaataatttaccgatccagagtcggagttacctcattcatatcaattgttttgatatgtttaatcttttctttatcctctctagatgtgcaccgttcacgcagtttgtagttgcacttgttgagcaccaaccgttccaaggcagtcaggcgttggatggattgtggcaaatattccagtttgcttgcttgaatatctagcttctgcaggaaagttagttctcccaaccactccggtaatacagaaaagttccagcagttcgttatctcaagtttcctgaggcagtggcagtttttgataggttctggcaaggtgattagatcgatgcaggaatcaatagtcaaatacaacagatttacacagccttgaagaaatttcacgatatcagatgatgagccagagtcatttattttcagtgcgatcaaggccaagtttgagcttccgatgaactgttcaaatgataatagtatgctgtagcttttctcgagggtacactcccgacttctagggaaacctggaacaaatctcatcctgggacaatttgcaatgagaagaacctggagattagggaaaacttcttcgcttcgtgaaagctgatggtcattgtgacctgttagtagtagtgtagtggttaaccattcctctaggttcttcatagtactaagttcaagttctctcaatttcctgaatggtttctcagtgccgtaaacatgaccgtccacttttctgacgctaggcatatctgagatgtgcaatacttccagatttgctaattggccaagtggaggaagacattgacagtttgcgatgttagacagtttaacagtcacaagatttggaagggaagaatttatattcatcatccaatagcaaaattcatcaccccgatagccttctatttcaattgtttccaggtcgtggtggggtcggagtttttggagaactgccttgtcctcagccatgcttgaatcctcaatgaaattgcttctggaccacaccaaacgaacttgctgatacttcgccaactcttggacttcacccagtgatcccttcaaattctcaagatttttaatgaccaggctgctactttgtccgtcatagtgtttatacagtaatggaatgttacttgagcagaatattcctccttcctcaattggttttacggaaaaagtgcccacctgcatttttagacataggcataatctgtaaacacaactaccatttttttaaatcccaaacgaacattgctagtaagtataatagcagccacagctatctgctgtaaaaagcacatcaatttgatagcttatgcacctgcgcaggcattacattatatgtttctttttatgtgaccacccgcatggaaggctggaagcttgcatgtatttgtaatacgtgtgcatcctcaaagcagcacgcttgagctttagccaggttatatagatcgattatgcatgagaccagtatcaacgcttcaactatccgcaaatctccggagcagtgatggcagagccatctttgtgtttgttattgggtaatttaaatccattctttttaatacctatactaattatacactctgagaaggctcccctgtcaagtagaaagacggagcactaattactttttaaatcctattatcatagctgaagattgtagggataattcatattgaaataataatatgccatcaaaaataccatgatgcaatggacttggtagacaggatggaaactattggacattgcaacatactagcaaaagacacaagtaaactagtagagatgcagtgcacttggatggattcagtagattgtaattgacttgaaatagcgaataacactagcagcatgctcaattacactaacgtattagcaaagaaggaatactagtagatatgtttgtagcagaatgccatacttagtgggatgtaacagccagcagattgcatcagccttgaagcactagatatgcatgataggatgtccaaagaagctaccagctagaataatagccaagctggcccaaatagcagtggcatatcaactccactagtctagaagtagtgacatgatgaacaataagctgtgtgctggagagcagcagcagcaagcagtgcagcgagtaaacaagaatgaagatgatggacttaggccttgtgttctgtttacatggtggaaaaaataccatcctaatgggccttcacacctaggcctcgggtcacggtccaggtggcccaaggcctaggtccgcccctgtctcgcggggagttctcgaggaatattcctgttagatccaggtccaaagcgcccggcaaaatcgagctgatcatctcgacccacttcgacgggcgcacggtgtgaaccgtgcgccgctacttcactcgcccgcccgacgtctgcctacccgcacgccaatcatcgtcgcctgcttgtcagtcaccgctgcagcttctcttgaccgtcggtcgtcgctagtcgtccgcctgctcgcccacttctccgaccatcaccgagctcctccgtggctcgcgtacccagccgccggctgccgctccttcgcctgctcgccgccaacccgcgagcactcctccgcttgcttatcgcccgcatgcttgcgctcctcggccgcgctcgccgcccgcctgctaggagcccgcgctgcacctctgcctgcttgctcgtgagccagcgtcagccactcctccgccttctcgtcgcaggcttgctcgcgagccgtgcccacccgctgtcgcgagcccacgccgcacacgctcctctgcctggtcgccactcctacgcccacttggcaattgttgacggtggctgcaaacggtgtccatcccatccctctctcatccgttcaaccaaacaaaaaactaggataagcccatcccgtgaactaaacagatgagtggatgattccaaccccaaaaccagggatggcttcatcccatcccacttagtcatgaaaccaaacacatgctcccgccgccggtgagagaaggagaaaggaaaggggtgcggtgaaaaaaaaggtaggccagagggttaccgcgcgcgtgcgaagtgggatggcgccgtccgccagattttcgcggatgagatcgtcccgaatattggaggaatattctctttttggaaccatcctatccctcttaatctctcaaccaaacacttggttttggggatcatcccatcccatcccgggatatccctccaaccaaacactacctaagagaaccatcctatcccacccatcccaaaaccaaacctaaaaaaggtccaacctatcctgatccatcccacccttgcaaccaaatatatccctctattagggggaaggttagaattagttcatgggaattaaatggtaggaatcatgtcctgttaggtttcgtgggatggggtgatcctccattccccgtccccgtccccgtcccctacagagacccgcatagggttcaagtttaattttcggtccaagtttaatttgtttacttatcttatgtgattaatcttgtgtttttatcatatgtattagtgggtataagttgctatattaatataaagtgtgaatatatgtgttgcattgcatatagaatttcacatctatatattgttttaagcagggatgtagaccctacggggattaattcccgcggagataggaacaagttttccccattgtatttcgcgggagcagggatggggatgcattcctcgacggggaattcctatttgccatatctagccggaataaagaaatccggtgctctcatatcatgttaattttagtgaattggggattttcaacagtgcattgatttagccctaaatagcatatatattatgtacacaagagaagggaaagtattctaatacccttgacatctactagacttaacagtaaatttgcttggtactgctagaaacaaagaaactacatacctttccaatattgatatacggaacctgagaatcaattctacctacaaagtccacaatattatcatagttagaacattcttctagtccatattgatgagatggcggtaaatttattttctccaagttggcaatgcatgactgtggcagaccatagatgctctccagggaatcatgttcactaactgtgctctcttcctctaaatacttcgaattgtaaaacaatgggtcagtgatagtcaactcgtccaagtgggtgcttagaagttctgtccattggcgaagttgatctcgtgagccttcgatatgcagttttgatttcaatctagggatcgacttctgcatagcatgttcgtgtggagggatcgcagtaccttgtcctgaatgtgagcatccttcagtatactgatcatatggacgtgatggaaaacttgaagtatcttccttgtctacaggcagactgagactgctatctttgacgaagtactctttgctctttgggggagtgggatgcagtttcaggtcatggcaacttccaatttgtaggtaatcaagttcggggagcgctgcacttgtgacctccaaacaaccatgagacagttttggtgacaactgggactcttctggcactagtgaaatgtgggacaatgctgaggccaatgttttctttgcccttgctcctccaatagataataatagagcgtcaaaccaattctttaccttgcccttttcagtggatgggcctctagaaagttcctcacttcttctcacttcgtttttacgaaaagaacagccaggtaatgtgttgaactcttgtcctgtttctgtcatctcttcatcgcagccatgacttgattccaccatctgtacttctgtgtgtgtacagatatcataaaataaatgtaccgtggcctcatttggtagtcctaccagtgtcagtcttcttagcttattgcatggcccaattcgtgcatcatgaagctggggcatattatagatttctagctcttgtagatttggtaaattaccaagtacagggatatggtcgcatctctcgatatgagacaatataagtttcaccaggtttgggagcgtaccatatatcttgttaagccggggcatattattaatttctagctcttttaaatttggtaattgactaattgggatatagttacaaccattgatatcagagaatacaagtttcaccaagtctgggagtgtatcatttatcttgttaatccaatcaggaaattcggtgcaaatgtaaccttttatagagagggactgtaaattcctatgaggcctcaaattacccagcactgctcgttgtttaacagaagataccataccagataaagaccattcgaaacccaacgaatgaaactgtcgcatcctgtccagttcaagctgcttcgcttcctctgaaaacaccacattctctaggcacttgatattgagttgacgatgtgtaacatcaaggatttgctggaggatcaaaatattgctgcacctcccatcatcttgcaggcgtacattaaaattgggcagtgtcagaaggtccaccattcttgcaataccttgctccgagtagagagtgaatcctccaatggacaggtacttcagacgaaacaagccttgggtgatgatatcttcctgcagcatacccaactctaactctttaatgggatcttgtgaactttggtcttctgcagaggtacctggtgcctcagaatcactttttgcgccaacccccgagatgttgaggtactctaatgtaccaaacttccatcgtggaatcaacttcaaaaagttttgaagtttagaacagcctgaaagattcaaacaccggagttcacggagttcagttgaagactcagggagggcaggcagtttagcacaacccgataaatccaaaacctccaacatcgagcagccagcgtcgtgctctacaaattcaggaagatcctcaagagaggtacaaccagagaaattcaaaaaaagaagcttcctcatgtgcttaaataatccagtaggcagttcttgcagcttggggcaaaatgacatatttagatgtaccatgtttggcagataatgatcaggctgcttctcaagtttttcttcgaggaacgacagctttacaagttgagaacaatgtgatacattaaggaatgaaagtttttgaagcccaccagactgtgaactgaataaaggaagtgattctagacttgtacagtctgataggttcaggtgttggagctctttatgtttgtgaatgccatctggtagttttttcagttttgagcagccatgtagatccaaatactgtagcttgagaaactcacaaatgtaggaagggagctcaacaaggtcaatgtttgttgacagggtcaatgcttgcaggtgatgtagtttactcaacgatttaggtaatgtgccacttaggcctgaaacattcaagtacttcaatagactcaaatgactgatcgagtctggtagttcattgatggtgcatgcactgaaatctaagatgcgcaagaatttagtttctgaataattcttgggagatttcctgcaatccttgaaatgaagcgctcttgctgtattgggcaatatgggatctcgggaaaattcactcaaattcaagaggtacatgtagcggcagcaatttttagtgttggagctactgcagtcactggcatgaaagatacatacttcatcagctgcaattacacttgcaagatcgtgaactatatcatgcatcttgagtacattttgaggctcagtatatcgtgcagacatctgaaaaattaagtttagtcacttgacagagtaggataaataaaacagcaagacagacacattctttctatgcatgataacgaatgcattttatatggtgtgaaactaaccaaactcagcacataaaatggttagaagcttatccggagttcaaattcaatttggccgtcgtttcttaatactagatgcgtacgaccaaggtgcagccgtctacaacaggcatttcttcttcttctttttcattacacgggcacacaccactccaccagcacaccacactcacggacacaaaccacatctgacacctccatgaatacaccccttaacacatactcaaagagacaaagactagcgtcaactccctagcctcaataaaatcctattgaatgtgcgcccacatgtacataatacttaacctgatgggtggtgttactcatgactccatcaccaaaccactgctgcttgcatttgatgcatcaaatttatgtgctactcatttaatctcagtacaaatagctatgaaaaaactgaaaaaaaaaatagtaacattggtacaatattcatctaacatttcgcaagatttttaaatccaaatatcatagcatgtcaacaaaaagacaatattccaattatccaattagtttcaggattaaatttggattgaacttgttggtgcatgcatatgttttattctgatttcaagctttaggcttttttcatgactttgggcccaaaattttagcccaatggtggaagatctggctaggctgcccatgaataagtctattcaacagaagtagactgccaaagctaagcattttttgtgtcctgtgtgcatccaccaccatgttgtggacacctccacagcaaccaaagtgaaaggagggagcgtcaagcttatcaattccatttcaatattagccagagtagttggtatttatcattccactaacaaaaatagtatgcaacaagtgatgcgtctttccattctaaatattggtcaaatttcaattgggtattgaccattgacataccactagtttcggtaccattccgagcaaaagtgatccttccattgaattccgcttactcgattccttcaaattacatttatctataaactcatttttctctatcatatttgttccgattaccaccatttttacatataatatcatgtgaaattttgataaaatattgtataataatactatttggaaatcaatcgaatgggaaaaaagagagaaaaagagttgcggctgaggaagcataccgcagttgccgcgttcacattctgcaaaaaggacatttcaatgagttcttgcaagcagtactctgcgtattgttctgtcgggatggattctgggggctgaatgaatccaagagcaatccattgctgaatcaaactgctcttctgtatgtgggagcccttggggaagactgacaaatatgcaaagcacaacctcagagaacaaggcatgctgtaataactaagcttcaagttggctataactccgttatctggaaaacgatcatctttttcggcccatatattactatgtaggttttgttcccactcagtcggacgcattcttcctagaaagtaaccaagggattttacagctaatggcaaaccttggcatttctccactattgtctcccgcatcgcttccacgtagggaggcactggtgtcggtactcgtgcttttttcctgaacaaggtccagcagtcttcgtttggtagaagacccaattcaatttgcaaatctttgttcattcggtcagcaaccttcttgctacgtgtagtcacaataaccttgctacctttcttgcagagtctaagcattgcctctaactcatccagcttaaaattattttcttcccagagatcatccaaaacaataagacatcgtttttccgtgaggatagactccacagcaacattatgaattccagaatcaccatattggagcgtatggctattacattgctgtttgatagataaactgattgcattaagatcaaatttctcagacacataaacccatgctagcatctcaaaagctatctgtgttgtgcagtcactaaaagccatttgagcaagagtggttttacctaatcctccaagtccatatataggaataatggagtgttcttcatctgatagcagcagatccattattctccctttctccgcgatccttccgacagtatcctcactgctgtatcttctaggctctaaatgccgactgatataagaatcctgctcctctgtggcaccatctaccttaaagctggtgagatccatttctttctttattccttcaagtcttctcctcatcttcttcatctcccttggcaagttatatcgtgacttcaatttttcaggaaagctcgaccattcctgtcagttagcaaacacaaagttagactgaaaaatcgcatttaaacgagaaatcatgatcaggaaggatgctgacatgtctgagagaaccatcatggccatcgttggagctcgattcataaacggccagcctatcctctatgtcataggctacggccttgagtttcttcagcaagtcgcgaacgctgccatccgtctgcgatttcctctccgcatcgttcagcttcgcttggaggctgctcagcatgctcttgatggcttctagatcatctctgaaggtcacctgagacatgatcgtgttccaaatcggagagcccagcttccccgatagttccttgatcaccgcggaggcgataatctctccgaacccaaccatggcggcaaaacaggaacgaggaaagcaagtcaacgcgcaccggaagtctccccacccccccccccccccccccttccctcaggctccaagcccttctaagctagcgtctcggattcaccacgcactgagtcactgacctctctccgccttgcccctcgagcagccgctcctctaggcttgttccgcggctgggtgggctgccggggagacgacggcggaggctcaccggcgaagatggccggagggaaggtgtgggcgtgcggcggcgcttgggagaatggtggctgggaagggatgcccggcaccggcgacgccgtccgcacgatgaagttgtttgattttgagatgaatggggatcgatttctgatgggaagctcttcttcatcaagtgaagaagttgtttgaattttgagatgaatggtgaggagtcgattagttgctgcgattaatatccgagtcgccggcagaaaatcactactccagtatggactatggagtactactatttattcttatttttattgatggtagtgctgatgattggcaaccagggtcttcgattccgacgaaatccggtaagatttcgcgaaattttgatgttttgacgaggctcgaaagtaaaaaccgtatgagattttgagaagtttcatttaaattcaaatttgaattgataaaaaaagaataaatcaaataaaatcttataaatattatgatattcatagaacctattgggatataaattttcgaaaaaaataatgtattatgtgtatttactgaaacttacatcaggaaagaaaagaataaaaaattaaaccgaaaagcagcagtatttgacaagaactccatccgaaatttcgatgatttcgatcggaatttcgccaaaaccgaccagtttttgagaatttgtcggcaaatttagagaatttgtattcaaattttggtttatgaaatttgttcggaatttattggtttttcaccgaatttcgcgaaatttcaaattccgccagtggccaaaacgaaagggtctatcggaatcgtaaaccctgttggcaatatgaatgatagagtgtagatgtaattcctcgtttcaaaataaatttctaacaaacctatcaaaaaaaatgtgacactatctatcatatccagaaatttagatttatttatttaggataaagaaaatataagatactgcctccatttcatattattacctccgtttcatattataaaactttctagcattgcccacattcatatagttattaatggatctaggcacacatatatatttagattcattaccatatatatgaatgtgagtctgctagaaagtcttataatatgaaacgaacgaagcaagaaaggaggaaaatatagtatacaaaataatactataattctctatcttaaaacaaaagcaagcacacgcactactacgtcattttagctaaagtattttacttcaataattcaagacaactcaaacttagttggcacacatgtactccaccccctatcactagagttgttttcttttttgtacaagatcatcctaacattcccacaaggacataaagaaacagcagaaccttcccgggaaaatttcactgagacaggtgcattccgtgcacgtacaataatcatcaccatcatcgtatcatccaacctacaggaaaacgcaaattcaaggtactcttgtccaaacctgtaggtggccagtgatttgctcccatcggctacaactaccagactcaaaaaaactagacacaggtatgatgctaataagcttagcatgatcgactgatggacagacagtaataacaaataggaaacggagggaactatatgtgtcaactcgatgaactctataatatatggatgatttccagcgccctcctggcaaaaataacgtcctcgtaaatctatcgtcaccatctaaaaccacttgaagaggatgcctccatgggtggcgaagaacggggcaaacacgagcgactcgacagccatcagcttgatgaggatgttgagcgaggggcctgaggtgtccttgagaggatccccaatggtgtcgccgatcacagcagccttgtggcagtctgagcctttcgggcccagggtccttgcatgctcagatgcaccagcctaaaaccagggagaacgagagttataatgtttggcgaatatgggaggggaaaaaaactgcttgacgtcaagtgttgctgtgatggaagatggctgataagttcttacctcaatgtacttctttgcgttgtcccaggcaccaccagtgtttgatgcagagatggcaatctgaaaggaagcaacatggttatgaatgcaatatggcaagagtaagtgatgagagtgtggctgtgaaaaagaatgtgcgaacctgaacaccagaaacgagagcaccagcaagtagtcctgagagggtctcgacaccaaagaagatcccaacaatgagagggctgagcatgacaagagcacctgggggaatcatctccttgatggatgcatcagtggagatcttcacacaggttgcgtagtcaggcttggttgtgccctccatgagcccagggatggagttgaactgcctacggacttcctccaccatcttgagcgctgcgctgccaacactcttcatggtcatagcagagaaccagtatgggagcatagcaccaacaatcagtccaatgaaaactttaggtgtcagaacatcgacagtggagatggcggcacggctcacaaaggcaccaaagagggcaagagacaccaaggctgccgagccaatggcgaaaccctacaagtacaatcatggagatgggaattaactttaaaattgtgacatttgtaacaaaaggaaaaatatttacaagtgcaaacacaattttaaatttttaattgacttcagagtggaaatgaagcataaaaacaacataaaaacactttcgacaagataagcagttttaccttcccgatggcagcagtggtgtttcctgcagcatccagagcatcagttctctcacgaattctgtgactcatgccagccatctcagcaattcctccagcattgtcactgatagggccataggcatcaatggcaagaccagttgcaattgtgctaagcattccaagggcagccacagctacaccgtacattgcggcaaggctgaagctgaggaaaatactaaaagcaatagcaaaaataggaataatgacagatttgtatcccagagcaaggccaaagatgacattagtagcagctccggttctgcaggaatcagcaacgtcttggacagggctggacaagggaaattcaaggtgtgagggacatgagggactagaagcaaatatataagattacagacaacattgaatatgatcagacttataagcacctgtaggcgttgcttgtgtaatactctgtcacaaatccgatgattagtccagcccaaagaccaaccgccacacacaagaaaagttgcctatcaaaatcagggaaatgaggtcaatgattttaacaatgaagttctaagtaaaagatggaattccaatttaaatatgggcataccagttatacacagtcttctgggcaccaaagttgaatattgtgaaggaatatgggaggcctaaccaactgacaagtgcaatgccaaccgtcatcacaacggtggaaattataagttgcttcttgagggcaggctcaatttcatcaacagccttgatctcaaaaaaatcagtggcgaaaagtgtggttatcagacaagcaatgataccaactgagctaatcaggagcgggtacagcataggagtgaattcatggttaattccaaaagaagagattgaagcaacgacaagagcagcacaagatgactcagcataggaaccaaagagatctgaccccattccagcaatatctccaacattgtcaccaacattatctgcaatgacctgcaaaaggaggaagaaatgatcattcttgcatgcacataaattcctatcgatgttttaatgctttgctcaataacacaaatcattatgaaaagaacaaaacaaattatttcaagtaatattaagaaacaagtttttaaagcgtcaggaaagaattcttacagctgggtttcttgggtcatcttcagggatattcctttctactttcccaactaggtcagcaccaacatcagcagctttcgtgtaaataccgccacctacacggccaaatagggccatagaagaaccaccaagaccatacccagtgatagcctcaaaaagaccttcccagtcatcaccataataaattccgaacaagttgatggcaatgtaaagaacaacaaggccacttgcagcaagcaggaaacccatgacagcaccagagcggaaagcagtaatgaatgccttcccaacacccttccttgcctcaagggttgtcctggcatttgcataagttgcaatcttcattccaaggaaaccagatacaagagaggtgactgcaccaagcacaaaggcaacagtactgaagatagcatttgcaagggcaggcttgcacatcctatccttgctgtagtggcaaggttgactctttgtgctgaatccctcaacagatccaaggaagaggaagatcaggaccgcgaaaatgcccatgaatagtccaacatacttgtattcagtgaagaggaaagaagttgctcctgtttacagtttaaaaaaaacagtatttagatcatagacgcatacaaatatacaacaattagtcaatgacaagaaaaggttagcgataacaataataatagctgaaacataaaacaccaaagctagcaacgcataaatatgtttataattagaactgaacctgtttttctaattgtagtgtttgactggactccataaacatgagcaccaaaatatggtaacaaaggctaaattaaatagtgaaatagatgggactttggtcactggtcagtaacccaatatctcaaatatccaaccaattgaaaccaacaaaaatgtatttgattaaacaaagttccaatcctagaaagtttccacaaaaccagattcacaaattacaaaccatgcaaactattagcatatctagcatttcctgtgaaacagatcatatgcatagcaggactccacaagtaaggcacactaactgcaagccctatagtcttctaagaaagaaatgttgaccaaacaaatatttccaaaaatacgtttgaactttactagaaaaggacagaacctaacactttcacaatattaaaactcacccaagcatcgctagagatgaaacctgccaagaaagcaggcgcctaacataggacaaactacataaatcaccacctctcagcctgcaactgtccttgaattataaccttacatgtaaggtttatgattaatgaatggaccacaagatcgtcccgtccatgtgcgccgcatctaggattccttccaagctaggtggatacagtcaaaatgaaactattttctccctgcttcaataatgcaggtgcgcagaaaaatcgttatcttcttatcctcctaagagcaataagtaggaccactggtccaataacttgtcctcctccatcagtaaattctcctatccccacagcatggccaccgcagggctttacgtgagggcctctaagaactgagcaattcaagttctgatctaccccactaaaaatatctccccaataaaatatctcagcagacgcaacaaacgaacttaattgacccgcgattagcacgcactgactaagaattattataacatgtgctgtgtaaagtgggaacatgattgtttaatgtttctgtagatccaactaacaatgtaacagttcacatctagcatactagcatagttgtagtttcgaaaatactatgcatacgatttctgcgtacgattctagtatgatttctaactgatggtgaacgccgtgcgtgcatcactagaaaacaggagacaaacgttacgggctttcgctggaaatcgttagtcgtacaagtatcgtacgtgaaaaatcgtatgtgtagcagctctcgttatagtttaggcacacagtaaattcaatcaaactcagagaggaatctcatgattccacacaatagaatactactttagccacagtaaattcgatagaactcagaggaatctcatgatttcacacaataaataaagtaacacaagctcacaagcactactgctagacacgcaactccgcttgattaaaagcagcgccatcttaacctgagctttataatctcttcacagcaatataaaaatataaatcctgtgctgcaaattccccacaattatatcaatcttgtgctgcaaattccccataattgatgctcggataagctacttttgaacatgttcacgccacaagcaaccaaaaaaaaacaactaaattagcaaaaattagcgccagtaaccgctgcgacggcacgagatctacacaactacgcgcgtgctcagatccacccaaaaaaggccaaaaaaaaaaacacgaacagcacacgggggtgagtcagtccccctccctcaccttcggagatggcgtgctggatctcggagcacttctcgacgacgttgtgctcgttgagcccctcctcctcctcgatgaggtactcgctggcggcgccgccgtccttcccggcggccgcgccgggggacccctccccgccgcgccgctccgcggtcatcttcaccttggacaccagcacccactgcaccaccgcgaacgcgatgccgaccacggccgccgccgggaccagcacctgcgtcgccaggtccggcagtatcgccgccattgctacctgcgagatcctcgcgctaggattcatgtactctcctcttctcggaggaggattcgacgcgaagaggaggaggagaggagaggagaggaggtgggaggaggcggggttttataaggagaggaagggggagaagaagtgtactgtagtagtactactcctacggtggggaaggtggagggtattttcgtaatttttcagtcgttcggattcttgactaatttgactgtattttttagtgggtgatttctcgtgtttatccggatgaaacggagcaattcgggggttataatttaagctatttgattcaacggaaattcatataaattttagacgattttatttctataggaattttttctataaaactctttgaatcaaaggaatgaaccctatggaatcctatgaaatttctatgaaatgactctttcaatataagttttggaggaattttaacaagaggtagaacctcatgaaaaaaatcatttgagtctttatctcttctcaaattccggtatttttcctgtttttcctgtgttttacaatcctctgttttccacttacattctatcagaatcttatgtttttcctatttctctgtttttttattcatgtgattcaaaggggccctagtagtaccagtagtactttttataaacagtactagtactaagtgagtatggttttatcgtagtgatacgtagtgttgttttgagttgaagcacgtacgataggtttgtgggtttatcgtatcagcaatgaacatttgtatgaccttattttggcataaacgcgtaataagatcactggtctctcgtaaataatttaattaatcgtattgcatcagaattactttgtttctcaacttctttaacttttcaatatcaattgagttggttggtttgaactcctgccgttcaaacaaaccttgtactacgtctcacctaatctgacgtgtattagcgtgtaggaatactgtttttttttaccgtgttttaggataaggaagtggataatggataaacacaccggcaaagctcttccttctttcccggagatttctccctattttttttctctcgaatgacacttaacgaaaatattttactacgagagattacgagacgaagacatcggagtacgtgcagaaagcttggttaatttctctcgtacaccaactcgttgaataattcggcctaatagcctaaagaatgggagataatcatcgttgatcgaggtgatcttctggccggtgatgactcatcactgactcgactcgatcatgagttagtttaatggtgaaattgaccggttacagacatctggtttgaataacgaacatctttattttttctcatcaacctaaatccgcacacgggacacacggcacggtacaattttgactcgcattgttcgtgccgatttcgcgttaattacagtagtagcagtacaccatctccgttttaaaatataaaagtttctaaaattagacgtggatacttaaaaaaataaaattaaatatgagaagaatgtaattgttaagaggagaaagtagatgagtatttaaatggtgaaatattataatttgttgagacgagaatttaagtgaagaagttattatatttcagaacaaattttgaatattttggcatgagggagtagctagacagtagtagaactagtgtaggagtatagtcttaagaaaacgatagtactaatatgtcgtgatatattaagaccctctttgtttaggcttataagccaacttataagtcgaaaagtctaagcctaaacaaacaagcagcttttccgtttggcttttttgaagccataagccactctaacactattaagccaaaagctaggttgaagaagcttttttggcttatgtgaggtagatgtatgactcaaccactaaacttaggacattaaatccaccggcttataaatcatataagccaataaactaacttaaaagtctagaccaataagtctaagcctaaataaagaggacctaaatgtaaattagttccgggatcgacagataaaaagaagcataaatgatggacgaggtgagccggcagagcgaattaattccacgtggaacttcacccttcaatagtaattccatccattatccactatagtagatatcgcttttgcaaaagttagctgatgcacggcatgcacgctgatgtagcggcacttatctgagatgattgaaatgtcaaaaccagacctttgttaagtagattaagctattgtaaaatctagtacaggtaactagtaaatgtactgcagatgatggttataagtattatattcttttgacaccagtgattaaccattcatccctattatctataagcaatgcctctaagttgatgcaattttcagagagagaagaagaactgaaagctttcaccacctcctattgcagctttagtaagagtaaaaggcatctttcaattataaagagtggaaattactgtcaccaccaccagtaggtcgagtaaaaagcatttttcaaaaaaaaaaaagtggaacaattactgtcaccaccaccaatagactttagcaagagtaaaaagagcgtaattaatatctgatttaatctgtatggacatggagcccaaaagatgatgcatgcatggtccctggtgatagcttgccttacaactctgcacacacctacaatatgattgcattagcatgcagccaccagatggatgctttcatggagcaatgtgcatgcatgcatatttggttgttgttatactatactactcctactcaattatttggactctttgaagcatctcacaaatcaatgtcggtgctagagacgtgtaacactgaatatattttggaatccacttggagagctttgctgcagttcacacaaccatggatccatcaattatagctggatttggattaactattcctagctagttgaatagttaaatcaaagaagctatgtatgcaaaattaacaaaggccgggtttagttccaaactttttcttcaagctttcaacttttccattacatcaaaatttttctacacacacaaactttcaacttttctgtcacattatttcaatttcaaccaaactttcaatttagcgtgaactaaacacacccaaaaggtgtgagagatgtgcaagatcaagctcaaatggtatcctatacaacagagcatgtgcttagcttaatttaatcgtgtcttgttatgtaaccacgcacactagtactgtactgtactgtactggacagcaatttatttgagtattagtagctaggaagcagggggatcagtggttgttaaggggaagtagtgagaagagatgaaattaaaggatgtaatcacatgctgcatgctgctggtgaggagtaattattttacaaaggctgtcattggtttggtttgaaggaaacatcacttgcatagctggaattgaagcagtcgtcctaatattaggtagatctaggtccagatggaccagatttatgacaatttctttatacacattaagatacaaaatacaggcatgctgcaattatacatgacaaataataaggcaccaaaatagcaacctttacttctcttatacagaaagataatatgacacccacatatatccaaaccaaaataaatgccaattaaccatctccaaccttgcgaaaaagaaacgcttaactcaaactgctcaatgaaatcgatcggcacatgttcattaatatcagtgatagttttgttgctaatgacagcaggggcagatctacggttctaggaccgatgtcaggctacatcaacgactttcgacaaaatatataacaaaactgcttattcatatgttataatataattagcatactatgacaccgataggcacgttatgatatcaacgaatcgatttttccgccacttaatgacaggcaaaaacactacagataaaacaaagtacaatgaagctttcaaacaacctactggcgagcaaaaaacgttttctaaaatgataacacaaaaatttgtgatgcagatggcagtaccaatgaattcagaaatacagttggcactgagttgtaacttgtaatgttcgacaacaaacaacaattcgaatgcgactcggtggcgaatttgaaacaatagatccagccaacaaagaacaattcctgtagtatagtgcagctagctgtgcaaaagctttgctccataaatgcatattggaacacttcacatgtagttgggtgcaaggaaaattggatcaagaagaagatcccatttctcatgtgagcatatgccttgtgacttgtgagatgctagttaagtagtaacatgtaccatctcatagattaacacaaagtaaagcatatggttcacacttatgcatagagataatctctcacacacatcagcacacatccatggatggtaggcaggtctaagatatttttttccttgtttattgcatggatttggatttatatactaatcataatttaatctttttgcaatggtaggtgagacacttgatggtgatgttctgtctatactctctctagattcatgggagcaacccattttccatcacgatgttgccgacactttcttctctacaaggaagaataaagaaagatacagatggtaaatacagcacggcatacagatggtcagatttggagggaagcctaactgcaataattcgggttcatgtagagctgtatcagtatgactaaatcagcaagtcagaaactaagctgcttgggagaaaattttaaatacgagtactttccttgtcttctttagcggttatgaaagagagctggccaaaaaattgacaaaaaggacatgacaattgatcctaaaatcaaattttatgctgatgctttcccaacttcccaagcaggacatgtttttctacaaatgaatgaattaactcttataaagttaaaaaatagatttaaaatattttctaagaaattcatatacatagaaagtttatatcaaaatcgcaccgtttaggagcccacgcagcacgccactgaatggaatggttccatttcttagaaaataaggcagatcccattgtcttttcctatttgcttgctcctgttatgctccattttactgaagatttgagagtcaatataatggatggtcatggtctcatggaagaaaagagatcccagtaggtattttatccgtccattgtcagtactgatgagtagagtacagcaagtggactgaaggagcaattggtacagctcaattgctcaaatactatcttttttttttcttctaccactactatcttcatttgatcatttccttgtcacagccattactgctgctgcaagtggtctcctattttttatatattcttgtgaactttcttaaggaatatattccaggtttccagcaaaagaaaaaggtcaattgggacgaagaaaaggcagaaaaaaaatgccatgatcctttttgcacgtagcttgcatgggacgccatcgttgaagatgatatctttgcttgcaatggcaagctcggaccactataaacgatcagggtcccatgcatcatacctcctccaatcccccaaactcagacgaagatgacgatgacgaggccatttttgcgaaagaatcagtcgaattggctaaaatacaaatgccaggagacaaattagtccaaatccaaattcaaaatgatgggggtttgtgtctggttgttagaatttgtcttgtgttcttgattcttcagcacaaaaggttgtgtgattctgtgaatgggacacatcattttcatgaggtgcaaggtaggtgtgatctggttcaggcggctcctggttcttttggtgccttatctttttcaggccattggagagcacaaaatttcccatggttgtgacttgagtgtgaccagttgtgtgaaggtatgtagtgagactctgagagtatgcatggattgtactctagtggaacatgtcccatctggtggccacatgctactagcctagtatgctacacaagtgtcaaattaagcaggatttcaatcaaataattggtttccagctttctttcggcttaaaatctggcaagagttgtagtatagacagatacgtagacatgttaatcaagtgaagagcaagcaagcaatttgagtcacctgcatatggacatggcctaatgtttatcaagtcgagagtacatcataacgtcatgtgactaatagcaggtcaacatcaagtatgagtatagctatagttgattcaacaaggcgtgaaatatacgaacatccaaaattcaacacacttaactcagtctgggctataataattcaataatgcatcgctacttcagttagattcagaaggttctacccccacaaacctattacatcttaaagtacaataaaaatggagaaagagtttccaccttgtgctagggaaagattctattcaagtgtggtgttcagtactgctcttcatcccatcataaacttaacttaaaccatgcagtatccccgtgtagtatgtctagctgtttgctcttgctaataggccagagaaggatggaacaggggagttcctcatttgttcttgagcttgctttatctcctcgggatcttcaagtgtaaaacagagacagtcaggtagaatacatacataatatcaacaagtattataaggtaacatttattaaaaatatatacatcattcatatcaccaaataacataagctctttcagccctttcatgtcagcagtacataaatattttgtaaaatgcgaagctgattaaagaaacaaacagctaacccacaaatgttttgctcaaggagctcaagaaaggaaccactgtaaaaacatatcatagaatgaagcaacgaactgtaaataaaaaactgagaaggtacataacaggagtagacaatggcaactaaaaatatacacaaatacaagctaatttaaaaacaaaaaggcacttttaccaaatatatgctttttaccattatcttgcatcctaactacagtgatggtgtgggtattaattatatcgccttgctactttgtctttgcatggctgatttgttcttgattagatacagaaaagcaacgtaattaggtaactataatatgtcatgcttgtatgctgcatgcggtggagccccggcaccagactaggttcgctgggccttggctccacagctgcgtggagcaaataatatgcgacaataatctgatgagtaagcagaaaagaacggggcctaaatttacaaccaatggaacagaatgagagatgtggaatgaacaacacaattaaatgtaatatctttctgcaaaagtatgatacgagctacatggtgcaaaatgtctattgggcttgaatcctgttctgcatagctgctacttgtgggcacaaaatatagtgtaataactattacattataactcaaatttggacataaaaggctaaaagtgtgcagcatacctatgttctccatcattttgggcataacgaagaccattatgaccataaaaccaagcatcatacccatagggctcttcaaaagtgacataatggagaaaggctcccttttctaggaaaaagaaggggggaaattgactgcttattaaatattatacaatagaaagtactgaagaaataagaaacatgaggttagtattagtcacctcgtagtattgctcttctctgagaggttccaacacaagctcatttagaactcttctgttttcagtcaatgctgcttgaatgtgcccaggattcctggcactgatgtctacccgaacctatcacccagcataatagagaatgaatcttgatgcccatttaacccatgttacagaaaaaaaaatgactaatgaacacttactggtgaaaataagtagcccaatgaggagacctcaattaaatgagtaccagctggcacattgtggcttaagcatatcatgtcaaggaggaacaaaaagcaacatagtatgctcttctaacattgtggcattgctgcccacaaggaaacattggaaaaaaaataacaaacaagaatactacaacaacagagctagatttatttctattagcaacccagaggctatatctaattttcaggaataaggctacccataacagataggaaatgtaagatatgagacatccaacaatagagcaggctaattaaatttaatgaaaaatgactaatttccctaatccgggaactcaaaatggagctgaaaggttgtaaacatatggttttgcagattttgcaggatacaatgcaaagtagccatctggcctggcaaatgtaaccctctgaccaccgttaagtatcacttttgtgtttgatgtcttggctggaagaccaaagccctttgcaattgcacttgcagctataagcacataaaacagaaaaaaaaaacgacatcaactggttatcattataataattagtacaatttggcttcacgggtatggaaacttaattccagataaggagcaaatgcaagatccctgagtgcaaagaaaactaagacttgccttgacaatctgagttcacatgaaatatccagcactgaaaaacccatggttctatccacaagctaacaatgttttcagcaagagaaaatgtaaaagttaaaagcggtctgaaacactatacagcagccatttattattgtggtctgaattatttcaataagcatggttgggaaacgtgggcttcaatgctcatgccaagttgccaacatatctatcgaacatgttgtaacgcaggtagagactcgtcctagaaacaaaaagtgccggataaactatgatggcaatcacaacagtacaacacacggtttttgcaattcaaaattccacgaaagctcactttcaaactcttgtaaaacatagctaaaatcatcagatattcataatcaaataccccctgaccaatgaaagctcagctaaaatcagtcaatacgaataccaactgtcatctaagcaaaccccatgagactaagtaaccaaaaccaggggctcatcgaactgtatcagtgcatgatctgaaaaacagcttgcacaaatgcaatgaattccacgagtgcctgaaaaatcactaactaaattaacaaaccctcaaagctgctaagtagtcgatagctaacaaagttggctagcgctggcttgcgctaagacggaactagatgagctcgataaatagtgtatcaaatctcgttagtcactaccttaagtacaaagttagggacactttaatcggcagatctcgaaaataattccagcaaattgaccatagccaactatgaaatcgaatgttaaaaaaggcttttatccccaaacaaccctgacacacaaagatatctgatgcacctaagctacacgagtacgatccccaacgatccgagcacaacaacaacctcaatgcacgcatctggcacaaaagctccacggaattcactcgagccatagggtgagaatagccggagactaaccatcgatcttgatgcggcccgcgatcgtgtgcccctcagcagatctggagaaccaccaaagcgagagccgtggtcaactcgcggtcgatttggattggatcacggagcaaaacgagattgggggtggcgcggcgagggggggacatacccgggctgataggccgccgctgcgcctacgcgcgctgccacgacggcgaaaagtacgaggaggaggaggcgcgcggccatcgtcgcggcggaggtcgtcgtcgccgccgtgctcgtcgcggctgctcaactagacgaggcgaggcgaggcgaggcgagagagagatccccttggacttggtggatttggtttggtattctcgtcgcgggctttcctgcggcttgtgggcttcgcgagcttccattttgtggggtttattacttggaataagtccacctagactccccgatatataggttaaatctaattcacgcccctcaaccgtaatacggatatcttgatccttaactgttaaaaccaatgtaattgactcacaagatagtatttataatggtatttgctaacgcagctcgtattcacatcaataccactatgaatactatctttagagtcaaattataacggttttaataattgagatgtcaagatatatatgtagcatatcttaatactagcaaagtcctactacttaaaaaataattagccatgaaagtctaagatttgagttcaagtaaataagtctcattacgaagaatctagctagataagttacgctgactttagaaaatcaaagttgtttattgccgaacgaaaattagattttacgccgttttctccttagattgttaaaagaacagctccatatgataaaaggataaataaatcgattttgatggaggcatatgaagctggcctgatttccacccatgccgatgacggtaggggagcggtatggcagtgacttcaaagtttgttaggtttaacggacaaaatatattgcatcatcttgccatgtcataagctactttctcaaatataaaaatactaaatctatttggttggacgtgactacacagctaatggtagctggtttgtttaaatcagctaccactccatctatgagagatcatattccacctatacttcaaataaaattttctcttaaactactcatccaatctacgatccgattacaccgttatgttcgtaacaattaaatctttataacaagagctcacatgattatattttgatgaaaaattataaattacttttataatatatctaaattacttttagatttcactaaattacttcttcgacatataaaagtaaattcaataaagcttaagtaatttacatatattataaaagtaacttataacaaaaataaagtaactttaatgcattcatttttttttcattggacgtgactacacaactagtggtagctggtttgtactccatctagtgtttcctttcaacttgaaaaaaatgcaatagtatgtttccattttgttttaagatacttttataatatatgtaaattacttttagactttattgaatttacttttatatgtctaagaagtaacttagtcaaatctaaaagtaacttatatatatgataaaagtaacttatgtatataacaaaagtaatttacaaatataaatattttttcatcgtaatataatcatgtaagatcttgttgtgaagatttaattgtaacgaatacaatggtgtaatcggattgtagatcggataagtaatttgagagaaaactttataagaaggaaggaaaagacatgcatgtctaagaggaaaaacaagcatgcacgccagcacatgtagcagttcttctcacaaattggtttgtcgctggttaacgctaaaccgataggcttctcggtttagattttgcctatttggtttatctttttaaatctagattccatgattggctcaaacaagtgcgatgtgattggcctttggtagccaaaacataacctcaatatgccaatcaatgaatcaaacaatcctccagatttggtatcgtggtgtgtcgagatccatatacttccaatacttagtaggagtaactaataaccataaattttgttaaaatatattgaaagccttgtttattcaaagttaatacacatcttgtgagctgttcgcacgagaaagcattcgtgtggttttatcatgatactaacaacacatcgaggctgatgcacatgccatcgatataaacaatactaggtgaaaccccgcgcattgctgcgggaatttagtatgataaaaaaaataacgtgcaagataactagataacatcagattaagtaaattaatgtggtttatgataatttaaacttaaatagtagaatggtgattcaaacgtaaaaagtaaggtggtatgactttatggaagaagaaaagtagggagatagtttggaccgtagattaatcatctaaaggctaaaaacaattaatgtgatacgacttaattagaggaaaaaggagaaagataatttggaccatagattaatcatttaagcactaactaaatgaggacttatataggatatcataaaacataataaagatatacattgaaacattatgtgaattatgttgtatgataatttaacatgtttgtatttgaaaagctcctaaattataaaaactataaagatatagcatgtttgcacgatgtttaaacatgatgattgttagtggatgatgatgtggcgtcttgttaattagtgaatgatgatgtggcatcttgttagtggatgatgatgtggcatctttgcatgttaagcttaaggagttagtggggaataactttatagtaaaataggatatgtgacaaataatttgacaatagaaaattttaaactgtaattaattatatgttaggcaattcttgaattgattacttttaaaattatatcattaattgctaccaaatactccatccatcccaaaaagactcaattcttgggtttccgtgtccaacgtttaaccgtccgtcttatataatttttttttatgattggtgttattattattgttaaatgataaaacatgaataatattttatgcatgacttatgtttttaatttttttcaaataagatggacggtcaaacattagacgcggaaacctaagttttttttttttttggatggagagggtatttcagtaaaaaaaaccatcaacaaccacaaaagcaaaccgtccatccaacctgtattgcaaacggaggaaaactggaggagcaggctgaaaaaaggaaaggaaaaatactccacaataccctaccatcacttgaaaggagcggtatggcggtgacttaaggtttgttaggttgaagcaaattccatcatcttgccatatcataagtataactagagcggtagcacaattcatcctatagattccaattccatcatgactcaaacaagcgcgtgtgtgattgccttttgctagccaaattgtggttttatttcattggccaaaactgtagataagttaaggcatacaattattataaatattgacaacctcagtataccaaccaaacaacagtaactaatgcctgccataattttataaatatctattgaaatcttaagttaatacactgctacaagttgattacataggaaaactattcgagtgatttcgtaaagaaattagtaatacatcaaagctttaaagataagagattgacacacaaccgataaaataatatgattatagaaatttaattctaaaattataaattagacatcttttgagctaaatgattttaaaacgatcattaattgctactacttccatggacggaagtagtaacagatatttagatatttcagtgtgtccggtacaaaaccatcaacaaccacggaaacaaaaccatccatccaacccatctcgcaaacgaggaaaactagcaactcgaactgaaaaatgaagatactaccaatcacactactatgttatttattttccaacccatctctcttctttctgcgcacacgtttttcaaactgttaagcgatatattttttaaaaaatatataagaaagttgtttcataaaatttatattaatctattttttctaaaaaataactaatatttaattaattatgcgctaagtaggaaaggtcccaactaacagccgtctcgtaacaccaaacatgatcctctctctctgtctccgtccccaacccagcgcgagacgatcccctcccctgcacggtaagcgaatcctcccaccctttttccagcttcgcttcgaatcatcctcctcctcgtctcgacttcgaatcagtagatcctctgcgatcctacgctttctcctccattttctcgccaccaccgtagtagacgagccgtgcggtatacttgtactacagagtttgcttccgtgaggtgtcagctttgctacgccgccttcactcctcgcctccgctggtgggtggtgggcttctctcccgctcgccatcctctccgtcgtcttcgccggcgaggcggcgcggcggcgcggcccccattccaccggcgcgtccgtctcgggaggttcgaatcaggtattcgtttcttcctcctccgcgcttcgcttggtgagcgggcgcgaggcgtggattgaagatccatccgaacttggggtgtgcttggattgggtgccctctggtagtacagcgccatagctgttcgtgtttattctgtacgaatctctgctggttgtaccagggaggtccaggacgacacaccatagccatgtggctgattcatgtgcacaatttttttatttttttaaaaaaacgtttaatccctcatttcgagtattttctgtggtcatactcgtatgaatctcaatatctcataggtgtttgttttggtctcaattgaacatgtaacaggttcaaaacggggatcggtagtgttctgcatcagtgatgggctggagatttgcgttgttactgttacatgttcttctgtgccttgtcaatggcgtctcctgtggccgcacgagctcttacgtgcgtacggagtacccatcgactgatatacctctagaaagcgaatggtttgcggttccaaacggctacaatgcgccacagcaggtatctaaactcttctgccagatcagttcattgcaatgaatcgacggtgttttaattgattggtctgctgccaggttcatatcactcaaggtgactataatggaaaagctgttatagtatcatgggttactgtagcagaacctgggacaagtgaggtgctctatggtaaaaatgagcaccagtatgatcagagagtggaaggaacagtaacaaattataccttttacgactataaatctggatatattcaccattgccttgttgatggtcttgaggtactagacttcattttcttcatatcgtttaggctttgcattttatacttgcatacaattgtagaaatatttgtccaacattatgtttacccatgcaaaatactaaaatagaataacctacaacatcatgtttcctttgtaaacagcttagacatattctaagtaactatcacacaaccttctcacttataattccataatgatctactttagctgtaaacttagagttattatgcacaaatttgatttgacagagaacttttcttcgtcaaatttcaattgagtaaggttatcatgttgaaacacgatgctcacctgcacaaattattttcacacactttcttagttctgtggaatagttctactattctagtatgatgcattaacaaaatactctgtgtgcacattattttgttgttagttccaatttaaaattgtaaatatataaaattactatattgttttgcagtataacaccaaatattattataagattggaagtggagattcagctcgagaattttggtttgaaactcctccagcaattgatccagatgcatcatacacatttggcataattggttcgtcttttgttttctcaagtatttttttgttaacagcatgtgtcatcgaattactttggatctctgcaacatctcttctaggattttacctaggttgcatgagtcatataagatagatctcaacaagattatactatcagaaggactggaaacacatcctctgttcttgtcaaacatcctagctttaggataagggaatacatgaacggaaaaaatggggatcaatgacttcatggaaagaaccactatgtcaagatatggttatagtgtccgagcttgttgatactaaagtcttctggctgtgctttgctaggtgatctggggcagacatttaattccctctcaacccttcaacattatgagaaaagcgaaggtcaaactgttttatttgttggggatttgtcatatgctgatagatatcaacataatgatggtgttcgttgggattcttgggggcggcttgtggaacgtagtaccgcttatcaaccatggatttggagcgctggtaaccatgaaattgaatacaggcctgatctggtatgttaacattcttctcatctatacaccagttgtttttttttaccacatattcctctgattggaagtagtgatttctcgacattttgtaaactcccaacttttttggatttttccttgctttagcatgttcagaagaggacaattacaggcaaataatactgaagaaaatagatatgtgatctatagatctttgtattagtttattttttcttatagctggctgtacgtggatttacacactgacaaggatctgtgcttataagctactccgtccgtctcattttaagtgcagccatggttttccgcgccaactttgatcgtccgtcttatttgaaaattttttgaaaaaattaaaaaccataagtcacaagtaaaatattattcatgttttatcatctcataacaacaaaaatactaattataaaaaaaattcaaataaggcggacgatcaaagttggacgaggaaactcatgattgcacttaaaatgggactgagggagtaataacttatccattgttcagaataacactgcagttccacctgagcattttaactagctgacatagttgtctttctttaaccctgaccgcattcgtatttatgttttcagggagaaacttctacatttaagccatatctgcatagatgtcacactccatatttggcatcaaagagcagttctcctatgtggtatgcagtcagacgtgcatctgctcatatcattgtgctttctagctattctccattcggtaagataaagatcctttctctgacttgctttgttttgtatatgccattaagtctgtacaaaccaccagatttagtggtggcggctgtggtggtgatagtgacttgggagttccaagtgcttcacgtagttcaaaattccaagtcaaggaggggcaaaagtagcacttcttagacaaaagaaattatcgtgttactgtcttcttgtcttcttactgatccaaatgtgagtatgacgatattctttatctctgatgcggatggatagaaacataaagtcttctctggtttgattgaaagtttgaaactactaataatgcaaggttccgcgttccagctgtttgaaacctgtaacattgtgtggggacaggcatggatgctcccttgaatgagtgcagatctactagtatctttttttcattggcgtaatatcctgaccatcatctactatatttagaagtgattatgtgatgcatgtatgatttgatagttggatgattcttttcattgaatattttgttgtatgccttataagcttatctctgatgtttaccagtaaaatacactcctcaatggacctggttgaagtatgaattgaagcatgtggatagagagaagactccttggcttattgttctcatgcattctcccatgtacaacagcaatgaagcacattacatggagggtgagagtatgagggctgcttttgagaaatggtttgtgaagtacaaggttgacttggtatttgcagggcatgtgcatgcttatgagagatcggtaaatatttacttaattctttggcacaagcttctttgatattaaaaaaaaagagctgaatttggtctgaatctcgtaaagttatattttgagaattgaccagaagaaattatgctagcctgttatttcatttctagtcgaagagctctgaactttgatttttgtttcctcgtaagtacctttctatatgtctatgtttgcagtatcgtatctctaacatcaactacaacataacatcgggtaatcgatatccagtgccagacaaatctgctcctgtgtacataacagttggtgatggaggcaaccaggaagggcttgcttcaaggtaaaggcaaatgaatttatagcggaaaacatactatttgtaatattgttgtttacgcactcctacggttcactcattgttcaaaatcacggtgttgcaggttcagtgatccacagccagactactctgcattcagggaggctagttatggtcattcgatcttgcaactgaaaaacaggactcatgctatctaccagtggaatagaaacgatgatgggaagcatgtacctgcggacaatgtggtgtttcacaaccagtattggtgagtgcagtgatcgataacgcttcaattgttcacaacgctcattggttgcccctgttcgtaatgctcactgaagctagtgatttttttttttgaactagagcctgtaaaggcccccatttcttttactagaaatgatcacattacaaagtctgactgaagctagtgatatgcagaccttcactcttatttctagtttttgttgcctagatagctgattaaaaaggacattgtttggcagggcaagcaacactcgccgcaggaggctgaagaagaagcattttcacttggatcaaattgaggacttgatatccgtgttctaggagttgatctttcagaacactgcatcgcagactttctgaaacggtggcggaatagctctgttgccctttggtcttgagcctcgaccgagtgaggcagaggctctcggctctcatgtaaaggaaccatgcacaggtttgtgggattactattattgagcactgtattgtatgatgaagacaatccgatcagcagatgattagtgctgtacacatgtagcatttcacagccagcgacagtttcgcaatgtgacagtatcttcaataaagtttcaaagggttgtgaaccgagattgcagcattagctgccctctgttcgtaaaagatcttatttctaactatgtatctcgacattaaataaggtcttacagggactgaagggcgcatatagctagaattttccatctaaacgtcacactatctgttaaaccatggcagcttaacccagaaacgaacacaagttaacaaatctcaaaagttaaatggggcgcatttttttcaatttgtgacatcatgctattttccaagtataggtgattaagacaaggacgggtgacgaaaaaaaaaaaaagaaaattccgttctctcctctgaacctgatcctgacatggacgtgtcctgtggcgataagaatcgttaggtcaactgaaccattcggaggcgccgagctggcccaatcccgcgaaggcataacctcatcgttgccgttgcctttattacgaggaatcgataatatttgcatgatcctattcctaatcgacctgtagctttcaattactaagtttcaacgtctctaattaattcgcgatttgcagctgagcaaaaaaacatttctccgttagtcatctgacgggttgaccatcttccatttccatcgacttgtccaaatcatcaggcgttaaaaaggacaaatcaaaatatgcctggcacggttttggcttaaaatccgaagctggtttaaattttaactttggtctgaggattattaatgttgggtgttccttcgccacttccattgcctgcctggctctcttttgaattatttttaggaaaaatatattcaaaattagcttcaacttttaatccaaagacctatgccaaaccgttggatcgaatcttccccacacttcaaaaaaataattcaaaagcacctgacctacttcgtgttttacaagcaatgccacgaacagtacgtaccacacgttaggagaatcccatcgcgaacacccattggcagaaacaaaaattaaagaaagttctactaaaaaaaagaaagttctactcaagagctagccaaagctccaactgccgcgcacacacttaactaacaaattaagctcgagacgtactagatcacatatctaccatcttccgttcaaaaaaaacatatctaccatcccaagattaaccaaccaatctactatataagtaatctacaagcccttcctaagcctaacgactgctgtaatattcggtttaggggataagatcagcagtagattacccataattaaactaatctgccgctgatgctgtcgctgctgcacatggctaggtcagcggcaaatgatactaattagaggtggggggttagcagattagcgctaatcaacaagctggccaaaccagcaaaaccaaccaaccaatgacgcgtcgcttggcacacaggaaaaggcgaggagagaagggaagggtcggagacggtgggtgacaccggatggagaccgagctatagcgctactggcttttgcaactccaagttggctggtaaacaatggcaaattgggggaatatctaaagaggaggaggagtggcgacgcgacggcgacggcgacggcgacggctggctgtgcctttccctttgtgtgttgtgtccactggtgtgtggggctcttgggtttgccgtttctctccgccacttccttggcgccaaatttttgtttctttctctagaagttttgttctctgggtctctaggaattgtatatttgttatggtcttatggaagcagatttgaagtgcctttctttctttcctttccttttttttttggttcatggtgatgataaactttattgtaaggaaatatatatggttctggaccatatttagacatgttggtttattggaccatattctagagcctacatggaaacatactttatccggttcaaataattttttaaagtcaaatttctttaaattttaacaaattcatataaacatgtagtaatatgccaattttagttccattgaatctatttttatgctagaaatatttattgaagcacgtaacaatatttgtttcgtgttgaaaatgctatatttttcttaaaatttgttcacttcaaataatattaactcatggcaaaaatcttactatgtgcaacaaaaacaaataatacaactgacataattaaaaaccatcgctatagcatacccactccactgtgacgagccagtgagcttacaaggttatccccttttatcaccaagccccgttgagaatacacatacgggaaacccgcgacgaactacggttgccattatatgtcccacagcttataagccgttgctaaagtttaaattaaaagttaattttaagatttttttcatcgtagtttatttttcatcgttattggcttttaaatcactaagggtgtgtttagttcacgctaaaattgaaagtttggttgaaattggaacgatgtgacggaaaatttgaaagtttatgtgtgtaggaaagttttgatgtgatggaaaagttggaagtttgaagaaaaactttggatctaaactcgggctaagaaaatatgtatgaaagtttcgtcctcaaaatattttttttgtgtgacttatcataatcagcattaggccgaacgcattgcccttagttcaaaaatggtgggtgatgtgtgcaatgttactttaacatccgaaaacatttgcttaaagacgtagctttaagacattcttagcatctagaccgaatagaattgtgttctttgaagccatgaaagaccaaacttatcgctatcaagctaacaacctcgcattattccatatactatgatatgggagtactaatccatagttgaccaagactcttgaacaataatattatctggtctacaaattagactcttatttgagctctttcccttttcttaattcaaggcagggttgccctaaaggtcaaattcaattgccatggagaaggaaaaaatggaacaggtgagaaagtaaaagatgctgctccaacagtcctatagaacaggtgaaaaaaatgtattattatgtcttacctggaaatctggaactggaaactttccaaatctgtccacataagctaggagaaagattccagtgccatgtggttatagaacttttagagcatcaggtgagtgagaaggtggatcatggttagtgttaattaaacacacacatatctagaacaaaattaatggtatcaaagcaaatgccatggcctataaagcaggcaatagaccatgaggctgtacatataaatgaatgctcacctagtcaatcaaacaagctgtccaaataacacatcatttttttaggagaaatgatttcaataattaatgcatggcatattataattgttttgaaataaatgcaatgcaaaagttgaaaaaccagtcaaaaaccggacaaacactcgcttgtaaccatcgtggctaataacataccatattatactctgacaaacgacaaaagttatactaaaaacctttctaattttattacaatatcgtaaaagccatgaactcctacacgagttttctttaaggtttttggattcactttaaattagtctgaatttaaacaaaacattctcaaggttttggatccaaccctcacatgtaagcaaggagaaaaagacacacgagacaggttcctgaccgttagatcaaaatccaacggttaacatcggacaaaaacccaagtggccaactgcggttggggggcaataaccacgtccgatttattatttccattttcgattccatttttcgctatttatttcgcatcgccacctgttcccttttctttttttatttatttatttgccaccactttgccccacacacacgcccacgcccacccctcgtcgcctcgcctcctctcgatttcgccggcggcggcggcagcggcagcaaccgcctccgcctcgccgccggcgggggggcccccgcgcgcgcgggcgggcgcgatgtacggcaacgacaactggatcaacagctacctggatgccatcctcgacgccggcaagggcgccgccgcctcggcctcggcctcggcggtgggtgggggaggcggagcgggggaccgcccctcgctcctcctccgcgagcgcggccacttctcccccgcgcggtacttcgtcgaggaggtcatcaccggctacgacgagaccgacctctacaagacatggctccgcgtacgtccgcgccgcggtcctgcctctcctctccctccgctcacgcgcgccgcgagcgaatctcccggctcgccgcgcgtgaatttgcggatgttttttttttgttttttttgtttttacccccgatctgtgtgttgaacgggaggcgtggtgtcggcgcaggcgaacgcgatgcggagcccgcaggagaagaacacgaggctggagaacatgacgtggaggatctggaacctcgccaggaagaagaaggaggtgtgtgtatgtgcccttcttttttttttgtttttgtttttggttcgttgcgtcttctccgtagcacaagttcttcggttttgtgattgggtggggggagcgttggtaaaatcctgtctgccgtttccatttgggttccgggcttgttctggtttagtggagatgtggtttgatttagtgtgatattccgcgtaggaaggactaagggctggattgatcttggtatgcgttgcatttgagagagcacatggatctgttcgagggaatgcgttaacggaatgcttattgatctctttcccgtctcctctacgaatttgctgaggaaatggcatgagagttctgacataaatgtagtagcattactgcgtacctgcaatgctaggtagattctcggcccctatcagtttcgaattgtgctgggacaacatggcacggctatatataattgcgtgtgctgttggataatatgctaaattcgctgtcaccattcaccattatatggactccagctctttccatctctctctgtctggttactctcttagtttgttggatgctggtaccctgcagaagaagctagcagggattgcgacaaatagtcattacatattggttgcatagacaccacagtcaaataggctgcactgaagctttctactgggcaatctttcaaatgcagtttagttttgtttgctttctacgcgtgaaatagatgacaaaatgcagtgagagagaaggttgaagaccagtgttggagtgccatagatctagttggatcaatggagccaaagtatatgttctccattgttggagtagactgtataagtttcgctgataagggaactatctgcttttttagtgaaatctgtagtaattgtgtaatgcgcactcaagccagttactacctactacagactgcagagtagatcacgtggtgttcaccaatacaactttttatacaaatgcttcctgatactttcatgaaagtacctttgttccaagcagagaatgacacagagaatcgtgtactgaacctcagggtttgagaggagtgcgatgtgagtcatcaaaaatatccagaaccatgcattttatcagaagagaagattttaccataggtcccctgttttttcccttcattttgcacagcaaacacacacattctgatttctttgctcaggtatgacatttttacttccatatttagttctaccactttgttccatcctttgaatctttagaaagcttgaggtagtgtcttattttgttgaaggtgacatagacaaagccagtcttgatcaaaacggtctgcattcagaaaccctcccattatcctctgcttctggtcatcattgctatccacattcaagcaagcaaaactgcacagttctattgacacctcctgcaaacccattatttggcttctcttatttttcctctaatttgcattttgattgcactgaggcttggcaaagaaagaacacatacaaatgataatgttgatgactttattggatgcgtttgtggcaacactggggcatgggtgatcactcagtgtgcatgtaccttacaacttatgttgatttctcatccacctcatccatgacagtaatcaagtgagctgttgactcttgcaagtgtgggtctttgattgaataaattggaatatgtagccaagtaagattcacattagaactagagcggcaataaggtgcgtacagtacagttgatcgaaacaataccagattgtttcttatgtcaatatttagatgctcaaaggtcataccaacgggaggaaaatgtgatgtgtttcaaaaaataaaaataaaaatgtgatacatcactaaaagtcgtatgctcacttgttgatcatttacttgtcttttggttttcaatttgtttcattcatctaacatgctggataacttctaacttcggtggaactatttttcttacagaagagccttctatatcaaccattgtacataatgaactagtgacatatatcagtagtcttattgctattgtctagtccatatgttgtttgcacatggcatgctctcacaccacctatttcttgtactaatcagttgattgatgcattgtcctgaggtttgaattgttccatcatttaaagaaaataaaattgccatttttaattgtgccatctcaagttgtcagatttttacatttattcccaaaactttcaccttttgacacctttgaggtacattagatatattacattttatataggaatatttgcactgagcgctgatgtttctttcacttctaatatgtaatccatgttggtcctcaaaaagcaaagtttccctttccaatttcagttcctaagttttgtacctcttccgtttttgtgcatttgtttatttctgaattattttcatgctcagttggagaaggaggaagccaatcgcttgttgaaacgccgtctagagacagagaggccacgggttgagactacttcagatatgtcggaagatctctttgaaggtgagaagggagaggatgctggtgatccttctgttgcctatggtgacagcacaactgggaacacacctaggatcagttcagttgacaagctgtacatagtgttgatcaggtacacagtagtttctttaatatcatcatattgtatccttttaagtcaatgtgcagtgtaggttcttggtacacgtaaaaccctgtttgcaatcaattcatatgcactgagctgctatttacataaaatgcaaacatgacatagctaaaaaatgacctagaggaaatcaacattgcaaatttagtgtacaactgataatcaatcccttagactcagaattagtgataatacctctttctcctattttgcactttgatatatgatgaaatttgcaggtttgttggtatgtatgttcacatgtattggccttataattcctttatgatgtattaatactgcagccttcatggcctggtccgtggtgagaacatggagcttggccgtgattcagatactggcggacaggtattgtttgttgcatgtgcttatatgagatatgcattccgttatccaacttgaacagctatacaatctagctttatcctgtagtcaagtggttgttagctattatctttattctgtcttacataaggtccaccaacacgaagaatctgtatggaaataattctttatgcatctgttgtgtcattgcataggtcaagtatgttgtggaacttgctaaagcattgagctcatgtcctggagtttaccgggttgatctttttacaagacagatcttagcgccaaattttgatcgtagctatggtgaaccagtggaacctttggcatcaacaagcttcaagaattttaagcaggaaagaggagagaatagtggtgcatatatcatccgaataccatttggaccaaaagacaaatatctagctaaggaacatctctggcctttcattcaagaatttgttgatggcgccctcagtcatatagtgaagatgtcaagggccataggtgaagaaatcagctgtgggcatccggcgtggcctgctgtgattcatggtcattatgctagtgcaggagttgctgctgctctactgtcaggagcacttaatgttcccatggtctttacagggcattttcttgggaaagataagttggaagagcttctcaagcaagggagacagacaagggagcaaataaacatgacatacaaaataatgtgtagaattgaggcagaggagttggctcttgatgcatctgaaatagttatagcaagcactaggcaagagatagaagagcaatggaatttgtatgacggttttgaggtcatacttgcaaggaaactccgtgcaagagtcaagcgtggtgctaactgctatggtcgctatatgcctcgtatggttgtgagtatacttatgcatcataatcttttcttttttcactccgaaaatagtcaatggtaactactgcacaattattttcataattgggtaatttgctgttataatctgctgtagaggtttaatgtgcattagttccctgttccttgttctgcagatcattcccccaggtgttgaatttggccatatgattcatgacttcgatatggatggtgaggaagacggtccatccccagcctctgaagatccatctatttggtccgaggtcattttttcttttcttttttagattcatacatgcaagatcccacctactagttcacctaatattttctttagaataaaacttagtagtttgcacatttaatatttgagaacatttatttgcttattcatgtttatcctgcagttttaactttatgcactaataatttgtatgggtggcagataatgcggttctttacaaaccctaggaaacctatgattctggcagttgctcgcccttatcctgaaaagaatattactactcttgtgaaggcgtttggtgagtgccgaccactgagggagcttgctaatctagtaagacaaaactgcattttgatgtcttaatttcaatatcatacttattatgcattaagtttgattgctgctattaatctgaaacgtccttatatttaattagtactaacttatgatgttgcgttgcagacattgataatgggaaaccgtgaggctatttccaagatgcataatatgagtgcagctgttttgacatcagtacttacattgattgatgaatatgatttgtatggtcaagtggcatacccaaagcgtcacaaacactcggaagttcctgatatttaccgtttagcagtgagaacaaaggtgtgttatgtctgaacaaaagatattcattggtgatggcattcttatctttgctttgaatgtctagcacttgaagtagaaaacttgtgaccaataaattaagttgttcaaatggctgaaggattcagtatctgtttctttgaagtcaaaatcttatagcaaagatttgtaatgtttgtaggatttacagtacttctttagcaatttcctgtaccggttatattgacgctgatcatccattgaacatctgcagggtgcttttgtaaatgtgccttactttgaacagttcggtgtcaccttgatagaggtcattatcattgtatctaaattcagcttgcttccattactgaattttgtatctaattaacaccaatctgctattttcgtgagcaggctgccatgcatggtttgcctgtaattgcaacaaaaaatggagctcctgttgaaattcaccaggtatctgagcatatttattgtgcctttgttaaacttagatattttttacctaggaaagtattatcaactactagctgggatgaagatcaccatgtcttttccatggatgtatgcaggtgctggacaatggtctccttgttgatccccatgatcagcatgcaattgcagatgcactctataaactcctttctgaaaaacaactttggtcaaaatgccgagagaatgggctgaaaaatatacatcagttttcttggcctgaacattgcaagaattacttgtcaaggatatcaactcttggcccaaggcatcctgcttttgcaagcaatgaagaccggattaaggcacctattaagggaaggaagcatgtcactgttattgctgtagattctgtcagtaaggaagatctgattcgcattgtcagaaattctatcgaggctgcacgtaaagaaaatttgtcaggatcgacaggttttgtgttgtcaacttccctgacaataggggagatacattctctattaatgtctgctggcatgcttcctactgatttcgatgctttcatatgcaatagtggaagtgatttgtattatccttcatgtactggtgatacaccaagcaactcccgtgttacatttgcattagatcgtagttaccaatcacatatagagtatcattggggaggagaaggtttaaggaaatatctagtgaagtgggcttcttccgtggtagaaagaagagggaggattgaaaaacaagttatcttcgaagatccagagcactcttcaacatactgtcttgcatttaaagtggtcaatccaaatcatgtaagccttttccttccagagttcatgatatttggttggaattgtatttctttatatattctatgaactgctcaagtgcatccttttctaaaaagggtttaggtatattgttttatagcttgttagatgcaaggtttttcttaattgttgtttgtttatgaattgtagttacctcctttaaaggagctgcaaaagttgatgagaattcagtcactccgttgtcacgctctgtataaccatggtgctaccagactatctgtaattccaatccacgcatcacggtctaaggctctaaggtttgtttgattttcttattttcctcattcatttatctcttctgttcttaacatgttctgatgtaccagtattgttgtggttaacattttttctgaacttggctcaaaatgtggggcagttttgcctgtctgatcttttttgtgtgggttacgatcaatacttttccatagaagattaggtatatttcttggcctcttgggtgaggaaagactatattccaagtctttgtttgagaactccaattttacagaccactgaaattcaagtttccatggcttcctactccctccttcccaaaatataaggtattttgactggatgggacacattctagtctgtctatattcatattactaggatatgttccatctaagcaaagtaccttatattttgggacggagggagtatcttttaggaaaaaggaatgtgtatgagatgctgttagaccaaattagcaagcaacagtagtaactttttgctcatgggcttgttaaatagttttttatattcaattcccatttgcacctagcctagcagcatatatgtgtgctctccatgttgacaaaattctgttctaggtacttatctgttcgctggggcatagagttgcaaaatgtggtggttcttgttggtgaaactggtgattcagattacgaagaattgtttggaggtcttcataagacggtcatccttaagggtgaattcaacacatctgcaaatagaatccattctgttaggcggtatcctttacaagatgttgttgcacttgatagcccaaacatcattggaattgagggttatggcactgatgacatgaggtctgctctgaaacaactggatatacgggcacagtgacaccaagcccccatctgtttatcattaatatatgaagaaaaccagtggacgatacaaagacagcaaacaaacactagcatttccatacttgatggagatgccgattttgccatgtaagtcatgtagtttatgtgtgtggtccttgagctgtgaatagcattccgaaatctcatcccattgagattttggtatgtggcaattttggagtaaaaatcgattccatccaggaatacggacaaaagaaattggttacaatgttgataatgaaaaacatgttaaggaagcattaattcagcaagaaaagcttccaaaatcactacaattcttggccaagcttgcaatttccctttttttgaagtggaagcttatgttgtgtgtttactgctgggtggaccatatggccctggcagcccttctttactatgtttactccaggagggctgcctagctttcgtgtaagtattgtttgacacgatggttcattctatatatccaaagttttgttgagatcaatgcatttttgttgtttgtccttggatgggcaaagattagtactaccatctagttgatgtttatctgccataacagtttctaacttcttttttactgagaaacagcgtgtcttgtgtttatagcattgatttccatgtccatatgttgctggtggttatgtagttattgtggcaactataacgcagatgccaactccgacttcgtataaaatgcctatatttatcctgattaatatcattggtcaatgtgagttgtactcaacgcagctgtagtttggtgtagtagctgcaacaattaagccatgttttcttcaacttcttttcacactatcttccatctttagtttaaagtctgatcgtttcgcatacaactgataaaccgtaaaatgcttatcagtaattaaagaataatttatgagtaaaacttttatatttgtgctaaaataaattataataaaaacccttaaaatcaactataaaattaaattttagccacagttgataagccaaaaggcgaagattgaagatttgatctttatgtgaactaaccaattaattgaagatttgatctttatgtgaactaaccaatttttaatgctcttaattttgttttgattttgctaaaagaagagtttgttattgttgatgctaacttatacttgttgccagaaaactttaggacagttggggcgattggttttgggtattggttatcggtttatggttggccatccgtatcagcttatcagaaaggctagtaatacagtcgacctgttagctataaggttctgtgtagtcttctcttagcttacccatataatagttagctctttacagttaatacagggcaaacttatctctctcacagagtttcttggttcttgtgtcaagtcggctgtaagtttacagcccgctctcctctcttctctcctccacctcagcatttagccggcttgtagcctactattatacttgctctcaggggattgtgatacgtctgctcatcttgaacaatatctagtcaaagtcacatcttttttgcgtaatgtcgcatcttttttgcgtaatggctaatttaatttaaatctgcgaaaaaggttcctgttcggtcggcgagaggtcagacttcaaaaaattaaaatgggggttgccccaattgcctttttcttttctggtcagactgcagatttctgtccaattaatacatggagaacttatagtttcaaaataactgctatgtttttgctgacaccttcatatcaactagctgacatttacacaacatttagaagaaatactccttccagttaaaaaattccataaaaattttaaatgcttgtgcttttttaaaaaaaattggtatacttagattttccttgaaaaagactattataattgttagaaatataaaaaaatattgcccctaaacataaaatatttattataagagagaataattgttttttaggaagacaaattttgccacaagacactcagaatttgtgtaattgtttggtggacatcgtaaaaaaatgtcaaggttagaggacactccgaaaagctggtaatttgttaggggatactttcaaccgaattgaagagacaaaaatttcaaaaagatgataaagcccttagagccaaaagtttctaacttgacgttggagcaatgatggaatatacttcagctgacgctggagtgatgatggaacatacttcggtttgatggaagatttatggttgcataatttccaaattatcttccaacaccatggaagcttgttgctgcgggggcattctcatctgttttatgaatctctcttcatttggatcaaaaatgttgcgaactaccaaatttaggaatattcttcagccgtggcacatgttttactatatctatcaacaaattatacaaactttagatgtcttatagcaaaatttgcgttcaaggaatattttgaagctataacgcaaatcattcaagtatgcaactaggcaagatgggctagaagaagaagagatgtgcttgcaaaccaaagccagcgaactacaccgactgaaaaatatatttaagaaaataaaacgagagcaattctcttgcgtcagctttggtaacccctcctgttcagtgccacattcatggctaactcaccaatcattccatgcaaacctgcacgtttcctcataaggcgcaaaaaacggtgaagtactacgacgaatcggccaatcagacaagtcatctctctcggactgcagactgaaagtctgaaactcagccattctataccagtacgagtacagtacaagattgggttagctcaggttggttgtgagcttcccaactaatctgaatctgaacctccctgaagttgaattcagaaagctttcattatctctaatgaagcaatcagagcctcaattttcaacggttgcctgcacgccacagagagaaaattaacctgcagcttcttgctggactgcgagagtgcccattgctgaagaatttattgtgacaggtgggaagacggagggatggatggccagctgacacctacaacatagacgggtcaaaacttcagaaatggacccggagcaaacaacagctacctaattctatttcaaagcactttctttatgctgtcaatttgaagaaaaaaaaaaccctctactactccctccgtcccaaagaaaccaacctatagtactaatattgacacattttagtatgtccattggttttatatgagatggaggaaggatataacaacggaagggagcgtaaatatacttttataatgagagtgttatatccttggtctctttacaccgtgaatgtacacaattatatattcatgtaagtgcaaatacgtggtgtggttaaagtgataatgagcttgctatactatttggtgaaagaaaatataccgcctcctatcattaatatttgacgtcatataatatcgacataagtttgtgtgtagcgtcaaatataatgttagggggggggcatatttttgtaatgaaaaggttttatatctttattctctctacatcgtagatgcacatagtcatacatgcatgtaagcgtaaatatgttgtgtggtgaaagtgataatgaacttgctagactttttttgacacctagttatgctccctttttatgcactgccgcaccatctcttttctcctcttctctgttatcatcgtatatactacatattttacattgaacctattgttggctacgccattatggcatccaccactgctgtcaaactgtgtaaaagatgacataccactattaagagtgttaactataaaccaataccctcaggctatataaaaaatgatttcaacaatattgatgctgagcaataatgcagacacatcgaaattcttgagttaggtgtccaaaggcatttaatcaatatttcactggtatttgacatggacttttatagaagaaaaatacatcactgtagtagtagtatctttttccaagccctgttagcaacagtattgatgtggttgtcctcctactctacctgtatttgtcctcttccacctcataccaaataaaaccccccctctccattgttctcgcagcgtataatctcacccaaaatacacgcaatctcacgccatttgcacctacaaatctcatcatctcatcaatatccatttctacaaaaaaaaaatccatttcagtatttcattgctgtagcatcaaatttattggcattatttgctgatattgcatgctgcattgagaagaaaattaaagaaactgacttggatagcactgcactctagctaccattttcttggcttgtttgcgaaagctgctccatctcctgtgtcctaggctctttccctttttaaccccgtgccacagctagccagccaagcactgcacaaacctttcccctgaagaggccaagaagttatgggagaggaggcagccatggccaccatggagagcgcctaccatgatgagcttgctccggcggcggcgccggcgccggcgaagggaggagggagcaagaagaagaggaagcagcagaagagggaggagaagaggaaggagtgcaggctggtgagctaccacgagctgccggactacatgaaggagaacgagttcatcctcgactactaccgctccgagtggcccatcctcaatgccctcctcagcctcttctcctggcacaacgagaccatcaacatctggacgtatggatttcaacctgaatttttctgaatttgattctggttcagctttgtgtgctgtgttcttgctgctcatcgtgtgggcgttcttggtgtttgttcaggcatcttcttgggttcgtgctgttcttcggcctcaccgtcctgcatcttggccagtacttcccccaggttgctgatctcatcggacacctctcctggtgagtttgtgaaagcctcagtggaatttgtttggttaaaatcttggctaatgtgtcctggaattagtagcacgaaatagtttagtttttcagtagctgtgagatgaatattttaacgttttaaggcactgaataggattctacatcctacttgtttcttgttaatcaaattatgctgagtgatagcatgagagtttcgataaatctagctgcttgtgtatcgacaaattaaatctcaccaacaaattcactccaattccatacaacctggaaaatgacaagttgcagtttttatttcagatgtctatgtgctttgcatgcttaatattctgttcactgtctgtccctttttttttttctgagaattgtacttctatttgactgcaggccaatctcaaaggttgctgaaaatgtctccagtaacattggagatgtcctctctgtgagtaaagcttctatttcctgaaatcattcattcctgtgatagaagtagaagttactgataagaaaaaaaaatactggattgcagtaatattattgggctggttagatccacatgcttaggagattcattgtgcagctttgagtggctccacttttcagtactgtcctgtttccttctgtttgttcagatgtgcatgatttggactttttggatggcagctgggccaaagtgttgggtggggcttctgattgctttcacctttacctgatgaaccttgcccaattaggtccccttttactggtgcccattcatgacaaatcctagattaagtgttggccacttcacttcaccacaagatgttaagctttggtgatgtgttcataggacttggttgtgacttggtgattgtgatgatcaagtctacccgctacgacacgactccagtgtcgccgcgggttatcttttcttcttgaaatccttgtgccttggatgtctagattgacaagatacatcatgcaaccaccaaagggaagattttgagacttgaggggaagattttgggaggttaagaggttaggggtcactaaaattggcaaacattggggacacatatacaaggcgatatttgcatgaacgtggtagcagtttatcgcgtgtgatccttccctttgtgttttcataccaaaccttcttccatcctcacatggtaacagttgtcctctctttttgtgattgagactagttggtagacaattttgggcaaccatagtaaaccttcatttttttgcataattaattacttgctagctaaattcattgcttgtcatggcttcccaactgttcttgaccaaagaacagtgtttggtaaccaaatagaaattcttagataaggaagatgaatttgttcggagttcggacaccaatatggttagatgttctattcaagcgttgaaacgaatgtcgtcgcaataattcggtgttcccagtcttctaaattctaatgcatatgctttaatttggagagtatattgctttcagatgtttaatgacatattatacttcgatgtgatatgctacaatgatgatcggtgtccgatcagctgtcctgtcacgtcaatggtttgatcgagtttggcgtgtgtgtccatgcattggccagggcgcggcgtcgttcatgcaggcgagcccggcgtcgagcgccggcgccatggcggcggcgtggccggtgacggcggcggcggcggcgacgacgcggtggccgttcttcgtgttcctcgcgggcgccatgttctgcctgctgagcagcgcggcgtgccacctcctgtcgtgccactcgcaccgcctcaacctgttcctcatccgcctcgactacaccggcatcgccgtcatgatcgtcgtctccttcttcccgcccatctactacatcttccagtgcgagccgcggtggcaggtggtgtacctgtcggcgatcaccgccgccggggtggccaccgtgtacgcgctcatgtcgcccaggctgagcgcggcgaggtaccgcgcccaccgcgcgctgctgttcgtcgccatgggcctctccggcgtcgtccccgccgcccacgccgtcgccgtcaactggcacgagccccgccggaacgtgacgctggcgtacgagggcgccatggcggcgtcctacctcgccggcaccgcgttctacctcacccgcgtcccggagcggtggcgccccggcatgttcgacctgtgcggccacagccaccagatcttccacgcgctcgtcatcgccggcgcgctcgcgcactacgccgccgccatcgtcttcatccaggcacgcgacgagatgggctgcccggcgccatagctaagctagcgatcgaacacacaagaaaacatttctctccatggatcgatgaaccaaatgataattcgatacagcagagtacacaagaagcatatatatacagcggtagacgatcgaattaattgatttgagtggttttgtttttgtgaggtttttttttaaaatttttaagtttgtttagcttgcaggagtcggtcatcaagtgtgagatattaccgtgtcgtccggttaatgacaaggatttattgattgttatgatgtcgaaacttgtacatacaagaagcaactgttgcttattcgttcgttgtaagatgcaacaaattaagaagagagagagagataaggcaacaaaagtatacatgtgttgattgccattcctccatcaaaaactaatcccgttaagacgtccatggcgtgatgacaatcaatgctatcaggcggcctctgcgtattaaagagtgtatacatggtttaactgttggcccttaactgttagattccttataacggaactagcccactcgaatttagtttctagattttacatgggtactcatatatttacggttattctttttaagtgatagacgacgtatacgtaaatagcgagacacatataatgacctcgttaattttaagatatgccggctcagtctcttctgaaggtgttcataagatatgagtatgtgcgttcaaggagtacgtgttatagcgtctgtatttatattgcctttaaaaagagtgtatacaactagacacgcatatttaatgtacgtcatactcccatcatcaaacatttagggtgttttggaggggttctctccgacacgcaaaatgaagtatacattaacgcattattaattcaatatattagttatttttaaaaaaactaatatgattttttataaacaattttttatagaattttcttaaaaaataaattgttcatagaagtttggaaagtatacgtgcggataaacaaggaaggagaagttgtgaacataggccctgtttaatttctaaaaattgtcgcaaaaacatcacatcgaatctttggacacatgtgtggagcattaaatatagataagaagaaaaactaattgtacagtttgcatgtaaatcgcgagataaatcttttgagcctaattagtccatgattaaccataagtgctacagtaacccacatgtgctaatgacgacatgattaggctcaaaagattcgtctcgttgtttccaggcgagtaatgaaattagttttttcattcgtgtccgaaaaccccttccgacatctggtcaaacgtcctatatgacaaccaaaaatttttatttcaccaattaaacaggcccataagaacccaacataatgcaattagacacacgtatttaatacacgtcgccacacgtgtttgttcagcgttagtagtattattctgatttgaggatatcatttttgaatagtcgaatcgaatagggtacgggccgtgggggttcataaatggccgacctgtgatgtgagtcgtccacaccccacaccccacccaacccgagcctcagccgaccgactcgacgacgtctcgcgctaatcgcaacgccgacgcccatttatgaccagccttcgcttggctgcacgtctccgtcccgtatcatattgccgtctcagcgacccagccgccgcgccccctaccactgccaacccaatccatctctctctctctctactgctctccccgaacgcgctaccgttgttggacccgacgacgacacacgcggtgggtgcgtgcagtgcagccaagaagccaggtggtacgcgagagaaccagacgaggcccgtgaatctccgcgatttccatcgcgcgcaccggcccgcgcgcgggcaaaatcccagcggcggccacgcggaggcgaactacaccgtgcgcgcgcgcggcgcctcttccgcttgggccgcgcgaaatttacgtgcgctcacgtacgcgaacgggacgaaacgaaacgaggcaaaaacaaaaaaaaggccacaacactgcggcgggcgctgcttctgctgccgcttgggttgggccacgcgagcggctcagcctagtacacgcggctcagcaaaggggataagttttttgacctcccttaactcttgctgttgattgaattgcatccctcaaccataatagcagagaacaggtgagagagagggagaggagaaataggtgagaaaaaaagagatgagattaggatgattggcatgtgagctgatatttttatctttttcctggctaatatgtgagtcctatgagcgtcacgtaggatgaaaccgctatcaaaatagctgaggtacttttatttactccggtttttgaaaatggagaggccttatacctggtattatagttaagggtcaaagattcaatatatagcaagagttgagggaggccaaatagacttactgcacaaatcaatggtagtggtggtgaacttgagggggcaggggaggaggtaggtttggtttggggtttgggggagggggagggggaggggatgccggagctgccggaggtggaggcggcgaggagggcgctggaggcgcactgcgtggggaggaggatcgcgcgctgcgcggtggcggatgaccccaaggtggtggtcgccgccgccggggggcgcgtggcgttcgagcgcgccatggtcggccggaccatcgtcgccgcgcggcggaggggcaagaacctctggctccgcctcgacgcccctccattcccctccttccagttcggtcagtacctgcctcctcctcctgcagttcgatcgattgctttttgctactagtaaattggagtgacaaattgctgtgtgtgttgcagggatggcaggtgcgatctacattaagggagttcctgtgaccaagtacaagaggcatgtgtaatttgtatgctggggaatttgttatacagtaatggactacatgctgattcagaaaattattgcagatcagttgtcagttctacagacgagtggccctccaagtactccaaattttttgttcaagtaagatctcctagctgtcacagcatcttttttcagtacattgctgctatgtgagatcaaaattaacagtttataagcaaaaggggatatggaattgttgttcatcagtactgtactgtactactttggttgggtcttataaagagagagatggataggtagtaactgtcatcgtttagcttggacacaagatcgatttgttaggctatatagctcagaaaacatgttttggctgagcctctagcggactagctaatccaaaatgcggaagaacaaatcgccacaaacagtagtgcttttgtgatctccagaaagccagaaaggaagacgtgccatgtctcagggttaacatgctatcatataaacacgtcaatattacttctgctatataaggtttattgaatagtaatagaacacgcaatgcatgcctaggcattgttgtttagtcaaaatttgatctcctcttattgtttatgtccttttatgatatcataggttggctcttttaatgttggttgtttctaatgcatttaacttgttccagcttgatgatggcttagagttttccttcactgataagaggcggtttgcaagagttcggttgtttgaagatgtatgtgctttgactagttgaatctaaatcttcagagtcttcctttcatgttattttctaatgatgtccctaatcaaataacgatttgcagcccgaaactgtacccccgatttctgagttaggaccagatgctctctttgagccgatgtcttctgacagttttgcggactcgctgagcagaaagaagattggaataaaagctcttctactcgatcaggtgattttattaccataaaaccaatatgagtttttagctccacaaaattgtttctacaatatacgggattaggtccttgtatctcctatacaaacagaagacttgattttttttttattgaacagagcttcatatcaggaattggtaattggattgcagatgaggtgctttaccaggtattaatacaaatattattagagcttgaatgaaatgcataaattttaattatgaattcatgttgttttttcagtcgagaacccatccattacagattgcttcaagtctatccagggagagttgtgaagcactacaccaaagcatccaagaggttgtgtaatttgacattattttaaataattttagtgtattctactgatgtacaatcacggagaacttatgcctgaaataaagcatatttcaggttgtgaaatatgctgttgaagttgatgctgattgtgactgctttcctgtggaatggttattccatcaccgatggggcaagaagcctggtaaagtcaatggtgagattgtcctcaagttttatcatgaactcgttattgtcttgaataaaattgagcaaagcgttcgcttgtagttttgctgatatatgatggtgtataatcgaacatgttaattattacccactactttaaatgtcttgcaggacagaaaattgagttcataacagctggtggcagggtaagctcttatctgcttcagtactactacactttctagtgctacgaacattcatgcatctaccctctgatttgtactctcactatttagactacagcatacgtgccacaactgcagaagctgactggaatgcaatctagcaaagtagtcattgctaacccagaacaagtggcagagaacgatgatgcgaaggaaatagacacagatccagaagatgctgataatttgaatacaaagaagcgaggagcaacttctagggttgccaggggaaagcaaaagagagatgccataggtgccctttccagaaagacaaggaaaaatggtggtggcaaggagaaaccaggtagtgactatagtgaagatgatggtgagactgctgaaccaaacaaagttagcaccagtagcaagggcgagaaggcagatccggtgagaagatcatcaaggaccgcatcgaaaccccgccaggtaaataaattaaaagaaagatagcaagagatgaagagactcgctgatgttcgcaaagatcattttggtgtgtgtatagctttagctttagatgctctccgatggccatattggtgaaatccttgtagccttgattagtgagttcttttctctgtgtcttgtgcgctactgtaccagattattcaaagatgccctcttggaaattggaaggtgtaatcgttccatactgggcaaaacatatgcttctcctgtgcaacatgaacaatgacatatctaggctatgttgctcgtgtcaaaccaccacctaggttatctttttttatttttttttaagacggaagaagtaaggatgaatgtatacacacatgcttgtctatcattcttaagatttgagtctcttggggacagagagtaatccatagatttaactcaattagtcacttgtgtcatgtctgcactcataactgtgcagttccatccttgcctttctgcaagcagcacactagtgagtactagtgatcatgtgagaagaaccaagtaccattttatatggaaatttagttgcaaaatatttcaagccacttgtatttacacagttggctatctttatatattggccagtacactcacgagcagccttttcaaagtctgttcagtataaaatccaaggtaagatcacatatggccattgcccatttgccgtgtttcatgcacagcccagagctactacaaacagaagacaacaaatgacacggggttacatgtccatcacatcaactcagttactgctcagtattcgctcacgggcggcatactgccaacggagtctgcacatgctttgccctcacttttgcaccaatcatgcctctcggttaccctccagagaatgcagaatatcgatcgagcattccggctcctatgcagtcgtcaaagtattctctacagtatagttttctctcgctatccgaccgtacttgactatactagatctccttgctagtaatatgtcacagctcacaatgtcatgcatgtgagattttttcgatccaagggctagctagctctcctagctactccttccgttccaaagaaaaaaaaaaccccaattttaaatttaaaactggacacaacctaatcttgagtttaaacctgaacccaactcattgtgttcaggtttaaactcatgattgttttttttacggagggagtagctccgacaactattctatgagtgatactcgtccgtttcattttaaacacaaccgtaagttttcgagttcaattttgatcgtccatcttatttaaaattttttttataattagtattttttgttgttattagatgataaaacatgaatagtactctataagtgacttatgttttttttaatttttttaaagattttagattttctcaaataagaccgacgattaaagttagatacggaaatctatagttacgtttaaaatgggacggagggagtacgtgtgttctctcccaatatcagtgccaaaatcaaccacaaataaatctgtctgaagaaaacaggttaattaaattaatctcagacatattatgcttagatccgacacattattacatcagattgcatgcactgtccgcacatggaagtatgtaggattacacgcttaagtcaggctgcaggcattattaattaatttcttgataggatacgatcttgacggaaacaatttctgaacagttgctgtcttattgatcacaccacacaatcaagaagaggaagcatgcaattaagctgaaacattgaaacaaattaaaaaaaaaacacagcaatacgaacatcaatctatcgttagcagattgatccgttcctctagctagctagcagacgacatcctctcatgtttccacacactaacaaattaaaaccaacaataaattaatacacctcgtactcatcattaacacatcaataagccgagatcgagtagccaacctgcatattccatcaaaaaaacacactatatcagtatcaaatcaaagacaacatatatacctcctctctcaaaaaaaaaaacttttacacacgaatctagacataccctttgccatttcaagattcacgtataaaagttatctgttttttttcgagagagagtaattatttctgacgttttttattaaataatggatagaaatcctgcctctaaatccacaagtagatacacatagcaaaattatttctgacgcttatttgcgatgggagaagagagtaacacacttacaaacaagagcttgagcttgggcgccatccatggcgaggcaggggaatggcggctgaactagatggagcaggtgtagccggggggagggttcttgccgcaggtgaggaggagctggagcgcgaggggcaggtagatgttgatgttgaggagcttgagcctgatggtggtgcagaggcacacggcggcctccagctccacgagcccctccagcagcgggcagcacttgttcaccaccgggtcgccgatccccacgtgcaccagcccccccagcaggtccacgcacgccccgatcttcagcgagtccaccgggcacctctgcgtcgccggcggcggcggcgggcacggcgtcgtcgtcggcggcgtcgggtacgtcaccggcggcgtcgggtatgtcaccggcggcgtcgggtaggtgaccggagggccgacgacgaccggaggggtggtgaccggaggtgtggggtaggtgaccggcgggccgacgacgaccgggggggtggtgaccggaggtgtggggtaggtgaccggcggcggacgggtgacggggcccttcggcgggtgggtgacggggaccttgggaggggcgacgagcggcggcgggcgggtgaccggagacgggtaggtggggcccttgggggggcgaggggtagggttcttggggcccttggggtggccgggagagggagaagggtgcgagggcttggggtgcttgggcttgtcgcagtcgcattccgggtcgtactccgcgaggatggaagccacggtggtggagaggaggaggagcagcgtcaggaggaatggccgcagcttggtgctgcccgccatggctgctgctagctctgagcttgctagcaggttgtggtgagaagggggggggggggggggggagaagaagaggagctagaagtgtttgtgcgatcgatctagggtttatggcggtgtggttatatagagtggcgagctcgccgttgtggcccgtgaactctagggtttgcagctgctagagtgctagtagctcggaaattatgcatgtgtgtgtggcaacgtgagtgaccgtcactcacagtgcaggatcttcatttgagccttggagtactgtacgtctgtaccacgaagtctagctagggtcataagtctaaaattattctttttataatgtaagtggctctaggaatggcattgttttttttatttcagaccttgctactatctattctagctctcatatttatttcaatttgtgtggaagtacacaatttaacaatgaataccagaatctagaaaaaaaataaaatcccctctttcccctcttccgtcactctctcgattctctcctcgactcctcccacggcagtgaccgcatctcagctcttatctcgtcctcccatggcccacgactgttcggtggctctcctactctaatcggcgcgtcgacgagctcggtgatgtgggaagggtggactactatgagctcagcggcagagagtgggaggtatagtcgctttttcctttcctaaaattgctgttgatgtccctcccccatctccaacaacgagctccctagtgccatcgccttgaaccgggtgaacatcgaggagattgacacgacgacgaaaagaagcgacgaggaggtcaaggcagctccgacggagcggctacggacaggtcgaggcggtcgtcgtcgagctgcttcttcataggtcgatcacgacgataacatcggttggttcgaggggcaacaacgagcttgacagtacggaatggggacaacaatgaggtcctaaacgctagatccgccgcctcctcttcgtccaccatttccatcttcccttctcctcacccgcgcacgtctctcactaggctatcgtcgctgcctcgtcgagctcgctagatcaggcattgggcttgcctcgatcagtgacaaccacgagtggagcaactcgggacgaccgccaccacctcgaatcagctcatcgtcgctggctccaacgggttatgagggcatcgcatggggcaacacttctcccaacgtacaacgctcgctgttcctctccccctccctgaaaaatccctcatgaatattaataaggaactcgtgtctcatttgggatttccattcttcacttggtaatgggagaagcagatgtgatgtgaaatcttttatgtggcaagttgatgttgaatgacgtgaaatcttttatgtggcaagttgatgttgaatgacatctatatgcattgtaaaagcccttactaccattccttttgttccaaagtaaatgaattttaatttagaatttaaaatttatacaaatattgattttaatgcacgaaaatctatatatttttcagttgtttacggattgatatctaataatcaaaatttcaccattgagacaacgggaaaggaatctctctcttaatcttaatgtttttagtaaacaacctaaaaatgattgtattgtaaaaacagattgagtacgtagttactggttttgtatgatttgcctaaagaacatcatgatcacactcaattgggacgtagcaactcgatcaacatgctaattgggtttttgggtggaatcctatatacttatatagttatccccactaagtatagttaatgctatttctctcttctcttattaagccatatcacctcaattatttctagcctttggatgatagatctatggtccaaattgtctcttttttcttctctcttacaaacatgcaatctcaattatttttaggctcaaaattatataaaattgtttagttttgataatcaaattacatcttatttgtacatattatgcaacctaattttccgcagcaacgcgacgggttatttatctagtaaaaaactatttttctgtacaaggacctctttagattgcagacgaaccgtaactggtcgtgtttataaaaattatcctcctattttcgcgtgcagacccttaaaaggaccacacacaaaaatcgattttcgcatgcggacctcttaatggtccgcactaaaaaaataagtctatttttgtaggcggacctcttaaggggccgtgattttcgcatacgggtctcttaaggatccgcataaagcctaggttcccttatctttccttctcaacacttcaaatattttcatccatatcctctcatctcctctctgtcactttctcacctcttcttcgcacaatctcactatgcgttgctctcctctctcactctcctctcgcggtaggcagtgggcccggacgacggcaggcggagggctcggccggcggcggagggctcggtggcggtcagatccgcctttggcggccatgcgacgggcggcaggtggcgcggtcaacggcgaaggcggcggctcccttggccctcccgcgcggatctggcggcgggcttgagtgggaggccagcggcggctctcccctgccatcccacgcgctcatctggtgacgggctcgagcggaaggccagcggcagctctcccccgcccgtatccggcggcaggcgcgggatccggcctccacatgcgcggatccgctggcagcgacgacgggaggtgcggatccaccggcgacgatggtggcagcgaccggctagggttagggttaggtttttgtgttttggaattttttttttcgattttccattttcgtgagaaaaacttaagcgcccgcactcgaaaattcgattttcgtgtgcggatgcacgtaaaattgcgattttcgtagaccctttagtatgtgcagcagtgcgggtagccagccatgtcgcacgcgaaaaccccttatgggtcatctgaaaaaaaatcatttcttactagtggaagccagaagacaaatacgtatataggacgatactattactagtacgtctaggtgatctgcatgtatcgcgtgatgaactgacgatggtgatggtgatgcatgcaccatcgatcgtcggtgttgtttcttcggccgttcttgtgcgcatgcttcactgcatccggcgcacgacgatgcagggcgaaagtacagtacgtgtactatcatggagtactatacctcgcaagaaccgatcgacaatgggtcgcccgctgcgtcagtcggcgtgcgccgcagcgcccacagactagctagcagtcacgagccggcgatcgatcgatcgagcatcgcaacggagtgcaatgcattatgcatgcatgtggcagatgtactgttcgaccataccgacaggtctctgtactcaacagccagcaagtctgccaagtcccaacgtactatacgtactgttcgaccaccaaaaatggttgtaattttctttaaaaaaatgtcattgtagagtataatggcatcgtctatcactccaccaaaaaagaacatccttcgcctctagctcgcctacctccgccataaaccttcgcctcatatatgaatgtcgtcatattttaagaatttttcataaccatttaacggacgaggagacatagggcttgttcatattgatgtcattttcaaccataccattttttttataaagttgccaaaataatatacgtttagtttgttgccaaaaatttggtaaatatggaagaaatcctagcaaaattttggtattggctacaatctgaacatgcccatattcttaagaaatcaaaacatttcttttcctatatggatgtaacaccatacactatcactcaactcaatatattctttttcaataatcaactttcagtcctcaaagaaataccaatcaaaattctcaacgtgagatgcgtgtggagagatctgtccaagtctaccatccagtctctcgcccgccaccgcgcgacaccatcttaccatcatatccaaacaacgtgctacccttgtcgatcgatcagtgatcgatgttgagacccgacagatat

SEQ ID NO: 81747 - DNA, 42755 bp, Oryza sativa
agggtcatgaagtgaacttattccccttgataagggccacacgctgctcacagtcctgttccggcccataaaatgtgggcccagcgcgtctgtcgcattgacgttccggcccagttcgcttgccacataaaatctttcgagtgagatatagcaaaatcgcacgcgaaaaggtgaaaacgtgagagccatgacgtcagcggcagcatggtacgcacatgcagtcagatcaccgatcacgcctgagctgagcagatcatgcctaatcgatcgatctgtccacacgtttccgccctaagattcgtgcttaattaattaattgattgcgtgtgtgtgaccctaatctaactacgcaaaaatcaaacaaatcttatcgtgcacgctgttttttgtattaattaaaaaagaaagtagacgacattcatgaatcctgacaaatctagctataaagcccctaaatctctcttttgtactgttgtatcattgtacctgtggatcaagagcgaacacgtaattacgatacatggattcgtatgtatatatttcggcgcacgttttgatttgaaattcgaaggaaatacatatatttatgcatccggggggcgtttacttgagttgcttgtttggcgatcacaaagttaatgatttcgtccgttcgcaacaaaaactaatgattgctacgtggaatttctcgtgtgtgattaattgctagttaggcgaaacatatacatatataatcaattcagtggttgcagtaactaattaattaattaaagtcctttatgaaatatatttctcgtcaaattccctgtgacaaatttacaaacccaaaacgatcgagacgtacgtacgtatagtactcgagataacccaaagaagtcgtccacgaattaattaatttaactaactaaccaactaaattataatcaccaatcattaacagtgcattgcgtcaattgacagttgacgtgtgccacgtgtctcgatcagtttgatggtttcgttttgacatcgcgatctatgattagttgagggacaaagtgaccaatctatgatgtttttgcttcgaaccaaagcagggaatgtccccttttgtccttaaaaaagggattccgggcccacatgtcagcctctctcggtcctctctatctcaggtcatcaccattcaccagccagccgctagctaggtcatatcgatcgatcgatcaatcatcttccgactactaattaatttcactttttccgtgtgttggaaaaagcgagtgattaatcgacgcaagcagcaggaagagattagctagatcattaattattagattagcttaattaggtcggtgttaaccacgtggtttgtgtacgcttagctagcttgagccgccatccatggatggaacgcacatgcatgatacgtacgtaggcacgcatgaacgtacgtcgacgttaattaattttctcttccgagaaagtaatacacacgcatgaaatgctttcttgtttcttgtttctttttattttcgcggtcaggaagagagatggatcgagtagttgacctgatcagtgatcacatgcaggtaagtgcgtactacactgcatgcatacaaccaagacgtacgacaccggccgctaatgtggattataatttcaggcacattttttgtttgtaggatagagtacagattaatacactcatagtattatatatatatatatatatatatatatcttgtgattggtgaaatcaccacaacagatcttactgtcattcggtatttttcgatggcggagttagaaaaatattaagcccgggtaaacttcattataagtttataaccattatttaatatagaaatttcattatcaattcaattaaaaatattaaaattaaatggagtttctgctagttaacccggacggcggaggctcccccttcagggatgaatccagaacaatatttaaggtgggactcatctccttctttcttcttcagtctccctactctttattttctctatattgttctcctttcatctccctttctatcattagtgatccagcggggtagggggactcgagtccccccagcacccacgctggatccacctctgctccccttgtaccattgtatgaataaaaatagctatagatacacaaaccggatagacaggtttcaccacggaaaattaaacctagctatacgatcacttcataattgcaggcaaaatttgtgacatgtgcacgaagaatctttgtgttctaccaggggtcctgtgtgtgcgtgcatgcatggcgaccgatgatacgtacctacgatgcgtgtgcagccacacacgcttgaaggcatatctagctacgtaccaaacttaattagggctcgagctaattaactaactcagccatgcatctccctcttaattagctgctgcttctttcttcttccggggaagcaaacgcaacatgcacgtactacgtgtgcttgcattgcatgcatgctaactcgatccttcccgcccaatcgcccatgcaaaccccgaatctataaatacctcgccatggctgcaccttcgtctccatcgatcgatcgatccaccataatccaatagcttaattcaaagcctgaaaaccatacagctcgatctgtagtgatcaagttctggctaattaactagctagctcgtgatcgataatatacagtagcagagcgtaagtgatcgagagcgattaattcgagcttttgcgtggaattaattcatggcgtccggtgcgagaaagctcgtgaggtcgtcgttcatggcgtccgtacgcgccctgctcgcgctgacctttctcctgtccggcggcgcagccacggcggcggccgccatggtcagaaatggcggctcgccgagcatctatggcggtggtggtggagagggagctgcagtgatcggtagaggcggcaggtcgctgctgcaggcggcggcggcggcggcggcgacgacgcagagcgcggttttcagcctcgacagctacggcgcgcacggcgacggcgagcgcgacgacacggcggcgctggcgagggcgtggagcgccgcctgcgcctcggcggcgccggccgtcgtgctcgtcccggagagcaggagctacctgctccggcaagtcaccctctccggcccctgcgaatccaccatcaagctcatggtaaaaaaaattcaaacagaatattagttgattaatcttccatatccagctgcaattcagcttggaactgaagctgattaagtgattaacacggccattaatattaatctttctgaaattagtgtaattctgacgtgatttttggataatatgcaggtgaaggggacgctggtggcgtcgccggacatgtcgaactggaacgagagcaacaggaggtactggatcgtcgtccgcggcgtcgacgggctcgccgtcggcggcggcggcaccatcgacggcaacggcgaggggtggtgggagaactcctgcaagatcaacagggcactcgtaagtgtacttacagtactgatcaagaaattaaattcaagttcaaatcgctatgaattggcttttctagcacgtagataggtggttaattaataaattataactagttctagtaggcgccgtttttcttgatgtgatggtttacttatgcatggcggctgcttcaaattttcgtttgcacgtcgcatggtccttgactttctactcgtgcatttcgtattcaaatatatattcaattcaatttataatttagtcaattgtgatggccacggatctctctaacctagttcatttttcctctgtacttttcagccatgcaagggagctccaacggtacgtgcatgcatgcgaaatgcaatattttttttctcttctttttccaaatttcatttactcaatttttgtagtaccttttaatttgattcattttgtttgtaattaatacaggcgctgagtttccacacgtgcgacaacctgagcgtgaatggtctgaagatggtgaacagccagcagatccacatgtcagtggaggattgcaccggggtggagctggcccacctgtcaatctctgcgcccggcacgagccccaacacagatggcatccacatcacccacagcaagaacgtccaagtcagcgactgcaccattaagacaggtaatgcaactactccctctattttatattataaatcgttttatttttttagtcaaactagtttataaaaaaattagtactcaattgccaaatatagcatctaaaccatcaaaattagtttcattaaatatagcatttaacataattttgtaatatactccctccatccacaaaagttatacctattatttttatcactaagactaataagaaattaatttgtcttggatgttacaaaatcaagaagtaatgcaagcatgcaaccaatgagtatttagaagtctccttggattctaatcaaacattttatttatttatttatttaagtcttgaatgcataaagattacaaataggtgcaacttatttggaaaagctcaaatgtggaatatgtgtaacttttatggagggagggagtatttattttatgttgaaaatattactattttttaaaataaatttgattaaatttaaaaaaaattaactagaaaaaataagtaaaaactatttataatattaaactgagcgagtaatcaattgccaaattaagcacagaaacatgatcaggccttgtttggaaggcccaataattccctgcccataagcttgaataagcccaaaagggtatgtttttttttaatcttcaaaaggatatgactctgattaggtttttgttgttgatctctgcaggggatgactgtgtgtcgatcgaggatgggacccacggtttacacgtcacgagactggtgtgtgggcccgggcatgggattagcattgggagcttaggagatgacaactccagagctgaggtgtctgacatcttcatcgacaccgtgcacctctatggcaccaccaatggagctcggatcaagacatggcaggtaaatatcctcctctcatcctgcagagatttgtgtgaacttactacgaaattttcatcaaaccttttgtatttcaagtgaatctgagagagatagatgtggattttgtcaaatgcagggagggagtggatacgccaaggatatcgtattccagaacatggtcatgaacagtgtcaagaacccaataatcattgaccaaaactactgcgactcagctaagaaatgcgagacacaggaggtaacaaaaacatcaactctcaaaaaccaatcctttatttaacaccagtgagtaatgctcaacaaaaatcatccaaatcacacaattattgcaaatttgccatgaacatggatctcagggatcagcagtggagattagcaatgtggtcttcaagaacatcgcagggacaacaatttccaagagtgccatcactctgaactgcagcaagaactacccatgctatgacatttccttacaggacatcaacctggaaatggtggatgacaatggtgccacaggaagtacttgccagaatgcaaaatggaggaaatctggaacagttgttccacaaccatgcaccagcacaaattaggaggaactgggcctgataaagttcattactgtataaagtgtgtataaaaaaattcagaaggaatcagtcatatttatgcatacattgtgcatacactcattggggtttctaccaggaacctgcaatgcagtgtgcctacaaggctacagagtgtatttgttaaattgattcaagttatatacatgtaaattctttcatacagagcaacattgatttcatattcccattaagtgcagcagaatgccgtcaggcatttttcagcaaagtagttctactaacttaattatcaacagatgaacagcaaggtaccacttactactccttaatacataacaagcattccggcagctaagatcttacagtagactatatagagtcatccactaataacttacacaacagaatggatagcaaactggcgattctttgcctactatcttgctcactcctagcagttgataccacatttttgggtatcagggcctgtgacacgggtggtgaatggatcgatacgaacccacagcaaggagaagatcgatgcaaggaggatggcccaaacaacaacaatggtcggtgtacggttctgccgacccatgagacccttaaggaaggggtacaggtggacaatcacccagaaggcaaagaagagcttcccaaagagcggaccccatgactggtagccactgttgatagcgtaggagataccagcaacaacaccgaccaggttgatgatcaaaatagtggtcggtgggatcagaagggttgtccacttgaacatgtagagctcagcgaaatcgccttcttcatcagaggcctttgaggtgacagtgaagctggtatcaattccagcaagcaccttcagcagaccctggaagaccgcaaatagatgagcggaaatacctccaataacccaaaactgctcattcctccaccattcatcgatgccaacaccactccacctcatctcaaggataccagtagcaaagattgacagaaagagagagataaaccaaatactcgcaaagttgctaatctgcagtccaaaataagtcagtcagcgcatgctgttctgcgatttcgtctgcagaagaggaaaaacaattctacatatttacctctggtatgatgaacttcccagtgagaagacagatagctggcaatatgcagtacaagaggagtggaatcgatgtgagtggataaatagtggtgttgatgtaagcaaatctctccaggaacttaagccgtcctccgtacccataccatatgggacaatgcctgctaaaaagaatttccacagaaccaagagcccaccgaagcacctggttcagacgatccgaaagattaattggggcagaccccttgaatgctggtcgcttaggcatgcagtagattgaccgccagccacgtgcatgcatcttgaatccagtgagaatatcttctgtaacagaaccatagatccatccaatctgcaagtcacatagcatcataaacaaagttataatggcaactgagaggagatgccaatttagtcaagtttcttcgcatgaactcagaagtacttgtgcgaatcagaacagaaatcaaattgcgtccttaattttgtacaagaaagaccacttgatatctcgacattttctgttacattgtataatttgtactggtaggctagtagcatgtaatgcagagcatgaatgccatagctttattacctcagttccccagtcacttttgtcttcatagccacagctgataacatgtatggcctctttcagaagagattctggagttgcggattgaggaacaccaccatattccatcagagtggaggctacaaaaacactagattgaccaaatcttttctctaagctcatttgagacatcagtagtgatttctcatcatcaaatccagaacctgccacaaaaatgatgtgccaggtcaaatatatagtgtaagagaaaagttaagcctagtgtccctcccttcctaagcatatacagaaatactgcgaaaaaagttgtggggtgcaatgcaatggtggtggccaaatatcactaaaaatctaagagcaaaaacatgtaattgaacaaaaaccagactcgatggtaccttcaatcccttcctctatatcttcaagattaaaaactggcacagaactgtccacatgtttgtgtgactttttcttttccgtgctcttctccttcgacttttttgtcttctttcgtcccccacaaagcgaagagaagtaacctggcctcttctgcttaatggggggttcataaccataaagagctgttctgttgaacacacaaccggttcccacataaactggtccttggagaccatcgagacctctcaaattaatctgcagcaagcagaaatgcagataagttacttgacaaactccagaaatgttcaaatccatcacatagaaacataaatattgctgatccatcaacagttattgatgtttgctaaagcgtgaagtgaagcatccaagaatcttaaagggaaccaagcttacatcgaaaaacacggtgttcctgtttgcatatcgatcatttctatcgataccgtcaaacctctgagggaattggacataacagacacgccttcctaggtttggatccataaggaagcacatagcctctcggagagctttgctattgttgatgtagtgatcacagtcaagattcaacaagtattgtccattagtaaggacagctgatacacgaacctgcagtttcaaattccacatatcaagtaaatgaattaaacaagatacttctcacttaagcaacaccactctagctgctactcacaagtgcattcatagcaccagcctttttatggtgttggaatccaggacgtttctcacgagacacatagactaaacgaggaagctcattgccttcggtatcaaggcctccactatgaccaaggaaaacctgagcatgaccagacgtcaagagtaagaaaattgctggatcaataaccacaccacaatggcaatatctaagtgatatttacctgaatcattccaggatggtctctggtattgttaccaggccaaggtgtgccatcttgcataatccatccttcctcaggaactttctgtgccttggcgacgagagcattaacacgaactttaaattcttcatattccctctggattttggttttgcaacagacattaatgcgagattacaccaaaaaaaaaacaacaaaaaagtacacacatataaaccaaatttaccttcatggcacgacgatctttaacaaaagaagcctgaactttgtctttcaagtaatcaattttctgtgcaaagtaccactctggagctctgggttctatgctgtactttttacagaacggtacccattttctagcaaattctgaagtctcagcaagcgcatcaaatgttaacattgcagctccatcatcagacacatagcaagataccttatcaacagggtaatccacagcaaggatggagagcacagtattggcagtgacaagaggaggttctttcataggatccacagtactgacaaaaatgtcaacaggagccaattgagatggttcaccttcccggtcatacctgagagtgcaagtgatattttgttattgtcagtaatcagtactacagtgctaacgcaggaatggtgtatcagaggtaaatattgtacatcaccttaaagccagcctatccaggtaagtttcacggttgattggggaccacttggggaactgatccagaatccaggatagagcaaaccaaatctcacatatgacagagagcaaccatagcgggtatgcattacgcacaggatttgtgatacggtagtgcaagaatatacataggacaatcaatcggagcacaataaccatcctgtacggatttattctggatgacgaaattggcacttttctcgatagaggttggcgtgtttcatcattcctgtaatacagatagcacaacatttatagtggcaagctatatgataagtccgcattataaggttcagagatgtacaaccatttagaatctgatccattaaatgtgcatattgccttgcttaatagcaaggtatacttgtaaacacaaaataattatatttcgaattatgcaagaatttttcctatgttcttccaagtacaaactagtgcaagttagtacaccagatacaaggaatattaattactggtagaattcatagatgactaacggtggacaaaagcatatcagaactcacagtaaggcgtcctccatgttatagtcagtagatgcatcaatgtcaccaaccccacgaccttctgaaggagcaatgctagtaccattagccatgggaattgcacctttatccttcattttccagccatctactctctctttccatgcaacattgccaaggctaccagaaaactcccttgatgggtttgctgttgagcaacaaagaataattaaattttcccagtcgatgcaacgaaacatgagatcttgatgatagataaacttacgtgaatggttcacatagggaaatggatgcccacgtctgccaatgttcccaacgggagacatcatatgatcaggggacgctccaggaatttcacctgagatctatagaattaatcgagaggaagaaactaaatattagttcaatctttgcacataccctgaagggttaacgacttcacgctatcaacaaaaattctaacaaacctggctgtgagtgagcgatgggatatatatgcgagggatttcaccactgtcatacttgggatgaccaatctcaccactatcatacttagaatggacaatatcatcattcctcccagagttcatgcgccaggtgagcatcctctcggcaatcttgtgcttatggtcctggttgccggatgttggatagttcacatcactagcatcatccgcatcaacatcatcgctttcatccccaagtatcggcgggctccctgaagcaaagattaaatatcttgttaagctcaacaaattcactcacatttgcttctctcaatggaaataacccatacaggaaagaaattatgttgtcactggtcactaccaacttcgaatacagctcactaaagaacaggactctgtgctattaactcagcatattcactaagcatatatatatcttctctactattattgtctaaatgcaatatgcaacaacctgattgggttcacgagatgttcagtccaatgtagctgttcttaaccaaagatgaagtatttaggtgaaatccaagagaaggatgaatggataatgtgcaacttatacccttgtggcgcttgtacttggtcttgcactgcgggcacgcctggctgccgtccttgcgctcgtactcgtagcatggccggcacaccgggaacccgcagacgtcgcaggcggtgaagagctcgccgtccgccgccgtgcccacgccgtcgccgcagatctggcagacatggcattgcttccccgatttcttcgccgcgcatacaacaacaccaaacgaaacaaacaaacaaaggcaaaagcttcagagctcagaccaacccaaacatccacgcaacaaattaaccaatctttgaatctttccccccgaaaatgcgactcaccgcaccgtccatggcgcacgaaccaagaactcacggccaagaaagtgtctccacgaacggactcccgccaattcaccgcattccgcggccgccccgatgaaaccaagaaaccccaactcccccccaccccaagtgaggcaaatcaatcagtcagacaccaaatcgcctcggattcaaggcgccccccgccaccgccaaagccgacctcgtagctagcagcacaagctggatgaggaggcttgcaagaatcaaacgggacaagaaaaggacgtggcaccagcgaggatgaggaaaccgcaagcgtgagcgtgaagtgaatcgaatccgctcgcgtatcactctactctactccggggtttagcggttgattggtaattaaaacccccgtaaaatttcgagatttttggcgtgcatttgagatgagatggttgggttgttgctggggttttgattactccacggggttcggggagaggagtgaagtgaagtgacggatgaggtgagctgggggtggggcccacctggcagtgacgggcggagtgcgcgtcggctggaccgtggtcgcatgcagacagaaagtgtgaccgggatgggcgtgtggggaccgtggggcctactgtcagtgagaaagggtggacagcttgtgaggttgtgatagacacaaatgccaactgcacgcagcctgtatcgcagtactctgttcttaaaaaggaaaaaacagagcactcctcgcgcatagtaatcccttctaaaaaaacgtttgaacctgaatacaatatagaattgggttttttgacgggtgaagtatatgtatttgtgttttaaaagcaaaattgtgttaaatgtttaaaactttgaccgttagttttgcattaaaacaaatggtttgtaaaatataaggagtttataatgctatgatcgtatttttgaaataaaatttacggcacaccatttttctttcctttaaactataagtattttatatgaaactactccctccgttttaggttataagatatttttgactttggtcaaagtcaaactgttttaagtttgactaagttcatgacaaatatagtaatatttataatactaaattagttctatcaaatcaataattgaatatattatcataataaatttgttttgggttgaaaatgttactatttttttctacaaacttggtcaaacttaaaacagtttgactttgatcaaagtcaaaacgtcttgtaacctgaaacggatggagtatttgtgatcaaaatatcaaaagcttgactaattttatccaaaacataagatatttatgatggaaggaaaaaaatactgtggcaatctgagaagcctaggtgcgagcaatcgttacgctagtgatatgaactcaaccaagaaagtatctcgtaatcacatccatatgaacacatataaacactcgtacttataaacggatccgcgcacaccctatccatatgaacacatttaaaagatggggccccgcatattttaaaatcgataaatatattatctacctcttaaagaataattagccataaatgtaaatgcatgtgtcaaatctataagtttaaatcagataaactgattccaccacggtaatcctaatcagtttacactcagcgatagactgcaaatctgtaacaggagcatcaacaaagtagtgctgaaatgacaatctcatgatcatacaccacatacatatggtacgcaaacaacgatagttgtctcctcgacagtttaggatagtgtcccacgcatgcgtccacgagtcctcgacgcaacgttcccgccatccacgcgaccacgcatgcacggggggcgcgcgcggttgatgcactggacgtcgagcggaaaaacgccctgatcgatctggtgtcctgagcccccgaggattcactagctcttgccaattgtatccatggccgccgccacggcggacggacatggcgggaggcggcggctgagggtgttcttcctcccattcttcgcgcgtggccacctcatccccatgaccgacctcgcgtgcctcatggcggcggcgagcactgatgccgtggaggtggaggcgacgatggcggtgacgccggccaacgccgccggcatcgccgccacggtcgccgggaacgccgccgtgcgcgtcgtctgctacccgttccccgacgtcggcctggcccgcggggtcgagtgcctcggcgccgccgccgcgcacgacacctggagggtgtaccgcgccgtcgacctgtcgcggcccgcccatgagtcgctgctccggcaccaccgccccgacgccatcgtcgccgacgtgccgttctggtgggccaccggcgtcgccgccgagctcggcgtcccgcgcctcacgttcaaccccgtcggcgtgttcccgcagctcgccatgaacaacctcgtcgccgtccgccccgacatcgtccggggaggcgccgacggcccgccggtgaccgtgccggggatgcccggtggcagggagatcaccatcccggtgtccgagctcccggacttcctggtccaggacgaccacctctccatgtcgtgggaccgcatcaaggcgtcccagctcgccggcttcggcgtcgtggtcaacaccttcgccgcgctcgaggcgccctactgcgacgagttcagccgcgtcgacgcgcgccgcgcctacttcgtcggccccgtcagccagccatcgcgcgccgccgccgccgccgtgcgccgcggcggcgacggcgacgtggactgccttaggtggctgtccaccaagccgagccagtccgtggtgtacgtctgcttcgggagctgggcccatttctcagtgacacaaactcgcgaactcgcgctggggctcgaggcctcgaaccagccattcctgtgggtgatccgctccgactccggcgacggcggcggcgagcggtgggagccggagggatgggagcggcgcatggaggggcgcggcatggtggtccgcgggtgggccccgcagctggcggtgctggcccacccgtcggtgggcgcgttcgtgacccactgcgggtggaactcggtgctggaggcggcggcggccggcgtgccggcgctaacatggccgctggtgttcgagcaattcatcaacgagcggctggtcaccgaggtgaccgcgttcggcgcgcgcgtctgggagaacggcggcggaaagcgcggcgtgagggcgcgcgaggcggagaccgtgcccgccggcgtgatcgcgcgggcggtggccggattcatggcgggcggcggcgggcggagggagagggcggcggccatggcgacggcgctgccggagagcgcgcgcgtggcggtcggcgagaacgggtcgtcgtggagagatatccgccgcctgatccaggatctgacggacgcgactgcatctcagccttgaccatgacttccattccggctcatttcattatcgtcgcaatcactttttgaaaaattttgtagaaaaaaatcgagtgaaaagctatgatgacctttgtatgcttcttccgttctgtatcatcaacatttgtttgtcccatcactcaactatcttaaacttatcgttacatcaaaatattttctcatttagttctaatatatgctaaattacctagaaaatttctattttagaacaaaggattagtgtgtgtatatataagaaactcttttaattcctcaaaagatattcccttatttcttacacgtcatgattattaaaaaataacacgataaaatgaatgtgaagaaatgtgaacaagtgtggtcatctaaatgcgagattagaaatacatatcggggacattcgagattagacatttcaaaccaagtaacacaagtgtgacaacttttgccgggtccggttggctaatctattttgggccacctcaccggcccatgaaaatattctcatttttatcgggccaagaaattctctgtcggacaacgaggcctagcccacggcccgttcctcaagaatctggataaggacatcaagaaatggcccgtttggtaaaatttcaacttcgaatggtcagtttagattggtgtcattttaaactatacaattgcttgttaaaattgataaatttatcactgtatttagtttgttatcaaatattggtaatacatagaaaattttggcacaacatatttattccgttctaccaaaattttggcgatactgccaacttaccaaaaatttggcaatgccaaattttagaaaatctgattttggtagtaatataaacagaccctaaaaatctgattttggtagtaatataaacagaccctaaatttaactataggagttggatatgaagtaaattataaaacagtctaaactcaactcaacttctctatttaattttgtgagagcgcttcagccagtttccgttctattttaagtgaagctaaaactgtttgattagtagcttcagaaatcaaaataaatggagctaaagctgaagccgtgtcaaactagcccctaaaagtggccgtcgccatcaaatcggtctggactccggcggatatgccagcgagaccgaccccgccgcgtggcacccccgccattgttgatgctgacggccgcggctcgcgaggaagaagaagaagatgccatattccctcgtctactcttgccgacgctaatctcccccggttccgttaattatccccggtcaaatcccaccaatctctttcatgcctcctcctcattccctgtatcgaattcatctttaaaaaaaattcaatggcgttatcatgaggaaaagggcgaaacctactgacgtgtagctcagggcgagtgctccctttctccgtctctctctcgaggttgccgtccaacgtccatcagtcatcgtgatgattgagattgacatccaatgtccacacgtagtactcacagtaatcgaattgatttggtaccattgctttgagaaattgagctagattgatccatggagagctgaagaaaaatgaagtgctagtactagtgtcgaactgaatgtttgcaagatttgagcaaacaaaccatttatgccgtatggataatacaagccaggggaaaaacaagggccactctgtgatcacaagcagcagagggcaacagcagcaacagcaaatatacaacttgttttaaaatcttttttacaattaggttctcggatgcgcacagctaagcaaacatcacacgaagaacggcagctagattaatccagcacacaaaaggcactgaaagaaacagagcagcagcagatcgatcaagatcgaaggtttgcagaggctggctgcaggaagctagaagaaggatcgcttggtaggcaccctcccaacagccttcatgaagttggcgagctcgagcaccttggcgagcttgaggcctctcttcgcctccgccgacgccctcttctcctccgccttgcgccgcgccttcgcgatgtcgttctgcgtcctctccagcgccttggcgcgctgctcgtccagctttctctgcgttagttgttcagtcatcaagaacacctacgtgagtaacattttggagtacatagcagttgctgctaagcactattcagtaatcagatatgctttctaaaagataaaactgcactatgcaaaagcatgatttgcagagcatgtaatggagagagaaaaaaaggcttttaaaagctggattctgacaaagaccgctctcctaacgttgcatgattgagtagtggttaactcatctgatgtcgcatgcctacatccaaaaaggatagatagtactagtgctactctgaacattttcttgcaagaacagataccctgctactctgctttgagttaatcaccaagaacaaagttggattccctttgctcggaatcaaaatctatcagctataatttcagatttttgcaaagcctaaacggacaacaagaattagatgaaaaatctgcaaacttgagagtcataaataaattcataatcagttattgagttacctcgatcttcttgagccatgcggatgctttctcgacctgctcggtctcccacccgttgatgacaacctcctccctcttgaaccggttgttgatcttggccacctccgccgtctgccacgccgacaccttcgtctccacctcctccttcttcacctgcctcgcctccaccggcggcgccggcgatggccctgccgcggggacaaccttcagctgggacgccctgctcctggccggcgtggcgatcgggtggctgtccggcacaattgccagcgggttggtctcctccagctcgtcctcgccgatgctggtgagctggtcaccgtcgttgttgccgtcgttggggccagtctgcatggtcgtcccggcggcgaccatggccgtgaactcccggctcatcgtcatgaactgctcctcggacgacacggaccggtggctgctggccgtgtcccacgagtacgcggcggacccgagccgcgtgggtggcgtcgtcgtcgtcgtcggcgacggcggcgtcagagggtggatgtcgcggtacgtggtgacgacggtgacctcctcgtcgtcgcctgcagcgacatcgtcggcggcggtggcgggcgccgacagctgtagcgaaacctccggctccggctgcggcggcggcgcgtgctgctcatgcaacatgtgctacccgcgcggcggcgatggcggtggtcgtcgtggaggctccgccgccgtgcatccgaagcgccgccgtggttgctgctggcgagctgaggtggtgcgtcgtgtcatggagtatgtgcgcgcgtattatatggcgggagatgggcatggagggggggaagcgatggggccgggtgtggttttgtccattggcgccaagggggtgacacgtacttgtctcgcggtgcggtgcgttcgccattggcgccaggttaaagctggtgcatgcactgcgcctgcgcgatgtgggctttggtcaaggcgagagcgagtgttttggtgcacctggagatcggcgaatttgcaagttggggcgcttgtttaatccaacaggatgggttggggaatgtttcttttggttgattaattgattggcaaatggcacagcgtggcctcgtaaatggagtacgttgtattagtgttttattagtgtgtgtagtcttcagaaaaaaaagcagcagttagtaacttatgtagtactactcgtgtagctcagcaaaaagatggttttgatctgtgcttgatcagctcgagcctgaaggtctagttgttatcccttataaaaagttttttcgtagcatttcacatgcattacgccagtgcaaatcatcttatcacgttacgcggagagctagcaagctttgcaaaggcagtttagtacatgttcagatgagtgcttccatacgcaaaagatactactactactggacaacacaaaatcccagtatacgtccaatccgaagactccaaacacgtacgaaggcaagggtttgtgaaccaaactaccaatgaccacaggttgcgatcgattgcgccctcaataatctcaaatccaatatcctcacgtcttaacctctaccggtctctttacggtcgaacgggtcatccagtgcagtacaggacaattgccagaagtcgacacgacgaattactacctgtacagtagttcgtcatctgaactggcgatgttactattggctggtcatcggtttaattcgcgagcaagtatgctctgctcatcgtcgacgtgttcatcgtgcaggacgtggaagtcccgggttggggatggacagctaagagtgggtggtggtggcgacgcgtcgctttcacccggataagagcctgtccgcttcctccgcctcaagctgatcaagctagcacacatcagcaaaagaaaagaggagtacatgcaatccgcgcccaaacccaacccgcgccgcgcacctgtccccgcctgccgctttcgcccacgtcttctcttccccccctccatatttcatatcgtctcattcccctcgcgcgcgcggacgggcagcgcggcgcatacacagacacaatacagggcgcgaggccgagtcgcgcggcgacgtgacgtgcctttcgttgcgtggctttgcgcaccgttatctgcgcggcacgtgtgcgcggcgtcggattcacggcttctggagtacgatcttttttctttttcctacccgcaggcgcaggcggcgacgggggcgcagcggggcaaatttgcggcacgggtggatgactggatggtgaacaagaatactaaaaggcacgcgaggagatgggccgtggaatgcgttatgcgtagcgcgttgaggtgaagagtatcgccagcggaacgtgattcaatctatgttattacaatacaacttccaaatctagataagtcttacaatatgaaacagaagaattagctactttagaatgaaatagaagggttctatttacttaatttattatattttggatcgagtttaaattttatgtaagtgtttaaatttatacggagagatacacactaacacacgtagtgaaaataaaaggctatagctaaagttttatttttaccggttcctagacaccaccctcgtacgtatacgctctccgtccgtccgatgtgttgcgctccaagaaagtgacccctcctttcgccatcgatcgatcgatagaattgtttacgttaaaggttggtttcaaccagcctgttccaaagaaatttactactccttgtaacttggaagcaagagattatatagtagtatatcttttggtaggctttgtaatcacgcttgatgggtttgtcaaaatcaaactcaaatcctatttatgttgtgtggaggaaataaaatcttatcccttctcgtacatgcatgttagtaatatgtatgagtggctagtgcagaggatcagagtccacgttatataagtttatacctcacagtcagctaaccagcatgggtctgagaaaccgatgttacatacacagccaccttcattttcctctctagcaagtcataccagctcacttgtaggtcctaatcatgcacgtcgtcttggagctactgatgaggtagcatgtttacaactaacccgactcccaactattgtactactcaattagctaattaattcattctagaaacttggggtcattagtactagtacccatcaattaactttatcaatactcttttttttgtgtgtggtttgtgatctatatatatagtggctgactagggagcgccactaattaggagaaagaaaactaaattaaaaaataaacaagattgatggggatgaagatgcatggccattggaagtgcaaccatgcatggcaaatcagacagccggttagtgctaggcagctactatatcacttcactttgtagctttcccggattttagcaagataatcaactctggccacctactagaaaaataaagaaggttagttaagcactgtgtgtgtgcttgctcaactcaattaatcgctgggatggtatgagtggatttgcagaatcctcgctatcacgatgtgcttcgctttctcttttctttttttcttttcttctttgtcataatacactttctttagctttatgtctccatctctctggctggaccaagtattgttattttactcattttcgtccatgtcataccgaacttgacaaaattgttttgttaatttggtcctacagagacacgcgtgattggaacaactggagctaatataattaattaactagcaccagaactctcatgtgtacagtagtgttatcttttccatttctcccaagatgatatagtaccagttttaaccatatacatgaggtgtccgtgtcccctccgattgcggatcgctgcctccgtcggtcggacaaatcgccgtacgttgaagcaaacgagccaaccggtgagcccctttataggcaaaattcctctgttaattcctccgttctcaaataattcagtgtaggttatctgagatcggaggcagctcagcattaggcttattagtttgattgttttgcttcgatattcagggaaactattctaactttcatgaacattcactagttatttacatatcaactaaatgatttatactacctccttttttaatagataacgctattgactttttctcacatgtttgaccattcgtcttattcaaaaaatttacgtaattataatttattttgttatgagttgttttatcactcatattactttaagtgtgatttatatcttatacatttacataaaattttttaataagacgaatggtcaaacatgtgagaaaaaatcaacggcgtcatctattaaaaaacggaggtagtaattttttttaacaagatagattaatactcctatgtgataaattaaatcattccacaaacttgtaaagttttaacgaaaaaaaaaatcaaggattctgaaattttcagggctgcagagattcgtgtcaatagatcgatagagaggatttggaaatttttcaaggctgcagattttcgcatagccagaatgggcaaatgcaaagatggcccaggagaactagggctgatgccatatggatttggaatttattcgggccttcaatcacacacaagcttctactaatgtcagtccgattagtagcatttagccaattcaaaaacagcagagcaccctttacaagcgactgaagatgcgttgcttcagctcagagagtcgtgtctccaactactgtaagatctcaattgaatgctctaaaactaaccaacaatttcgtgcgcctcgatcaaattgagacaaatattgcagaaatttaaactatctacagcttgaatcgcagcctaaaattccgcagcagcttcctcaggcaactcctcgccttcgtctcgcggcacttggctcctcctccgccgccgccgccgccgtcgccggagaagattgctcggagccggcccagatgccgcgggctcctcccctcgtacgccgccgcctccggattctcctgaaaccgccaaaacaaacgatcgaggtaagaacagctcaccgagaagaagacattcgcgattcggaaggatgcagcaatggcggcgcaccagtatgtagttcttccagtcggcctgcttggcgacgaccacgcggcggcgagggtcgtagctgaaccgggggtggttcttgatccggctcgccgcctcgaactcccgccggaactcgcccagccgccgctggagctcctccacggggaagccggacccggtggcggcgttcagctcggcgcggatggatgaccagtcctcgccggtgagctcgcccacgttcctcgcgccgccgccgccgcccgtgtggcgcagcagcaggtcgaggaacttggcgtcgtgctggctcgtccacgcgtccacctgcagccgcgacaggatcttgcggagcgcgcgccgcgacaccggcttcctcttgatcgccttctcctcgtcgtcggcggcgacatggacatgcaactgctgctgctgctgctgatgcatttcttgcttcgccgtcgccgtctccggctgcatcaaccgcacattatgcatctccgtcctgccatagatcgatcgatcgatcggttcgtcaaaacaaaatcgtaagaatgctcgccgtcgtcgttgtgaaatttgcacgtactgataggcgtcggtggcgaggcggaggctgaggaagacgacggagtcgtgacgcacgccgtagtccgcgagcgtgcggtggtcgtcgtcgaggcaccggccggcgaagaacagccgctgcatggccaccgcgatgcgctcccgggccatgaccatgcccttgacctgcgccaccgtcgtcgtggcgccgtccacgtcgagcgccacccggtccccgcgcagcgtgcgcaccatgatcctcatcgtccccgacaacgtacacaccgagctcaccctcagctcaggcgacaggtctcatccggattcccgtgcgagaaaagatagcgaggaagaggaagaagttgttaggttgagatgagaaaaataatggagatctagcgcgaagaagaagggattggctggcatggcaatggcatgcatgcacgatggctacgagagggaataaagcggtttggatcgatgatgatgacgacctttgggcgccaacgtgaaggaaagtattttcttcttcggagcgctgacctgtgtacccaactgtccatgcagttcaggcgttggaagatctgggccgagacagctaatgggctgcttgtgggcaatgtcagaacctggcctggcccagggatggcctgtgcaacccaatggaaaagaacaaaagttttaatcagctttcaacaattcgtagggttaaaatgatctttttatagcactgaacggagtgctgttaatgaaaatctaatgacgatgatatttatggaacaaagacgattgtacaatgacatttttaggaatatatgttcatcgatggcatttcttgaatttggatgtttatcggtggtattttctggattttctcatatgataaagttgtgtttttgagcttttgactctcaaattattctctaggttgtacaactatagattcacaaactatgggcaggaatttataatgtttaaaatagttggagatcattcaaaaagggcatgcggactagtatagttgttggaaaaaaaatgcagatgacaaaaaattgtggcaaggggcattatggtttgatattcccttttggatatacggattgaatgcaacataaagatcaagtgaactgaatgcacaatcacatggacctcgcaggcgacgcatggcgtttagccgctcgccatccggtcgattcaatacgcgcctgcagagttgttcagcttgccggaaatggcgacgagcatggtaaagtcgcgggaaagcattcaggcgcatcaccaacctccttgacctcccccacctacaaaaatggccgccattgccaacctcgagctcagcactcacacacacactcacacgcaacgcgtttgttcaatcgatcggccgtcaccgcgagcgcacgatggcgagcgctcgtcgcagccgcggcgtggcggcggtggggatcgcggtgtttgtggctgtcgtggtggtggcggcgggcgccgggggcgcggcggcggtgtcgtgcggcgacgcggtgagcgcgctggcgccgtgcgggccgttcctgctgggcggcgcggcgcggccgggcgatcggtgctgcggcggcgcgagggcgctgcgcgggatggcgggcacggcggaggcgcggcgcgcgctgtgcaggtgcctggagcagtccgggccgtcgttcggcgtgctccccgaccgcgcgcggcgcctcccggcgctctgcaagctcggactcgccatccccgtcggcgccgccaccgactgcagcaagtaataattaaaaaaaagttgattagattggtctcatggcgcattagtttgcatttactgaattgtttgttcatctcggttcgatccattgcaggatatcctaagtggcagcggcggcgacgacgacgccgctacatggcgtgagttcgtcgcgatcggtgcatgatcgaacatgcatggtgttgacgcgggagaagagtgatttggcttttgcgcatggtgtaatctgatctgatctaatccgtgcatgaataagtactagacatgcttgtaataactcatgagctaaatatcactcagatgagatctcagatttgagattttcttagccactgtttaactgttacagagttactcctacatacataacatccactgagcagagctgatgcaagtttggatcgcaaacttgggccttcatgggccgctcgaacatttcacggttggatcatcaatgcgcggcccagatagcaatttatctgatcattttgcacatcttggagataaactggttcagatatttcatctagaacagcgaatgagaatcgatagcaaccaccatatatataggtcatcatcaggaattcaggacaagacaaagccaaagccaaggaggcgcatcagcagtggaaatttcttggtttgttctcttcagaggtcagagatctgacctcacctgagactcctgtggctctgagctagtatatcgtcttcttctagagtgaacagttcatgaaccaatggatgcatgcatgcatcagcatcttaatttgtatagtttcaccatcctgtggtctagaagattgaaaatgcagctaacatgtttgtattcctgcgcccttcaattttctcctgggagaagaatatgcaacctgcacgccggtttcagtttgccgtcagagaatataatggtgacaccgccaacaacaaaaaaaaagaaaagaaagaaaaactggtttcagtgctagtagagctggtacaatagcagactattagccaactataaatatattttaatgagataaaagatgagagagaagagcagcgggctgcaacacggactctaagacgcaatgtgtgtataacaggtgggaccatatattaatagtatagtaagcaactattgtatgaattggctattagatcggctatagatgaattggagctagtagtgggctgtactattaaacttgctcgtagtagaaaagagggaaaaaaagattcttatgaattttatgcgatgtgtcttatgatttatggtagaacccaattttttttaaaaaaaaataaaaggagggattaggagattaaaattccgacccccttcacctgtttttttccttcactacttcagtgcatgtttctctctcagccacatccacacatctctcttctcattctcatgcattcacaacgaacctaacatgggcacacatgctgaactaatcgattgattgttcagaacagtccttttcattttccatgttcattctctgaaatctcaacatgtttctgctaacgaagtgcaaacagtttatgagccatttggtacatgcagcaccaccatttttcggtttagaagattgaaatgcagcatgctggtatgccggtttcagttttgccgtcaaaagatagaacggtgacacctccaagaaaaatataaaatggaagttccagttttagctgctaggtacttctctttccgatcggcacctcttcttttggggggataatttgatcgataaccaccttagaaacaaaagttcagtcctttttccttgttcattctcggagatctcaacattttctttccaatcaagcataattaggattaccatgcatgcgtgcaaacattcatttctgaagccgaagccggagagcagagctctggtcatatccaaagggggtcggagttttgaactccgatccccttcgacctctttctttctcacgctcctgtgatctagaagcttaaaatgcagcatgttggtaatgcctgcgcctgtgctttactgcttttcttctgaaagaggaatatatgaatcagttttcagtttgccgacagaaaacataacaatgacaccgccaacaaaaggaaaaacaatagtttcagacttttaagtgctagtagaaaggataaaaggaacatttgtatgaattttatataacattcttatgatttatttattcctttatggcagtagaacccagcatacaaaaaagaaaaagtaaacttcagagaggggttcggagagttaaatttcggtgcatgtctctcgctcagccacacccacacacctctctctgtctcttctcctttgtcgtgcatgctttgatgcacacacggtgaactactcgatcgatcaacagttgagcttcaggaccttaagaagaaaaatgcagtccttgattccctgaaatgtcaacatttttctgccgacgaagcgtaaaaaaacatgcaatgcttgcgaggcaaacatcgtttttctgaaggcgaagacagagagcagccgagccgttgtcagatgcagaaggggtcggaaattaacccctttgatttcgtttttgctcgctttctgctcaatctgcatggttatcttattctccacaaggtttaggacgtaagtggcgtcgaagctgctgtgtcacttgggtggcaagcttgataacgataacatatgtaggctgttgtgttgtctcaaatggcaagcttggccgatgccttgtgtcgggctccgtcgtggtagcttaggataggttagttgttggtgtgatgttgtagttgtggttttcgctcagttgtccctaattaactgagcactgtgaggtttgatctcgttttctctttaaaataggatatcttcttcttaatataaaacatcggcaacggcctgaccgttcgaaaaaaaaaacgtaagtggcatatctagaattttcaaaatgggtgatccaacttatatgtttttttaaatattctaaatataagtataaattgttcaaatttacatcttaatatactaataagggagttattttttccaaaaaaaatcttttcacatatgtatatctgtattgggctaatgcttttttgggtggtcccaataccacctctagatccgcctcgtaaggttgagatcgtctacatgctcatgcccgctcgccggccggccacatttaattgttcttgaccctctttacttctttagttgttgtcaagcaaatactaattaattaaaggaaaacgaagtccccttcttttcaactgaatatcagaacatatttatgaattattattattgttgttgttgttgttgttgttgttgttgttgttgttgttgttgttgtgataatatcggacggtgcaaaagaacgagttcattgttacaaattttattagttgtttttagaaagtgttctaagaatcttatatacacatagaaagggttttgcaaacgtttagaagcttacaacataatccgcaagatggaaagaacagggcaagagccaagaaggcaaacaattccatgaacccattgggtacatgcatcttcagcagcttgaaaaagaacatatattatttgatcgccttaatttgttcttcaatcttgacgtctttgtggtctagaataactgaaagtcgcatgctttatacctgcgcctactcttttcttctggaagagggatacgcaattggtttcagtttccagtcataaaatataatactctctccgtttcacaatgtaagtcattctagcatttctcacattagattcattaacatcaatatgaatgtgggaaatactagaataacttacattgtgaaatggaggaagtagcaatagcgccaagacaaagaaaagaaaagtggaaatttcagtggtgatagaaaagaaaaagaaacattccatggattttatgcacgtgcttttgatttatggtagaacccaaaaacacagaattagatgaataaattgatccttgagtagtactctcttcgtctaaaaaaacctaacctaggattaggatgatacataggctgagttcggtactcatggttcccaactcacttccctctttttctgcgtgcacgcttttcaaattgctaaatggtacgttttttaaaaaagtttttatacgaaagttgcttaaaaattatattgatctatttttagaaaaaaagctaatacttaattaatcacgcgctaatggaccttttttgtgctaagggaatgagttcccaaccgagagaatcgcaaccatagtctaatataacgaatctagtcagaagcatgtccagattcatcgtattatgtcctatcccaatcctaaattgagtttttttgggagagtaggaagtacactactactagtagggattgagatcatgtttggagttcaataagctctttgcaaaagaatagttcctgctagtgaagtacctaaatagtgcaatctcttgcatcgagaatcatcctactggataacctgctgcagtggtaactacgactgcaacttaggactgcacgtatcttcagccgttcattttgatgatcaacggtccagttttgccgctacagttatcaaactacataatcatagtaatattttattctacagtacttttgctacagtgctctacctaatcagtgccatctgattcagatcaaacggtagctgctatgactgcataagttgcagtcagtactactactgcagctgatccaaatcctactagtagatactaattttaccctataaacattttaaagctggataaattctttcttttttcttgatgaggacttgctactgaatctgaaaattgaagttttggtctgaattctgaaggcttaaagccttaaaccccacagtgaactcttagagttttcaagtcttctcattgtaagagtaaaccctgaactatttgatcgccttcgttcttcaatcttgacgtcttgtggttgtggtgtagaggattgaaagcagcatgtgttgataggcctgagcctgcacctctcttctggaagagggatacgcaattggtttcagtttcctgtcagaaaaatagaatagcaatagcgccaacaaaaaagaaaagaaaagaggttccagtgctgctgatagaaaataaaaaagaaacattccatggattccatgcacgtgcttacgatttatggtagattccaaaacacaaaaaatattatgaataaactcatccttgatctatactactactcgtacaaacataagatgaatacattctctcctctttttttctctgcggatttgctactgaacctgatgaaatttgaagttctggactggtctgaactatgaaggcttaaaccccacagaaacgaaaaaaaaagaaaatacagtaataaactcttcagttctcaagtcttctcattgaaagagtaaaccctgaagtctgaactgaacatgcaatttccttctagttagttgatcctgacaggtcaagtctgaaccgaagcttcagtttctatcatcctcttcttccccaggttgctgatcctgtcaagcaacgccacgagctagtcaatcaatggccagggattagaataatcgatgactaggttccagtactgtaccaatcaattctctactgaattccaaattctcaatacaggacgcttagggtgtgtttagttgacgttaaaattggaagtttggttgaaattggaacgatgtgatgaaaagattagaagtttatgtgtaggaaagttttgatgtaatgaaaaagttgaaagtttgaagaaaaaatttggaactaaactcggcctaaactgtaatttttttctctccatttgtaatttactggggtgtcattgtcctgcttaccaaaccaactttccaagctggtgtgttttttttttctttgccgcttgtcgccgtcgcatttgagctccacaagtcgtccgtgcgaggtttcaaacgtcaaagtcctcttcacattgtcctgcatatatcttttatattccaagaaatctaaactcaatcaagaaccgaattttaaaacccctttatctttttcggggaaagaaaacctttaattctttacttctaaaaccctgttcagccccaccgtttagcctttacattaccaacataagctaaactttaaaattaaatttaaacttagagttaattttaggttttttctcatgtttatttttaagtatttgcttttgtatcactaagaaaatataactaattatttaatcgttaataagctgttccgctaatacccaaacactaaaatcaaattggcaacttggcatgtactccttaaaaagtagaaattgatatttgtgaaaattatataatctgaaattatagtattatgtgaaaaaagaccggacaccatactccttagacaataactgtccaacggcatctgctctcactgactcactcatctctagaagaagcaaacaaacaccaactactcctccatctatctgtaccggattatcctaatcgcgtttactaaactccgctaaaatctcttgtattcccacaaaatttccccaaaattttttactaaaacttttttctcaagatagaaaaaactatatatccttttggtttgcaaaggttttactaggttatttgcccccctcttctagaacgcatccagaattcgtggactctgcgacccaactcacacggcgaagcacacagaattttttttcccaaatccatttattttcctctcttctctctctcgaatcgaatcgaatcgcctcgcctcctttgttgaattgaatccaagctcgattcgccgccgccgcacgccgccatgggcaactgctgcggcacgccggcgacggcggaggagggcgggaagaggaggaggagggggaagcagaagaaggcgaaccccttcaccgtcgcgtacaaccgcgcgccgtcgtcggcgggggcggcggcggggaggcccgggctgatggtgctgcgggacccgacggggcgggacctcggcgcgcggtacgagctcggcggcgagctggggcgcggcgagttcgggatcacgtacctgtgcacggaggcggagacgggggacaggtacgcgtgcaagtcgatatcgaagcggaagctgcggacgccggtggacgtggaggacgtgcggcgcgaggtggagatcatgcgccacatgccgtcgcatccgaacatcgtcagcctccgcgccgcctacgaggacgaggacaacgtgcacctcgtcatggagctctgcgagggcggcgagctcttcgacaggatcgtcgcgcggggccactacaccgagcgcgccgccgccgccgtcacgcgcaccatcgtcgaggtggttcaggtgaacgcgtgtctccgtgtggactgtggactggacagagtcctgttctatttttttttaccttgttatttgcttaattaatttctagcatctgttgttatgttcgtaaataaatttggttcagatgagagaaattggtggttatgcctcaaataggataattgctactactagctgttatgttcatgaattggccatgatctggtcttttatgtagtgaggaattagaaatcatggtagcatccaactgggtatctggtaagattctgagcaaaatttaattgttgaatttgctagggttcaacagtctgttaaaccttggtgcttgttagagtcacccatcattgtttagccagagtgataatgtattgacaaaggagtccatgtactagtgaagcgcattttgtactgcgagtatggtatattttggcagcagttctatttgtaaacgtataatcacgctgattctagaatgtatgctagcagttcttcatcatgtgcttttcatattaagttcttgctatattggacttgcttttgtgacatctgacatgtattgttgtcctctctactgaacagatgtgccacaggcatggtgtcatgcaccgcgaccttaaaccagaaaacttcctatatgctaacaagaaggatagttctcctctgaaggcaattgattttgggctatctgtgttcttcaggcctggtatgctctgcagactgatgctcaagtacataactttagaataaatggaactgaatctattgtacttggacaaaacaagtagaagaagagcaaatgggattgccccattgtactttgcttcaattcactgcaaatggagcttacttcataggcacatgcagcattcttttcagcaaaactgaatgcttgttgatttctaatgatggattcaatatgcaggtgagcggttcactgaaattgtaggcagtccatattacatggctccagaggttttaaagcgacactatggccctgaagttgatgtctggagtgcaggagtgatactttacatacttctttgcggtgtaccaccattttgggcaggtgtgttctttctcttgactagactgcatgtgttgcggggaagttatagaacaccattcttatcatattattgtggtgccatgcagaaaccgagcagggagtagcgcaggcaattatacgctctgtggtagatttcaaaagagaaccatggcccagggtatctgagccagctaaagatcttgttaagcggatgttggacccaaatcccatgacaaggcttactgcagaacaagtacttggtaagcatcgccaatcacctgtcctaacgcgtagcagcatacataatgctatctcactcctactttagtggaatatatgaaggatatgtctgtactatatattatctatgatgtgattgatgagtaatgaactcacattattataagaagatataaaattagcccagggctatttattattcagggaccatcatgcagggctaatctcagaaaagttctccgaaaaatggctagctgtacccttttttttactgtgtttttatccagaatgttttttaatggcaccatgattaacatttttcatggctcagacatttttttctcattgtttttctctgattttcgttgcatgtacagaacatccatggttacatgattctaaaaagatgcctgacattcctcttggtgatgctgtccgagctagactgcagcaatttgctgcgatgaacaagttaaagaagaaagcccttaaggtagcatttataatatgttagcaccaaaatagattattattcttattgaataaaaacttctacatagagatcacatataatttgcttcctaaattctaaacacgagatgtgcataaggatttttctccttttcttgtagttagcttatttgtgcttaattgcaggtcattgctgagcatttgtctgcagaggaagcagctgacataaaggacatgtttgataaaatggatgtgagcaagaatggccagctgacctttgaggatttcaaggctggcatacgtaaacttgggaatcagatgcctgattcagatcttaagatattgatggatgctgtgagttatcattaaaaatggtctaaactagaataaaaaggactggttctggttcttggcgatacatattgatgttcgctcattgctttgcaggctgatattgacaaaaatgggatcctggactatcaagaatttgttgctgtgtctatccatgtgaggaaaataggcaatgatgaacatatccagaaggctttctcatattttgaccaaaataagagtggttacatagaaattgaagagcttagagaggccttggttgatgaaatagatggcaatgatgaagacattattaatagcatcatccgtgatgtagatacagacaaggtcagcttaatctttccttagcaggccattatattgcatgacattgttcttggtatctatgcaatgacttcaattatataaaagttataagcccacagctagtgaaatctatgaatatcatttgctagaagctgaatagtgccacatacttgattacctggtagccagggttcaaatgtttctacctttggctgcaaggcagggtttatttaattaaagggttggtgaatgttatcattgacctatactatcatataataagttgtaaccggatggacaaggatagtctaattagacgacataaaacaaatgacataacaaacaaacaactggggtaggcttactggagatgattctagtgcaattgttagttgaaagtaacattagcaaagtatgacctgttcaaattccgtgtgattgaacttgtcgatatggtcatcctaacaacaatgcaatgttttcttttcatttattcttttctcaggatgggaaaataagctacgacgagtttgccgtcatgatgaaggccggcactgactggaggaaggcatctaggcagtactcaagacaaaggttcagtaacctcagtctgaagcttcaaaaggacggatccatcagtgacgacacgcaatagactggacagagaaaaaaactacgcttacgttttttctttgctgtgtgctggctgttacattattttttcacacagtaacttagtggctttgtatagatagcatttgtggttttgtgcttaccagcagcgattatatttgtcagtcaggcggcagatatgtatgtacccaaaagagggcgggatggggaagcagatggtgtgcttacagtttactagaccagaattattggtacaattgtttgtagttttgtacgtaccataatacaagcggcgtgaaattctcaactcgttcatcctgttgtcatccagtgtatctgaatctgaaattctgtgtatctgaatctgaactctggaagttgtgacctgttacggtagtagcttgcattgaacttgtttggtttgataccaatatataccaaaacaacaaaatgtcttagaaaattttgtttggtttgataccttaccagtatataccaaaacaggtctactaactccatttcaaaatgtaagaagttttagggctgtacattgatattaagaaacaaatgattggattaaatgagggaatattgtgattgattaagaaaaggaaatatgtatggaatttgaatgatggaagtctatgattagttgataaaagaatgtagatggagacgtttttatattttaagataaaatttaaatgctagaagttattatattttaaaatggagggagtatcaaatttaatagggtatatcaactactggtacaactatttagaactaatgtgagcaaaatttaacaccactaatggtattaatggggaaaaaatcagacaccaatccaaacatcaagatggtactatgctgtttaagtaaatactccctccatctacttttgatagtcatatttccaaatctgaaaaatttatttttgataggcatatttcaatccaataacctatcatcttaatgaatttctcggatttaatgcgtgactccattcttccacacaagattggctacatggacatcgagaaatgtaaatattaatgaatcgtttgtttacgaggaatgactagtagcatgtttaaatagatgataagtagaattacttatccttggtccatgtgccaagatgaaatatgactatcaaactagatggagggagtatatcaaaactttgctggataaaatttggctcgaatccaaatctgcccgtagtcccaagaaaattggctcctctttctcatcatttcggctgacatgagtcaagtgaagatgggcttgatttgggccagtcggaagtggagactccgagaggagtcctagggtgcggcccggcatggaggaggttgggaactgaggaacagaagaaggaataagttcaccagaggtccctcaacttaacagcgagattttctaagttcccttaaccacaaaaccagaaatcttcacccctaaactatacaaaaccgtctaatttgggtcccaagacagtatagatggctggttttgatgacgtggcatcctagtcagcaaaaataataaaataaatatgtgagggcccatatctcactgagagaaaatgatgtgggccccacatctcttttttcttttctttttctctgctcttctcaacttctcagttcgcacgcgcaggcgagcaaatggcggccgacggcggagcgggagctgcggcgcgctgggaagaagcgggagagggggagaggaggcggccggcgccagagaaggggagagaggcgcccggcccgatcgcccatgaggccgcaacggcaggagcggcggccggcgccgcctctccccattcggaggcgggagcgggtggagcaggcgggcggcgcgcggccggagcaggcggagcatcggcgtcagcgcgcggcgttagcgggcgagcgcggccgcggcggtgggcgagcaacggctctgggcgcaggcggcgcgcggccggagtaggcggagcggcggcgtcagcggtcaagcgcggctgcagcggcgagcgagcaccgactccgggcgcggccggagcagtgcggcgggcgagcggccgacgaggtagtcggtgacggagaagaatacttcaataagcttcactagccgccgcctccggagacggagagctcctcgtcggagttctaatccaacgtagctactgcctcacaatttcaagcatatatataactacttgtctaaacgattgattatgttgtgtttgagaattaagatggcggatccagtgagtagcatgaagcatatcacggagatggctctgaagatcaagcatgcggtggagacggtccagagaaacaaggaggactgcctccagatcagaagacgagtgatgagagtgagtatactgtcgctgctgcaggaaacggagaacatcttgagcaacccggcaataagcgccgcgttggaggatctcgccgacacaaatttctcactgtactcttaccttttttgcctctgtaacagcagggagaatgggcaaaagtgggagcggcggcgatggcatcggcatgcggtaggagcatcggcggtcgtggcggcgcgtggtgggagcggcggctccagggggggaggggaacggcggccgtggcaacgtgcggtgggagaagcagtggcctaggcgacgacggggaacatgggtgacggtaggagcgggggaggagtcggcccgcggcgggagcagcggcggcgtgcggcgggagcagcggtggtcgtggcggcgcgtggcaggagtggcggccgccgccgcgacggcgggagcggtagaggcgtcagcgcgcggttggagcaggggaggccgcggcggcgtgcggcaacgaaactgacatgtgggccccacctacttttttatttatttttgggacccaaattaaacggttttttttatagtttaggggtgaagatttctggttttgtggttaagggactaaaaaaatatcgctgttaagttgagggacctccgatgaacttattccacagaagaaaggagattggaacagaggaagaaggtgtgctgtggtgtggctagtgacatgtgggcttcacaagttttctaaaaatatttttgactaatatgccacatcagcaaaaatagctctccatactgctatgagatctaacttaggttgggattaagattttcggtattacgatggagggatatgatttaaactaattatttctctcctctcccgtcttcctcatccatctccccccatgcccgcgggagcatcggggccgaaatgaaaccataagctagcgttggcataaaaacattataaactagtttcatattaatctatttgatttaaaatgggctggttcaattcagctctaatccaaagatcaaacaacaggtagaccccttgttagcaacaggacccgggatttggccctggactagctaggagacaactgaatgtggcccgaatctagacacgtctacgttgttccattaatgtcggggtagggatatatcatgccaaaaaggtaaatcacagcgcaacaagctttcaagttaagtacactagagtagtaatttagacgagcttaattaggttggtagatttctcgaagcagcacgagcagagagcatgtacagtttgctcgtctttttcttcactaatcatcctactagaacatgtgcaatgatactctactacactccttaacatagagatggtaatgctaatatgttcaactgcgaaaattaacaccggacgaataatacactgcattaccgttattgacattataagtaaattcagtatttctatcaattaacggcatcttaattataagttggccctgaataatcacgcagctatgaagcaatcaaccatggcgtgcacgacacgagcaagatctgtagatgtcctgagtagtactactagttctgaattcaaatctttatatgagtgaattttagattaggtcatttttgataagctagtcctgacctgagtttaaatcttcgtaagaacgagatcgggtaaaaaacacccttatataaaaaaaaaacccaaagtgttcagctgatcagctgtgtgtttcatcacaactacttttgctgggatggaaccgattcaggcccatcctgtgcccagcctgacgtggatccggcacaccgttggattcttgaacacgggcccaactcgtgcctggcccggtcacgcttggttaatccaacctcactttccagtttccacgtgttgctaactttgctatgctcacatgcaaaaataatactcgttccgtttcaaaatgttttataccattgactttttagtacatgtttgaccgttcgtcttatttaaaaaagaatgtgaaatatgtaaaactatatgtgtacatgacaatatatttaacaatgaatcaaatgatatgaaaagaacaaataattacttaaattttttgaataagacgaatggtcaaacacgtactaaaaagtcaacggtatcaaacattttaaaacggagggggtataaatggctttgttttggaaggatttttttttaaccacagctcaatagcagtagtatttcttcagttgcagtaaacagcaacattacttatctgcaacattgccctcaatcatggattcatggtgttgagctgacagagaatcagagatggacaatgatttaacttagcaaagctcaaaccttgaagccaatcatggagtgctactggtaacgtccactaacctatttgcatgtgtccatttagcttgtcttgtttcatcgtttgtctgacatagcataaccatgcacttcagtggtgtctgacataactcttgtctagatgaatagatcgaatttgcttttgtataccagttatgagttggatgtgctagcgtatcttcaactgtaaaatcgataggccggtttaagctcttggcacttgcatacaactcagactgtgtttagaccaggggtaaaaagttttgatgtgtcatctcagatatacgggtacatttaaaatattaaatatagactaataacaaaataaattacagattccgcttgtaaactgcgacataaatttataaagcctaattatcattagcaaatgtttactatagtatcacattgtcagatcatgtaacaattaggcttaaaatattcgtctcgcaatttacacgcaatctacataattatttttttcctatattaaatactccatgcatatgtccaaacattcaatgtgagatggtgaaaaattttgtcaaggatctaaacagaccctcaataggtgaagaaaagttgaattcttttcacgagcaaatgtatgattgcagcattctagaagctgccaattctcactcctggaagcataagataagcacttcgagataagctaacaaacaaaaaggcaattaattttgatatatgaggaaatacagacataaagtatcatattcttcaaagtatttgtctaaagatattcttgaaattaaaggtgcgacggactgttatgcatggatggaattcgattccagctttccaggaaacaaattaaaggatcggtttgtaactaaagttaattagctgaaattagaggatcaatgaactgtaacactccgaacatgatgtttaagatcttagaagtacactatacgtcagtaatacaagttatatttttcttccatttctacgagaactcttaccaatttgagtgatattcgtgcattgcaaacggagcttttgacttgttgaactgaaagatgattgattgctgagttcttcaggtgctataatataagagccttgagaaattgagttgatagttgaaagatgcatgattgagtaatatccctccgggaaaagaatgatattagtcttactggtgatcaatacagatttcttctactatgtactagtaatttgacttctaaatatgctagtctgttaatctgtttaagttgtccgttcatcttgtttcatgtaaaatcccccatgcttcacactccagaaattcagataacactcccactactttttaacacacaataaatcaataattagtgccataggtgacaaaatacataaagcaaaaacacagaagcaaatcaacaaacacagacaagagacctagaattctcaaaaatctggaacagatcacaccctggaatgctggaacattcacctctggaatctggatccttcaagagacaccaacaactagtctaccagtatcctagatgatcacctacacgtgaacctactcctctccgggcccacaagtcatccacacacaatctcctactctccaaccatctcctgaaatcccccattttcttcatcatcaatcaaggctgatcagatcagaaatgaagatatttttcgtccagaaacctcaaagctggagtgactagtgagcactttaggccctgtttaaatcccacccaaaactttacacattatcccatcaaatatttgaacacctgtatgaagtattaaatatagtctcaaaaataactaattgtatagattgcaacttgtcggtgacatgggaccgggagtatcatgacttagagacttgaggcagacacgatcacccacgtggcctaaccccctcgggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactgatcatgtcgtcagcagacagccatgttcccacgtcgcgcctgcttccggcggaagtggaggtaggtatgggctgtcccatcagaaggtcattcggacggcaaccatacaagtctccgtctgtttatgaaaagagaggataagtccccacaaaaaagagagagatggtgcatgtggtatccccttgaggtataaaaggaggaccttgcccacttagaagggggaggattgattttcggatccagaacgatcagagagggagagagtaagagctctctggttctccagctcttttgtagcttcttcatacatagatccacaaaaacacaggagtagggtattacgcttctcagcggcccgaacctgtatacatcgcccgtgtcttgtgtgtttccattctcgcgaaccttccacacacagactaggagcttagaatctcacccagggcccccggccgaaccggcaaaggggggcctgcgcggtctcccggtgaggagccccacgctccgtcatctggcgcgccaggtaggggcttctgcgtgtgttcttctaagctctcgcactctttcgtgtgcgc

SEQ ID NO: 81748 - DNA, 2862 bp, Oryza sativa
ccgggactaaagatattttctcgctatttccaaattctttttaaacccggttagggttaagaaccgggactactgataagcgcacttaatattaatttccattacatatgtgattctaaaatagagtgtgatgcattaggattatttaaagtcgagcaattaatggcaattacttcgaaacattattgttgtctgtagtgaattaagtggataaaacgtaataagcaaatatatgatttacaattaataagcattctaatgatcatatatacttacatatgaataatattaaattgttaaaaattgtaattaacatatgtatatacatacgacatgtatgatttaaaattaataaaaattataataatcatatataattagcatatgaatgatattagattgttaaaaattgtaattaacatatgtatatacatacgacatgcatgatttaaaattaataaaaattctaataatcatatataattagcatatgaacgatattaaattaattgttaaaaactctaattaacatatgtaaatgccacatgcatgatttaaaacttttaaaaattctaattatcgcatataactagcatatgcatgatttaaaattgttaaaaactctaagtatcatatgtaaatgccacatgcatgatttaaaacttttaaaaattctaattatcgcatataactagcaattacatgatttaaaattgttaaaacctctaataattgtacgtaattaacatatgccatacaaaaattgatttatatggataatcaatacatccaaaatagtttacatcgtgtacacaataattacgtcaatacatcagcggtgacggttgaccgcacgtactttctcctcactattgttccctccttgtgatcgctacgtgagtaaggggtgtcttcatttgataggaggatgctaaggtcaatcgtcaccgtgaaagggggttgcccatccaattgatcgtaatcctcgtcagtcttgtcctcaactccgatgatttttcttttgccttggagaaccacgtaacgcttcggctcgtcaggccctttgcccttctttcctttgctagacatgtccttcacgtaaaagacttgcgttacatcattggcaaggacaaaaggttcgtccgagtatccaaccttgttaaggtcaaccgttgtcatcccactgtcatcaatcattacgcctccaccagtcaacctaacccattggcaccggaatagagggaccttgagaggaccatagtcaagttcccatatgtcctcgatggcaccgtaatacgtgccagttgttccatcgtgtcccatggcatcgatacgaacaacgctgttttggttcgtgctcttcgtgtcttgggctctcgtgtagaatgtgtacccattgatctcatatccctggaatgtggcgatcgacccagatggtcccctcgccaggaaggccagttgttggttgatcgtctcgttacccatgagatgttgttgtagccacgcggggaaagtatcaatgtgatgccgtgtaatccacgcatcggactaaccgatgtttctggcgtgaactagagccaagtgctcctcgatgtaaggagctaccaatgaagattgttgcagaaccgtgaaatgggctttacagaataaattgttgtctaccgtcattattgctttccttccgagagttccctttccccgtagtctcccttcatggcgtgattcaggtaccccgattgggcgaaggtcttcaataaattctacgcaaaattcgatgacctcctctgttccataccctttggcgatgcttgcctctggacgagcacggttacgaacgtacttcttcagaacgcccatgtacctctcgaaaggaaacatgttgtgtaggtatacaggcccgagaatactgatctctttgacaaggtgacaaagcagatgtgtcattatattgaaaaatgaaggtggaaatatcaactcaaaactgacaagacattgtaccacatcattctgaagggcttctaatctatccggatcgatgaccttctgtgaaattgcgttcatgaaagcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatactctccaagcattcaaacatactttcattctctgccttgctaagagtgtagctagctggactcaagtaatggcttcctttctcctttcgttccgggtcaaggtcgctgcgttgttccatatacttcagatcattacgtgcttccagtgtatctttcgactttccatatacacctaggaagccaagaaggtttacgcaaaggttcttagtgaggtgcatcacgtcgattgcgtggcggacgtccaagaattcccaatagggtaactcccaaaatatagagttctttttccacatcgccgcgtgaccatcttcgctctctataggctggcttccaggctcctttccgaacactactttaagatctttaaccataacaaacaccgttttcccgctgtgatgtttaggcttcgtacggtggtccgccttatgttcaaagtgcttgcctttcttccgtaccgggtggtttgcagcaaggaatcgacgatgacccatatacacaaccttcctacagtgcttaagatacgtactttctgtttcatccatacaatgagtgcaagccttgtaccccttgttggactgaccagaaaggttgctaagtgcaggtcaatcgttgatggttac

SEQ ID NO: 81749 - DNA, 3771 bp, Oryza sativa
accacccaatttattgtttaaatttagtttttatttttattttcagcagcaattaccctttagtccctatattttatgtaatttagtcgaaacagttcatcagttgtataaacaattatgtaatgatcctatagaccactgatgttatgtgtttattaacataggtgtttatttaaataccctgtttcactaaatttatttgttgtcttaataacatgccttttgcatattatttcaagacacgctctactttctcgctttattaatttacaaaattctataaattttgtattttgatttagcaaattccattaattatgtccaacataattaatggaggatttaatgcatgttccacttcatactttgacttggaaattaattacatgtcgatggagtcctatactttggtcatatcgaccataacttaggcagcgagtatctcgcccatcataaagtggtctacattttgagatgattacctgatggagtcctagaaattggccgcactggtcataacttaggcagcgagcacctcgcccatctcacagaggtctacatctcacgatgattacccacatgtgttcttttccaagaatatgttttgagaaatgagattgtttgaaatttggttgaacacaaggtagtggagtcctaaacaatggctgcggtatattcatcagaatatatttgcctggagaccgtgttttaggcagcaagtataccttgcccactattaagagatctactccactgtttaattacttggagattagccacattgtgccacctaatttcgaattctaactcaaaattgtcaggtccataacctacatctttcgaaacattacagaatatgaagttttacatttcgcattgagatttcaaccttaatatcatgtttttattaatttacctctgtaaattgataatgttaaccatgattgtagggacatggcaacaaaagagttcgacgaactcgccctcgatgggactaactatcccatctgggcttctgatatcaaaatcaattttgcctctcgggggattctaaatacaattgaggaacctaatgatggggatccagcaattgagcccaggaagctcaatatagccctttttcttttgagactctacattcacaaggatctcaaacatgaatacatgttagagacgagccctctcaacctttggaaagctctaaaagagtgttatgatcagcaaaaggaactcatttagcctgaggctaattataagtgggttcatttacgcctacaggattttaaaactgtggcaggatacaaccatgttgttcataacatttgttccaggttgaagttttgcgaacaagagccaacgaaggcagaaaagatagagaaaactctatcaactatgcttccggaggacacgatactgactcaacagtatcgcgctaacaatttccagaaacattctctgcttatacatacattgactcaggcagaaagacaccatgagctttctttaaagaatgcccaacagcgcccaccgggctctgctccactgcctgaggtgcacttcaatgtacagaataatgctgagaataagaaaggattcaagggaaattcttcgaataatcctaagaatctgactggaaagcgcaaacgcaacaacaacaggcgcaaattcaagggtcgaaagaaaggaaaagggaagggtaaggcaccacaacctcgtagcaatggcaacaagcattgcaacaggtgtggatctgacactcatgtcgctaaagactgccgcatcccgaaacatctcgtcctcttgtaccaaaaatccctcaaggacaaaaaaatcttctgagaacccaagatttgaagcccacttcaatcttacacatgaagagcgccctgaggttgcaagttctcaccaggctcctgctgaaccagagagcaacctcaatgttctcccagaagatgtcgctccactctctacgatggacggtatgttcatcgaatactgctcaacggaccaacttggagatttgcaatgatctcggtgcgtcctacttggagatgaagctgcccttatctcagtgtgcttgaaacagtatattgatatcctataagtttgccaaataatattggttgtaataagtagataagtacgaactcccttgtattgtaaggttgtatggcttgctagtcattagagtatgtactattaacatatgtatttgatgttttaattattgtatgtatgtatatatattggataaagaattcttaatcatgcaattcttctttcattatagatgtctaaggatatcgctccgattgtagaggaattatgtcttgtggacagtggtaccacaaactctatacttagggagatcaaatactttcaaactctcaaaaagagagaaggcaaagttttgactatcgctgggcgcgatactgtgatagttggctcaggaagagcaaatattacactcccaatgggtacacaaattacaatcgaggatgctttattttatcctgattcaacccgtaccctattaagttatagagatatccgtcaaaatgggttccatattgaaacccatatggataatcgagaagaatttcttctcttaaccaaacaaaacggatatggcaaacgcatttgcgagaaaattccatctctcacatcgggattgtgactatacatacattaagcccattgcacatgttgcatacaaagtaatttttcaaaatgttgatgcattccacacttgtcatgatcgacttgggcaccctggtatcgggatgatgagaaaaattattggcaactctattgatcatcatttgatcactgacaaatttcccaaatcctctgatttcgtatgcactgcatgtgctactgggaaactgattttgaaaccatcttatctcaaaatcagagccgaaccacttaaattccttgaacgcattcaaggagatatctgtggccctattgtgccaatatctggaccgttcaggtactttatggttttgattgacgcatctactagatggtctcatgtgtgtcttctatcgacacgaaaccatgcctttgccaaattgatgtcacaaattataaggctgaaggtaaattaccctgaacataggattcaatcaatccgtatggacaacgctgccgaatttacatctcatgctttcgatgattattgtatggcattgggaattcaggttcagcactctgttccatatgtccacacacaaaatggtttggctgaatcattgatcaaaagaattaagcttattgctcgaccattattgatgaattgcaaattaccttcgtcgtgttggggtcatgcagttctgcacgctgctgaccttgtccaactacgaccaactgcatatcatgaaacttctccaatgtagttagtacgtggaaatcctccaagtatttcccatttgcgtaagttcggttgtgctgtatacataccgatttcaccaccacagcgtaccgctatgggcccacacaggaaagtggggatctatgtgggattcaaatctccgtcgatcataaagtatttagaacccttaacaggtgatctatttactgcccggttcgctgactctatctttgatgaggaacatttcccggcattacggggagacttcaagtaccagaaagaatgctaggaaattgattgggatgcccagggtattccagcctcagacccacgtactactgaagctgaacttcaagttcagaaaattatacatttgcaaagacttgcaaataacc

SEQ ID NO: 81750 - DNA, 12009 bp, Oryza sativa
ggccttgggtccacctgtcggcgagggcagaaggaagaaggctgggggttatgtggacttggagaagggggagccgagctgggccgacccacgcgaagaaaggagggaaggagggaagggagaatgggccgagcccaaagacaaagaggggaagtttattttgttttctttttatttaaattagtttaatgaactttgtgactttaaaactatttctcgagctccgaaaattcacggaaaattccggagagtacattagggcacaaagaatattacaaaatattcccggccattgatttttaagggaaaattttaattctcccattatttcacttgattaaattgatttaacttttatttaatttctagaaaatgcattatttaatgatttttaatcccgaacgaaaatcggggcgttacaaatctaccccccttacaggaatctcgtcccgagattctgggatggctagaaagaaagccggtgctggtcagcggtctgactgatctgcacattgaactgccacattctgcttcgaactgattgattgactggttgatcaaacctgcacgattgcactggctggattcgacctttctgttcctttgctttgccaaaactggaccgactggttctgcttgaactgacctaggccagaactgcggatactcctgaaacttacttatcttggactgaactgttgaggttggcaattttggtaacctgagaattcaccacgctggctataagaggatgaaaatggaatctggcatttataaatcatttaccctatgtccgcttcgactggtcccaattcaaataacaagtaattccaggaaaacctgcttgacctgtcttttgtctgaactgcaaccgtctgcttgacctgtctaagctaagcggttgaactggcctcatgggtgtaccttagaattcaatcggttgctcggggatcggcttaattcttctgataccttgcaacatacttcttcaagtgctaccctgattgcggcactggttgaaccttcaactaaaacagcgacgaagtgaggcaaaactcttccccgagacctaccccccttacagggagtagtcttacttccgcatggctgggatcagttgaactgttgtccttcaaatatagccaacacttctctgatttacaaagagccctgactttgaaaactgaaaacttcatcggtccatcaaattgaagcaatggcgatgcactttcaccccgacaagatttggaacttaacccttagttgatgataggaaattccacataaaagaaattctcatttagctcctgatcttactaactcttaactgactttcccatcagtactaactgctggcatgactgtccttcttctgacctgacttcggtgtcgtccacctaaatgggttgtgtagttgatatctcaaaactaaactgaccgactcgcattggaattgacacaacttgaggaactggggtgctgcgaatagagctgttgtcttgatgacgctaacgccttgccgttgaacaaccttgcaagaactgaccttgtaaaccataaccactataggtagcacttgttattcctgggattggtggtggcttagctgtgctgatttgctgaggacttagtggcgtactatctgaggttgtgggtgcttcctctttgaaaacaaactagctttggctctgatcctaattccagcttgcatctgagcttgtacttgttgttggagacattgtcgttgcatctgctgctttggactctgcggttgcggtatcaacatctgacacatccatcattagatcttggctagccaggatctgaccagagcgaggtgctccgactcagctggtagcttgttgtcttgaactgatccactgactctgactgcaacacactactgctagagttgcttccgctacattcgaccttgcatcgagctttgcatctcctgcatcaatacacccatcttctgatcttggacaccaaaagttgatcatgagcagggttcatctggcgttggggcaccttgcagctttcaactaaaccattgatctgtggctttaattgatcttatctctgacactgaccatctgctgctaggacggaagagaggtggaagagaggggtcgctaaagataaggtactaaaccacttgcctactgatctgttgtgagtacacttttattgttcaagttgcttaagcaaacaacctagtatggtcgcatccccaccaatgatgcaaaccatacccctacacacaagcaaacaacacacgatctagaaagctaacggaactactcttctgggaaagattgggtttaggtcatctccgagaaaacttcacttgatcttcgcagaacgacgactctgaactgatcttctcgctccttgcacgaagcttgaggctcgaattgacttgacttccgaacagacatgaagctgacagctggtcctctaggtgtgacaactacaagaattggagagactgggaggagaattttgaaaaaccgtttgacaaagaaatgccgaagggcgagaggagacaatttgcaaatagggttttcagaaaacttgtccttagggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaaaaggcacttagtcctcacaccgaaacaaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgcattgggtcgatttattaagatgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcgactagaggaaagatacactacaagtccagccgttgcccacgctggcttgtggtaagtacgataagttcttccagggcatcccgcgaaccggtccttaattgccatgggtgcgaccagcaaaaccatgcacccacagcccaccattcagttgcattttagttggataattacgaccatgaagcatggccagatgtctcgagcacgcagctcaacaagatactagaatgtctaatactgcaattatcccatcaactgagctagtggtaattaagcatggctaagcatatagttctagctaggtcacataagtaacatgagctagtcgattcattacccaaggttgccaaagaatagatatcaagtaaacatggcacaagcgagcagataggtaaaccctgatcccgtgtaattagcaaaacatgcatatttatttgcaaacggtaaaacatttgtaaattaggatcaacatgctcaaagggaatgtgtgacttgccttgcttcttcactttgatcttccgaactcttttcctcgcgaccgcggacttccgaaacgacggaaactacacgctggcacgcaaaacgaggaaaaactctaataaagaccaagaaaacagtacataaaaactaaacaaacatgtagagctcaattttagatgaattttgcaagttgaatggctcaattcggagttcgaatgaattagatatgaattttagaagttttgagccatttaaatgaatttctagaattaaactcgatttattgcgcaattattaattatttttacaaaggaaaaggatctcgctgacgtcagcaaggggcggccggcaagcgggccccactggcagcggctctataggggaaaggagagggaggggtggtccaccggctggtgggccccaccgggcagtggctcaaggggaggcgagggaggcgccggccgggctcggctcggcctcaaagccgaccggcggccatggcgaccggcggcggcacgcgcggtcaccggcggtgaccggcagcgcgggagacggcggcggccggcgcgaaagcggcggcggcggccgaagacgacggcgcacgcgcggaggacggcggcgctcatgggagagagaggaaaggaaggaggagaggggattcctcaccggcgaacacggcggccggcgcgaagggagaaaacggcggcgacgaccggtgatgccgaggcgcgaacgggcggcggcggcaccctaggagagagcatagaggggttagggaagggaaggcgaccatggcggcttgaattgccggccggagacggaggggagagagggtctcaccggcgcgcgaggagaaaaaaaggctccggcggtgattcgcggcaatgaagcggcggccgaggtgcgggcgggctcggtgagcgcgacggcggcgatggtgcggcgcggcggcgcgacgcggccgactgaaggcggtgtgtggcggtagtggctcggcctcgcgatgggaaggtggttccggcggtggaggagggagatggagtgggggccggggtagagcaaggcgtggcgatgctagcggcggcggcggcgcgacgcggcggtggctagggcggagaggagcgacggccggagctcaccggaaagcggcggcgcccgggctcgcggtgcggacgcgatttgtggcacgggagagctcggggaaattggggaaaagagagaagggagctcgtggatgctttttatagaccgagggagcgacggcgaagccggggagcggcggatttcgaggggaagtggggcggcgtcgtgggggagagagagacgcgggaggcggcgacgtggccggattttgcggggagagtgggggaacggcgcggacgtgagcggcgaggtcccacggacgagcgcgcgcgcggggtggaggaggtgggcggaatcggcggcgacgtggggagaccgtggcggcggtttcggctgagggagccggaggttagggatggccctgacaggtggggcccacctgtcggcggctcgggggaaaggagagaggaggagacggttgggggggcgatgacaggtggggcctcgggtccacctgtcggcgaggggaggagggaggaggctgggggttatgtggacttggaggagggggagccgagctgggccgacccacgcgaagaaaggagggaaggagggaagggagaatgggccgagcccaaagacaaagaggggaagtttattttgttttctttttatttaaattagtttaatgaactttgtgactttaaaactatttctcgagctccgaaaattcacggaaaattccggagagtacattagggcacaaagaatattacaaaatattcccggccattgatttttaagggaaaattttaattctcccattatttcacttgattaaattgatttaacttttatttaatttctagaaaatgcattatttaatgatttttaatcccgaacgaaaatcggggcgttacagataaggtttggtctttcgaagtcttaagacaatgagatagctatttaataaattttaagtaaaatcatagtaaaaagtatatgttttgtttaggtgctagccacgcaattgcgcgggccacttagctagtttcttaaataatacggatggttaaacattgcacgaagaaattacagctgcatttaaattaggacgaaggtactaggccgcgttcgatagcgtgagattgaggggattgggtgaaagcagcactgtagtccaccgaataatttactccatcgtgaaatgcagtccagactgtccagtgacaggtgttagacagcagtagacggcgccgtttgctactgcacagatgccattcatttgggcttaggtagctgtagcgtctatttttttctacttgcaagatgatagatattttttgctgtctcaaatagtagttacagcgttctattaaaagtagtgacgacaaatgcagaaaaaaaaatattgcaattcgacatatgggaaaaaaattgttggaaaaataaaatatactccatccgttttttaatagatgacgccgttgactttttctcatatgtttgaccattcgtcttatttaaaaaatttacataattataatttattttgtgatgagttgttatatcactcataatactttaagtgtgatttatatcttatacatttgcataaaatttttgaataagatgaatagttaaacatgtgagaaaaagtcaacggcgtcatctattaaaaaacggaggtagtagcaatttgagcaacgtaatgaaaaaaattattgaatacgagttggcacagtccaaagacttgaatgcagtacataatacatatatccatcacgaaatggatttcttattaaatcgtacatctaataaaaagctcgtacactgtacaggagatagttcatgtacttctacaggttctccaccgaattggcaatggcatcacggtatgcgttcatcgcttgtgcgctattgccggcgtaatacatattggagaaggggggtgccattggtgctataggattaccattatacagagggttattggcctggaagtcattttgcttgctgtcgattcggaagttgtgcaaacaaaacgctgccaatattatgttgctctggacattcttgtatgggttgtacggtatgccttttaagattttccactgttttttcacaattccaaattgcctctcaattatattacgcagcttggcatgtatgtagttgaacttctcttcccttccttctggcggtggagcgcgtggccccttgaattgatccttgtggtaccgtacacgtgggtacggtgccaggaagcccatcctactcggatatccggagtcaacaagaagatattttcctacaaaataataagttatacatgaaaactatcagtgcacaattaatgaagtgctatatggtgtacaaatgtagtacttacgaaaaggtagtcttggaaactcctctggatatgagtcaatagcttcgtttaggactcgattgtcatgcactgatcctggccatccggcatcggcaaatataactctaccatcgaatccaacaattgttaggacattttttgttgtctcgtcatggcgattcatgtgttctatggcactatccacaccaacagtgaccggaatgtgtgtgccgtcaatagcacctacagcaaactggaatggtccaaaacgactatcttgtagtaggcgacgagggatgtccgtaaaattcagatcaattggcttgagtattttcgaccctaacataaccattcggctaagaacccttcgaaaatagatagacaccgtcgagttcgaccggacccaacgattgttcgactcccttgcagaattatttcctgccattgtgaacaagaagattcctagtgcctccaaagaacttacatcattactcccatgcaggttgtaaggggcattttccataatttccatgtagagtgtatatctgatattccgttaaacggaaaatcgcacggcactgtgcaggattcgccattgtctctagcatccaagttattccaaattgggttgggacacgacgaggagctcttggaggagcagctaaaatctcttgcatcattgcaataatagcgtcatcctcatcgctcgtgtattgcccttcagtaccatccgaactccacgatgaaccgtcgctcattgtgtgattccttcgaaacaagaaaaatatatagcttacattaaccattacaacattatttgtaaaaaaatgcacgcatggtgttcaataaaaaaattaactgcataaaaaatttcacagtgacataccacaagtaccagttcagactacaagcattagaaatgagtaaagcagatgctaaaatcctactgcaaacagtatggtgagcattattttttatgcctctcatatgaatctcctcctctcagtgagctccaggcaactgaccaagcaagagcaactcaatagaacccattaccatctacgctaccaggacccccacctccaccagggccacccccctaccaacctccaaaccctgtatgacctcctgaacaagttggcgggggtactcctccaccataaccctgctggccagttggcgggggtgctcctacaccataacgctgctgcccagttcctccttcgtatccaggctgtccacctccttggccaccagctccttttccgccaaattgcttttgccatgtctgtactatgtaatgggaccgtgactcgggtgtagggcagtaatcaatgaaccattgacgccaataagcacgctcaaatacatccagtgccataaagaataaatcactccctgggttatgtccatcagctaccaccaactggatgcaagctgctgcacttctagccctgtcctcttccaccttccgggaacggctctccatcgactgcactcgcaaatcagctagccggtgcagggcatcaccggctgagtcacttcgactcttctttgaagccgatccactcgaagtgccagcttcatctgctggcctcttgcctttttctgcacttgaaactcctggagtcgcaatgttttgttgttgagctagcagctgtgagatattgatgttgggccttggagttggctgctgaggaggtgctggtgctgcgcctgcaacagcagagtggttccctaccactgtgcgccccgaaaaaatagcacagtgaaggtcgatgtgcttgagaggggaatctttgaagacacgagctccgtcctttttctgcgaaaatggttgagtaataaaataaatttacattgaaatgaacataagtagtttcttaaatcgattttcatttttgcattttgttgacgctttttgaactaaaaaaaagacagcagcatacaagtacataactaatgtacgcagcaacatagctattattggtggcaccatgttttaacatctgcagactgcaggtaacattttacctagattttacggtctaactaattcaagaaaatggaggaagtactatatgatattgatatgcattgacaataatagcagatgatgagcagactaaaaatcaaaaaactttatgccatgtaagcaatgtgacatgtcacatagaggttgatgtcatgtcaaactatggcatcaacaatagcataggaataccaaatatctcaagatatggctcagttttgttgaaaagacctacaagagaataataaaaatagtaccaaccatgcatttgctgcttcctaatcaatttattggaaggtagtgaatgcagcagagaaattgtacccccattcattatagcaaaaaaattacattctgattttgtatcctagaaacacaaggttttacaaaggtacataacactttctatgaacaatatgtatgattatacctaaaaatagataactgtggagatttcatgaactaaacaaatgtcatgggtccttgtgttaatgcaaatcagtatggaaatcactatcttcctagttcgaccgaacacaacataagggtaggtgacatacctggtccttgtcttcccaccaatcgtcgtcagcaacaatggcttgagttatcgggtcacggccaatgccggtagcctttgattccagccacgtccaaagcatccaccttttacgacattgacgccatatgtacttcacctgatccttggtgaggtttcttccgattctctccttcatcttctgtatgaggttcttgtagccttgcggctttggacaagtggatgttatggtcattgcggacaactcctccaagcatgcctcaagaaatatgccaatttcatcgtcgctccatcggattttaccctccgccatctaccacccaatgttaacaaagcacaaatgcaatggatcaaaaacaaattacaatgggcattaccttttgtggcgagatgggccggatcaggtccaaatcgagggaccgaacaaccgtcgccggcgacacacgacggacgaaagagcgaacgccttctggggaggtcgcacaaacggctgttaggaagcgggcggccacattgatgtcattgtcacaaggaggggcagagctggcgtcagatttgccagaggcgctcgaccccgtccccgaatccagattgatgacagtccgtgaggagccggtgcggcgaacgccaaaggcacagcctgccccttggctgcagtcgacggatggatgtcctcccctctctttcgctttgttcccctggtgcccattgtccacccggagaaggaggcctcaaataggaggccggaggcgagaagatagcttccaactctgccgaatcttgacgacactgtgacacccgagagcgctccaccgagtacagccgcatgcggccaaagctgcagtgcctgatgagcagctaggtgacgcagacaacaccggcagcgctccccgacttccgcctggcttgatggcagctccgccagagaatcccctttctccggcctcgattcgccttttcagcagctcccgtgacgagtggtcgatttctccgcgtgcctaacagccccaggctgaccacgacgaccaccggacgacgctcagcagtagggcacaacgattccagccacggcaaccgcgcgtggagccgtcgacgaccgagaaaatttggcgaaggaagaaggggatcgatgggagagagagagagcgagcacggctgcttgcgctggtggtgggttggggacggatgggccgacgaatcgatccatccaaatgccgtctgtgccgtttgtacaggtgccacgtttagtcaccaacgccatttaatatgcagtaaattattcagacatgtacagtgctgaacagtgcacaattcaccaaatcccctcgatctctcgctatcgaacgcggcctaagactaccaggaagagtgtgatgactgatgagaaggcaggacagctcatggggtcaactggtgattgctgtgatgcggcgcatgtgtgatgagtggcgaaaagaaaaagggatttggtgtgccaggctgccagcgtgtgtgcttgtgtgtgaagaagatgacgattttggtcgttcggttttgaataacgaaggcactaatatcactgtatcagtggtttgacaaatagaagtagattcgctagatgaatggtgaagaaatgatgatctacatgccgtcttttttcaccgttaattcatcgacgtcacgattttgtgcgatcgtggtctcgttcacggtgtcttaagatttaggctctttcgtgatgcaggagttttacctaatttcctaggagttcgtttagcgttccatccgttgttaagtataaatatttttaggttatttaataaatactaagattagatcaaaatgtttttaagtccttttaggttgtcaattatttatactattcgctctcgaagcatctgatttggtttcgaaatattaaaatgatgagaattagtataaaaatgcttatattatgttactccctccgttttttaatagatgac

SEQ ID NO: 81751 - DNA, 6034 bp, Oryza sativa
gattcagaacatataatatatttagcatcttgtcgaattaactgtattaagtggacaatatgctgttttcagatcttacatcatgaacacattcaaatgcttggatcatggcgttgatgttgccagtgcattcaacgctgcggtcaactccgccattggtcatctcagcaagtacctaaattaccataacacactgtatcagtacaatcaagtgatacagattttccttttcctgatgtaagggaacatacatacctgctgaactggcttgtcatggtcctttgggttcacaaattcagtgcaaccaaatttcctagctgaagatatacaaaatatataagatgactttaaaagaccatcaaacaaactgatgatctggtaaatcaagaggattttaccttcttcaaatctgttggcgttcaggtcaatgccaatgatccttgacgctcctgcaatccttgcaccttctgcggcctaatcagacaatatgtagagtaattagatggatctctcattgtaattgagaacattcaaggtgagttcagacactcacagcaaggcctacagctcctagaccaaatatcgccaccgtcgaaccctttggtggctttgccacattgattgtagcaccaagacctacaaaaggaaattgcgactcagcatctcaacttacattctatcaagtaagaagaatgcaagaaacaaaaaaaattctgcttaccagtagaaataccacagctaagaacgcaaactttatcaagtggagctgccgggttgatcttcgcaacgcaaccaacatgcatgacagtgtactcgctgaaggtcgaagtcccgacgaaatggtaaatgggcttcccgttgatggaaaagcgtgatttgccatcaccaatcatcacacccctgtcagtgttgatcctgagcagatcacacatgttgctctctgctgacttgcagtgggcacactccttgcactccccagtgaacacagggagaacatggtcaccaggggcaagatcagtcacaccctctccaacactctccacaatactgcagaaatgaataaatttcagcagatatgaacaataggaatcttttactcaatggaagtgttaaaaaaaataatccacgctgtatttcagaaaatagaaagggtaccatgaatatgttaggtagcataaaggtcaagcaatgcctaatttatatgccctttgtcaactggaaaatacaaacttattgaagagaagtcttctaaagggtcaatcaacgcctatcacaaataaatctgccaacttcaaaaataaactaccaactactaactgaaagaaaaagtttcttccttgtaataagttataaattgataaatctatcaagatccaactgaagacccacaaaaaaagcacacatttataatgtttgacacaggcaacagcatgtgcccatatgattctttcccatgttgtccagattacctcagccaaatgttctactaatgccaagccaataaacaatgaaccccccccctaaactgcaattagaggaagattcaaccacaaagcatagttttaagtacttaacaacatgccacatcagcaaccagagcagtagagtaaaccaagaagtaacaacgagccaattaattaacaacacaacacaccagcaaccagagcagcagagtaaccaagtagtactaacaaagaatcaattaattaacaacaggccacactagcaaccacaacagtggagtaaccaggtagtaacaacaaatcaattaactaacagcatgccacatcacacatcagcaacaaaagcatgcatcagagcaaccaagtattaacaagaaacaaaatcaaggaagaagatgcataaaagcacataccctccagcttcatggccgaagatccgagggaacacgggagtctgtccctaagagattcagaagccacacaagaggcgcaagtcaaccacacattggagcagctatggatggataggaactgaagaagaggaggtgagtagataccttggcctcccagaagtagacgtcggtgtggcagagcgaggtgaagaggatcttgacgcgcacctccatggcctgcggcggcgccacctccacctcctcgatcaccagcggcttcgcggcctcccatgccaccgccgctgcacagatccagcaaaatcacccaccaatccaccaaaaaaacataatcctgaatgacatttttcactaaaaaaaaagatatgcttttctccacagcttctgcaagatcggtaatgttcacccaagaaaactctaaaaagaacacaatccaagaatttcatctacagcgccgctccagtaataaaatgcctaaaagttcgcccaatccaaagcaaaatcgaaccaagaagaaacagggaagggaggaaaagcactgacctttgcacttgatcaccttccctgcggtcgccattactctcctccccacaaaatcccgcacaaaccaccaaaccaaaccaaaccaaaatccctcctccaaagaatctcactcactcactcaaatcacacagatcaaatcaaaaccggtgaggaggctagatgaaccatccccgtctatatatagctcctcctcctcgaaggaagaaaggagaggatggaggatggagggtgaggtttcgccacttccttcttcttgtcttcttgggtagcaaaccacggacggagtggggcggcgtggcacacaaaccgggcctcctccccctccacctggaagcggaattgcagccgctgttttcgcctcccccgacgccgatggtgagtggccgtcggatgcgcgacggccggcgagatctgcggctgggagctgtcggcgctgggttgcaccacgcgtggattattaggaaagtaaattgattttagttagggcgtggttagggccagtccataacattatacatgatttttataaactctaaattatcaagacactactctttcaatttaaacccaactattccatatttcaatttaatgctatttatctcacatgatgttttggatgttgtgtaaaaaccggttttcttctctttcctcatttatttacttgtcacatcattttttagatgacgacttatttaatgatatgtacattatcctagtcattgggtttagaatacacttaccactacctccgtccagaaagaagaaagaacgtagctttgtactgtttatatgccacgtcttattattcgtttaaaatttcatttatatttcaattattattagatgataaaatatgtagtattttgtgtgtaactaattccttacatctatctatctatctattatattattaaaacagctttgaaaggaggcaccacgttcgctgtgggggctagaaattctcacattaatcggagaaaaagaaaaaaaaagaaaaggagagtccaagtataaatacaatataaaaatagctaaaattcggaattaaaaataagcaatattgaaaaaaatttccatataagtacccaatacgagaataatcaaaattcgaaataaaaactattatattattaaaacaactttgaaaggaggcatcacgttcgctgtgggggctagaaattctcacattaatcggagaaaaagaaaaaaagaaaaggagagtccaagtataaatacaatataaaaatagctaaaattcggaattaaaaataagcaatattgaaagaagtttccatataagtacccaatacgagaataatcaaaattcgaaataaaaataaaaaaatccaaaattataaaaataaaaggataatcaagtaggaatacaatttaaaaatagctgaaattcggaattaaaaataagaaatattaaaagaagagtccatataagaacccaatacgagattaatcaaaattcaaaataaaaataaagtgacatctaaaattagaaaagaaaatgagagttttaagtagaaatacaatttaaaaatagctgaaattcggaattaaaaataagcaatattgaaagaagtttccatacaagaacccaatacgagattaatcaaaagtcgaaataaaaataaaataaatctaaaattagaaaaataaaatgatagtccaagtaggaatgcaattttaaaatagcagaaattcggaattaaaaataaaaaatattaaaagaagagtccatatagaacccaatatgagattaattaaaattcgaaatataaataaaaataaagtccgaaattagaaaaaaaaagaagagttcaagtaggaatacaatttaaaattagctaaaattcggaattgaaaataagcaatattgaaagaagaattcatataagaatccaatacgagattaattaaaattcagaataaaaaataaaataatattcaaaattagaaaaaactaaaagagagttcaagtagaaataaaattttgaaacaactgaaattgaaaataaaaatattaaaagaacacaatacggtattaattaaaatttggaaaaaatgaaattataaaaagaaaaataagatttcaattaggaatataatttataaataactcaaatttgtgataaaaataacgactattgagagaaaataccatctagaatacatgaccagataaattaagtcacatgcttataaaggagtagagtggcggcggttgatacgacatataaaaactgttaataaaacaccaaataaaatcctaatgacaattaaaaggagggacgacaggcatgccgtaaaacaaaaaagcaagggagttgccatgacttctataaagttaaaaaaaaccattgataatcaatgacaataaaaagaagaaggagcgggcggggtgtataggagtatagttgacgggtcttctagaaaataaaaaatgaatttcaacgatagttatgttcgatttttagaatcacaatgacaataaagagtaggcggcaaacgggctatagaggagcatagtgatatcgtttgacgggacttctaaaaattaaaaaaatggaacccaacaaaacaataaactctaaaagctacatggtctaatttttaaaggttcgaaacttctaaaaagtaaaaaaagaagggagagagtgggcgagccgtagaggagtacaatggcaaagccgctgacggtttggcgaaacttcttgaaaagtaggaagtaaaaataaacccaaacaataattatgttcgaattttaaatctcaatgacaataaagagaagagacggtggacgggccgtagaagagtacaatggcaacgtttgacgagacatatagaaattataaaaaccgaaacccaacgtgactataaactttaaaaactataagatctaatttttaaaagttacaagaagaatgaatagaaatagcggtagatcaagcaagtaaataaagaaggagatggcataaggggtagtagctggtgtgacttttaaatactatataattaaaaacacagggatgataatgtcacgcccagaaatttagcccaaatttccagactattttgtgtattaaatccctgtccaggaccagccagggtacacaaaacgacaagtaatatacagttccaaacgtaaataaagcgtaaaatacttacagaaaaggcacttagtcctcacaccgaaacaaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgcattgggtcgatttattaagatgggactaatcacggtgaatct

SEQ ID NO: 81752 - DNA, 15267 bp, Oryza sativa
cttaatgaatgaacacaaatatgatgatcatttagaaataacctcaaaaaactacatgtagatcaatttggaatggaggtagtaatgaatttacagttgagactttacacaacacgcatatcaaggaaataatgttagtgggtgtttgggagtgagaaacttcctctctccgaaaaataagtccctcctatacggactaaaatttttgtgagagggaactttagtccctccttcccaaaccccaccttagttgatctggacagtgtgtgcacgtggtacatttctcttttattcccaaacaccgccttggttgatgtggacagtgtgtgcacgtgatacatttctgttttagtacgatattggtaggctaattcctttgcaaaaccaaaagcattttttttcagttccacctgagttttgaagccgaaaaatgttctaacttataaactaaaaggccagcttattaacatcataattgaaaaggctaataaaccaaaacaaactggcccttagtgatcagtgtaatggtggcctagctaattttatttagtactaatttctcaaatgtcgcaactaaatggcagcagcaaaatgtaggtacggctctcttcaagtgattgtgtgctttaattgctacaaggattgtaatctgtccgtgctgtcggcactgcagttaatcattgccgttagtggcttcacaaaagataagccaatatattaagttagcaaccgtagcaagacacgtacaataaaaaggaaacatttttgggaccaaatgtacttcgcgatgacaattatattagtggtgttattagcatccaatgagtgaccaacattactgattgagtgtgttgcaattaaattcataaatagccgcgtaagcagctacagttgtttgcttaaatgagcccaaatgtacttttgtcattgctaattccctctctattgacatttgtacaacttttcatggaaaacattctatgatttaacaccagctgattttagcttgtgatgattttatttgtatgtttcagaaacataaaagtacagcagagcaaaatgaaacagaatgaccaaggtcatcggccaaatgtctggtttaattttagtataaaccggtcagtactcatcactttttgggtaagggtctcaacattttaaccttggtcataaccagaatcagtaaccttttctccgccaaaaaaatagtactactccattattttttttcttttatttcacgctgacccattaatcatgcatgcctagtttccaaccaattaactctacgacgtagagtgattaataagagtcgaacacgataaaatttagctagttctctcaacctctcaaccttttggttatgacactaatacgacatgttaaggttatgatttacatactgagacttaggccatgttattaatttttgaattattcatcgcattattaaaatggattgtgtgtgcatgctttgaaatatatgttttttcttttcaaataaatttctcctgcctgtttgttaatattattttgtaacaaaatttattcattcttataatcaactagataatccactacaataatctaaaataaatgaaacggggccttaaaaatcttaatttgttgagggaaagttgccattattaataaccaggcccgtacattcacctccataaatcatagtactatttatgtcctcaacatatacaaacatcgtgaaattactttgttgtactaagaataagtgcattgtacaaaaagaaaaccgtgacaaaacatgaagcaacaaaggaattcaagcaccagatctagagagctggaaaagatgaattgaagatcgatctagctaggctgtgatatgtatgggacaggttgacagaatcacatgtagaagctaggtctctttctcacaacaacagtgatctttgcattgtccatgaacagctaagcacaaatcaatgcagcctcactttgtagttgcaagccactacaaggtactctgttcttgctcctcaataaaaacagagcccaactaacactgcctacttccctgccaactactcacaaatgtggcattcagataaaggcaatcctgaaataggcttgaacagagcagaatacatttgtgttttacagagacatttaacaattaatcaaagcaagggatatagtgcaaagttagtacaaattagagtgaggaagagtgaaaatcttgcatggaaaaacagagtaacaaacctaacaaatcagttgacttgtaattcagtgaaaaatttacactacctggtaattgcattgcatatatcaaagatgatagaacaatccatgtactaggccggccctaacaatataactgcactttaaagctcgtaacaagaagcaaatggtagcttttaatttacaatccaaccaaagaaaaaaaattaagctaggggacagatcgttacagaggtttggcaccacttagaatcaatgaattcaacacttctttacagtttcactcggcaacaaatcaacaaaataccccaaacccaagaacaaaaatgactatatctcacttgtacatatatgtatatatataaacatgtagaccaaatttatcttataacccctctctctgtatatattccatcttctgagaccccagaaaagaagaaaactgcacagatcctcaattaatttaatatttttggacctttatgcaaaatttctctcttcttctgtcccagcaagatgcacatgaacttgatcaattccttttaatttccagtaatttaattatgatctacacaattttgttgatttcaagaagaaattaaaattatgccaaccatggatgattaattttcatctcattctaccagctaatagctctagcttaattttttttcaaactcagttgaacttggagcagactttcctgacctcgccggcggcgccggtgagcacgccgacgctccccatcttgaccatggcgtcggcgaagtcctggcggaagtaggggccgaagaaggcgctgagcatgctggagtaggtgtcgacgacgccgacggtggccgtggcgttgtagagcgcggcgtcggaggcgatgacggcgaagccgttgcggatgttgcggaggatggaggtgtcgaactcggcctcgctgccgcggtcgagcggcagccgcgtgttgaagtcgccgggggcgcaccgggactggagctccgagaggaacgcctccgggatcgacgggtccgcgccgcggccgccgccggcgagcgggaagttgtacagcctgtcctgcaggaagaagcacgccgtcgtccccaccgtgtgcgccgctgcaaacaaaaaacaagagttcgtcgccgtcgccggccatggttaggttagtgtgctcgaccgcctcgacgccatggttggcaatgcaaggagtcaagaagaagatgaggcttacagctgaggaggacgaggtccttgtcgtcgaggccattggcggcgaacttggagcggaggacgtcgatggagtccttgacgtcggggagcacgtcggcgtcgcggaggctcgacgtccgcccgtcgcgccgccccgtcggcacgtcgaacgacggcccacccgtctgcaaacaacaacaacggatcatatcaatccatgtcaccgagctaggcagtacagtgcacagcgacggagcctgaaagattttttgagcccgaacaaaattcaaatataacaagtacttgttatagaaatttcatcatcaatttactcataaatattaaaatttaaaggagttttcgccggcgcggtgggtggacgtacgaaggcgatggcgtcgcgggaggcgaggacgacgatgtcggcgcaggagacgacgccggggcactccgactccagctgctgcttgatgctgtccaccacgtcaagcccacgcagcccctggtgcttgttgttgttcacctccgcgttattccccactcccttgatcagcaccgacccatcacacccctaattaaccaaaaatattataatagaaaattaattaaacttaattaaaattctaacaaaatatatatcacaattgaaaaaattataatttattgtaatatttttatgtatatgtaccttggcgaagcagtcgtggaactggagacgaacaagggcggggaggatggtgctgtcggcgtcggcgaactgccggacggcggaggcgacggtggattcagctgtagggcatgacttggagtagaaccccaccttcagctgcgcattgctgacggcggcgccggcgacgagcaccgccgccaccagcaacatcgccggaccaccaccgccaccaccactcctacccatctcaacccaacaagaagagatttcagagagatatctagctagctaagatagctagaatggagaaagaagaaggtgaggaggtaggaggtcggaggtccagctgggaactgcgttgaagagcttttatagggttttctcctccatgggtgggggtgtagtacatgcaatggatggatggatcatggacaggaattatgtttgcactttctcgcaaatggcgccaagctgtaacacatgtggttgcgcgttacacgatttgacttgagtgaagtcccatcgtttcgctacagttgattacaagccgtaacacttattagtgaaaaaaaatatttaattatggataaaacttttgtagcattaggcacgctcttagaaatttaaaagctaatacattagaaaataaattacgatggaaataaaatcagaaccaactctaaaattaagatttaaaattcaaattttggctacggataataagctaaagagcaattgatggagtactaggtccgacctaggaaattaaagtagctacaaagtacacttgttttttttttttgacatatgctgctgatttgtttttttttttccctataacatgaaaataaatcgtgtatatatgctgacactgaatctactgctactagctagatactccagttttctgaattcaaatcctgcaggttaccttcatgaatgctatacacatgcatatactatatactagtaatagatatagtacagtactatgcccaatttcagagccagaaatttccagtggaccatggttaattggcccaagcatgtacgcatgtgcacaggtcaccggagttatgtaggacggttgatcgatgaagctttttcccgggcagcagattgccactgcaaaacggcagtcagcacggagaaaagtagctggtttgttcatgcatatgcatatgctggtcctaactgtggttggcaccaatggctggctgagaaagagcaaagtaaattcgctcatggagtcaggataactaattaaaccaaaagtatttttgctattgggtcacatgagtatgtcggacatggattcatatatgcatgtttagggcttgattgatttggagaagttagtgagaattgatggcatatgcaggcaacaggtaggctgactgcctgaagaatggaagtatctgcagctgcatttctgaacttggagattttctgttcagaggagagaagaaacttactgtacatggctaggaaacttcttgtcatcagggcagtcatagagttgcttagctggtgtttgagcctgattgcctgacatccatgcacatgcatgcttgttttttttcagcttcttttttctttctaggtttgattttgacctgacattcttcatcagagtcgtcaattgcatactaaattaatatgttttcttttttttgagaattaattaatatgtttttctggttcagttaaatatactcatgtgattgaaatctcagaggtgtcattttcacgaatgatccaccatataccattaatttggtgtcattttctcagagtcggggtctcagtttgacctaggcttcaaatccaggtcaaaccctgtactagctcctatgtacacttgtcaatagtcactagctaggaacatggtgtcacacaaacattccgttagtttgcgagaaaatagtgttcacgcaaatattctccgctttcaattttcataactctcaattgctggcggcccgcgaattctcccccttccccctctcggccagcttattagcgcaagcggacgcaccttcaacccgccactgatttcaaattgcaaacatcattaaaaaaacttttctgcagttctagacaaaaactactgataatgcacttgctatggatgatcacttcatgattcatcgttcgcctaatatttttaaaaatgtaagccctcttagaacttctagttttatctcttcttccatgcatgtttggccttatgaaataaatgtcaccactctcacaactaaatgacttttttttagtctagtataaataaaggatatgaaagctctatcggtttgttttcttaattcattggagagtctaaaacgaattatatttgaaaccatagtaatacccactagtgaaaaaaaagtttttccaggcagccaaatggctctacgcaacgcaagcaaagactctgccatcaactaaaggcatgcgaaaaacggtgtttaaaccacattcgtggccaaggcatgcaacccctcgcccacgactatccagacgggcgttcgtgtccgaaatacagcccgtctgcacggtgatgtgggtatcgttgtgaaaaatcgttttttaagtagtgactgattaagactaaaattttatttggatcataaatcaagttgcgattaagcaagtgattaacattatttatgtccaatgaattgagaacacaagcaagcaacatattgcgtcatcaatagccaaataattatatatacacattaaagagagaagctccaaagctgactgtgcacatatcaaattatatataaaccccaagccggccaatttagctgtgccgattgtgactaggcatccacagacaagtatttattgtgcacattatattggctatcaatatatagcatgaccatgagttgggccaagcttgcaaactagagctagcttagcataagtgcacacggctgattgataactcaacggttgctcctagctacttccaccggttgaacggctttcccatttattgcccacgttgcatgtctccttccaaatgtgtgtgttaatttggaagattgccaatgtggttttatgcacgttcacacttcaatttctcgcgatttcaatttttagaggtgatccagctaagctatgcatgtttggaaaggccattgcaaccgaaataatgtgtagaggttttttttttctctggtagaggagataaaggtatctttctctatgatcaaaaagacttatttattttgatgtacaatgcactaaatgatattctatttcgcaacatttacacgttaattgttctctactgccgtagaaaataataatatcaagaagttaccttagccatcttaacttggcatcacagcttgtttaagcatatgtgtctttagttattctttttttaaaaaaacaatttaacctcaaaagttgaagatatatatagataggtcgaaacgaaaaggtatacacaccatgaattagaaagcgcaaaaaataaacgcaattacaaataattcactctatttttaaaacatgacaaaaccatcctggtacgttttgcagcgtgtctatgaaacatataactttgtagatgaatataaaaatgtttctagaaatagtgatagaaagagagttctgtacactatatactactagctctgtattaaatagattcaccgttgattttatttgtttttttcacaactttaaccacttttttaattagaataactttaatacataaaaaagactgtaatattttaaaaatacttataaagaaaaatcaatcaatatgaattttatgtaaaaatacttataaaactaaatattttgatagcatatattattatatggagtatttaaatacagaaggagtacttagtttgcttggtaaaaaaagagagtaaattttacaaaactacagatactttgactaaattatcacaaaactacagatttaacatgatgtatcacaagactacagatttaacactaattttataacaaaactacagatttaaggtaaaatatcgcaaaactacgatttagtaacaaagttatcacaagcatacatgtttaacttcaatttaatcacaaaacctggatatctataactcaaacattacattactgcaaaggatctaaatcctaaaatctgtagttttgtgataattttattctaaaatatgtagttttgtgatagttagttttaaacctgtagttttgtgataaatttattgctaaatctatagttctatgatatacgaccttaaatctatagttgtgtgataatttggtcaaagtatacgtagtttcgtgaaatttacttaaaaaaaaaagcatcttctactgattatgcatggactgaggaggtaattacagtgttatggtgcattaaaagctgcacctaagtctccgtgacggcagtttcattaattaactgtcaaacggttattcaccgacaatatttcagtacctaaagtaacctaactgcctcggtggtgggtccttaagccaagcgaatctgtgaactcggagatgtgttattttctcctcatttctaactttgaattatttttcacgcgcacgatttctaaacagttaatcactatattttttttaaaaaaaatgatagcaaagtgattgtaaaaatcatattaatccatttttaaaatttttaagccaatacataattaattatacgcaggaagggtttccaactcaaaagaacatagtcagaggttgttcaaattgacgccgcgtagctagcccatccgacggacccacttacacataccactccgcttacactttcgtccttacttcgtgtaaaagggttaatccgagagtgatatagttgttccgcttacattttcgtctttactttatgtaaaagggttaatccgaaagtgatatggtggttcccaactcaaaagaacatagttagaggttgttcaaattgatgccgcgtagctagcctatccgataggcgggccacttacatataccactccgcttacactttcgtccttacttcgtgtaaaagggttaatccgtgagtgatatggttagagggacaagcccttataagctggttccactctcactaaactagcaatgtggtactaaacatgcgcacacaacttacatggcccacacatgcctaatcttaattgggtcaggatgtcacaccaaccataccattttttttttggcaaagttgccaaaggtgtgcatacatttagttttttttttgccaaacttcgacaaatacgtaagaaattctaccaaaattttagtaatattgtcaatttatcaaaattttagtaatacataagcattactaaggtttattttggctacgatccgaacagccccttacaaaccgcgagaattttttaccatatttacccgtgagaatgtaagtgctagtatagcacaaggccacaagccgtccgatgggataactgatcggctcatattcaatttcccaacctaattaattagttaatgtttggtagatgattgatcatatgtacattgttcagttattgctgacgatttgcagttttgcactgtgtatataccgtactccctccgtttcacaatataagactttctaatattgcacacattcatttagatgttaataaatctaaatgaatgtgggcaatgctaaaaagtcttacattataaaacggatgaagtactagctagtaggtaatttgacacctaaatttttacttcacatcggtgatatatatatcgatcaagtacattaacttggtcgtcggtcctgcaatgcacatgctcttgcacggttgcacctagtcggccatcgatcaggccataaacccataactgcatgcgtgctagcttgtccatgcatatatctgtacagatgtactaaagtttttagttataatcatgctgtcatgttgccggttactttaattacttggattagtaggcctgcatatcttctgttcctttttaattatcagaatggcagaatgcacgctggcccgttggcctttaggtttttaagggccgagcctatttgatttataacattgaacgaattattattatcgtgaattaattatttaattatagagataaattaaatattaaaaagataaagttgagaactaacttaaaacaaagtgatgaaagggaatgaagggtagaatggtaaattctctgcttccttaattttcacaagtgctccctctatctaaaaatcaaagacctatttcgtttttttgcaaaagtctaagacctattagtaatctatatgtgttgaattaaattgttaaccgaaacccaagaagccatcttattgcatgcaagtgtatagttcatttgttttgtcacatagtggatgagttaaattacttattggtcttggtgacaaaagaaacatgtcttgttttggatggagggagtatatctgaaatatcgtaagtttaaaaaaaagatggagttattacaacttaatattataaaagaaggcattcaaagaacatcgttatacatttttcttctgaaaagaaaaaaaaatctatcatgcatacaaattaaatatgctgtttcgactttggtcgggtttgatcatgaatcacctgggacgtgacagcatgcaacgataaacaaagaaaaaaaacaacccacatatacactccaagccgtgtttagttgtaaaacttttcttcaaattccaacttttccatcacatcaaaactttcctacacacacaaacttccaacttttccgtcacatcgttccaatttcaaccaaacttccaattttagtgtgaactaaacacagcctccgaattaataaatgcatctcaaaatgaaagcaaaggttagcctgagcgatctaagagtgttcatgtgggacctatattaatcgagatgaaagtgagcattcactgctacagaaatcataatatgtaccggttaggaaccctacataggtgctagatttcccaaccgacctcatagacggtatttgataaggaggactcaaatgtagcagtttaggaactcacacctttaggtatacggtttgaaaaaaaaaagctaactcaactcgaattgagttgagccgatgcttcaaagctaccaaaaataaataaaagaaaacctaataacaaaaaaagagacaagttcacattagagaatcaacaatttcatagatcacataatcaaatattcatcgacaaattcacatcacaaaaattcaaaaaccaaatcaaagaatgcaccaatcacaatggagaactccacctaccaccatcgctcactggagagaggaaggggaagccaccgccactgcacaggggagaatgggaggttatgtggagacgagggagaagccatcgaggggaggcgctgttgaggggaggtgagggaggtgatgttgaggtggacgtcgcctcctcccgctcgctctgccaccgcctcatcgagcccctttcgagccgcgacgctaaatgtgggatgtgggggagagatcgagaaggagagagaaccagctaggtggagaggaggcggccttcggcgcttttggtgctggggagaggcggccggccgccgctcaccggcggactcagagaggagagggcgatgccaatacccccagcggccagcggctagccgctagctcaacacggcaacaacgctgtgcgtgtgcgaccctccccaacaggcggcagcggcagcacgcccttcccctccggttgccctctccaccgtcctgtcccctcctttcccctctcttccggcggtgcagaggtacggcggcgcggcggggcagcgcgcgcggcggcgtggcggccacgcacaggcgcggcaacgccacgccgcagaggcgtggcggcggcgcaccgacgcagcacacaagctgagagcgtctctaagacacacatcgagagaaggattcacaaactctgagaggtatttcttgatctttatttctgtgttcttttatccctaatttccaatctgatgctatccctaattagaacatgatttgaggtgaattgttgtggatcagtggttgaacttgtggtgaattgttttggatcagcggttgaacacttgaacttgaatgattgatgtatcaatatttgtggaatgatggatcatgaaaatatttctgtttttgctgaattttgatgatgttattcagtattcaagtaaagtatcatgttatttttgggctgaatcgatggagttgctactcactgcggggccccgcaggggtcgggggcgggggatgatttccacccgcatgtccactcggggccggggcgggtggagggttcgggggtcgggggcggggctattccagcccgccccgccccgttgccatccctactaataagtcgctctgttttgtatgcgtaggagattagctcccaacacagatagtacactactatagtgtatatagacttgcattggctcgcgactgacatgcagatccacataagttgggccggaataatgggaatcccaactccgtgcgggcccatgttagctgggccgacaggggaacctgacctcggcgctgacccatgtgaattgggccgtaatgcgcgggccaatgtaagttgggctggaatgaaaatcccgcttcatgttaattgggccaaacgggaatcccgcatatgttagttgggccggaacgggatacaaacggatcgaacggcctatgactgcgtgggctgttagagagaccgacgtgtattaggcccaagtattgtgggcccataagaatgttacagagcaagagcatttgggcctgtctttttttcatcttcatattttgtacctgagcatttacgttagtttcatcttcatgtagtttgaaaagatgagatttttacaatggaatcaaattcgtatatatatccattcgttcgcaaaatacctcaagacttaatttataagcttgcaatgtgtgttgtttgtgattacacagctaaaaagaaagagagaagaacaaacaaagaaacggccaaagaaaaggcctgaatcaacaagaagttcctaaaatcaaattaaaaccgaatttctatgcactgaattcatctgaaccaataattcagagcaagccagggcgggagtggaaggggaactggtacatcaagattggagctgatgatgatgatgatccactcttcttcttcctcatctcgaccttctccacaccagcatgatgatcaccatctgatcctcctccaatcttcttctccttctcaccaacttcagcagcatctgcatccttcgacttcgagcagtacagattcttctgctgctgattctgatctacaggttgctgctgctgctgcttcgccggcgacaccttcttcttccccatcatcccagcacccaagcagctcaaacccatcacttactactccaattgatcctcctctcaatcgtatgtatgtacgtgttcgttgttgctcacttgcttgcttgctagttttgctatgatcagattgatctggggcgagctggttttatagctggaggttaggaggaggaagacgacgactgaactgctcaggtggtttcctttcgttgactcagctagctagctgctgctgctgctgccttggtcaccaaggttcttcgtctctactacgcttgcaggctactcatcttctgaattccgagtgagtaaatttcgtggtcaaattggatacaattcgaaagagaaaaggggaagaagcatcgcgtcgcgcgtgtgcaactggacgaaagtggtgatggtgactgaaagtgacaccggggtaattaacacgaggttatcttcaaataccacggattttcccttctttttcttagaagcaccattgttctcatccctccttttcccagaaaaactgctccctcccccctttaaaaaaaatcactcataaaaaacgcatgaaaaacaggtatatatatctctggatccgttgtaatgcacaggcacgtaactagtcagatgtcactgttgttcgtcctcatcttaacagattggtccctgactatagatgtttctaatcaataaatatataaatctcacggtttttgcagttgtggaatttgtacatcttgatccttctagtatttcttaatatcatagacctaataaacctcacagttttgcagttctggaacttttacactgagatccttctggtactcttattatataaataaacattttccattatacagatggatctttttagtgtatttcgtgccacactcagcaaatttctcaacgtcgtcacttgtcagctgcccaaaaaaaaaaagttgaatttacttaatttttaatatctttttgttatagtttgtttttcagtgttgcacatatataaaatatttatctattattttttgtcgcaaataaacgttaattacggtttaatcaccctttgtcagctgccaaaaaaattgaattttgaaacttattttttaatatccttttattatagtttgtttttcggtgttgcacatatataaaatttttatctattattttttttttgtcgcaaattacggtttataatcacccgtaggtgaaatggaggtgcgaaacggtaggagcgaaagcatctggtgctgaggatgttatgcacttgtacttcaatgctttcgttgatgtcgatgagctaaagtttttattagcttaataaaggtccattttagaaataagtttacggacgagtctctgtttgttgaataaaatatgggatggaaccagctgtaaaagttgctgcagtttttctctgaggttgtaggtttggtgtttctcaagctccagttactggcatgcgggccccgctcctgaacgatctatggggccaacaatatcagataatcagaacagcccttaaaccacaactcgagcgcacaaatctctgatgacaaatatcccacatttacatgaacatgtaccaaattcaagccaccatggaattcaaaaacagcacgtttggtggctctgaagtcataagacttaaaaaagttctgaaaagtgaagagggtgacgaactgaaactcgtataaatatatgataatattacgccaaaagatcactgattcttaacaaactctttgcagctacagacactggaattataccgtactattactgattgacaaagc

SEQ ID NO: 81753 - DNA, 7632 bp, Oryza sativa
gagggagatgggccgagccggcccaagagggagagggagggaaaggggtctttttagagcttttctttttataaaatcattttaactttgtttatttcttaataattattatttgtgctctgaaaattccactaaaatttatttacgcattttaggctttttaggaaatatacaaaaatcctccaagccttatttgatttttaactttgcacattttaattgttggaggctttcacatggattttaattattctaggcataatttagaggatgtattttagagtcgttttgggacgtgacacgttctcatctgctccggcagcgtatagtaccaaggagtagacctgaaggaattcttctgggtcggtactcccatcgtacttctctattgccccgggtcggaatctctcaggccatcagacatcacgtagcgaatggttgaaagctctacacccggcgctgggggcggtgggttgttggcgatcgtacgtcctccgtggatgtctatcggatggtgaggatgaagagcaagatgatgatgacgatggttcacttggctccggtgtccgattccgaggacgacgttcgggttctcgagagtcctgtcatcatccaccattgtcgtcccggcgccgatctccattatcatcaccgtcatgtcggtgtcctcgaccaatatcgtccggcgtccgctgttcgcgatcatcgcggtcgtggcggttgtgacgattatcatggcgtcggttttcgctcgagcggcctcctcgctcttcgttctcgcgacgtcgtgaagagacacgatgtcgggaacaattctcgttgtctcgcgcgcgtcgtgcttttcggcagccattcagatggtcgcggagatcgccggtgccgcgaggtggaggggtagctcgttgaggcgacgtccgttgttccggtggttcgctgtcagcaccgccagctgtcggttgttctggttgcgctctggtagcggcctcctcgaacgcgttactgagattggctaccgattcccgtagtcgttctgtccaccgtgcgaggtcatcgttaagtacgggatcataggggatttctctcagtattgcgttgatggtgccgaggtgctgggccggcgtgaccgcttgattctccacctctgcgatagcatgtgcagacgtgctggtcccaccgttggcaaatacgtcgcgtggtgtactggaggatgatgagccatagtcactagtggagataggcacatctatgacaatctacttttgtcatggaagacgcgcaaatcgtcataaagtaacttctatgacgaatttatgacgaaatgggattcatcatagaagtcgcgtcacatatgtttttctatgactaaacagtagatttcgtcatagaaatgcttatatccatgacgaaggtgctcgtcatagaactgctttccagctggctaggacagacgtcgtccatgccacgtggctatcacacgtggagtccatgttggctgtgatgtggcggatgacgtgtacgccacgctggatcatcatctcccgtacgctagagccaagtggcagtcgtatttaacgccacgtgttgacatttggtatgtccacgtggtggtgcaagctgatgccacgtggtcgaacgtggtggcgccacgtggcagccatattaacgccacgtgttggcatttcttatgtccacgtggtggtgcgcgctgatgccacgtggccaaaggtggagacaccacgtggcagtcatatttaacgccacgtgtttacattttgtatgtccacgtggtggtgtacgctaacgccacattgccgaaggtggaggcaccacgtgctctcattttgaagcgccacgtgtacatatctgatttgtgacacacgtctttacctgatgttgtcacgtgttgatttgtttggatgacacgttagcacagtagggatgaaggcccgctcattttttttttcttagcccagcccatttggccacatacttcacatattgttgtggcccatcccactatgagatctaggaaatttttagcattcacccatttcaagcaacaattaatcagaacttcgcagcacataagaaaataggcccaacatcaagattgatcacatggacaaacaatcagaacttcacagcacattacaaataggcccaacatcaacatatatcacatataccaacttcacatagcaccatattacaaaaaagttcacagaacctagcacacatatgttcacattaagtccacaaaagtttgccataggatgacattaagtccaccatagcaccaaacatcatttcacataatcaagtccaccacatgacaataagttcacagaaccatcaaacaactaatataagtagatggagttcatcacagtgcagaagatcataaaggagactaggacagatttaagttaccctgggaaaggctcaagatacgtcgaaggagcaaattgttctcttcctgctgctgcttgaactctgccaactccttttgagtctttgccaaggcttcatttgcaagatttgcttgttcttttagttcgacaacttctgcatggagaatggctaaactttgcttttcagctgcaagttcttcctgaagtgctgcttctgtcggtgtcactgatttcttggagctcatctgcagaccagcatttttcaaaaacgtggtattggagttgtcccgagagagaaccttggacacaacttctgcactagttcttggtgtctcaccatcaggtacaggttcttccataatagctttcatacttgactgcagcaatgattgaacattagctatgaaattagatacatgaaaaactggcagctgcataacacattcaaaatactggcagctgcacaacacattcaaaaagtcactgaaaactgatggaaagctaccaggaagcacaaactagaggtaaggaaacttgtatagaatgcaaatttaaccaaatttgttttccataagccaaaacagaaacaaattatatgagtaagccaagcattcccatatttagaaatattgcattgccctcttaactgtgaaagagaccagaaacattttgagctctaactatggtagaatgtaattattttctatctagcctctagcaacaatgcaggccaaatgcttcttgacagaatctaggatactgttttagcatatatcagaaggctgactttagactatatttgattagctttcatggcagcttttgattgatggaacaccctggtagctataaaagaacaaggttttcccctcaactactttcataaaatttggagggggtgcaatgttacttagcgttggttattttctattcctcctatgatgcctaaatattttccctagaaaccactaatgtttagaaagaaaatactagtgtggagtacataatccctcataattaagtttacttttccaagttacaatgaaataagttttgaagtagtaaaggctgaaatatattcagtcttatgttcatatgattcaaaacctcaatacatgcaaacaccactacagcagcttaggtaaaaatgagttttcatgaatcacaccctcaaacccgggatattgataaaaatacaaactgcaaccaggatcaattctttgttccttcttcaagacatagcgagcttgtgggatgcgaactgagttgccatcctgctgtaagtgcaagttatgtcttttgttcatatcatgcaaatctatcctcgaattgactgtgtcctttgtcttgccctcgattttgagcaatgtgcccaaaatgttgtcacatatgtttttctcaaagtgcatcacatcaagattatgtggcagcaacaaatctttccaatatgggagcttccacagacttactttgcggctataaattagtggcccttcattctctccacgttttcttttcttacttgtatcatgcttacccggtctaacatctttcaccttctctaactgctcgaggacctcatctgtgctgaattttcctggctcaacctggttttcatggtgtccatcaaaagcatggctttttcgccaagcgtgtgtccttggaaggaaacgacggtggccaaagtagcctatcttatttcttagtgctcgtgacaacggatttttgtcacaatgaatgcatgcataataaccttttgtagttcgccctgacaaggtgcttagagctggataatcatgtatgcaccatagcacggcggcacgaagattgaactttctagcactgaatgcatcataagtactaacacctatccataattcaagcaattcttctatcagaggctccaagaataaatcaaaatcctttcctggagatgttggacctgggatcagtaatgacataatgcagttcgatggatcgacagattcccatggtggtagattcaaaggcataacaaggacaggccacatgctatacgaattgctcaccttgccaaatggattgaatccatctgtagctatggcaagcctcatattccttgcatcttctgcgaaagttcgatactttctgtcgaagtccttccaagcctccccatctgctgcatggctcatttcattatccactggcttccgcttgattttgtgccactgtgtgtcttcagctgttcgttttgatgcaaatatcctctttaaccttgggataagtggaaaatgcctcaaaactttgcgaggaaccttcctgtcgccaaccccatcttcccatctggattcaccacatattgggcatagatccaaattggcatattccttcagaaatagcacacaattattcttgcacacatggatcgacacatatccaaggcccaattcacgaagatattctttgcctcatcataagattttggtaattgacattgagggaatgccgaggacaacaacttcaataattcagtgaaagctgtattgttgattcgataatatgacttgatatggagcagcctcacaagaaaggaaaatcttgaatggttagatcctgggcaaagtgcctgcttcgcatcttcaagaattctagcaaaccttggtggctgtccatcttcctctgccgcagtgtatagttcacctattaactctggaactccattgtcatcctcgggttcatacccgcccacatctgtcccttcattatggttagtttcatgtacctgttccaaatattcgacatcttctgtatcaactaattctccatgataaatccaccgggtgtatgttgatgacatcccaaaaatatgtatatggtcatgcatttcttgctgaggcagtgaagtgtggttaagacacctacagcatgggcatggtatgtcaacgtgttcatcaaatctttgtccaacaaattccatgaactgtttcactccctccatgtatgcaggtgtgaattgtctcccatgtatccaagttctgtccatctgctttggcatgttaaaaaaagcaattaggcaaacaaagctaatccattttttaggacagaatattttctaaaacattagatggaacagctggttgctacatgacttaaaccatgttgatttgttcataatactctgacttgtttctctgttcatacaacacaaagcataatctttcatagctgaacttgcatttcatactcagagtaatgtacttatggaaaatcataccttatatctactgaacggcgttggtgatgggctgtgcgcgctgacgacaggattgagagaggaggtgctaggataagacagtgggcgaggagcagccgatccgtctcagtcgtcgaggatcccccgcgccgaccgggatccctccgcagccccaccgaccaagatcacttcaccgcgccgccacccaccacgatgctccacatcacgatgccggccagcctgtggagccgcccttccctgcaccgatgggataagaaacctcctcctctgcgccgtcccggtggctaggatccgcccccactgagctccgcctgcgccgccgccaccctccctccctggctgtgaccaaaccctgcgccaccgcccccctccctccctgaccaaaccactaggtcgcccgcataaagcattcaatcattcttgtgttcgagaattgaaaggaaaactaaaagtaaaacatcatcagcatgaaagctccttgcagcatagtggttaagctagaattatggttagtcacaagtcgtgggttcgacccccaagtgctgcagcattttttttagaaaaaagagttcacatgggctgcacagattcacacatgggctgcacaaattcacggactgcacaaatttgggctgcgaaaaaaaagttcacatgggctgcacagattgacacatgggctgcacaaattcacgtggactgcacaaagcatctgctggcccgaaaacgcacctgtgctgcatatacaatgtggggtccaataacaatctggatagccacgtatacaatgtggggtccagtgacaacctagatagccacatatgcaaggtgggaccaacagcagaatagagatttacttacaactgacgaaatatatttcagcatattgtattaataaaggagcgtcataagtgtgttacatgaatggtgcgcaccattttatgacgaaattatctattgttttatgacaccattttaaatttcgtcatggagtttcgatgtctaccctccgccatgagtgatccatgacgaaacatgaaatttcgtcatagatatgctgtattcaatgacgaaattatacaacgtcatgagcaaaacgccatagatggacgatttcctactagtggtcttcgagcaagtgtaggactgatggctcgtggggatcgatgtcgatcaccccaacaaatcgatccgagatcagcgtcactccttgttccttgtctgcatccctaagagagattcgtgactgctagaccttagaaagcggcgtcttcatggcgcggagaaggaccttacagcttgagaagtcgtgattcttcgtcttgtgaataggacaatagacatcacgagttggagaagtacgctggattccacgctctttgcaggcacgaatctcagcttgtacattgagaaaaacccagcaagcttgcaaggtgtgtttcctggtcttgtggataggacaccagggctttgttacctcggaagttgtccttgtcggctcgtggttcttgtcgaaaggacaaggtttggccgcactaggatccttctcgggctcgtatgacgtcgacgttccgttcttcgctacggcgggaggatccttcgacatggagtcgtctggggttatagccacggcgtcttgcttccggtcattgatggaccagccgagatcggtaccgtggtataaaccgggaagacgatttcgccgacttgagtccacaccagcattgttgaagtagggactccttggatgaggccagtgttgacgctgttgtcgacgaaacttgatgtcatagtagtagaaccttgagcaccaaggccccctacctggcgcaccactgtcgacaggggatacccgtagaccggatatagagggtattggggtacgctggtacgaggatctacgtagtacgacatcaagcaaacaggtaaaatggattatactggttcaggccccttgataggtaatagccc

SEQ ID NO: 81754 - DNA, 3785 bp, Oryza sativa
atatatatatatatatatatatatatatatatatatatatatatatatatatatatatatatatatatatatattcaaattagcgttgaatatttgtccagtgatatttgacaccatacaaatataaaatatgatgtgaaattatttaaaaatatcataacatcatttattacatgtcgacgcatatgtcataatgtatttagcactatagtaaagctattatgagtcattaatggtttgtttaattaaaggaatacaacatgatggtaaattgttcagtcaaaaaaaaacatgatggtaaattgcatgtataatttaaaagttatgaacgtttcaagaccggtgatatattatgtcataatctatgtcgtcaagtttgctacttttatttgcataacatgtaaaatattagaacatagttccatgtgcaacttttttaataaaagcatagttcttaacatattttcttaagataaattatctggcactctattcaatcatattgacgaaattaattacaatctgcctaaaaattaacagactcaatggtagcgagaaacacatggaaaaaattcactcgagtaataatctcactaacatgagttagtgggttttgatattattatggatctaataatttttagatactttttactacttatatcgtaaccccgcactatattaaagaaagtgtaaagataagctatatcaaagaatactcacggcgtgtgtcacgtggttattatagatctaatttagcaatgcatgttggtgagcaaatggttgtcaatactaattgatgcgtgagaaggacatgcaaaaggatataatgtgacatttttttattagaatataggctatttcactaagaaaggctataataaaatatttcgacaacgaatatgacgcacatgtaggtgcactttcaataggattatataaacgtgtgttagaaggtgcatttgcaggcatgtgagtgtgaagttgcgtatgtagtggtgtgtgtgcgcgtgttcgtctactttataaaataaataaatacaatattccatatgtgaacattttttaattaaaatgtagttagtataaaaatatagttaatataggatgcaatatattttcttctgttttatattgaagatagatcctattttaaatagtgaattatggtttaaataatcactatggtagaaaataaagagagtaaaagaaaccatagaggagggtgcggaccatgaactgatcatgtgtatgtatacaaacatattacaggtttgaatctaaaattacgagggaaggatggatttactttttcccaactgtatctacaagttttattttctgcttttttttcagcgtatagtgagtaccacgtgtacttatgtttagaaggacagatggtagatacgcatacaaacataacaacttttggctatgttcacaggtctaggttctaatcctcgtttcccgcacatacgatttccgctactactaaacggtgtattttgtttggcaaaaaattttatagaaatgtggctgtaaaaagtcatattaacccgttttaagttttttaaactaatacttaggctgtgtttagattccaacttttttcttcaaacttccaacttttccgtcacatcaaatatttggacacatgtatggagcattaaatgtggacaaaaagaaaaactaattgcacagtccgactgtaaatcgcgagattacatttaaagaaataattaatccgtcattagcacatgtgggttactgtagcacttatggctaatcatgatgtaattaggctcagaagattcgtctcgcagtttacggtcggaatctgtaatttttttttgttattagtctatatttaatacttcaaatgtgtgtccgtatatgtaaaaaaaaattggccaaacttttacagcatcgaaacatggccttattttttttaaaagaaagctaattaatacttagcattgaaacatgtgcataataataagtaaccccgtattccatattaggacggaaggattaacattttttttcctaatcgtacacgtgtacagaggtagtatgtatgtttatttcctactttcgtccagtgaacagtgcgtatatacgtattttccttgacgtatatctgctgatgacatttttgaccggcacaataccctcgcacctacctgtcatacataggcggaagagaaggggtgggttattttttaaaatctaatctaatggtccacaataatgggtccaccaatttaaataaaaattaagggttggatgtatttctatcacgtggtggtttaagagcgtttttagattgtcacgtggcggcctaagagcatttgtaggaagtttaatagacttttagtatataatagatatttcataaacattacaatcgtacacctgttgtttttttggatttatgcaaaagaagtaatcaaaatctagtgcttgctcacctcaacttcttgaaccatgggatcaacatggatcctcagcctggctggcttcagagcatcaacaaagaagcgagcctgttcattcctggtggcgctgtctactccatgggcgatctctttgccaaacataggcaccgtgaactccaacaggttgccatggctgatctctgattccaaaccttggaagaaatgggctgagacctctggtccgaccaagaaggtcatcttcagtaatccagccaaatttatggtgaacacgctgccaaacttcgtgtacagttcatgcaatatggctggcaaaccactcctgaaaagagtaggcaagagtcgtaggagggcaattgaattcacaacaggtggaggaggtggcattttgcaggtaggatcagtggcacttcttctccttcctcctcttgcaatcttggtgacggctgcagtgatggccagaataatagccatggcgagccacgtgacgcagtggatgggactacgagaggaccattagcaatttgaaaaacgtctgtgcggaaaacaagataatggaagttaggaacttgccctaccaaatgaactctaactgtagttactacctccgtcctaagactctatttctggggcacgcatggttagcaataaacactttttatatagtagcttctaacattgtgaatggcgaggatgggaggcttaaccatacacaaattttttgttagaccgataatttcacactttattcttgtcttatggatccgcggtctatcctccctacctttctatagcctacaaacaggttatatgaataaggaaggtgcaacgtctatatttatatttactcatgtgttagacttatgatttcatcctttattcatatctatctcgttccaattctgttttttaagtcggttgtacggataaggatgtaaagtcctttgcatggataagaatgttgtgcctatatatatttatgctttggtatcaatctactatcacattaagtcaatccattaagttaatctttgctttcacttttttgaaataatagaaatggttcatatctcttgcctgtgctaataaggcacaagagctgtgcccaaaaaaagcaacaattggttcttccacggggaaaaaatattctaacccatatctatgcattatgctacatttcagttcatcttgccaacgaattcatgggatagaaatccatgctgcatactcacacattcaaaaggaacacaaaactgatgttacctaattctcacgatcaatggaacaacggatgcaggtagagatcactcaaatatatatttcagtaac

SEQ ID NO: 81755 - DNA, 22746 bp, Oryza sativa
agagcatacctgaatacaaagtcattcttctcctcgcagaactgtacactgcatatgtgtaagcagaaatagcctcctctcaactatatatactgcccctccagtttccaggatgcatatcctaaaagaaagaaaagaaaagtttccaggatgtatgcatcaacctaagtcaacagcaaccaaactattagcttgcatgtgccacgcgatcgcctaaataaaacaggctacaatagctcgaattttttaaaaaaataaaaaattaaacatgctgctagtattgatgattcagatctgttatcttagtccccgacgaagaaccaaactattcgcttgccaaaaacatgtttacataaataaaacaagctgcagtatcgtttgaattttttttaagaatgaagtgtatcggcgcgcgatccttgcatgtgtgtattacttaggtctcaaactttcaaaatgtatttttgattctcgaactcgttctgggtgccctaaggttcaaatgggtttaaacccattttgtgtactgatgtggtaggtagtacccactttgattcttttttgtttttctctcttctccttctatccttttttcgctttcttttcttttttcctacaagctcgagcaagagtctggagcagggttttcaattttgatttcggccatttcggttctaccaaattttcagtatttttggtacttattggaccgaatatttttgaaattttaacataatttaattgaatttgacaaattttaaccaaattcaaaaaaaagagaaaaactgaaaattttggctgagataatcacttggcgggggtcagtaattttggaaatttcgaaccaaaattacaatcactggtctgcagaagtttgacgcatgcaagatttgactagttcatacttgccggagtttgtaccatacgagccttgttatcgttgacgacggggacgacgccctccagtccatgctctacggcggccggcgagtcgttggtaggggccggcgcagctagcccaggcgaataactggtagcggaccaacgatggctccagcagaggagaatagatatttttatttttatttttcctatgtgactgacaagtgagtcccgctcacacaaatgcatcactgtgatattccggaggcggctacgtgtgcaaatcgtcggacggtgttgcaccatattgttgagggatgtttcacatgtttcatctcttgataaaaattgctttaatgaaaatgttccagatgtttcactagcagagaaaaaatgtttcagtgcttgtgcaaaattgtttcaattcttgagcaaaattgtttcaaccaaatcaatagtggaacatactgattgcaacacaaaaaaccaatgtgtgcaacattgaatcaaaatagaatgaaacaaaggtggtgttcttttctcctgaagataaaaatgaatatgaagattgagttttttacgcaaaacgaggtgatattaacgtaagattgattgagttttaattattacaaacttaaaaaatagattaatatgatattttagagcaactttgatatagaaagttttcgcacgaaatgtatcgcgtttaacagtttgaaaaacgtgccacaaaaatcttaatattcatccaactcttgttggagaaaagaacatgacctaaggtctagatcagagtgcaacaaaaatacaaataagctacaacatcactaaaattcgcaacaaagcccacctttgtcttcttctattccggtcaccgaaataaagcgaacgacatagggagacaagcgaggtgaggtgaaggtgtagatgacaacaagggcaaacaacgatatcaggagggcgacctcaccagggccagtcatatcggcatccggtccaacgccaccttcgcgtcgtgagctcacagctgctttgccggtggcaaaggtctagcgcctcatcttgtcctccctttcgcgtcagcctgatccatagtcaccagcaaggtcgtcggcatcctcccccctcaccgcttcgcgttgccccaccaccgccagcatggtcggcggcgtcctcctccctcttagcgtcgcgctgcccgccaccaccagcatgtcgccggcgacctcctccctcttcccgtctcggtggtcgctggcgacatgctccggtgtctctctctctctctctctctgatggttacgagaaatgagaggataaggttgtgggaatgacgggtcgaatcaatagtgggccccacctttcgtttctgttccgtccgatattttttgctccatcagacggtagatgcaaagcattttcgtgatattccacattagcgaagaagggagtttttgcccgtttggatttgcatggaactcaagacaaagtttagagacccgaaaatatattttgaacgtttagggacgtagatgatacgcctgtgaccggctggaccgctcatacacttcactcctttaattctcaggtgtgactttgatcgtgaacttttatcggaataagtttataaaaactaattaattattttaagagattatgaatggattttttaaagataaatatacacatattttttaaaaaaaattaatctaagtatttagaattcattgatggttagagttctaaaagtttgataaaaaaaatctaaatactccctctatcttaaaatatgttatttttctttcataaaatgtaagggattttgtgcatttgactttatggacaaaatatgttatattttgtgatataggtggtagcaacttataacatttaaaatttgtcatagtagttcttttttcatctatttattcatttcaaccgatcataatcatgcatctcatatttaattgtttacatactccctccgtactcataaaggaagtcgtttaggacaatgtttaagtcaaaccttgggaatataaatcatgaataactctcaagttgttgagtttgaaaatgtaaaaattatatgaatagatttgttttgaaaaatactttcataaaaatatacatatatcacttttcaataaatatttttatagaaacaagaagttaaaagttgtgttttagagaccgtgtcgatgtcctaaacaacttcctttatgagtacggagggagtactttctagtttatttaagcaagattaaggttaagggaaatgatttgtttcacttattttgttagctaaattctaaatcgttggattccagtcctatgtatctgattgcctgaaaatgcttgaattttcgtgcattgagatcagtgtctgaaatacttatatattttgtacaaatcctataataaatacttgagaacggatgtggtacaacgtttaattttgctgcattccgcacggaaaggcttttctaatcggtagctgctatcggtgcctttcagtctgattggtgtaagatatatttagaaatacgggaaaaccagatcgggacgctaaggtagtcaacgtgccctgtatggattcgttatgatcaccgttttttcctagagtgtatttggtgctcatttattttttttaatataatggaataaaaattctggccattgcttaaaagaagctacaatcacttattataaaattctctcaaatagagcaaacacttagacaacaataagaactgaaataataaagccaacacacaagaagaaaacaattattgaagtctatttgtgaacatccatccctagttggtgaaaatctacattaccgtatttggtactcatttatgaccacaaagaacgggtgtggctaatgggcgggtgatcgcccatagtgatcacccccatccccctatacgctcctatcccccttcctcccccccttcttctcttcctactacaccataaatttttaaaaaatagaaaaaataaagttggaaaattttatgtatagaaatactatatacataaaatatttgaattcaaattcaaatttgaaatggatatgtaaacttttgacttataaactttgagtctataaactaatatttgaattcaaattcaaatttgaaacgggtatgtaaacttttaacttataaactctaagtctataaactttaggtgtataaactttagatgtatagaaatactatatataaaaaatatttaaattcaaatttaaattttaatcggatatataaacttttgatttataaattttgggtctctaaactttagatgtgtaaacttgaggtgtacaaactttaggtgcataaatttactaaaataggaaagtaatgcggtgtaaaaaaggaaaccgcgtggaggaaggaaggtgatcgctaggggcgatcgatcgcccgttagtcttttcgacaaagaactatcgaggtggatcttacgacaaattaaagaaaaaattctcaccggtcataaatttttttgtttaacataaaactttgtgaaccgacaattttatatttaaaataagtttataaaatctgaggtattattatattgcaatattttttcaaggcaatttttatgcattcttgtttcttatgtgagcattttgagtttgatcaaatcttgttttaaaggttacacatttttgttagaaacacggtacaaaatataggtaagcacaaacacacgtacacatttacctttaggaccacacacctacaggtggtaatgggcctaattttagtctatgagggctgggtttaatatgtgatggacttaatttctatatatttttagcctaagaatatttgatggataggttggttatgaaaaaactcattggtcttgactcattaccacctctacccacatcctagcgctatgagtatctccaagagactggaccgtcatatcttgagattgacgaagtcaccatagatgtcttattgcctagtattactttagctgcacaggtagtctgatcgataaacgcagctatgatgtggacgacggaaccgaggatggctgtagaagatgatgcccaggcacaaacccgaaaggggcctccctagattggaggttgaggaagccttgaccaattgtgaaaacttcagccataccttgaagaaccatcgttggagacaaggatgaagactaacgcggtcgctactagataaccggagatgaacatcacggccagcacaaccttcattcaagcagatcctccatgaattccgaccattaattaatacgttgtccaaacgatgaataatgaattgagtattaattattataaaattgaaaatggatttattttgtaagtatttttttactttaaaaaagaaagcactgtttaacagctcgggaaactaatagtgtgctaaaaaaaattgagatagtagctcactctaattattaagctgaatcaagcatgccccaaatcttacacatgactcttgtgccaagactaaaacacaggaaacaaatctcataaaggataaaactaccacatgaaaatgacataaatgttgttgaacactttctttgacagagaattgctgagtacatttgtgggagctgcaggctttttccttttgacttgcttcctcacaagcagttaaaatgggatgtcttgaaatgattctcggtccaatatgaataatatttgagaacttttacaggacaatatactgctagtatatatgatctaacagtgtagattgatttggttttttagttaattagattacagtataaagtttgaaagggtaattttgtcttttctttgttattctatcatcaaatcgtgctatcgtcacgtgcttcgtcatcaaatagcgctcaggatgctcctcccctagcgcatgataagatccagaaccgggtactcctaattagattcaatctaaaacaaaaattactaaagtgttgttttattttctatcaaattcttaacatacccttctatatactgctagtatatactggtagtatattgtaccgtaaaagttctttaatatttaactgctttcaataatctactgctttgtacagaagcttgggcactcccctttcctcatccacgctttttttttctccacatgtacaatttacaatcgcaaatgcagacatgccgactgcttttgtccacatgtttggttcaggccgcttcccttggttcgaaacacgaactcagtgtgtttctttgaaatttaaatgtctgtgctttgctatgaattaatttgaattatatgcatgcactcgtccctgtagataaacttgattttagggatgaaatagatagccacaatgtgtagaatgactatcttgtaatataaaagtacataaggattagatggtaagaaaatataacatagacttggtggtgtggcagtctagcagattcactaccaccaccattgccttcttttagaagagtatatctagccagctcctctgagttatatttccttttcttttcctaacatacatattggcacatatctatactttctatatatattaatagtacataacttcaccgtatctagtaagtacataacttcaccttatcggttaagaggtaggaagcaattgccttctcttgtaacttaccatcactttcccttggggctcaggcacaagcttactccagtccgtcttaggaaatggagacaacaatttgagctcaaagtttctcagcaaatggctccagatcgccttaatctgcatgtaagcatagttctcgccgacgcagctgttccttccaccgccgaaagatgtgtaagagaatttcccgccgaccttgtcctcctctcttctaggaccaaacctgtctggatcatacaggtgagcatccttgtagatgtaaggcacacggttgctgatcactatagggctagccatggtgtgccctgccgggacacagtattcatggccttctctcgtccggacggtgaactgcctgagggctgtcctgacgatcatcggcgccggagggtgcagccggagcgtctccttgatgcagatgtgcagcatgtgcatctccatcaggaaaccatagtgatctgtgacgattctgccattgatgatgccgtgttttctgacgatctgatcctgctcgtcgacggccgcggccaggaacttctcgtgggtgagcaggcgagcgccggtccagacgctggtatgggtgctcgtgtgcttcgcggcgaagagaacgccggtgatgaggccagcgacctccgcctctgtcgtggcgcgaccatcggccttgtacctggaacaatgttttaaatagtggtttaaggcatttagcagttagtttctcaaacagctatagcggcaactatagtaggctaaatggagctatagcggctaatttgtacttcctccatttcatattataagactttctagcattgcccatattcatatatatattaatgaatctagacatgacaatgctagaaagtcttataatataaaccggagggagtacatgagagcaaatagatagaacccttctcaaacagctatagcgagagatagtggtagttatagagggagatttaaaaccctgacctggaatcgataaagctctggagcacgtccttgtcattgacctcctcctgatctccctgctgctgcttgcgggatctcacgatgtcggagaagatggcgtggagtctctcgcgcgccatgtcgcggcggcggttggaagggatgagtggggtgtaggggaagaagacgctcatcaggttcacgccaccctcgatatcgcggaacaggttgcagacctcgtcgaacttcgtccccatcacctccttgccgaggaggcatcggcctgagatcaacagtagtagttgctccagttcatgtttcagatcgaccgtgccgtgttgcccccatttcgcaaagtagtcctgcagaacatgtaggtgatgccaaattgtaagttactgaagcttgtaatgactgggtgccgtatgtacaaatcttgatctaattaatcatctcaaaagtgtcatccaactgtagtcaggtttcccaaactgtcggggtcggagttaccgcgcataaaaaaaatcacttaagacctatttggcagaactctccaactccgcattataattaaagtgatcatgtgtaagctaatcttcagatcttataaaattagaaacttacacctccaactaactcacaagtaagtgtcgttctagaatccgtgcaactaacccaacctgactttgaccaactttggaatataatagattttgggcatacgaaagtaacacaatagatcagatttatcttaaatttggaggcaaacataatcataacacttgctaattacaattacactgttgcttacctcaacctcttgaaccatgggatcaacatggatcctcaacctgaccggcttcagtgcctcagcaaagaatcgaccctgctcgatccgggtggcgttgtctacgccatggccgacctctttgccgaacataggcaccgtgaactcgaacaggtcgccatggctgacctccgattccaacccttggaagaaatgagccgagacctccggtccgaccaagaacgtcgccttcagcaatccggccacgcttacggtgaacacgctgccaaacttcgcgtacagctgctgcatcgtggctggcacatcgcctctgaagagagcaggcaggagccctaggagagcgatgcaattcacaacgggtggaggaggtggcgttttgcaggtaagatcagaggattcagataggcatcttcttcttcctcctcctaatgcaatcttggtgagagctgcagtgatggcaagaatggccatggcaagccacatggcactgctactagttaactccatgtttgttgtagcctgaaggtaaaacatggagacaattaagtagcctggaaatgcgacaagaagatgaaaatgactctgaactctcatcttggatttaagtgtagtttccaaccaattgtgcatgtgcgatgatgggaagcttagtaagcaggcccaagaaagagagagagagagagcatcaattggctcttttcgcagaagaaaatgagaatctaatccatatgacaaatttctgttcatcttgtaaataattcatgggataaaaaccatgctgcattcaaatcgaaaactaggtgtaatctgaccaaaatccacggcttaatggatgcagaatgatgaacactccagtataaagttcgacagctaataaccaaagaatcgggtcatctaattagcgaaattgagaacagagcatacctgaactgaatacaaagctattcttcaacctggcagaactgtggtcttcatgtaagctagcagaaatagcctcctctgaactatataatctgcagtgatggaaacagcaccttcaggaagcatctaatcaaagatgaagtgaattgtcaatctcttgtaatagcctactagtataagtattagcttgcgtgacacatgcccacataaataatacaggctgctaacctgctactgtgtagtacattgtatgattgactattgatcaatttagaattgggaaatcatgttttgtttatggttatgaaacttctggaaaaatttgataacgtagataattatgtgagatatcactacactaacatacaagtttaaatttgacctcaacaagttgaaaaaaaaatcaaatctgactgaatagtacttatactactcagggtgtaatttgttttcttatcaaatttgaagttgattttttgcaagatgatagataaataatgtaccaatattgtcccttttttaaagattttttataactatttaaatagtatttgagataacaaacaagagagtagacatacgcttaggtgaaaaaacagaaccagttccatttagagttagctagtcgccgaaggataatcaaaatatatatgtccaactgattgaattagaaaatatgccaatatggacaatttaggtgggtatagcctcgctgctcatgtcacaaatatgtcgtttgctattttttcggtcttcggggatgtaactctgacgaccatactttttatatacaataagtttatgaggttacgaaagtaattcaagacaagaatatgcataccaattttaagttttcaaattaagtattttagaattcttttatggttggagtttcaaaagttgcatagaaatcaacaacatatttgatatatatgtaatgcgcatatttgatcattaccgtggaaaatatgggtaccgggtattcacacggccttcatgttcgactagatataggaggtatgtcagatccatgtactatgtaatagaagagtatatgtaatagaagagtatgacttgatcgtaatgttgccttgtgttatatgacaggacctataatatcgatcgagtattatcatgtgatagattggaaaactgatgtcaagtccgattaggttttcctctttgtaatcctgccccccaacctatataagattggcaggaagccctccaaagacaaatggcgagataagtcacgattagatcatcagatcaatacaattcccgtggatacaatccccaaacagaattagggtcttattaccttcgtttcaggttataaaactttctagcattatccatattcacatagtgtctagatctatatatatatatatatatatatatatatatatatatatatatatatatgcgcaatgttagaaagtcttatgtccgattaggtttttctctttgtaatcctgcatccgtctaatttcggtcttgtgcgctacatttttctcttaccgattttcagaattgacaattgtctttttctaatcatatacaggcagcgtttgcaaccgtgctgcaaaacaaggtctccaactataacctgctggctgccttgggtgtagccgtgcaggtgtgcaccacattggaaatggtcgtataaaagccaccacctcctataatattcttgcgtgattgattagtgtgcggtagatgcggaaaatacggaaaccagatcgagacgccaagaagtcaacgtgtcctgctaatggattagttatggtcactattactttttgacaaaattttgtgaaactatatcaaactattacaaaagtacatattcattataatatactcctatcatgtcttatgactacacacaacatgtcttatgaaaaagtatggtactcctagcagtgataaatatttgtcattctattctaatcaaaacaaatatttgatgttctagacaatatttgatacaattttgggaatttgattattaatttctgtatatttagaataaatgtataaattacaattttataaaatctaataactttaagatggtatgatagtgcttttcatggaaaaagttatatatagcatttcaagtaagtatttgagaattattgatgatcaaagttttaaaagtttttatcaccttttacgcgtccctaacacacgctaggaatgaaattggaggcactagacctcagtgcacgggaaacgtgcaatcccactgaacgcgcacgcgtgtgtgtaccctattacctagccaggaccaaccgaagtcagtcccggggaaagaggggaaaatccccccgggcgagcacgagtgtcgaacctggggtttgaacgctcgcgggctgcgtgcccaccagcgacgcttgccacctgagcaagcgctcggtctctgaacatcaaatatttattgtctgccgcagatgccattcgatgctaaggagaaggtcgagttcaaatcaccgcaaatctggggccagggctatcaacgctacaaacgccgacatcggcgatgcttgtcgacgccatacaccttcctagatgcgatgtcactgacgcctcatccctctccttcgtgccttgggatagtctccgggtcaaaacctggtacggatgtttggagtattgatgacgatattgtagatgtgatcttcttaggccatcccaaccctccatgtcatatagtttccatagcactaaatacattgacacataaaaaaaaattctatgtggcaagagagttaatgatgagagaggtaaaaagatgaagaaacaatttctcatgcaagaaaccatttctacacaagaaccaagaataaaattaaggggataggtggataaaaggagagagaagagaggggattggatgagaatttaatttgaagacaccatccattaaaaacatagtttctacacatgatatctatatgaaatgacaagtatggaaactactagatgagttggggatggccttaaagacgtgtcgtattggaagttccgtaatggtgggtatctttagcgttggatcagctctgattgtaatggtggcgtctaagatctggacgtatgagtgaatttagagattacagttcagttaccttctgacgttatcttctgctttgattttacgtcacatacacatggtgatgcttcaattgatggagatggaaaatcgaattatcgatctcgacctgacataacatacattggtcgtcctgtaaggcatgtttcttttagtttgggattattataatccagattattgggagtaagctgaaagaaacagacaacttattgaagtagcttattataatctgtagcccaacttattataatctgataagcttatttaggtgagctttttctagattattgggtgaaaaattacccaccatgccaccccactccctatttagacttgcaaacccaataatctaggctctaataatctaggaaagaaataactaaccgcgaaagaaacaactaaccgcttattctactacagattataacaatctagtttatagtaatctgactcaataatcttatattataataatccaagttgaaagaaacagggctaatccgatttttgatggagattatgcttgtgggcgcgcatggtggcccacaaactgggccctgctccttattgtggcctttgtgggtacgaattcggcggcccaaaaacctctgtgggctaaggcctacccaaacccgtacttgtgcggcccaggttgggtctacgggtccacatggaccgtcggatcataacatctcgtgatgcggatcgagctataattttacggaagagcccctgctttaacctgtatttaccgtttaagcccctccccatactaatcacggcaaaaaccccttgccgccgtcgacgccttcccgccgccgcccgacctcgccgtcgccgccgatctcgccggccacctaggtggtcatgtaactgattccgcgctctatcttcctcgcctgtctccgcaggtatgctacacgggcgcaaatgcgtgagccggctggccgctggcggcgtggtggaggcatcgccggcggccaccgtggagaggccagcctcgtacctccgccagctagcagtgttccagaccagcaggtttatctctcgttttaagcctcctcattagccttcacttcttcatcggttttcccacatctctgatttaggagtagcttttgtaggtttgctccttgcagtcctctccctgaacatattctgaatgtttactcttgagttttttttggataatgaaaatggattatatctctggtctctattgtaagacaggtagccataactttgttaaagaaaaaggtaaaaataaaaatggatgaaaatagaacataagatatgggatatttattattgattagcgttaaaccatgtagattttttagctagcaattctaatagaattacagcacccatagtggaatacaagaccattggttaccaattccaagagtttactcttaaattctgaagtaacagataggtatattcatgtgcaggagaaattatcagtatctgaactgcaacagtatgctaagttgctaacatgtttggttttgtttatggaatgggacaaaatctttgcacatgccaattctacaccaagggtaaaacaggatagcatatctcacagggatacaattactacatgaaaatgagaatgcaatattattgaaacactctcttgtaactcagagttcagttacattggccccagccttttcctttgactgcttctgcttacagcggttaaatgggtgtctgaaatgattttcagtccaatatgaataataataataataatatttatctgctttggatatcctactgctttatacaggagcttggctctgctggcgcggaacgtccataaccagttaccggtccagcagcgatccctctatgattcagcaagcacctgaagcgtgccagtcttgcgctgagcgctgctatttcccactcctttgaaagcttctcaaacggagtccacaaccgctcttcaaattaacaagtgagttttggtgagataagaaaaacttttctgttattttgggataaaagtttacgaattctagctaatcgagtatataagagtgagaagtcatgtatctgattatacctgcagctgctgcagcacgtggccaaatggtttgctgaatgtcagacgcatctatgtgttcagcccacatgcatacctcaccaccaagaaccaacttctgctgtgccgggttcttgatatttctcagtggttcattcatataaaatccatcccatgtaacttccaagtgatctaggtaccacttatcctggttgctcacaatgcatctcaaaccagcagcaacaactttttctgcaactccacctccaagcctgttataatttgtggtgaaaaatactagctgttaatttccaatagctgcacaaacagatgatttctggctgggtcctcctaattaggagaagaaactgcactatataatggtattgaaacttttcttgcaatcctttcaccttttcttaataaaggtttgcaatcccattacttcaataaatttccttgtttaaacaacattcctctagttttatattacttgttggacattgcaaaatacagatactaccataagttgttctctatgaatgggcatttactgacgtgtaaacaaactatgcaaactaatttgttcaaagagaaatttagtgccatcacaatgatgtataaattgacaaataccatccaatgtaagcataacatatggtcgcaggaccaatattagaaatatctaatgacatattccagcttggtgatctttgccttcttcaaatgagaatgtgctatatttgagatttggcaaatgtggtcattgtttcttataataggcatgacaatataatttggcaagagcatacaactttgttttattttcttttcctaacaaggatgctgataattttttatataatgacaatcaagaggcagttaggaaataccagttatgcaccacagttctgcggtctagtttgtctccaaagttgttaaaggtttcttccctacaaggacaagaaagtgtatcaatagctatttgaaagatctagatctgcaaaaccaagtcacataccagttaataacttcgtagccatgtgattttgctatcttttgagctctcaatacaaaatatctgtaggcatcagattctttcataccatgttgggccaacctgcacaccaggaaaaatacttcagattagatcaaatgactgatcatccctgctacagaaggacctggtgatggtggtgagtcggccatcaccaacacatctacaattggtgggatcttctgcaggtagaaaaatagatgataatgcatatgtcatggttatttatgggttgatgcttggttgcaaaatgttttggcctcagaaacatatataattttcatgtttagttcttatttttttaatctgttccaaggctcgggtattttgctacaataaagagaaaatattgtcaataagtgcatatcaagtatgctggtgctcttattctttatactagttctagataagagcataccatgctttaacgcgtgggggggaagtccagcaacctgaaattcatagtgagtaattattagattactaaactactatatgatatgagatctgctgctctgcaggggagatacttttgcagacttacttgtattgacctcatcacctcccaaatggacaaacttgaacttaaaaaccttgctgaaatctgaaagagcatcaaaagttattagtgaatattatacaagatcatcaatttgtttttcacaatatattcattattcggttcgttgaactgcttttttttttccttttgttggtaagtataagataaatggctgtttttttctctttcaaagtaataaaagtaccactcaaaatataacgtgatttctgttggtaaaccgtgaattacctgaaagaattccattaatcacttggaatgtagattcgctgctgacatcaagtggttctttacaagtagctgatggccacaacgacggataaccaacacccctaaaacaaaaagaaatgcgcaatttatttgcaaccttttgatattcctactgtcatatctagttaaataacttcatccgtaaggcactgtgctttctggatttaaaaggtataccatgagtacaacaaaaacaaaggattcaggttttcatcagtaaaacctgaatagtcatggagcatatgctagagaagaacagcattggcatattaaatacttaccatgagagagcatggccaggaacatcaatctcagctaagacattgacacctcgtcgttcagcatacctgcagattattgataagttatcttaccttggttaaatccaacagcatagctaactgatctctaaattgatcacatcattctccaaagaaggaatgggttttagagttttgttttttattttctgctgagttccctttgcaatatttatataaattacttaacgtggttttactgcatgctcttagctcctgttacttcatagtgaaggtaaataaattcttatgtccagccataaccttagagtgatatttgctaaattctgctctttcacatgaaaaatgaaagacagaaaaactcactgaacaatgtcgatagcatcatccattgtatatctctctgagtaagagtatgcaccattccataattttgggtatgaaggtatttctataggaaatgactgttcatccacgatatgccaatgaagaacattctgcatgatgatagagtaagcagattatatgatgcaactaaaactaaaggaatatctggagaaggaccattgcaatggagagaattatcaatcaagattgaagaactggtttcttgtgaaaagatcaaacctaccaacttgctgtaggtcatcgaatcgattacgctttttattactgggacaggaaaggtaatgccttgaagtatctgtaggatgccagtgcattgagttgaaaaaagatcaggtattatctttcctcaaactatttgaggacaatagtagatgtatcagataaatcctttaaaagaaagagatatcagacgctatttttacatgcacaatatttactgattcttcatataagcctagtatggaacatgtggagtaagtatgagcatccatcttagaattattcatgatggtggttaacaacaccaaaaaagaaaaaagacttgtgaacaaatggaaaagagattatgaagaaatggaatatattttggttcaaaacttctgatagctgtaagggtttatattaatggaacaatagggatggtccctgctagaagttctgaaaaaaaggacaattcacggcaatatgtacaagagcaaatacaagataaaggagttcaacggaggaaggttacaaggtactatttctcccatggatcaatgctagctttcatttctagtttcaggcttatgatatggtcagtagattgtgagtatgttacttttacaattttacttatgggggtgagcaacattaactatctggatgctactgttacagtcaagtatatttattacaataccctaaaggccttgatacaactgttgttgacaaaaccaatccaatatttagaatatatctcaccaataagaagccctcgataaggaaatctgggcatgtccgtgatgctccaaggggcagactgaagttcaattaaccttgaggtgaaatcaaagttacacaattggctaaacgtctgcaacgatagaaggtacactgttagattgtctgaaagtgatcgtgttgtcttttttatctatgatcatccagatgcattgagtggataaaccatgccaagttaccttcaaggcatgaagtgctccaaaaactgtttgggcctgcaataaagacatagtgaggtgacagcaaaaaaaaaaaagtgtcacaattcctagaactaagccacacgatttcattattttccgtgaattctcaaaggaagaatgtctgcagttaaagtgtcggcatctgatgtcatattctgccaacctttcatgttgacagcacagttagcagagcatatattttttttatcactaacctcaatttgagcataaattggacttccagttgcaggcactgacaaattgtataattcatccacccagaagttgagctgcagaggacaaaatcaaccaaatacaggtcacaagaaggtaagaaaaaaggagaacacccaaagttcacaaggctttacctcatcgccgggcaaatgcacgacgacattcacaccggcgagcagcggcaagccctgggagctgccattgatgacgtggtccagctctatcagcgtcaccatcctctggaacgcgtccttcaggatggcctccccgtcggcgtacttgctcccctccgccgtcatcctgagctccctgctgacgtgcagcgtctgcccgcctttgctcgccgtcgccggcattggccacacctcgacgacgctcccctcatcggcggcgacggcgcaggacaccaccgccgccaccgccaccaccaccagcaacctcagagccatcgctggcgccatcctatccctgcaagaaacccggcaagtacggcttcacacctactatatgtagcagaatctgcaagaaacgcatggagaattttaagagattatattaactgcgacgaggatctcgcacctacttgaatgcagcttcaaaaaccgtcgccgtcagtaacgccggcgaccagaccacgccggagcaagaagatgaagagaaacgccgttgccgattgatccggggatgtgccgaagtggaagagcttaataatgtgcacgccagcgactaggtgggtgcaagaaaaggccgcaacttttagcgcccttttgcctctgccttcccgccttttgcaagaaaaacaacaagaagaagatgatagtgcatcctgctcctgctgctgctgctgctgctgcctttatgaattgtgccaaactatggagtgcacaggtggatagcagtggcagtagagaacatcagtaacaatggtggctaatgcagccacaacacaagcatgtgatgtgatggtgtggtattagtgtagggagagatctgtgcttggatgtggaggaagggtactctctccgtcctaaaatataagatttttatttatgaatgtccagattcataactaaaaattgctatattttgggacggggtagtagttaattaggttggtaggatagggtaggggagagaaatgtggatgttttggatgagtgatgatattgttaacaatggagtcttttttgctgaaatgatcagaggagaagaactaagggaatggaagggagtgtgcctagctgccattatcaggtaggtaaaagtagtttactgacaaatgccgagcgttggagtatcacttaagattgtgtcttgtgtagttgtgtgcttaaagcatcgagcttccgtctctttgaacgtgtgttaaaatagcgtaccagtagattacatgtgtgtaggtagtgtacgtgggtgatgtgtaagtgcatgtctcattaggaaaaatgataaaaatagattatagggacagagaaaaaatgataacaatgaatgttgctggatttgtttttccttttttttcaggattttggttggcaggagctctatttacggtgtgcagcagtaacagaagggggagcatctgttggcgtaattggtttggtagatcacatgtacatgtccttttctccctgtccagtgcatgactactgacacgtgatggtccttgatctcgtgactcgctgggtctcgtggtctgcctcggattatgcttactccattctggtttagtccctggatcccatagaaaaccaaccaaataccgaataccgaatatgatatattctattgttacgaatctggatatatatctgtctagatttgttgtcttagaatatatcatacccaattctatattcactttttttaaaggacagaaggaatacctaactcttaataaataataaaaccagaccaatctttttccatgtgccagtgagagaatgtttcatggcagggatgggagactgatcttctatttgcttaggatgatcatccgcatgtgtaatctgcagacctgcagaaaacaaattcattaataatcaggcagggggtgcaacctgcatttgagtgaccatcctaaactggaaggttgatcttgctgtaaccagcatgttaggcactactgaactcataattaaggactactgttcgagagtagttttcacatctcgtgctagattagttccgcaggagattctaccagatttctcctaccgtcggttgccatgatgaccgggcttacttatggtacaataaaagctcaataacaatttcaaataaaaaagttaaatatttaaatatttttttaccgtgttaactggaattaccatcgggggtgctgtaaccctttcgatgtacagtaattaaaaccctggggctttgcgcgatcccgaagagcaacaatcagttgcctttccgtaacgctgctggaatctccggttttggtcagtacagagcttagcctgtccagttaatgttgcgtgcgactgcgtgcggtgcggccatgtgcagctgcggctcgtcgtaatcaagtccatcaggaccattagatcttatccgttcttattttagagaaagagagagagcttgggctactgatccaggctatatatgattagggcatggctaactcagggtaccctctcaagtaccatgtaggatgggacaatactcccagaaagctaatttcttatagtgctagttactttaagtggtagtcttacatttttatttcagcttctagtgtttttccatttagtcctcataatttttcaatttatatagaagttcaaattttacactaaacacctcaaaatctagaaattaatataaaatctctcctccaccctcttcttcctagttcccattgaaacccaatccccctccccacatctcttccacttcacgcctctccagcttgagttctcctcccactggctctcctcttctctcccctccccggcggagtggaccgacgcggcggtggcagatccaagcggtggcggcagccgggatcgacgcggcccttctctccagtccactccctctccacattcttcccgacgtggggtgccggcttggggtgaggcatctctccaacacggctcctcgcccgttcctcggccaaaagctgacgaaactatgcggctctctgctggggtcgcggctctatgtcggggtgcggtcctggccgagctgttaggaacccaattcctccaattcaatagcaaagatccaccatacaagcaaccattgttttggggtgaaaaagaaaagaaaaactagggaatacaagttctagaagcttctaaaactaggagaggtagctagaggtatgaagagaggtagaggagagagatcgccaaggttccagcccggaaccaggacgccgccgccgcccgtggccgaagccgccgatgtctgtgttctgttcgatgccttccaacaatgctgctgctgcttttgtatgctgccccttctgcttgcttgggcctcgcttggacttggctagcttggcccatatacagcccaattacgttccgttcagctggacaatgccgacaggccctacacgttagtgcaccgcgtgtaggcgctgctcggcgagcaccaaggcaccaaagcattatgtatcgttgagagttgtgttcacatcaaatacattatatatgcactactttcccagcccatgtttcagtagtttgatgtctctaattcaattgacatttcttgagacaaaataaaattggaggagacacatgatatatagtgtgatggaatgtgtatgtctaaatttatgtagtacatcagccactaataaggttttttttaaaaaaaattgtgtatgtttttttttctgcctgataagaaaaaaatattaccccatttttactaccattaagcattactagcttttatcacgacacaattcttcgattactccataccggtatagcctctctcttaaaggtgcgttggctcatttacatggcctctttggatcgagattttcttttggggtgtatttttgtgaataatgttacgatagcagcatcagcatgcgcagaacgtcatgggaaatgctgctattgtcaactatttggacagcccatgcaatatatatactattatgaaatatactattatgaaagacactggtgattgtggttttgccaacttttatactttttgcaaattagttcctgatgtttcttgatattatataatagtataatgtttgtttgaatcaagtgaatattatgtattcaaataagcaaacaagttcatgatatattattaatattttcttttactcgtagc

SEQ ID NO: 81756 - DNA, 32349 bp, Oryza sativa
tgagatagaacaatcccctttgatgaacgagcaatttcaattccaaggaagtagcgaagaggaccaagatccttcacctcaaatgcctttcccagcctttcctttagacacctgatttcttctacatcatcaccagtgatcactatatcatcaacatacacagccaagatggtgatgtgtgtccccctatgtttgtaaaagacagtgtgatctccattacactgagaataccccatatcacacactgcatgcctgaacctatcaaaccatgcacgtggagactgcttcaacccatacaaggatttcttgagtttacatacttttccaactgtctggctattcccaaatcctggagggatctccatgtagacctcctcatgtaaatcaccatggagaaatgcatttttcacatcaagctgatgaaggggccacccaaagttcaccgcacaagataccaaagctctcactgtacccatttttgccaccggtgcaaatgtctcatcatagtcaattccatatgtttgactatagccttttgcgactaaccttgctttatacctatccaccttcccttcaggggtttgcttcactgtaaagacccacttacatcccactgcccttttttctggtggaagttttacaagctcccaagtcttattcttcacaagggcattcaactcttctttcattgcatctttccactttggatcctgctttgcacacttccaatcctttggtataggcattgtctgtaatgatgcaataaatgttttgtatgctggtgaaacatgagaatatgtgatatagtttgcaatgtcatgcataaaactaagatgctcaaaaccaagacgtataggaggtctaccagcattggatctagtctctctacgttgtacaagaggtaattctacatgttcaagagttggagaagtattaccaattgtctcaagagaagccaaggaggctggaggagagagactctgggaggattcagggactggacattttgggtgtggtaactcttcaatttgactttgcactaacccttttcttttctccccctgactatcaaaccgcctcctttggtaaaccagcacatccttttgtttcaccctttcggctccctccataggacatggaattgtcccaacaactacttctccttcttctccatcctcttcatgagggaccatttctctatcctcatcttgtgtatcttcaatgacttccactactttactcgcatcatcaatagagcatggtattgatccaatcactactgcctctccattcttgtcaccaacatttttttcatgtatgtcacctctctctctctccccctctcgactatcaacctccatgacagtcgagaattcctcaagaaattgatcaagatctcctttacttttataatagggctcaaactcacgaaatgtcacatccatactcacaaacagtcttctcccaatgggatcccaacatttataccccttctgactcgaagcatagccaacaaacacacactttactgcatgaggatctaacttgccaacagaaggtcggtgatctcgcacaaaacaaacacagccaaacacctttggaggaaccttgaactctcgcttacccaataacagttcggcaggagacttcataccaagtattctggaaggcatgcgattgataagatatgctgctgtcatcacagcctcactccatagatactttggtacattcatctggaacatcagagatcttgccacttctagcaaatgccgattctttctctcagctacaccattttgaggaggggtgccaggacaagtagtctggtgaataatcccctcatctgagacatatgacacaaattcattattgatatattctgttccattatcagtccgaataatcttaacttttgcatcaaattgagttttcactaatttatgaaagtcttggaagcaacgaaggacctcacttttgtgtttaagcatataaatcccagtcatacgagtgtgacaatcaataaaggtgacaaaccacttgaaaccactcacagaagtaactgggcatggtccccaaacatcagaatgtattaatatgaagggctcacagttacgaagaccaattccaacatatgtagagcgagtatgtttgccaagctcacaagcatctcacaccaatctatgcttatccactctactaaagaggtctggatacaacttactcaaaatctcaaaagatggatgtcctaactaacagtgaagcaaactgatctccttctcaacatctccaaccaccgcagctagtcccagttcctcatgattgatgtaccacaacccatcacgcctgactccagtcccaatcctcctcccagtccccttctcctggaacagacaagaattctcatcaaatacaacaatgcacttgagttgatcaatagccgagctaattgagagaaggttaactggaaaggaaggaacatgcagaacagaagacaagttcattgatgatgtgcactctaccgaccctataccatgaataggcttggatgtaccatcagcgatttggatagtttcagagtggatataaggggtgtatgatgtgaaagtattatgcaatcctgtgacatgctttgatgctcctgagtctatgatccaatctataggatgtctatatgtagatgcaagtgcctgtgcctgagtaccttcgcccacttgggcgtagttggcgaagttaccaaagtgagtggtggtgttagagctctcattggtcttgttcttctgccattcctcccattgtgtcacttgttcacctattagggtaacagctttcccatcctccttaactgcattggcctgaggaacacctctgcccctaccacgacctccaacacgacctccacgatcacctcctctaccaccacgatttcccccaaaaacaccacggtctcctctaaatccaccacgagttccaccatgccctcctcgaatcgatcccctaccaccaatgttccgggaagtgggacaattgtagctcacatgacccacttgcccacaattgtagcattccctattatcagctgcaatgtatgctgatcttataggatttgtacctctcatcaacctcaatctcatctcttcttgcaccattgctgaaatggcctcttccatagtgggcaatgtagcttggtggaacatagctgctctcctatcctcaaactccttgttcaaccccttcaagaaatgaatgactcttcgcctctgcagccatttatttccaatcacaatgtcatcctcatgtttcaattgtaggggatcatagtgatcaagatctgcccataactgttgcagctcgctagcgtactcttggactgttctcccctcttgcttcaaattctccactttgttctgagcctcaaccatcatcattacatttccctctcctgaatacatgttgctcagcgtcttccatacaactgcagcattctggatagcttctatcatcctgccaatagaaggagccaccgaggtcatcagccaagataccacagtggaatttgtagtattccacgtcctccatgcttggctctccttatcagaaggttcttcacaactctctagtaaaaaatgatccaccccttttgctctcaacatcagttgggctctcctacaccaactcaaataatttttgctcccctccaacctcaactcatttggcatcaattctagtttcacttcgaatccccctgctacactcttcggacctatcatgcccatcttcaacaaattctctagcaaatctttcatatcacccttagtaaccaccgaggaggcatctacaacctcctttccaacccctgaagacatttcccctccccctttctaagcttccttagtcctcacctgctactgctctctgctcctgtaatttttcagcacacaagacactaccaacagcaagcaacagcggccagccggctcacctggtcgcagctccgccaccactcctgcgccgtcgcccccacgccacggtcgcgcgaccggccgaccaccccggcacgccgctcagcagctgtcgccgtaggtcgcgccgccacctcgcgagtcccagcggtcgcctccacaccgtcttccacttcgtcctgctccggcacgagcgccgccgccggctagggttttgccgccgctggtcgccaggagctcggctctgataccatattgttcaatttggggaatttttctagggttagcctactcagctcaccccttcctcatgtattctattagcataacactttacagataggtccttggtacaatacatatttacaccaacaaacaccaatttagctaacgggcccacactgttagttagtctctgtttgtcactgagatgcaattgatagtacagtggcaaggtctgtgtgattttaactctgaaatccaatgttcagtcctcaacacgttcataatttttacttaaaaacaatatttggccgacgtttccccttcaaatctcttttttttttctttagtctgtctgtcactggcacaggcactcacacgcacacggcgtgaacagctttcacctcatcatgcaaactcatgcaatgcaggaggagcaggacgaagacgaccagagctttgcttgatctgcacttatcctccaatgccctttttctctcatcagtactaggctgaagattatgctccagctgcatgcctgcctgcatctgcatggcatcataaagcagagctactagctgtagcaacactgagtatccagcccaggggacaaaatgcttggcactgtcatgctctgtcagaatcccaatgtgagacacttgcttgtgctggacttaacctcgtagtgatgcttgttttggcctggctttagcttgtggaatattatatgcagagcaaaagttgaatgacacctaatcaacagcttgtttcaggttctttcaggagatcaaaaccagttagtttgcagttcaagggggttctcacttctgaacttgcaatgtcttcttttcacttcttatttttcttcatttcatttcatatctagtgttaagtgttaacgatggttggttctattctacaactcaattacatcaaaaaaaaaaaagttcacactactgtaaggacaatttcattatctctgtggccaaaagttacaagatacgcgcccgaatcaaaatttccatcgcaacacacggacacaatgcttgcaatcaagaaaatacgtcgatttgacgtgagaaaaaggtgtcttcagaaatgatgcggccttgcaacactatcatagagcatgagaagatgaaattttcacttttcaagcatctagtaaaggagctctttcggctcagttgcttggtctctcctttacctggcttctctactcactcctatcatcctatcagcatatatagcgcataccttactgcacaggtcttttctgctatggatggctcacttgcattcaatctcaagtgccaatacctactccaatccgggtgcatatcacatagccctttttttttatcacccttgggctcgtgcaattgtgcggtctttcaggaagtaccacatactagagattatttcaggaagccaaacttagtcacttcccttgtttaaaaaaactgtatatatccggttggatgtaaaggctgagtaaaaatacccttctctaaaaaaaaaaggagatactatcgggaggtatcaaaatttataatactccctttgtttcaaattacttgttattatagatttgtcctaagtcaaacacatttatctctaaccatcaattttttgaaatattgtcttataacgtcaagtgaattattgtaaaagtatttcttatggtgaatctaaaagcataaattttattatgacaaactatataaatttctagaagttgatcattatgttaacatttcatacaagtcaagtccatggatcaccaacctacccacctctctgcatttcatgtcattgcgttgtgcatgtgcattcaaaggatccagatacgattaggtgataacatcttggacagcttctgtgtaccaaattcaattccactccccatgaatgaacccatgatgatcaagacaagagcaatgcagctagtgctttctaggtaagctgtactgcaggtgacaaccctgctgatggttacttaaccaaaaacatgcagcacatcaattatctgatgtcctaaattaacaaatttcgttagatggagctttctccttcgatcggatcgaccaaaccgaaaggaataatcaatcacccgtgcgtggacaggcacacgtggatggtggcttcaatcagatgatttctttttgcacgctttggattttgatttgtctctctcatatggaagcaaacgatgcatggtggattccttgttcgtacgtagtggtcttcttgtgcatcatgaaaggggaggactagctaactgatgcataaatttggtgaaaataattcaattttttttctccatttgtcctttcttttggaaaaacaaatcgtttcagcactggtgaagtataagtgaattgtccgtcttttctcattagtttaagcttctgggttaaattgattagtagtttaagctttttggcaactcaatagacgcaacatttgaaatacaattttgataattaattctcttgatatgagaatatgtataccatgatatgatatcatgttcagtacggtgcattgaaaaccagtgctaagtcctgtctctgtcagcaaaattatttttctgctctaactgaatttcagagaattcaggtcgacattcattgctggagcgaagatgtgagtaactcctgatctccgattcgatcgggcgaacgccattgcagtcttgcattgaaggagaagtcctttcagtctgttgagccgccatgacaacttgacgagcgatcttaagtatgcactggacgcgagctgttcctccccctttgttcaggtttgccaaaaaaaatgtaacagacttgccaacgttacttagttacttttttttaacttagctacagatttgctattttgaagaacagaacaccccccccccctcctctctctctctctcaagcaacctgttgattgcttttttttaaacaagtacaaaagaaattgaaagaaggattgctgatttttagccaggacagatgagcttggtttgcactttgtagttttcattgtaattctcccatttgcatgttctgttttttctgaacaacaattgtatcttgtgttagttttgtgttgaactgaaatcttcagtttgcgacctgaatcaattagaaaaattatggaagtgaagtcgaaaatgcctatatggaccatcccatacaagcccaaggccatctagcagaacatcagagtgccacattgtgaaaatctgctaaaatatttggcccatttggaagaaaggaaatttcacctgaaactattcatgtaaaaaaaaacgagaaaaaaaatctctgaactttcaaaatccttttagccttctcctccttccactccagtgtgtcagcgtcagtaaaaagcatagtgaaagtcatcttcctggattgatccccggccattgctgtcatagaacactggttacagatggtctcttctgacaatctgatatggttgtactgtaagatttgttctctttttttcttcttcactcggctattaatttgtcattttatttggaatttggatcaaggaaaggaggaggaagaaatcactgtcggtttcaaggtgctgtgtcgtgtactaatcgacaaatgaacagtcgcaaatgctggccagattcagtcaggcacagccaagcgatggaatcctaaaacaaaattctgcatctagtagtatctattcatttctgcaatttgatcaaccaaaatatgcacatctagtagatctgaaaatatacaggaggttggttgaatgatattgtacatgaagaacacttggaccaaaccaatataaagaatatgagaatatagatggctatcatagagaacacctggatctaatacttgactatgaaaagaaatattctatcaaggtttctaacacattaaaatccatcgtagtagccaccaaatgatatgcttgcccttgtggatgcacctcccattactgttgacacagcttgattcagtctcgaggcttgctgcacaacctgctgaattctctgcagttcagacaggcaaaatcgtcaggagcagttggaattttcccctaccgactggtgatttagcctacacattatcatcattccacttgatctaatccaatcaaaatattgtgaaattttataatttttaattggcagagtgatgcaatttcgccgaactatttcaactactaacttgcagacacaaggacagcggccagctcaagtcttactctaaaacatgctcttgagacagtgcatggattaagaaatttgagcaaaaggaaatagccaccaacctcattatcagcatacatctggaacggggtcttctgattctgcgtcttgtgcagctgctgctgcctgccaccaagcagaaagatgcacaaggtggcagccgcaaccccaaatgagcagagtgccccaacaccattcactctcagcttccccacactgaaaccattgtgttccttgtctttctgggcaccttcttcctcttcaacacattgatcaggtgcaaccatagccatcacctcatcatcatcgtcgacatcaacttcctctgcactgacgggactcttgatcatctctgcctcctcttctgcatcaaatatctcagtcaccttaggcacgaactcttctcggtacgattcaatcttcacgacatcgatgtccttgaacttgatgacaggatcacccacatagacctcttctgatagatggataggcagaaatatattcttggtctcatcatctaggatacaatcatagggagaagggtgagatgcaggggtgaaatggtccatgttgatcatgatcaaactggcaccaaacaagaactgatcatccttaccaacaacagtgccatggtcactggtgaactcctccatgaagtaggaactcttgttgtcaggcaggagctcccactcatctaggctgattgcatccatggaagcagtacctctgctcatgtcaaactagttcagaagcgagcttggatcacagagagatatatagctgcccaaatgcttttaattttgatactcccttgatactgtggaagtggtcaagaatggatgctcaccaagaatcaataccagcagtgctgaggaaggatactttctttttttctggaggagaataaatggaacaagagggtacacttcttgcaccaggggagatgggtggcaatccaacttgaggggtttgtgtgtgtgtattggcttagtctttctgctaagtgacaaaggtgaaaatgttacctggggcctaccagtgatgactcctcctttcctagtttccttcctttctactcaattctttctaggtttgtgcaagaatcaagattagcagacggcaaacaattaattattcagcaaacatgattagagattgatttctataaagataggatatagtgtcggtgcagaactgtgaactagtctgaagtcagctggagcctcacattcagacatctcgtgtgtaaagagcattcagattaattaattcctctaatgaacatctgatgataataactcaaaatattcctacgaaccagcagtatgttactcagtaatcttacctggacggcagacaaaccttcattaaatatcttgacagtagctgtcgaaggattagggtgccacctaatctgaaaaggcttggaatgtcaatccttttcagtcgacttacgaaaaatgtttccaaaatacaggtccaatatacaagtcaatttgacacagcactggttagtagactggtaacactgtgtagatgataagaaaaggacttgataaacgaaataaacaggaactgatgaaggatagtgacacacaccacttaaacacggcaggcataggataatcagacacatgttcagaaacttctacagaaattttactctggaaagctcagatgagaccatagatagaacccacaattttatagaagcagatttatgaacagggcacgcactcacaaatctccagtaaacaatagattcacatacaaaaggagcatcttccagaaacattttgttagcttcttataaacggtgatgtacatataacaatcacagtaaataaggcatgagtcggcggccccagcttcaggctggtgcagacaacgaccaagttaagagttcttcaaaggttaacactgtaatgattcatacagcagcaggagcaacaaaaattcatctaaaggctactcaaactggcaccacacatctcaaatttacagtagttatcttgacaacaagattaggcattgcatccgcaacgcaaaaggtattcctagtatacaacaaggtgaggccctcagaatttacatgaccatgaggttcccacatgcctgaatggcgcaacaaagcaactatcatatatagctggatgcggaagcaagattaaataactttggatcacatgtgcagctacactaaacaaacagccccgaaaaggttaagcacttaagcttgccgtgaggatgatgattcacccagtgaaacagaagtaaacgaggaagcccaagctcgagcattgcttgcgcctttcctaaggtcccttgtcttattgctcagtctaagcttgctacaaagcctcttcacatcaagtacattcagcgctcgttccaacagttggcttgatcccctacggatccctaagttcaagttctgaacacgcacgaccaagaacgttttcagatgggagacgacgatggggacgaaatgcgctgcaaccttcaggatgataaaaagcaccgcaagcaacacaaatggctcatcttttgcaattttacgcagagatcggtcccctggtgtgactggtctgaaatctccagtactgtcttgatgatcgacatcaaaatatgcaattggatcgaagcctgcaatataaataatttacttcaagaaatgctctgaagcaacaaaggcaacccaaaaaaatctaatcatcaatagcatatccctgtttagttgattggacaatggaatcgattctatacaattaatggttgtctgcattcacaagcatcaatatttcatactaaaaaggttcgaaagattaaaacattatagtaagatggagatcctggtgtgtaatatcgagaaagcatcatggcaatcctaacaggtgcagctaattaccagcgagggaactgtatagtttccaaactaaatagcacccaaaggctatgttctcatttctgggtttaatatatttgaaagttgttacgattcttgtatgcaggaaaagaagagcaatgcttgtacctgtagtttctttatagaagtccaccagagagctgagatcttttgggccccagtatcgtaccattgtagtctcatttacaagaagaatggccgggaatccacggacaccatatcttgaaaacaaactacaataagcagaaacagcataataagcagacgagtcgacttaaaagggggcatgatgcctcacttaaagagacatatagacaacataggagtcaacatttacatacctaggcattgcagatgattcttcaacagtaaagtgatatatctgagggaacatagtgctgagagcttcaaatattggccggaacttgcttgaaaatggacaccaagcagcatagaagagaacggagtacgtaacacctctgtggcgaaggttcaactctttagcaatagcctctcctctcaccttcagtaagaaaaatgcataagttatttacagataaacaataactacaatccagaggtttgcaaactttgcaatacggactatcgagcattatttacagtgccagcctggaagggtatttaattaccattgctagataatcaaatggggacaaactcttcagttaagaaaaaaaaatatcaatagtgactgacattaaagttggtttagagatatcctgaggaacattaatatggtcaacacacattgcacaattcatcaattttaaagactacccataagaaatttggaaatgcaggataatgccaaatttgccctagactgcatattgaaaagcaacaaatctacaagatatccttcaaacacgttgaggaagcgccttcacaagaaatacagcacatagcaacactccaacaagatatttaacattttctaagctttggggcatccagtcagcctaatgttattcacccggaacatgaaatgacaccacataacttggcccgggatcgtcgtctccgtcccaggaacaattgttaaaacctttcaaagtagcatacaatattccttgatctcattcctcaacccatcgatctgggaactttagtgaatttatatttcgtaactatgttaacatcatcatctcaatagctacttcctcctatgtctgcctttccaatcttacataagacactgaaaatccctcctgagtcctgcccgcccgtttcacctatgatgtagtccctccctaccgctagcacctgggcgccttgaatgtcgtttgcgctgccaatcattgttttgttaccttccctcaatcaattcccccgttaatcagctaattgttggcaacaaacaaacgcacatatgcacaaattaatggtgcaatatatttctaaccacaaatcgcacatctatccggtggtttgataacggatacacacaatacgccactgtcgtttgcccgcattttgacaagtagatattccacacgaagaggaacacgcgcagatactcgctgcttctagaacaacatgggataattgaattgacaagctatctgccggagaggaggtggggattggggaacacctacctctacaggcggggatggctcgatccggatgcaggggcagcgcgacgcgagcgcgtcgacgaaacccgggcccctccgcgcgcaggtcgacggggcctcctcctcctccccaccccccgccgccgccgcgccggcgacgaggagcacggccgcgacggcggcgacgacggcgcagcgcgtcatagcctctctctctctcctcgggaagggtgggtggtggtggatttggatttggatttgctcgtttttcttttttccctttttttctccttttttttgcgagatgagctaattttgggaggccgtgcgggtctatagtggttagtggttgtggtgggccacgtgtggcgcgacggttcgcctggctggcatcgtcgcgtgccgaccggggggtggcggggcccgcatgtcagtggctgtaggtcggtttgttacggtggatatggacgaccgacgggcgttctaatcttggtttgtgatctgttgtaatcatcctacgtggctgtatttggaaaaaatctgataccgtgggctgatttttcgcttgtttcggttcttgtttctgcatgggcctgttgttatcattgtactgttttttttttcagttcttttcattgtgtttttttttattggatgggatttaggagagagcttaacaaatgggatagatattcaaaatttcaaaagaaaagggagagatattcaaagtgtaaaatgagataacacacaatagtgttaataacgatatattgagcgtagcacaatatgttaaatttatagtgatacagcctgttcacggattagttttaaacttgacacgcgtgtgctcgtatttactgctaattattctttcagtaataaacgatgtatctatcaatagcaaaaatccttctgataaattcgtgaattttgaaaagaaaaaaaaaggtaatcacatgtgcctcaacgtgggcctaaagtaagtccacacagaatacatgggcctaaattaagcccatattctaggagcggcccagtccacgcccacagcccaacctgcacatgcagctcaccattctcctccgcctcctcgccgccagcccgccacctgcgaactcccccactcccggctgcccgccgccgcgatgcagatcctccggcggaaacttctggaagcttcccgccgcctccccttctacttcccctccgcgcccaccgcccactaccgcggccacgcccatgccgtcgccaccctcgccgccgtcctgcgggaccagaccgccggctccctcgccgccgccccgtgggccgccatccagcgccgcggcgcgaagatgctcggctccgaagtaattccctatctccttggatctgtttacgtatacctgtctccagggtttatttagggttctaagctagttgcaaatatctgctctggttgccccgttacggttagctcgtttcaaatttgtgggaggaactggtttggtaacgtagtagttcattgttgatgtgtttttggataatcaactcagttgaggccactagaaactcttttttaacgattatgcaggatgtaatttggtctagcatctgttggtttcctctaaacttcttgttaggctttttaaatgtgttaatggtatgtgcttttaacaaattcgtcgacgcagtcatgcattcactatgtttacactaagtggtactgttgcagtgttgctgagtatgtgcttttaacaaattcgtcgacgcagtcatgcattcactatgtttacactaagtggtactgttgcagtgttgctgccgttggtgcaggacttggacataattatgcataattcatgaattatctctctctctctctccctctctcacgcataatgatgcttacattaattaattcagggctttcttcatttgtaggtgaagcttggaaacgtaatacagagaagaggtgtgtgtgtttacatgtagttatgttttatttttgccttcaagtattgtggattactacttatcccatccctttggtcaaccttcaaggtcgcatttatcaggtatgcccatttgctatttgggttctgcatgagttttgtggtttatactttatgctcatgtatcttataagaacaagcaatctattatttcttttcttaacttgcttgtgctttggcaggtgataaaagcacaacattcacatcaaggtagaggaggagccactatacaggttttcatctcgttttgttcttttagttttttgcagcacacaacaccgtatagttcagcatcaaaataataagtaacaagtaacaagtaacagccaaaatagttaattttagagcacccctttttttaataacagaatattgcaaagctaatcaaataacaaaatatggatatcttattatactcccgatcatattttttcttcaattctttgatgctgcaggtggaattgagggatgttgacactggcaacaaaataactgaaagatttcgtaccgatgaggctcttgagagtatgaacatctttaaaaccaagacatatatgccttctatttttcagactaattttccttttacgatcatatcatatattacctgttcttgagatattctagcgtgattttaaacgttaatctctttatatttctatctacagatctaactatcaaagcaatacattcttctgaagtgttattacattacattcatgtgtcaagctaattttaggcagtcacagctcatttagagtgttaaacatataaattgtaatcatgctttttttgataggcattacatattttttctccaaaacattcaggagtttttgttgaggagaagtcattcacatatctttatcaggaaggagacaatgtgactcttatggagtacgtttatttcctgttatcctatcattaaacagttgacatgctatacagtgattatctgagtatttactttacttcatttaaccatgatttcacctgaaacctttgttgtcaggcctgaaacgtttgagcaacttgaggtctcaaaggaactgtttggcaaaactgcagcatatctgaaaggtaaagattaacaatattaatctacgacaagcaggaacactggttgtcacaagtctaaatgctaaaatatgcttatggtttcgcttctgtatggcgaggttgtatttttcacttttatcgaaggcatcacctaggggatgccttggtgcagcaaggtcatgatgaccatattaccttgttttatgaggcagacctagtgtgagaaagcggcagtttcgtgacaagtagtccttgtttgttgtgactgtcgttgctcctcgccgcactgcttttggcatttactgttgtcataaactcataatcaaccagactgggcatgagggagcgatggaaagaggtagagatggaagggttgagacttgagaggagggagggggttagctgccttgtatcacaaggtttcgtaatttatctttgtcagtggtggttcacgatgcgttttgtcatgtcatgacatcatacccaatttcctcacttacaacagatgaaatgaaggtgactctgcagtactttgatggccgacctatgtctgcatcagtgcctccacgcgtgacttgcacggttgttgaagcacaacctcattcaaaagggataactgcacagcctcagtgagtctcacatgatcattttcgtttctatttttactgtaatgtttgtttctaatgttcttatgacttttgggttaactgttgctcttactaccttttacgactttgatactagattgttttgatatgctgatgctggtcactgttcacagtttgtggatcaaaatagccattttgcgaaattcagagataaggctagtattatatactaaaaggtttttctttgctattcacagtttatgcctgatggattaggtcattagggtgttaagacttaatttggcatggcttgaggcctattgtttatgagctgcgcaatgaatactgatatcatggggtaggcctttggcattttagtaggcctttttatataaccgacgagctatttgctgttacatgtatatgtatagctttgtagttaccttctagcattgatccattagattgcaaggtccatttgtccaatacttgtgagctgtctcattaagggacgggcttaggtccatttgtccaatacttgtgagctgtctcattaagggacgggctttgaaggaggcttggcttagctcagctcatttaacaactgagccaagctggttcacagcttgtaaggctcaggcttgtttccccagcactatctgtgacatgcgaggctgcggaactgtatctgtcattctatgcactacacacaaagactttttttttttgctattatgagcttcataatctttcgtcaccagatgtttgaggctatgttatgcgggtaactaagctcattttgcactgcagatataaaagggtattgctggataatggtcttacagtgcttgtaagttgatgcgccatttcctagattttattgacctatccttttatataaatgttgaagtacatctaagaatggttgctgtatgtgctatcactttgatatccttttatttgtggcaatgtgtggaaaatggcatttgcagcatacatatgtctctgattgagttactgaaaatcaactctgttttgttctacatctgacttactcaaaagttgggatacacgtgccactactgaaatcaaccttgcttttgccgtgaaataatttactggttacatatagattagtactgaaaattagaaaacattgatgagtctgctgctttgaaatagttcttacttcctgttgcccttctgcgattatcttaggtaccaccctttgtagaagccggtgagaaaattgttgttagtactgcagatgattcatatatgacgaggtaagttctgagagcatcatttgcatattttggcatttcagttacataaactatatacttcggtatttgtttttttttatgaatcttgcattgatgactttgatggccatgtgcatactggtagttaaattcttgacaactttattgaaacaattttgcatttcagggcctgagggcaatacctggtagatggtgttattactccaaatttggttctcagcttgcattttcttgggtaaattttcaaccgccttgttgtagaaagacatcacctagcttcattaataattcagtattcaacaagttctgttctcatagattcttcttttcaattagtcattttgagttttgtttcccaccataaacgcaatcccaccatggtaccccatgaaatttttgtgggaactctgatatatatgctattggtattgagtacttggttgtgtcgtgctgtctatacatttctaagctgctaaacttaagctaggaattctgtcacgaacccacttgattctcaatcatacagcaaccagcgtaagagagaaatccaactccaatgcaaaatacaagagtatttggggatacaaattgagataatagaagtatagacttgaagaagcactttttttagataatgagacttgaagaagcatgggtttgggggctagagaattagagttttcagtgggaggtagaatggatgatgggattaggctgatgcagtctcttcatggatgcctttggctgttgcttgacttcttttatttttagacaaggaaaatgattgtatccccggcctggcctctgcatgtataacgcacacacatggccataaagtttcgagttttggctgctgatttatagctgcatccctgaaccaactaggccaagagacagccaaacggtgcagtctaaagcccctcctgagcccaggttcatgacaaattcctagcaacagcaacacatcacagatttcctggatggacgcatcatttgtcagcatggacataatcctggaaatagaaggtcttctcgatgaagttggcgagccagcgggaggcggcgaagctctctggacacccgacatcaccgccgtctccttgccggcggcgaggaacccgacgacggcgaccgccgccacctgcaaggtgatctccagagccctcatccccttcagtgcagctctacaactggtgcactgcatgacatgcgaccaatacctgttgtttgtggtatccaaacaagtattcatgttagatgatcactgagagttctctccaagagctgaagattgattgcgtgaagatcagtagacagcttgtttacctctccaagagctgatctctggtaggagtttgtggcagctgctgtttaactgttggatttgggtttgcccagccaatctgatggttgcagtactttctaaaccagtttctgtaggcgatgaccaagttgtcagatgatgttggcacatagcaagctttgtgccagttatcaagcccaactgttgtgatattgcggtcctgggaaaatgattaattaattattcgtgttaagaatgacaaaaggagagaatgggctaattaattaattgcacctgttaaatcagcctacagatagcctgaaaaaaatcatttggtttgagcagaagagaccaaatatttcacctcaacatggaggtacgtatccgaatccaagatggtattcgacgtcatatggtagaaccaacgtggtaggatcttgtcgagccatcctccgactttatacctggatgcccagatgaacctgctccttcccggagccaccgggacggtgaacaacaccaccctcacctcgggcttcttcttcttcttcttcttcacctcgtcagcctgcatcatcagagtataaacctcttaacaagttcaggaatataacgcacatctaagttagctttcaatactccctctatcccaaaatataatagattttagagaaatgcgacgcatcataatactatgaatctatgaatctggacagtctactatgatgcctcacatttctgagcatgtccaaatttatggtactagaatgcgtcacatactcacatccctccaaaatcacttgtattataggacggaaagagtatagaacaatttagtgcgatcatagatgtgccgttgatttctatttatttgagctagcgtgtgctaaggaatgtattcgccggtgccttgagtgtattataagcctatgttctttgtcctgggttcccaacctctctccctcattttccgcgcgcacgctttttaaactgctaaacggtgcgtattttgtaaaaagtttctatacgaaagttgtttaaaacaatcaaattaatctattttttttaaaaattagctaatacttaattaatcacgtgctaatggatggttccgttttccgtgtggaggaaataggttcccaacccccattagcgaacacgcctaaccaaaaatctgcaatggcaaagtgaagagaggctgatcgatatatacctctaggtcggtccggaacggcgtgccgtagagcgtgcacggcgccacgaacttgaagtagccccaatcaccgtccaggttcgaatggaacccatcgatgctggcctcttctatcctcatcttcatcgggctgccgtgttccagatcaaactcaactgtggagatttttttttatagataagggaagtttttattaaactcagtcaattacatcaaggtgatacaattatcctgagaacacttccggtctatacataactaagatatacacagccgaacaaacaaaaccacactcgaaagaaaaaaagaatgacatggagtattgaggaccatcaatctaacgactaaattgccactcatgaacaactccttggccatttcctccaaaagcacagagttttaaggaccaccaattctaagactagatcgccacccatatccctgggtaaaaaactccttgaccaccttctccaaatgttgacatgccgcaactaccatatcccgcgaatcaggcttctgtaggatagcccatatacaaagccaatggataagagaatatataacctgcaaaggtgaagatatgacttttttttatcaaaaaccacattattcctgcatagccaaagcgaccaacaagtagcagctgctcctaacagaacatgtgatttcacattattatgaattccatcaagccagctcccaaacatatgcgctacacaatgtggtggaggaagtccagatgttgcttggatgatggaccaaacagaaagggcaaaacggcattcgaagaaaagatgtctaattgtctcgtcattgcaacaaaaacaacagttcttattgccttgccattttctttttatcaaattgtccttcgttaacaccactccacggcgcaagtaccaaagaaaaatcttaacttttaggggtatctttaatttccaaagacggttattaatgttgggaacattgctgtgaattagagctagataatgagacttcaccgagaactccccatttgaggttaagttccaatgaatctcatcttgctcctgagttaaatgaaaaccagtgatgcgcggtgataaattattccacgccgctagttttgatcctataaggtctcttcgccatgaaaaagatgaaggattgttttcgaagacttgtgcaactgtagcgtgcttatgtctaactatgttgtaaaggcaaggatactgttctcaactgtggagatagaagctaagatgaatgtctgaaccagtaaaacgcagttgatcattgcaagatgaaagtttggggagaaaactgaacatatatatcacgacagatgaggaacatatctggctggatcttctctctttgggagctcaccaaaaagccccttgtgtgcgtaggggacgtgagcagggtccatgaggttctccaccaacaactcatacctgcaaacccatggtagtactattgatcgtcaaatttagaacaacagtagttaggcatgaatatgggatgagtctacgttccgatgatgcgggggaaaaatgggacgctgatgtcagcatccgcgtctaatttacgtgcaaaattattttaaactgatttttctcttaaattacctatccaaatcatgatccgattgcaccattaaattcattacaattaaatcttcaaaacaagaccacacattgatatattccgacgaaaaaaattattattgaattatttttaaatgttgcacgatgttccactaggtatatcggaattgtttcactaagtagatcgaaaatgtttcactcgtttaaatcgggtgttgtttcaccttatataaaaacaatgtttcagcaaatagcgaaaaaaatgtttcagttcactgtaacatttgatctatacatagtgaaacattataagtacaataggtgaaatatttttcggtggaacaaaaaataaaacgaattcccttaatagggggtttccaaaatatgtgggttttttgtggcaatggaatatttcagttcactgcaacattagatctatacatagtgaaacattgtgagtatactaggtgaaacatttttttggaacaaaaaataaaccaaattcacttaatagagggtttccaaaatatgtggatgatttgttgcaatggtagatgagaacagagaacgcggtggggcctatggcctacatgtatgcacgtggggggaggggcgtgcgggggagcgcccgatccggctcccccgcgccggtcgcccggattgaatcattctcgatgaatatgtgcttgataaccagttagccgtcagattagttttttttaccattaattaatctggttattaggagctgattgggatagggtgagtggctaatgtggtgcttcagcttttaatttagtccctaacattttaaacaagctggcttaatatagattttagactagccaaaaatgcctaccatttccctatatttttattttcaaaaaacaaaccatttaacaatttggaaaacataaacgtgaaaaataagtggggtgaagttaggaataacacaacctaattcagtcgtgtacatccatcaacgaatttgaggattctttgttgttttgctcagaagaaaaaattctcgcgtgtcggaacgaaattgagatagttatcgattcaccggccaggttcttggcaactaggacgtacgcgttgatgtgcgcttgtgcgttgtactctcttcatccataaaagtatttttgacaccaagactaaaaagaaattaaatcatcttaaatattaaaaaatcaagaagtgaatacaagcatgcaatcaataagtatttagatgactccttagattttaataaaacatttaatttatctcttcatttaaatcttgagtgtataaaaactacaaatagtaacaacttatttgaaaaaaactcaaatgtgaaataggtgtaacttttgtggatggatggagtaatatattttcatggagcaacaagcagtcaagcacatctcaatggcgcgacaagaaatactccctccgtttctaaatgtttgacaccattgactttttagcacatatttaaccgttcgtcttatttaaaaaattttgtgaaatatgtaaaactatatgtatacatgaaagtatatttaacaatgaatcaaataataggaaaaaaaattaatagttacttattttttttaataagacgaatggtcaaacatatttaaaaaaatcaacggcgtcaaatatttgggaacggatggagtatttcagagaagagaataatggatttgtttttttctcttctttttacccgtataagaggtccctgacaccgtagaccataaaatgggacgggtcatcgtcgtcgatctccggaacgtagggtggccgcttcctcttcagcacgtcgcagtactccggctccgacctcgggtagaaccacaagatgttgttctgcaccacgctcgggtacgacgccacgcacgccttgctattcttgtgcacctgccataaattgatccaagaactcaattaatcctaagaaaatcttgatatattttttgtttcactttgctgattgatcgaggagaggaagaaaaaaagtacaggagggccgagggcgggagcctgggggatgaactggcaggagccgtggccgtcgaagcaccagccatggtaggcgcactggaggcggcccttgccgtcgacgcgtccctccgacagcggcgcgaggcgatgcgggcacgcgtcgtccaccacgcgccactcgccgccgccgtcgagccacgccacgacgctgaggcccatcaccatcttcccgtgcggcctgcgcgggtcgaggtcgcacaccggagccacgggatgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgcgccgggccgtggctggcagcgtgcgtcacgtcgctatccttttgcagccactaacccacgttcccacgattccctccgcaacagcgcgtccacgttctttctcctgatagataaggaggccgcgagtccgatccgagttcctcgcttctttccaggtcttctttccaggtgttagtttctccttctccgcttccccgcttctgatctcttgcgcgcacgagagattggaagaagcagtgcctccgaaaccacaccttcgcctgagatctgcaccgggtaggcgggtgatcaggtttttggggagtgcctcctgcacgactgctcatcgccatgtctggagttgctgccgccgctattggcggaggtggtacgccgccgccgacaggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgttcctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacacgggataccactggtccagccactcgaaccgctcctccgcccctaccaccggcggcgccgccaccgtctcggtctcggccgacggcgccggcattgacgacagccatcccgtgctggtgcatctcggctgccggagccgccgccgtggcgctagactggctgcgcgtggcctagggacgccatggcggagaggaagcgaagtgcgcgcccggaagagcaggtggagggagaagggagccatggcttccgggtgcgaagctcaagcgtggcaaccaacttattatatctgcagtgggccgaagatggagcctatacagacactgtccgtattgctgacagcatcaaaacatgccgtagtgtgtaatccacaagaggaatcattttattgctagtactattttcatctactggaagcttaatagaaaccactctccgtccaaatataaaggagtaacaacttctagcctttaaaaattaacgtaaaatataataatttcttcaccaacattctctttccaaccaattacaatcatcttccattcaattcagtattcaacaagaagttctagaattattttcagagctgttgctaggtgtgaagtgatttcggacatcttgttctgggatacctttggaatgggtctattggaagccaaacacatccagaattatgtgctcactctttagacagaagcatctctgtaaccaagttatgctataacggccccatcgtttggcttatttatgaaataaaccaaacgatatatttgcaaataaaaagtattttgtgaataaaaaatttatatacgcattcttagcgatctataagcaaaggctaaaactaaactttgatgaaacaaaaaatctcaaaatcaacttcaaatttaaggttaaaattcgaattttagcagataagcatgagcttaagtgaaaacatgaggccataagcctgtagaggattgcttcaggctacctcttaatgagaaaacatatgtccagtttcaggctcttcagatagaggttaatgatttacaattactggatgtaaacgaggataaatggagctatatttggaactctccgaattatacttcacagaaattttacaaaatgaactttctaggaactacccctcccaggctatacatttggttgtggaaaacaaatgtcatgaaaaccaaaagtttttatacggcttatgtttactgataggtaaacaccaaagacatgtttgatagacgatattgtgcagtggggattgtctgcagtactgcagctgcagtagcagtggctgataggctgcagtactgcagaggatccatgtccgatattgtgtcctaaaagatgttggtctatcatgtttactctgtcctttggggatcagagagacattaatccatctcttttttcaatgcccttttagtgtaatgtgttgggagagaattgggatcaaatggaacacaaatatgaactttgtaaaaatccccctggcgcatgggtttcatgttctttccctgtgttaacgccaaaatttggtaagcccgaagttatcatcggcctagagtcagtatcggcttcagagtcttagaatcagctgatgggagtcgtcaaatcgccaacagttgtatttttggtagagttggatcaattaaaggaaatttatccagaagagtccgagttcaagaaggatatggcatggcggtttatctattaattaggaagtatttgctagtttccttttatctttaggaaagtgtgtttagtgtccgataaggactttatgttttccttttatctttaggaaagtttctttcttgtcctacaaggactagtatctctccatgggtataaatatgtacacccggggtcattgtaaaatatctctcgatcaatacaattactctcggcgcatcgccaccctctttcctgaggttttacttatcatccggcggaatttggcacctgacgcggggctgcatcggctttcgatctccggtgaaggggtaagtcctacgttccgctggccctggtgaatctgtcggctacgttggtgttgttcaagactgcatcgtttcgatctcttggatcgctctggtttggttgatatatttgcctacctgatatctcaattctatctctaattacattgtgtttagagacacatcggtttagttgggactgtctcggttaggtccgattatctgtcttagctgatatatctctaaaatcacaatgttgttctaaatagatttgttatatccatcacattagatagatctatcagctcatcaagtattagattatcatatacaatctcgtgctgcatcggttaggttcgacctactagattgttgttgataatataagtcttgctaagccgataggttcatgctagtgttttatcggggtgctagccgataagttatctagacgttgcatcggcttataaggattgcatatacatataagttggatttagccgatgacaacaaagacttcactgtttaatctaatcttgtggattttatgacatgggacctccagccgatgtatgctttaaccgtcggatcagtgcttgttctattatatcatattgctatccaattggtttatactggattatattgttattttattacatcatcatcagccgattgactttatatcattatctacattggacatacaaccgattgcttaaaccctatcgctatcggctggtatcgacatcggctattatcagatatcggctggaattactccatcgacttgtcagccgatcggctgtttgatctactgtttgtaggatcaaactgactggtacacccgcatctcatcaatctttggacctgcactggagctaagcagatctcccaggccagtgtgtgtttttcgcatccacaccccctgtaatcacccggtccaccacaaatcttcgtctctcccacaaagacggtaacgcaaagctgctcaacgatggcgatgatgtcaccacacccacaagaaagctgatacgaaacagcgatcgacttaggccatagaaacaatgaatcaagtgctaaataggtatccactttatcattcctaaaattcttctttctcctattcgttctttccaaaacctaaatctttaattccactttgttatatgggaatcatgtgctaggtaagtgctgagtgcacctgatacgttgcccatttgcatattttgacattctagttacataaactatatactttgttattttttggatgaatcttgcattgtgtgtacaggcaattagattctcgacaagtttactgaaacaattttgcatttcagggcctgagggcagtacctggtacatggcgttattacttcaaatttggctctcagcttgcatttgcttgggtaaattttcagccgtcctgttgcagaaagacatcccctagcttcactaatagttcggtcaacaagttctgttctaataggtgcttttcaatttgttgttttgagtttttttttcataaacgcaatcccaacatggtaccccatggtatttttgtgggaaaactctgatatagctattggcattgagtacttggttgtgttgtgttgtctatgtacatttctaagcggctaaatttaagctaggaattctatcacgaagccacttgattctcaatcatacaatgaccagcgtaagagataatcaacctccaatacaaaatacaagagttcgcccagctaatctgaatatctgatggtcacagtaccttctaaacctgtttctatagccatatagctatctagattcataatactatgttgcgtcttgtaatactaagttgctatattttggatgaaaattgatggaccgacaaaacgttctgtagcatgtaactatatactgttctgtaggattaataggaggaaacatatgcttctatcttcaccgaaaaagttgtcacatgaggaaccgtatgcttctaagtgatatggccctgggagtacgcacggtagagggaaataaacttcccatctagccacgtggccgtgcggcctgccttttctccaccccctcgggaggaggttaggtagttattaggtggtcaggggggcctcggggtgccacgtcacacccctcgggcccgtgaggcatgctgccccgaggcccttacccggccaccacgtggcggggtgagtgggcggagcaggaggcgctgttcagcgtcataaatgagcggcaccccaaccgtccctcactgcatttaatgcggtgtgggcggacgtgcggcgccgcctgattgacgcatgtcaatcgaccttgaccagtctgcgaccggtcgtaggcggataggacaggtggtcgtgcccccacgtcccgccctgtgtcaggcggagtgggggcaggtatgccccatcccatcggcacactgccaagtgcaccccctgtacatggtgaatccaccaaagtctccatacatttaagagggaatgacagggatgtcccccgtgtcaggtggaggacggcgctggccccacctaggggcggacaaccactttgcttccggttgaaggcacggatagtgatctgactcaggctatgtgggcccccctcccatggaggggtacgtatgaacggtgcatgtggtatctccttgaactataaaaggaggactttacccacaaaaaaaaacagggacgactcttgatagctgtcacgccccgaactagtaccgaccggaactagcccgtgacgctccaaattaacctgttaaccgataccagtcccaggaaatagtgctggtatcacaggaagacagaatatcacagcaacagaggtctctttattatagagtagaggtacagtcatgttgggctgcggacagatcccgagctcacaactgcattacaaaagggaaacggaagccagggctcggaccaaacatcacaggcgcgacttgggaactaggccgaaaccctaaaactcaacgtagccggcttgctcctggaagaactcctcatcagccggatccgcttcatcttctttagcaactgggggggaattatttatatagagcaagggtgagtacgggagtactcagcaagccaagggaattaagtgtttaatgcaggcttcaagggaaggctgttgtttttgcaattgattttatttgaactcttttctgaaaacaactaagtgagtgcttctcaaacgactcggatgagacagagcgtctcgtccggtcggagtatgtatcagtctttagaattgaaacaaggttggcacccggccaacagcttttcaaacggccacccgggccaacaacttttcaaacggccacccgggcctagctgatcccatcagctgctgaatctttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaataggttaggtcccagaccatactgtgccaggaagcccaggggtcctccccgacaccaccccgacgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaagtctcttgtaaaacccaagttttacccaagttgtttttcagattttaagtttgaaggcgtccgtcgatactcgcactgggtgcacgaatatcgagacgcaactggatggttacaaggggacatggtataacaattaacaattgagggatcagatgcaacaagttaggtaggtccgccaaactgtcatgcggacggaacaagcagattgagtgcgatcctatcaatgcataatatttttcaagcaacataattaaattcaaatataggctcaagatgttcaaaggtggcttgccttgctcgagatctggagcttgatcctcgaaatcctcgcactgcgggtcttcgggctccggaactacacgcgaaacgggacaactcaacaaacagcgaaaataaagccctattaatgacctctaagcgtgccattagatagatctcgagatttgaggaattttggaagttgaacggagtcaaacggacttacggttgggaagatattgaatttctaagattattggatttttggtctaaaggaaaaaggatttaattaaatcctttttggaaaagaaaaagaaaagaaaaggaaagagggagggaaaatagacttttctcgggcggctagggcgcggcccgagaggaagagcggctcggccaagcttaacgggccggccggcccaagaaggcggcccaagtgcgcgcgcgcgggagggaaggagagagagagggccggtggaccgggctcaccgtgcgcggtcccgggtgggacccgcttatcagcggctcggctcaccgtgtggagggagcacgcggcgcggcgctagggtggggaagggacgcggtgcacgcgcgcggttcgcggtggacgcggatgcggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacgccggccggaacggtggtcgacagccgcgagcgacggagcaaaccacggcgatacaggcaaaagcgagcacaccgggtggttgcacgtgacgaggggagacgaggcaacggctcggatttgccgggggttgctcgacggcggctgattgcggcggcggcaa

SEQ ID NO: 81757 - DNA, 68291 bp, Oryza sativa
tcatggattagatttcgatcacagttaagggtcacgaagtgaacttattccttatcaagctgcatgcggcctatactggttgggcctctgggccggatcggtacatcgagctccctgagatcagttactaactctgtttttaaatatacgataccgtttgtttttttataaacatttgaacattttcttaaaaaaacatttgaatatttattttattcaaactttttatatatataaaaataaattcatttttaaaaacaattgaatataaatcaaatcacaataaaatgagtgataattataattttttttcaataagactaatcatacatatcttgcacaacgttgtatattaaaaaacggagggaataatattttacgtagaaacgggaatgtgagcaccgtcatgtatgactaagaaacaatcaaattttacacgccatgaatgtgtcatattccaacatatcaaggggatcctttcgaacaaacgaaaaaagagaggaatttatacaattgaaatcctatgcaaaatttttccaggtgttcctttgaaataatggaatgcgcacttgagattgctacaaaatttctaacatgaggttgtacctcatgggaagctttcgtcgggtctatctctcacccaaaatcctatactttctctatgaagcatccaaacaaaaaaatcacatagttcctacattttaaaattcctaagcatcaacttagatatgccacctcgattaattcctacgtttttttaatgtttgtgttttttattcctgcgtttgaaaagagctctgcttttcttcagtgtagtttattatgaaatttgtgtcgcgcgatcaacagataaaatgagaaaataacaacagacatgccagcagatgacgtgcttgtgttgtaaactttaccagatcctctctagaaccaacagcaagagttgtaactcatgaaataaactgtgtcgacgaacttgacccaaattacaagtattagttgctacgttgtacttgtacactgtcgatgaaatggaccaaacagtttgcagcttcttcacttcactcaccaaatgaccaaactaaaccacacgctatcagctagatcttaatctatacttaaccctgaatgcatcttgaatttgtacccattacactggcttggtacattaattgtacacttaatatacatacatatacatcggactcgatcgagcaggaataatttagaatgctctacctaacgagctaaagtttaattaagttgagcaactcaaaaagaagtgtatgcgtcaggcagacagatcaggcattatttttcagccaatcttctcagtgttggtgtcgtctgttggccagatgaccgtctccatgagccgctctcgcatcaacgccaggttctcgtcagatatcctctcgtacatcatcgcatggtcacatttctgaaagatcaaaaccagaatctcatttggttacaaacttcagagctttgtgatggattatctaagagtaccaaaaaggaatcaccttgatccatttgctgtacaagtgaagcctagttatcatcactcgctctgcaagctcctgcttctcctataaaccaaaatgaacattcatgcgtgtgcaatttttctttagttttcagtttacatttgtatcgttcgaaagtttaaacaactgtggagtagtttatatatttacctttccaagagcacgaaggaacactttgccatcggtaggcttgtttacagcaacgaagctgaaaccaatgagaagcaagaacacaaattcagtaatctgacagggattttgctgattgatttgtggaataaatgggtggcttacttgtataaccatcggtagcttggtgggttcatttcgtagagctgcgtgagcacggtcttgacggctttgtaggtgaacacattaatcagttgctgcgcaaacaagaatgaacaaaaaaccaaatcaatcgatctcctctactcatcccaaccatgaaaatctcatcaaaatcacagcattttatatatcagcagtagaacttcaactctttacgttaggatctgctaacatggattaattaattagattcggcatgtggggaatgattataagccgcaacgcttaatagcgaaaggaataatttttcgataaaactttgttatatacacatatattctttacgacttaaaaaaaaattcaaaatcaactttaagattaaaactaaaattttaaattttagctacgtctgataagttaattaccacgtggatgtcctcgaaaccttcatcgtaggtgccaccgaggttgcagacgacggcgaggccctgctgctgctgctgctgcctcctgcccctgaccctggccgtgcacgccgcccggcgaggccgccgcctccagtctccggcgaacaagctgctcacgccgcggcccctcctctgccccgccgccctgcagctcccttccgccgtcgccaccgcccccaccgccggcatcacctgcaccccggccatcctcaccctgccactctcttcttctccaacgcagcagcagcagcagcagctaagatagtttcgtgatcgagcttggtgtatatagcaaccaagtggcagaagaagaagaagaagcagcaagaagaagaagaggaagaggtgttgaattgtagtttggcctcggcttctcgccgcttcgtcgtcgtggctggccagtggccgggatgcaactctgaccaaccaaattttgtgaggctcaggaggcagctacagcctacacagctcgtcgtcgtcgcggtattttcagcggaatgctggacacgcggcggcgagcgattgggcgcggggaagattccaaagggcgattcggcactgccgggccccacgtgtcatggacggagagaaaccggtcgcgtttccggcaggttcggtgaacctgaagcacaaagttggaacggcgacgttcgccacggcaagcaaaaagcaagaggatgagcgttttcttgcaggaacaggaaccgatttctggcaacttcttgtgtggtgcgatcgctgcacacgactacgagcacgagcacgagcaatgaatgatcatatatacttacagctatacaggacaattagcacattgtctaaacacgttgcgtcctcgtcatcaacagcataagcaaatgaaaactctgattttcgaattttgggggtaagagaaaacgatatcccagtattccgttcatactggtcgcagcagcacgagccagagcgatgaaccgatgaaagtgaaaccaccacaaattcagaaacggcagcagcaaattcagagacggcagcacagcaaattcagagacggcagcatgattaccaacttcaggtcggagcaaaagttaaaatgatgcaacaggaagaaaaacatcaccgcactgaacttaagtggtggtggtagtagtatatggctgtatatcaaaacagccagatcatgatcagaaaattgaaaacaaaatggaaaattaaggatgctctaaaacaaaatgatcaaggctataaagccatatactgaccatgatctataaccgaacacaacgaccctgcacccagtcatcttcagatactttcaggacaaaatggatcgataacataataattatgcagcattcattgataaaagcagtatcacagtaccatgatccaaaacttgacaggaaatagaaacatccagacgcagcacaatccaaggatgacaaccggttcttaactattgtaaaacaaagtgcatcagacaagtccgagctagcaaagactctctttactccgccatcctaagcctctacgttctcgacaggtgcatcaatcataagagccttagtcggcttggccaagaggtcggtgtactcctggaatggagacttgacgaacttggtgtccctccagaagtcaggagtaaggaatccataagtcttcatcaggcagtcaaaggtggcctgcacaaaacagatcatttggttttaatagaggataaacttaccactaagaatacatcaatcaagcaaggcaaactaataagaaggcctcaagccatcacagagtatatataacacaatcaaaccaaagtaaaaacgactgggtgtagaagacatgaaaacatattacatattagatattaacactccctgtttgagtaggacttgatggcatcaatgtgcaaacagggcatacgaaatgtttaaagaaaagtttctattagatgatacaatgtgctgtgtgtataggcacgatatcaagcagacaggatacactaataagcactgtggcataaggtaatgaccaatgcacaaaaagattaaagatcaaacaattacagcagcagcgtaagtgtcaataatcaaatagacccatgaaatggttcattgacagcagacaatagtaaatccatactgatgggcagtaagcctgtaacaaagtaaaatattttgaacccaaccagtttaactgtatcgaattagatgagtagaatactatgaatcaccttcaaagatgcatgtgtatgtacactaagaacagtagtctcattgaacaattgatgctaatatacaaactgtgatatagtgagaaactatagcataatgcagttatattccacccaattcacatcagaaatcaacaatactatgcctacttgccaagcacacataaatctatcattcagtaccaaacactaaatactcatagtcagagaatagtatataaaataacaaaaggagggatgtgttataccttgacgaagttgccaagggtcttggtggatccacgggacgaggtgaagacatcctcaatgccggcgaactgcagcaccttcttgggcacgcgggcggcgacaatacccgaacccctcggggcgggcaccatgcgcacggtgacagagccacactttccggtgaccttgcacggcacggtgtgcggctgcccgatcttgttaccccagtaacccctcctgacgggcaccacggacagcttggccaggatgatggcgccgcggatggcggtggccacctccttggcgcacttgacccccagcccgacgtggccgttgttgtcgccgacgacgacgaacgccttgaaccgggtgcgctgcccggcgcgcgtctgcttctgcacgggtgtgatcttcatcacctcgtccttgagccccggcacgagggtctccacgatctggtgctccttgacggggagggagtggaggtagatctcctcgatcttggagaacctgccttccttcacgaggcggccgagcttggtgacgggcacccacttctcctcctcctggcgcgggccgcggcgcccgccacggcgccctccgcggtcgccgcgaccgccgcgcccgaagccgcggccgaacccgccgcgctcgccgccacgctcgccgccgcgctccgccatggctggcttgagagggtgtggattagggttctctgggggtgggggagtggaggcggctgctgcggcggcgcgaagagtgggagaacgagattggagaagggtatttatacgggagggttagcgcagctagggttttgaggtgaggatgcggcgggccaagtgggctgggcctcttcggcccaatatgtagctatttgagttgtttcaggcccatcaagtgcatgggccatggaattggggacgaatggcctttacctagcctgtaagcccattccgaattgccttcgcctagcggcttcctccaccgcgggatcattgggcctgttcggtagtttgtttttgcagctgttatggctgcactggatagtccagttgttcagctgtctatcaagaatgcatctcagccagctcttccgaacaggcccattaccatttgctgagcttgacaagtagcagcagcgtggctccgcttccactcgtgcggatccccactccctagggggtcggcagctctacttgccttccccggcctggccgagccatcctcctcctccttgttgtcgtcaatgtgcaccgctcatctctccgtcggacaccgtccttctcgccaccagctcctctcctatcggccaccgcccttctcctcgtcatccgctgtgccgtcattcctgtcggccattaccctacaggggattggaaagacaagggagggaggagagagaaaatgttagccacttatatggaggggtagtatgggtcccacgttgattcagcttgtcctgtcaactaaaataggatttcgaataatccaaatttgtaaaatgaggaagcccgttatatatagtatttcaatttagggatgaatttcaaactcgaccatgctagtgatccatctttggtgggccaaatggaggcccaaacctgatcggttgggctttaccttaggctgccgatggaagccttgcttctagcgttgggcttgctaataatacagcgtccggcgttcaatgccaacgagccctgatcccgttcctcacctcaccggcggcggcgaaacgcctccgactccgagcaattccacttcgtcggccggcggccggccgattacccacgcccgtttcagcagcgcagcgaccagaccatgtgcagcatcagcaacgacgccaacagcttcgacctcatcgatggtttcctataataaccttttttgccgacgcttgtgtccgcagaatcatggcttctctgttcgagcgtcgccgagatctcggaggagcccatgttccacacgccggaaaacaccagtgaaaccaactgtaatggtggccaatccggttgataacatcatcaacgatcgatagcgacattacaggcaacaataaccatgacacaatgtttagctagatcacacgaaagttcaatgtccaaaacccaaatcaccaatgcagagttttacagacacgacgtctaagtagagcaattagcaaaccatgatccgaaaggagagctctgaatcgtagggggatcatcacgccttcaatggctggaccttgacctgatccagcacggggccgcacagcgagacgccgtcgctcaccttggtgtggtagtacgagctgtagaaggtcaccctggtgcgcacgccggcggcgacgaaccggaagctcgccggcttgaacccgccgtttccgacggactcgaacggcaccttctgcgtcacgttcccggcgaacgcctccaccagcatcgacccgtggcagccgttcttggcgtcgccgacgacgaacgataggttgtaggcgcggttcgccaccgtgcggatcacctgcgcgatggcgctctccctgccggcgacgagctccacggcgtactgccccgccgggacggagaagtgcgccgcgtcgatgaagcggacggccttgagcgactcgatgatccagcccgggagcggcgacgtcgcgtccttctgcttcggcggaaggaggacgcccaccgtcgagttcttgaacacctgcggcccgatctcgaatccctcgttcttgatcaggttgtctgcagccatttgttcgtcagattaattaccagcagcaatccatcgttcagacaatgatgcggtctctcttacctttggttgggtatggcgttgggagctccttgatggcgacggcgtcgagcagggggccgcacgacgcgtcctcctggacgccggggttggagaaggtgacctgcgcggcggcggaggaggcgcggaagccccacgcccaggtgtcggcggtgtcggcgctgtagagcgtgcggacggcgacgtcggcgggcggcgagagcgacggcgcgacggcgacgcggagcgcctcgtcctgggcgcacgtgcgcgtggcggcgaaggtgagcgcgtagagcgcgccggggcgcacggacacgttctgggacgccgacgcgcggccgcccaggcggagagcgtgcacgccgtgcggcaccgcgaagaacatgccgccgggctgcggcccgccggagacgtactcgacgtgcccccgcagcgtccaccccggcagcgagtggcggccgacgatgagtgtcttgttcaccttcctcggcgccgtctcgaagttgccattgatgaggaggcctgggtcaccattaaaaaaatatatcaaaattcacttgtttgcttcaaatgtctacatgattgttgctttctttaggattcaacagctaaatatagcgctgaagactcttaaccaaaatcttgcaaaatgcaaatgcattacagatttacagtaccacaccattctggggaaatggattgagcaacaacaaaaagtcacaaaaccgatggataaaagtgagatgaatataagtgatgcacaagacacgaaaatgcagtgtgccagacacattcttgggctcttgccaagaacatttccacaggtcgaggtagtaatgtgcttgcatgaatgtgatactgaacttgaaacaaaaatgcagaaatgaaactgtaataactgaatctttctttgcttaaaagaaaactgaatctttcttcttagaacatttacatctgcaagaaaatgggatccaagaaaaaaccaagaagatgtgacagagaagagaacacagtgagctgagacctgagagaagaaccataccttcagcatctttaggttgaggaggtgcatgggcaggggcaggagctggaactggaactggaactggagctttgacggcgagtgtggcaccggcggaggaggcggcggcggcgacggcgagcagcaccagcagcagggcaccccgaggaagctccattggtaagctcactctccagcctccactgagttcagctctctttcgctttcactttggctgcttctcgctgacgctgagagttacaaggaagcaagcagccttctattttttttcctcctttattaccaaaaggagtgggaaattgcatacagaacctcccacgctgtcggaattacacatcagagactcattggatagatataattaatctctaaataaatcgtgaatcaatatttagttgggactttttgcaggcttgatgactgcactgtgagaaacaaaaacaaaactaagaaggattactaatagtgaaaaccgttcactctagggctagtgtgtgaatctcacatttacaagaagggttaagattgttgcattattatatctgactgtcccttctgatgcgaatgaatgtatggggggggggggggtgcccacggtcatggttcccgcgttttgtggtgtagttcccgcgcaatgttactgacgcgctctgcaaactagtacagacttgcataggacatgtactgatttactcctatgtgagtactgagtactatatactactactgctagagtgttagatccaccctaatgaatgactgaaactgtgaaattaacatgctaccgcaagcactactccatcatgcattagcactgttactactctactctactgtgttacatttacagaaggcaacagaggctaccagcagatgtatagtactagcagtaacaaaatatcacctagtacgatttttcatctagcagatgtatttcagtctctgttttctcactgggtcgaggagaaatttgcttgatgcagccctttgtacacttgcacgaagaggagcttctggagaaggcacagacatatcacatggccacatttgttaattagtagtactacactgtacccaggcaaagatacgtgcagtatactagcatcatctacgtatagtacgtgtacaccaagggaagggagacgagagcatccaaagctagaggagccggacgacacagatgttcttttctaccaaaaaaattgaatggtattagtatataattaattaagttttaatcattataaatataaaagtagatttgtttcatataacttatatacagaaagtttcgcagaagatggaccgtttaacattaaaatatgtgctagcacaaatcaacatatatatatatatatatatatatatatatatatatatatatatatatatatatataaaacctatatatatataacctatacttttttcgtcacaataaaaaaacaaacatagtattatctcttttccaaaatttagtgttccttccgatttatgttataagtggtttttacccttttaaagtcaaacttctaaaaagtttgagggaatttatgaaaaatatagtaatatttatagcaccaaatcagtttcattacatcaaacattgaatatattttagtatcttttttgttttgtgttaaaaatattattatatatttttataaatttgatcaaaactaaaatgtttgacttagaaaaaaataaaaataacttataatatgaaacggatgaataaataatttaggattggattaaacacatcactgccaatctagatagacagagtatctatccagagtaattactataaaacgttagattgctgtattccggtgacggaaggagcagccggagggagaggggcgacagtggcggccactgcagcactgggcccggatgataaaagccggttcggcgcatgtcatcggctgggatggggaagaaggccgcgggaacagtggccgcggccggtggtctcctcgtcgtcgtcgtcctcgccattgagccccgcaccctgcacgccctgctgctgcctgctgccgacgcacgcggcccggcgcatgcatggcccccgtcatggcgaccacgcagctgtgccatgtgggcccctccccctgcacattaagggtctgtttggttcaatgcttcaacttgccacaccacactttaggctgccacatctccacacttgtctaacattgtctaaagtgagttatgacaatgttagttaagaaccaaacagcctctaactttgctctacccaactcaacgcgccattgcattttgcaccgcagcgaatcagcgattgccgttgtcccggggatggatggatggacggacggacggacggccaggatgtgctttgcacttgcaacagaggagccgcgctgctgctgcatgctgatagtttaaaatttaaaataaactcggtccaaatttatttccaaatctaatctttttgttcaagcaagtccagattagcgggcctgctgcgcgcagagccggcccattgcgaaattcagggcttatgttagcccaagtgctcaacactctcccagttgttcagtttacagctcgcggtacgtgtatttatcatggaaagcgtatggccgcagtccaaaacgcactggttcgtgtacgtgcatccgatatgtgttaattgtacgtacgtatgcctccgtctaggtacgtactgtagatgaacaatatgcattgattaatacgtatgtgctgactaagatatatgcatgtcaacaatgaccatactgatccattttgtaaactgaacaaccacttctgtttaattagaccggatggttacgtgatcgtttatggctagatcagaagatcaagtattaatcccgtgatgttgtgtttgaactgaagattataggggttttggtttactccctcactttgacaaacgttgccacactttctaggatttttacttgtttcactttcaaagttgcggcattgacaaagtttttctattcaaagacccacatgtcatacacctatcttttatgtcatacaatcatcttttagccaaatcttgtctaagatgtgccatcaatttataagccacacatttggttaggtttggcgatatttggaagtgaatcaaacaacccattttttccactatggtttgaaggttatatcgatgtcgttctaggtggtgtcgagacggggtgtggcaacacgtcatcaccattgcaggaccagacatgccatgccatgagccgactcatcgtgtgggttgtaccggcacagcccggcccggtccatttgtccagtttcctctcccaaactcccctattttttccattgtttttcttttttttttcttattttccttttttaagcaatagaaggagataattaagcaatgtattgattattttcgtcacgacgacacatggcgacagtcatcatgctaatccatttattaattgaaccaaatttatttggacaggaatattttagatactctagccacgcatgagttaagagtgttgaattttactgaaacacggcaccgtgcatttaaatatgcctttaaaacaatattcttaagttaacgttatgtatatactactccctcgtatatactattccctctgtcctaagatataagaaactttagttggataagacacatatccaacctgtctagatttctcgtattaaaatatgtcatatccaactaaactttttatattttataggacggatggagtattggttaggaaactctagatgctgttaagataacattaaactgaatttttatatttctatcttattttatgtttccacgtgctttgctctcctactaatatactccaatactccatactactcaaacgaagagctcagatcggttgaccttgctgttattaatgatttttcattttttgctgttcaatttcataagcacgcgcactttgcgtgtcataggctcatagctgattacttcatggactatgtcggtgcttaagctaaagttgattttgaaattttaaattttaaatttagattattttaatttaggaggttttccattattttattttcagaaatatgtcacgagttattttatattaagatttgaagagagatttaccgtgcaagctacaaaacgacgaaggcatgttcggctgctggagctacgggcacgaacaataccgcactcattatacgcagtcgcagccgaagccattgtagccggcctgcctaataggcccatagtttagcaagggttatatatccatgacatgccttgtgggaccaaattcggcctaagctcagctgatggcaagaggctggtctctcgccatagtgtcgcctccgttaggacggagctcctgacaggtggggtttatctttataggtccacatgtcagtgaccatatccctctaactttacacgagtggagcctcttctcgcctcatccgttgtagaagtagctatgactacttccctctaaatctgggtttgttgattaaacaaacgattgttgtgcttcttttagattgtcaagcaaatatcgtttccattattttatcgactagctttgtaatggataaaccttccattgtatatatctttagaaaatacgcactgattgatttggattgaaacgagaggcgtatccttatgatgacggtacttagatataaaaataaattttttaagataacgtaactaaggattgcttggaagttttctttttataaaaaatatttgtggcttacaagccgaagacacatgtacaaagcaataaaaaaaactttagaatatgactttttatatttatactgcataaatttcacacaaaccctaagttttaggccatgtgtaacacaaaatcctaggtattatgattagctcaaaaaccctatattttgagacagaatatttcaagaaaccttatatttattaaaatactcatttatattattatacatggtattttttacattatatatactcacatataagtaggctcaaaatgcacattcataccacatagttttatcttcttcctcattctcacagagcaagattgcaaaattgttacatataaaaacaagtattgataactcacacatgttgacaatgtcactattgtataactcacgtaagttaatctctcagtactttctaaagaactataaaaagcatattataatttaatagaaatctgtctagatttattatactaggttatgtctgctatcattttatgttagggttttctcggacggccggagtttatgtcaggtagcaactagtaataaatagtagtacacactatcccgtaagtgtatgtgtccatctctaggtatggtcgatgagcggtgcatcattcatcggctgccgacacatctatccatgcaatgcaatgtcaacaacgaccatgaatgctgatccattttataaactgatcgagtcgcttctgttttacacgggtacgccgtgtaaaacaaatactccctccttccctaaatgtttgacaccattgatttttttaaacatgtttgaccgttcgtcttattcaaaaacttttgtaatatgtgtaaaactatatgtatacataaaaatatatttaacaataaatcaaatgatagaaaaagaattaacaattacttaaattttttgaataagacgaacggtcaaatatttttaaaaaagtcaacgacgtcaaacattttgggatggaggtagtactattttagatgctcatgggaaccacgcatctatatatacccgtacatacgctcctgaaaatgctcaaagggcaaccatatataataccttcatcttcaattcctcctgttccaggtattgttctcacctctcttagtcttatgtataacatatatactacgtgtgatgtttagaaactctatgcttttcttacatactagcaaattactcatgccatgtcatgggaaacgaattaagaccgctttgccgtgtttttttaggcaccgttttggttttgtttcctaattttttgtttttttttctaattggctagttttttgagaaaccgttcgttcttttctggaggggacgagggtaggatctgtttctaccactgaattttttgcagacatgtgggaagaacggtgcggagaggaggatgactcctcttttattgtagtagagatattagaaaaaggaatcagtaaatcagctttgattaagttaagacaacttgagttgatatgtatgcttagctttgattagtgtttagcatgcgatatcttgtgcagatcaacacacccacacacatctcaattttctctcagaaggtgtatatatatttgcagctgttgtctaatcgatctgcagactgaactgaagtataatgtcgaagacgagtgccctggatcttgcttcaggattaggagggaagatcagaaaggagcaagtcaaatcggccgtggatcagtactgcacatactttatttacccttctaatacgttaattaattatgcttgaattttatagtgatatagtaacaattaataaatttgagttaagtgcacttacggggcctacaggagattagggggggagagaagaaaatatgttttttttttaattttattatttttatatgaatgacatgtaggctccattaacacgtatgcgtcaacatggcatgtcatatcagtgcacgtagcaggttagactgttagaactcgtttgaatctggatacacctatgataaatttaggaacctatataacatatccatttaagtttagacagaccactggtgtacttcactctaacaggttttgaccaactcgccagtcgtttctcgcttcgtttatgctgcccctttgttcaacaatcacacactaaaatgttcaggtgttccatcgtgtcaggtatgagaattatcatgaaatttatggaggtgaagtggaatcaaggacatccaactacgctgatttggtacctttttagctggagtagttgtttttcataataatttgcatatagctcatgtgaaatcgatcaattgaattagcaacgagaattttggaggttataaccaaactaattagtgccaaatttaatgcatcaggcaaacaagtattatgatcttgtcaccagtttctacgaatacggctggggagaatcattccatttcggcagcaggtcatgccataattttgccacgccataattttgccactaattaagtttgtttggatgggctttaggttattctgattttgtttttcttcgctgattatctttcagatggcaaggagaaactttacgcgaaagccttaagcgtcatgagcattttctggccttgcaactcggcctcaagaagggcatgaaggtcaatgttatactactattaattacagttcaagaaaagagaataatctattaactataaatgtgattgtttctaatcttcatagtggagtcatttttccctgtgcatatattgcaggtcctagacgtggggtgtggcattggaggacccttgagagagattgccagattcaggtgacaatttcctgttgccaatttcacaaattcagagataaaaatcaagcgaactataattattccaatgctactaattatagctcagcatcggtgactggactgaacaacaatgcgtaccagatatcaaggggcaaggtaacgagttctgcattttatttaaccatgtgcatttcttttacagagttagatgtgaattatttgaaatatgttatgcatatattatcaagatgaagacatggatttttcaccatgagctagatcaacacttaaaagttaatttgatcttcattgtgcaggaactcaacttttctgtcggtttgagtgaaacctgcaactttgtcaaggtagagacatatatacatgccctccaatcaccaattcagttttaggtgacaaaagcaagaattgtcatgcaggctgacttcatgaacatgcctatccctgatgccaccttcgacgcagcctacgccatcgaggcgacatgccatgcccctgatgctgtatgcttagctcatttattttcctgtatcatatcactactcatttcgttccaaaaaaaaataaatctaaaaagggatacgatccctcatagtacaagtaacatggacagaattttgtttaagttcgttatacggatcacatctcccgcctaagtttagtattttttaggatagagaaagtatataggtaagtactattacttccgttctaaaatataactatctagataagtctaaaatatacgatattaggttgctatattttggaactgaggtactaggttggtaacatgaaaacttattatcttggtgaattaacttgtacatgtaggttggtgtctacagggagatctgccgagtgctgaaaccagggcagttgttcgcgttggacgagtggtgcatgaccgacaagtatgatccaggcaactcgaggcaccggagcatcaaggccgagatcgagctcggcaatggccttccagacatcagaaccaccaaacagtgcatccaggctctcaaagacgcgggctttgaggtgagctctactccaaatactacacatcacaacattaaaaataggagaaactcttttaatttcttgagggaagagatatctccttgtttgttcgaacaacattcaaataatcataaaaaaaatctaaaaaaatggactaacatttgtacaacatgtaactgtgatcgtttagggctagatcttaaatgagacctgaaaagagacgtccctccaaacatttatcttaaatgagatctgaagagagacgtccctccaaacatttattagtgtgagcgtattgaggattgaacacggaaccttagggttgacaccacacatccgttgtcactgcactatcaagtgcatctctttatagctagatcatcaaagatcaagatttatctttgtgatgatgtgtttgaaggttgtatcggtgaaggatctggcagaggattcgccgttgccatggtacctgcctcttgattccagccagttctcactcaatggcttccgtctcacccgtgtcggccgcttcatcactcacatgctggttcgtaacattttactgatataccatgtactccaatctagatttgtagtattatttgtgtcgaattcagttataagttactactacattttaagacggagcgagtacggaagtaaatgaattgttggtagagtgcaattgacgtcttaatttaccttcaaaaatcttcaggtaaagacgctcgagtgcctccatgttgccccacagggcagcctgagggtctccagctttcttgagaccgcggccgaagggcttgtgaagggcgccaagtaagttgatcggcctcgagcaaatctgaagcaagaaaattttgaatttgtgccgaatttatatcaatctccgaaacagtaatgctgctgaatgaatgctgcatctttttttaaacaacgctgcttaatgaagtgtgattttcatttccagggaagggatcttcacgcccattttcttcgtcttggctcggaaacctctggacaagcagccagagatctgaagaacagagcaaggtgtggtaattatcatcttcataagtgtgcaataaaaagaacaactgtttgatcagtgtgtacttctctgaacccagcgagatgtggtgttttatttggtcaattcgtgtcataaaaaagtagtaagtttgttcagtgtgtacgtaacagtttcgtctgggtatgaattcagtatttgtttttcagtcttatctttcttctctccagatagtctgcaagttcaacttcaacaacagatgggagtgtttgaatcaacactattttaccaaacgatcgagtagtaaaatgcttcaaagaccactagtctgagtacaaaatgtgtccatggttacatcgaagtcaaaaaaacaacaacaacaaaaaaaaaaaaacggttataaacccgcgggaaaacagtagagtgtctgaacacaatccacatatatctgaaatcgatcaagaaatcaaaaatcaacacaaaccacggtgaaagaatcgacaggagatagatgcatcgatcatggcgagagagagagaatcatcaaccggagatagatgcatcgatcaatgcatacgaacactggatcatatatcgaaattgattctactgtagcatcgccgtggcggcgaccagcgccaacgccacggcagcgaaggccgccttagcgccgccgccgccggcggcggcgctggcgttgggcgccggagcggtggtcgtggaggaggacgagctgtccgtggtgggggaggaggactccggcggcgacgacgagacggcgggggacggcgcggcggcggcgccgcgcttggaggcggcgggcgccggggaaggggcgtcagaggaggaggagcgctgtggcttgaggacgcggatgttgaccttctggccggcggcgcagtggccggggacgccgcagatgaagaagcggtggccggcggccttgatggcgatcttgtcgtcgccggaggtgtgcgtggcgatcggcgacgagttggtgcagctgtcgtagtccgccttcttcacctccaccacgttgtgaatcccctgcgggtacttgaactctgcccaaaataataaaattaaattaaaccattttttagaaaaaaaaaagctcccatcggatggcctaataagctaaagaaaaagccaaattttaaattttcaaacttaattttgatattgattttgagatattttcaacatagtttcttttttagcattggcttttaagtcaccaaaaacacatatataaaaattttacctataaatttattttattttctaataaaccgttttggcttattaggggaaaaactaaatgatggggcctaaaatttggcaccatgatcaactcgatgtagatttgctcgaaaagtacttccataatgccggatcgttaatggttactccctccgtttgatattataagttgtttgattttttcttcgtcaaagttcttaaggtttgactaaacttatcggaatatatagtaatatatcgaccacaccaaattagtttaatccaatttaacattaaatatgttttgataatatatttgttttgtattgaaaatgttattatatttttctataaatttggttaaatctaaagaagtttaaatgaaaaaaagtcaaacgaattataatatgaagcggagggagtagaattttataggtttataagaattttgtcctaaactataagcttttataaccggaggaagtactcaatttggtgccaaatcgatgtagatttgctcgaaatactgtcacaatatcgaaacctattagattttataaactcgttctaatataaaattagtagttgagattttaaaagtttgattgaaccttgtccttaacgtcaaatatatgtaaaccggaggaagtgctccatttgacgccatgatcatcacaagtccacaaggacagacgtagtgcaaattttatcttttttcaaacaagatatatcttttgaaattttcatcatcttttggtaccaaattgatcacgcgaaggcggcaggaagagaagtgtgaggaacgaaactaaaaacgtgcaacataaggtactgtatctacctgtcaaaaggattcatacaaagcacctctttttacaccaagagcaagttgtgaacaaagcatgcatttggatgcttctatactactcataggaaaaaagtgtcaaaagtgattagctttacaactaatcagtagttgacaaatagcatactgtcagatgaatagtatattgataagtagattgagctactggccatttgatacataagtataatttatctcctagagttttggatcaaaatttctatggcaactgaaataactacctcaataaaactaaaaaatttcagccggcattgttggatcatgtacaggacatccaggtacacgcaagttcaggatctgcaagatcctgtagccaatgtccaatgagcacaataaatgaaacagccacatatgccatggcctagtaattgtgctcaccaacactaccatttctgaggctttctgaatagcagttcagatggtccatgagaaaaatttatggatcatgctagttctatgcaaaggtagcagcacacggcgcaatattcgtgaaacgccttcaagactagaagtgtgaactgtgaagtgcaagaaagttgagataaattggccttctttttttaacccaaatttcgctgtcaatggcgtggttaaagtgagactcttcatctaaacgcaagacaaaagaggtaaggtgggttgtaaagtacaccggtgagggtgactgttcattaacattccatctctttgcagcagtaagctagcttgggtgaaggaaagaatggacaattactgcttaacatattaatagtccaattttattaattttctcgaacaatgctggcttattcacacatttcaccaacgaaaagaaaatcactgaaatacaaatgctaaactagctagaaactacttgtagtaagctgtagcgaatatatgcaatgaacaaaaggccgaagttactagcactggatctagcactgaaaaatttacacgatcaaaattaactagccttggcactgagcaaacattctacttctacatatacaaagcaaacaaaggttcattattcagatatttcaatgtgtataatccattaagaaccacagattgcatgtatttcaaatgtgtattgacacgcaagccttttgcatgttcgcgaaaaaaaaaaagataaaaactgcttgggaagaactgaaaattagagtgagaaatgagagagcttgcctatggtgtccccaacatggaaggtcttcttgacagcccagtcagtgtaattgacattgccgaggatggtccagccggaggtgtcgccgaccttgtagaccgccgccgacgatgtcgccgccattgcgagcccgagcatcagcaccagcacactgttcatggccattgccattgccgtgctacctagactgtgtggatggaggagatgaacagaggaggaggaagagatgctaagagcagagaagacgaaaagaatttagtactataaccttgcttgattgcttccaacaatgttatgccaatgaggaggattttatagtgccattgctcactttcagaactgaccattttgcccctgtacatttcctgtctgaaactggtatagctaaagtagatgagctatgtattatttttcatcttcttggatgatctatctattggtccttgagtaaagcaaacttaaaagctggccgtgtatccaagtcttgatcatgaggctggctgttcgatgaatggttaggtcagtgcagtgctcttcgccatgagtgagtggactctgctggtacgagatctcacatagactctcatagactcatacttgtttggagatctctttctttttgtcgaagcaaccaattgccaaacatgtgtgtatgtatgcgttgtttgttagtcgagatcgatcttccagttggtacccacttatctttttctttttcagctttgtttgagatgtgatgcacacacacatatagttttcagagtaatggaacttggggttcaataaaatttgagtttctttatctttctcttacccttttcttctcctttaatttaatcattacgatgtgcttgcagaagtctaatcaatagcaagcacctcgccgaacatgttcagaatttctgattggttgggatgctaatcatcagagctgatctactcaagctcagaacttaggatatctaagtatctaacactcatattgagatccattatctaaaaaaaacactcatattgagataatgctatcagtagttgaacagaaaactatttgtatttgcataaaaggttgtttctatttcgataaaaatcaggcacgtttggtaattaatcaaatgatccttgaaatttaatactacaaaattttatattaaaaaaaaaactttcttccatgtacatgtggattttttgactttttcaaatatgaatatgacaaaaaaatcgcatcgcttaaattggtatgagcattttttttccattaaactttgttatgttgtaagatatctaacattcaactgatttgtttatacatatttaattaaacgaaatttaattggtgtttaacaccacttatattttcttataatcagctgagattttcttatatgtctgccaactacctcggccatcaacctcggccatccgactgaaatcaaatggtcatcacattttcagcgtatgcgaaacgagacaagtcattagtgtatgactaggtgagtattaattattactaacttggaaaaatgatttatttgatattttaaaataacttttacgtagaaagttttcgcacgaaacacgtcggatagtagtttgagaaaagtgctagcaaaaccaaagaaaaaaatctacatctcaatcagaaaaaaaaaacaaggctgagcctttggatgaaccacaatcttatctcatcaaactgtcccgacaaacaacaatgtcatgtcgtgcattttgtcatggcttcccaagctaaggtggcaggattatgtcactggtttagggtgagggtggtcaagttagttggtgcagcgggtacgaaggtatgttgtagaggatgcatatcctctacattgctacacgctcactgacacaccagtgagtagtactgcatattgtagaggatctcgacgcatgttataggcaatggtgagagcaatccagtgaggtggaggtagcgccactgtaaccattattcatgaagaaggccagtggtgggtggatagtatcaatgttagggtcaatcgggacaggttacaaggcggcgagaaacaatagtcgatccaatagcgtaagccacaaaaaacggagaggtgaggaagcttattggcttgagcgctcttaaatagagagaaaaaaaaaagaagaaagtttgtcttagagcatgaagaagtttttatgcaccatcaagttgcaaacaaaaccgaccgacaaaagtgaaaatgcatccactatggttcaaatcctagtggttaacaggccatgaatatcacgtacacgtgcacacactttccataaagatttagtggactcggccaagaatatgtcgttagcccccgtcttttcaaacgtgtgttaggggtacactcatattgttatagtgtgatgtccgtgcccgacggtgtgggtacatgtgcgtttcccgtgtaataaaaaaataaaacctaccaagaaaagctaaaattcctataaccatatggcgatttttattacagagcatataggggaaaaaaaatccggatgggcgacgcgtggacgtgccgtggatccaaccgctcgctggcgtcggctccaagcggaagaaaaaccgagaggataatgcagaaagcccaaccctcccaagaatcgaagctccctctcctcccatggagctcctcctcctccatcctcctcccttcccctccctcctcctcctccacaaaccctaccacttcccctccaagctccgccatggccgcctgcaagaaccccgcgtcatggcgtccccgcaggcgcctcccctcccgctttcgtcgctccaagaatcgagaagcgctcgtatccgtatcccccgcgacgagccgaggccgacgccgcccgcgcgcagcagcagcagggaggagccccggttcgtcgcggagaccaaactcatcaccgtgcattcctgcgcggggcggctcggggacgcacgggaggtgttcgacggaatgggccgcaggggatcctgctcgcctggtcggccatgatcggcgcgtacgccatcaggggaatgtacagtgacgtcctcgcgctcgcggtgaccatggtcgaggaaggggtgctcccggacaggttcctgatcacgcggattttacaggcgtgcgcatatgccgaggaccttgagcttggtagggcgctccattccatggctatcaggagagggttcatggggagggtaaaggatgtgccggttgggaactcggtgcttgtgatgtatgccaaatgtggagatttggggtgggcgcgcaaggtgtttgacaagatggtgtgcagggacttgggcacatggaattcgatgatttttggttattgccggtctgctgagtgggaggaggcacggcatctgctcgactccatgaggcaggaaggtacgcagccaggggttgttacgtggaatacattgatttcgagctatgccaggttcggggatcttgatgtggcaatggaattgcttgggcagatggaggagtctggagttgcaccggatgtcgtcacatggactagccttgtctctggctttgttcatatggataggagtgatgaggcacttcgatgtttcattcggatgcgtcttgctggagttgaacctaacggcatgtcaattgcatgtgctatctcagcttgtgccagtttgaagttactaaaccaggcaaaggagctccatagccatgctattaaggttggcagtgttaacaacgtgctctcagggaactccttggttgacatgtatgcaaaatgtggagaaatagttgcagcttggagaatatttagtgggatacctgacaaggatatattctcctggaattcaatgatttcagggtatgcacaagcaggttattgtggcaaagcatacgagctcttctgtaagatggaaaactatggtgttcggcgcaatgtgataacctggaatacaatgatctcagggtacatacggaatggggatgatgagagagcttttgagctattccagatgatggaaagtcatggagtaaaaagggatacagcaacctggaacatactcattgctggatcagtgcataatggttattatgatagagccataagaatattccggcagatgcaggcacttctgaggaggcctgactacattaccatccttagcattattccagcattcacaaatctagttgcgtcctggaaagtacgggagatccatgcctgtatttttcaccacaatttagaactggatggcaaaattgcaaatgcacttatcaatgcatattcaaaatctggtaatcttgctagtgcgtgtgctgtgtttgatatgcattcatcaaggaacattatttcttggaactgtatcattctcgctcatgtgctgcatggttctccaaatgaagccttggatcttttctgtcaaatgaagcaagaaggtgttgtgccagatcatacaactttggtcactgttatcaaggcctatggtctcacgggaaaggtatctgaagggtctcagacatttttcaacatggccaatgattacaatataactccagaattagaccattatgcagcaatggtggatcttcttggtcggtcagggagactaaaagaagcatatgagcttattgacgagatgcctttgatacccaattcaacagtctgggacacatttcttactgcagctgtaatgcatggaaatgtaagactggctcacctggcagctagagaactgtctgcgattgatcctggagatcccagagtccaaaggttaggttctagtctgcaagatctaactggaaaaactgttgatgtgccagaggagatgacacccaacaaaggaagaaatttagatgaggtcgagagctgttcaatagaaatcaggaataaggtgtatgtgttctcaaatggtgataatgttggcttggaggatacagtagcagaattaaagtcgatgatgtttaagatgggacattctatgcttgacattggcattggaactctagatgttgaagaagaaaaggaagaagttgttggagtccattgtgagaagctagctattgcatttgggctttctaattccccacagttcaaaaacataaggataatcaaaactgcaaggatgtgtaaccattgccacacctttgccaaactagtttcagagaaatatggacgccatatactgatcaaggatccaaagtgtttgcataagtttgaggatggaaaatgctcttgtgaagattattggtgaatgatgaatacaactagtttatgtctactgggtaaaatatcttgccaagtgtccttttgcaggattacacgctgctaacctcttgaacaggtaatatccattttgtcagattcactccaggagtttccttggggttgaattttgtctgtcacatacatagtcttgttgacaggattacttatccttgtagaattcaaacacttggaggatagcctatccatcaattcaacccccagacaaaaatatccagtactatgtggtatcagaaaaggggatctctagactgttctgatgctattccagcttcagtttaggtttattttgaacggcttgggagacagtactggtggttactccattccatcattcaagaaacagtttggtaccaatcacacatcttttaccttttgttaattgttccaaatagttagcaacttagtatctcacaaatttatgcttacaatttgatcatttctattgactataaaaagaatttcacttgccattaaactgattcatcaagttgatctgcgtgttggttcacatcgggaatattaccacattgaggatggccagacaaccttgtcaaaagggacagaggtattagaaggtggatacgaaaattgactgggatggaagaactagagggataattatagactaggatggaaaaactagaggcattgagaggcagtgttaaaggattgaatatttcttcttgattgatctcgtctgatgctgatgctctgtattttctctagatttgtccctaacatagtatatcattatacatagactcttgatttctaaccaaaaaaaaagctgacattacttgtacaatttagactctaataattaaaaactatatttacactcaaaaaaatattcaagactatattctaaacttgcagactcaatttctaatttaataggaccttaatgtggcagccactgcttcttgcagctgaaatgctcctgagttttcacaaatactccctccgtcccaaaaataagtgcagttttgcactattcacgttcaacgtttaaccgttcgtcttatttgaatttttttttatgattagcatttttattgctattagatgataaaatatgaatagtcctttatgtgtgattaaatattttcaattttttcacaaatttttcaaataagatagacggtcaaacgttgggcacggatatccacgactgcacttattttgggacggaggtagtatcacttagatttattccatgtgttatgatggtttaattttttccttcatcacatgcatacatgttttctttaaaatattacataatgctacatagaaacaatcttttaataatatagtttcagcattttaacagtgtcacacagcagcatgtacttattgaaatgggatggcagctattgtagtttcttaaattttgccggcatagtttgtgtctctatctgttttgttttccttttcagggtgaaatactaataccaatttcttttgcaggttcagaagcatgaacatggcaatgtaactttgagagttatagacttgaatggaaaaaatgaaattcttcaagtggttcctatttatacactgctggagcaaataagaattatcttagtagattttaatagcaccataaacattagggatagtgaggctagaaaatctattgtccacattcattaggtccaatctaatacggaaccatcatattacattacgcttcatttgcctcccgttcgatgacacaatttgttggatttgtttgcccctctgaccaaaggaaaccacgtggaaagcgtggttatcagctaatcatgtggaaggaggggatgaacagaggagaacgaagagatgctaagatcagagaagacagaggacgaaaagaatttaatagtaccactcactttgctcgattgcttccaacaatgttatgccgatgaggaggattatagtgacttgctcactttgagaattgaccattttgcccctgtacatttcctgtctggaactggtatagctatagttgagataaagtgtttagctaaaggtacgagaactctggtacttgtttggagatctctttctttttgtggaagcaagcaattgcaaatttgtgtgtatgtgcgttctttgttaatcgaatccgatcctcttttttttttttttttgagaacttcgatcctgttgttggtaccggcattccttttcagctttgtctgaaatgtgatgtacacatatatggttttcagagaaactagaattggttggtttctgaattctgaattgtgtgtgaaaacagatggatgggaggatcggtgggtcaaatctgagtggaagaaggaggacaacacagtcggcgagtggaaccacacggccggcaagtggaacggcgacaccaacaacaagggtgaggatcgatgcacacaccacgctgctgatttcgttttttcttttctgttccggcatgtgcgaagttactctgcttctctgtgcaggtatccagacatcagaggactacagattctacgccatttcggccgagtaccctgagttcagcaacaaggacaagaccctcgtgctgcagttctcggtgaagcacgagcagaagctcgactgcggcggcggctacgtgaaattgcttggcggcgatgttgaccagaagaagtttggtggcgagacaccgtacaggtgatggtttgatcaccttgcattcccttctgtgtgctcatttcagagcgcaacatctttgattgatcggtttcttttgaaattgcagcatcatgtttggaccagatatctgcgggtatgccaccaagaaggttcacgctatccttactaagggtgtgtttgaggagaaggagatagagaagattgggaaggtacgcaaaacgaggtaagtcattagcgcatgattaattgagtattaactattttaaactttaaaaatggattaatatgattttttaaagcaactttcctatagaatttttttttttttgcaaaaaacacaccatttagtagtttgggaagcgtgcgcgcggaaaacagaaacaaactcactccctttgttctccaaacgaacgcagcctaagaacggcaataaccatctgatcaagaaggacgtgccatgcgagaccgatcaactgacacacgtctacaccttgatcatccgtcctgacgccaaatacagcattctgattgataacactgagaagcgaactggaagcatctatggtgattgtgataatcttcctccaaagaagaagaaggatcctgaagccaagaaggtaatttagagataattcactggctgttctgaataggcagtctgtgctgttctatttttacagaggtcataactaatacggtaaaatgttactgtttgcagccagaagacgggctgtgtttagttcagcacaaagtttgtattttggttgaaattggagataatgtgactgaaaagttgtgtgtgtataacaggttgatgtgatgggaaaggactgaagtttagatccaaactttggatctaaacacagcctgggacgacaaggaatcattcctgatcctgagtacgagaagcctgaggttgctttcctttgtttgcgcaactttagatgatatttctgtctgaagattaattgagtttttactaataccactctactgagtttctaaatgaaaatgggtggcagttttgtactgtatgttgtgagcttgctgctcctcagatagcaatagagtacattgtgttacaaaagcatcatgaggccatatttgatctcatcaaaggctcatcaaagagcaacaatggcatcaatcaagtgacttgtaacagccatattatggagtatttgtatcacaataacagtgaatcctaggcttgtacacatacaaatcctcaatataaaagaggacatattgagatcaataaaatgggattcactgttttcactgtttatctatcgttttctaacacgttatcagcagctctaccaagagagaatagtgaaaacacttaccgacacttaccggcacgtgcatcatgttttcctctgtcactgctttgtggtgctttcgaagcccctcatctccctcgtgagagctagatggagtgatggacaattatttattttgcatgtcaatcatgttttcctctgtcaccgcttcgtggtgctttcgaagcctgtcatctccctcgtgagtgagatgtcaatggtactgttaacccatggatgcaaagtggtacgatcttcctctctcatttccctaatgagagctagatggagtgattgacaattatttattttgcatgtcaatcatgttttcctctgtcaccgcttcatggtgctttcgaagcctgtcatctccctcgtgagagctagatggagtgagatgtcaatggtactgctgtgattgacaattatttattttgcatgtcaatcatgttttcctctgtcaccgcttcatggtgctttcgaagcctgtcatctccctcgtgagagctagatggagtgagatgtcaatggtactgctaacccatggatgaagtggtacgatcttccttttctggttgatcgtccatgttttttgcttttttcttctatgttttcctctgtcaccgcttcatggtgctttcgaagcctgtcatctccctcgtgagagctagatggagtgagatgtcaatggtactgctaacccatggatgaagtggtacgatcttcctcttctggttgatcgtccatgttttttgcttttttcttctatagaggaataggtggtagtgaggactaaggcgagaactatacgttcgaatttaaagaaatatagcgagtccggtattttcgcggatacgctattttgactgtggttatcttagctgtgcagagtctaggagtactctcggtgtaattggatcacctcgatttataattatttggactgataactatgaaagaagcttaattcttttatggtcagaaatgacaaattcatcaaaggtaaatgataaattcatcaaggtaactgattaaatagtatttttcaatcattaaatgatcattgcgtattagtcgttaatcataataatttacagagttaaacaatgcaatgtggcataaataatgttgaaattgtgttacactcggataagaattctaaacaagccaaaaaaatatatatcttctaaggaagtttgaattgataagctcaatacagacatcaaatattctgaggaagtttgaattgataagctcaatacagacatcaaatatgcatttgttgaattcagacgacacactacaaaatggaatgagtgaccatgctgccccaattaaattcaatatatatatttatgtatgatatttatatttcatatgatttgaaaagtttcaatcatttgaattaaatggctacattgaaaaattttctataggattgaaatcctataaaatcctacatagatctttggatttaaagtagcgcttatttacttaagtatttattttttatattacatgtatttaaactaatgtatttataaaacaataaattatctaaagaaatgtaaaaaattcaatacattataaaaatagactaaagataaactaaatctcatttttatatgtagatctcattataatgcataggcatgtaactagtaaatagtgaatatcacaactcacttgaataatatatatcacattatgatcattggattcataacaagtgttgatcactacttcatccaaaaaaaattatatgactatatcgtttaatattattaaactttatagcattctagattatatttagcaaaaatatctttctactaaaaaactagtcagataccttttataaatacaatatcatttacaaagataatagttattattttctcatataaaaaacatagataatatatattacagagcacacacacacataagctagctgctactgcctccgtctctaaatataagggattatgtctagatttattgtactagaatgtgtcacatctaaccaaaatcgcttatatttagggacggagggagtagtattcatgtgcaagtaatagtgttgagtgctgactgtagcaatattattatcaaaaataaataagaatgagaaaacaagaagaagatggaacaacaaaagaatataaggttaaagttgttagtttcacaccattcactacaaagaacaattttaataatattaatatattatctattaatgtgagtatataccataccatggatgtgagcaaccaccctcatgtgtttgggctagtgactaacctcctctttttcttacttcttttgaagttctctgaacgtatttaggtaaaagatgttttgttttgaataaaaaagaaacaatttaactagattattttttagagagaatccatcgtgtgccgctaactttgtcactgttctataatatgccactgagtttgttaagttctacaatatgtcattgtattttgcttaaattctataatataccatcgccgtccatttagattctgttagtactttataattttgtcctaatgattgaaatatccctaggacaaaattttctaaaatttggctgaaaattccaaaatatcatattataaaataggcagagaagttgcccatctcaaactttgtaagttttacaatctgtatgataaaattgtacaatgctaacggaggctaactagacgatgatggtatattatagaagttaagcaaaatgcggtgccatattagaacttgacaacccaatgacatattgtagaccggggacaaaatcagtgacacacaatggattgtctctattttttatggttgttcggttaactacctatctactatgatgcggcttttttagaaaaaaaagttaaatcttacactataagtccatatcttacacattaaattacatacacttataatataattttcaaattttaaaatgccctattctcattttataggagaattatggaaaaatgatttattgtctatttaattatgagaaaaatattagtccaaattaacatatatgtagaaaataaaaaacaatatgaaagaactacggaaatacctactaatgtagtaatcatatatcatgcaatgaaaaaagaagaccatagtcgaatactttattattgagcaaaaatgatggtattatttttatcatcttttagcggaatctatctaaccataattaatcatcccgtgttttttgtgggacaaaagggagtaaattatagcacatactatggattcttaaaaattcttaaaagttttcatataatattatcctttaaccattcttttcatttacacaatagccaactttacatttcaatttggaccaccttattctatccaagtccggtgattcagcaatgactctgcacattaactctctctctctctctccattttctttttccctccaacagttggataaccaatagatctagcaagaaggagcccaaatatagcgccttcgcgcttcgtcaggtcagctcctgcctcccaaagtccctgcaagcctgacttccccgacctgaacgacaaccataacaatagtgtgcatcacgataggggagggtaaaaagacatgtcggttactagagggtaaggctgcgcatgtaaaggcaagaggaggaatgatgatggctcatggagaaagagtggtggtggtggtgcgtagagtgacagttagtgtttgttggtggtatgaggaatttgttgttgacacaatcgcttaattttcctttaagtattgatgatacgtggatcaccagttatataaataaatagtaactacttttaataaaatagtaaaaatattgagataagggctatagatggccatttggccctcctggtatggcccggcccaggcacgagcaaggcacggccaaagaagaatcaggccggcatgacacggtcggctctttgtgccgggccgtgccggcccacgtgctacacctcaggcctaggcacgacccactagcagtcgggccgggtctttgggatgtgacatatatataactaaaataaatatattttatgtccatattcttttggccgtgccatataatacgtctatttttgctcctactgtgtcttacatatggttgaaaattagtccgttatgtatcctgaacttcgtaccaggcttggctgtgccatcccggcccagcgtgccggtggggaagcccaagcatggcccggcggtcgggccgggccggcacgggcacaacccccagtcgggccgtgccgtgtttgggccgggccgtcaggcttggaccttgtgggcatctataataagggcggagtagtcgagtatcgcgtagaagaaaaagaaatctgccgtctcgctctcgttgtctcctccgctccttgcgccgccgccaagacgagtcgcggctgaacaggggagcgccgggcggcgagctccatctggcgagcagagcagagcagcggaggggaggggatcctggtgagcatccgcgtcctctctctttctgattcatctctctcttccaccccaccgggactggaatttgcttgcgttcgtgaacccctactagcttctcttctagatctggaagaagctcttctcctcctccttaatttgatagccttaaacctctcttaattcagtttatttgttcacccaaaagtttggtggttcagtcccaagttggatccgcccctgtagttaaatatccattttttgggctatctactgatttcccgtcaatgattttgttgctgaaaatttccagccttttctgcttcaggaatcaggacatagatggatccagaggtgaaggactcaaggccatcgaggtctcccggcgaaccaaatcttttcctgcaatggggcagccggaaacgactccgctgtgtcaagacgagggacgacggctcgccatcacctgcgcggaccgatgttcttaggcgcaccataccacgagtgaatcgcccgcttggcggtgatgttgccccgtttcgttcgccgcggcgcccgagcacgctgaaccgaaggtagcttcagtatgccatagaacacactcgcatcgactggaaatatcgagcaattcttcctaatataaggtaactgattgtctgagagcaggaaaaccgagccatttgtgagcgataacaggcactccatgtcactctcgccagagaaggatcgatattactccactaggggttctccattcccattcgagggaaatgggtttgattttggtggtggaatggaagaaaagggaaccacagcactgccaaggttcttcatttcattatccaacaaggagaaagaagaggacttcatggcaatgaagggatgcaagctcccacagaggccgaagaagaggccaaagttgatgcagaagtgcttgcttgtaatcccttctttcacaaagattactgcaaaattttgttcttttatgtgatcatgctcacttttttttaacccttccatattctgtttcattgttgggcttgttgtagatggtaagtccaggagcatggctgtctgatttgtctcatgagaggtatgaagttagagagaagaagtgcgctagaaaggtaaacctagctttgttgttattttccttttagctccttgtccaaattttagtttgatggttgctaattcaaggaaaaactttttgcagagggctagaggattgaaggctctttgcaatgagagtgattcagaatagaaatacagagcgggatcaattttttttgacttttgctggagacagttaggtacaatgctggttcattcattaactagacagatctgagcggctaatttagagagggaggatcaccggctctcctactatccttatttcaccacccctgtatctccatcctttttttgttcattcgttgttccaaacaaatcgtcatctagaactaagcctatcgaccgaaatagttgtatattagatcattcctgatctagcaagtttgtagctcagaccttaaaggcaccgcggagtttggtcaccactgaagtgaaagtaaatgaaaacgaagagagagagcttaagatggaaggcagcaatgcatggtctatgagtctatcatgatttgggattgagaaagaagatgggaggttgttgggtatggtgcatggtgcattttggtgcctcaattgttgtaacagtaacaccaagttgggaggaagatttgaggccagctggccattcaaataggttactactgaatcccaaatattgtaatcctagttgatgttgaagagaacgccgtgtgcaggccatgcctgggcatgatcctggattcatggttagactgtttctcctgaaatatatatcaaattcgcagagttgtttgaccttctccataagtcttgtgttacagtttaagttctgttggagtgatggattgtgctgtgtcactcactcctgttaataattctgcttggtatgttacgaccgttgttatctttggttcgtttcagactcagtaatctgtctaggcgcctcgtcaggctgctgaaattgagcattttgtggggagggccgagatggtggtcgtgggccgtaattgggagcccatgaagagaaacccggcctgccacgggctgcctcgatcaatgccgccgcaggaatttgggcctccatttggcctaccagtaaatggaccgctgctgcccgtgggctgtacgagggagcccaagcgaagaaacgcggcccacctcacaaatttgggttcgttttggcccaccaagaaatccgtattgggcctagagtggagtaggagagcaatttcacgcgccgagaaatggtggctgtcggactattttgggcctccaaatggcctgcttagaaagtgggtcgtcgtgggccgtttttagcgtgacaggccgagttggagcccaactgttcagccatcctcggccatcgggaagtccgtcgatccatggcaaccgctcgccggaaagtccgtcgtctccggcaccggcaagtgtacgccactccgtcatcattttgcttgctacacgtccaagacaggaactgcttggcatgtgagcaccaccaaggctcctgcagtgtccgggtctgcgagtgcatcatctcacttctgactaatttaggctgtgtttaggttacgggtgtaaagttttggcgtgtcacgtcggatatacggatatatatttgaagtattaaacgcagtaacaaattacagaatccgcctgtaaaccgtgagacgaatttattaacctaattaatccgtcattagcaaatatttactgtaacaccacattgtcaaatcatagcgtaattaggcttaaaagattcgtctcgcaatttacacgcaatctgtgtaattagttatttttcgactatatttaatactacatgcatatgtccaaacatttgatgtaatatggtgtaaaattttgccagggatctaaacagggtctaataactgactggaactggacagtgacacatctctacttccagtgtttctttttcttcagagaacagacaactgagggggcccctctctcccaaacaccccctcagtgacctcacctatgatcaggagtacaccatccttctgttcagggaggttcagagctttcaaaattcaacacagattcatcagagaaatatagtactactgtacaatgcaaatgttgatgatccacatttgtgtagttctcttcgaaccaagtcaaaagaaaacacatcaaagaagcaaagggacaactaccattgcctacaggatttgagcattcatcaccagtagccaacaccgagtgcctcattagttatccaaaagcttattataagccataacagcttattgagataaaaaaaaatgtatatacatatatgtttttaatgacttaactaatactgaaaaaaaaaactatgttgaaaatatgttaaaatcaacttcaaagttaagtttaaaatttgaattttagctttgattttgtttttttaggcgcaccgatgaggctaagcccttgtttagttcctaactttttcttcaaacttctaacttttccatcacaccgaaacttttctactcacataaacttccaacttttccatcacatcgttctaattttaaccaaacttccaattttaacgtgaaaaaaaacacaccctaagattcagaaacaattaaggagaagaagttggcctgaggagttatggcactggcaaacatggacctagtttcagaatggcccaaaatttcaagcatcttcacatgacacatatacaaactcctgcatatacaaacatgcacatttgagttgaggctgctctgcccccaaactgtctctgaatctggtcctggcctgtcaaacagcatgggttctcttccaacccaccaaactggagcatatactatgaaacaagggcaaacaaaccagacctctagaaacactcctcaaccaattttgttcatctgcacatgactgttgatggcattaagatggtcaatgcaatgtacagtacctcttacaaatccttcttcatctgcaattgacaaaaatatacctgacatttatgctccccatgaatactagtactcacaatattcaacatactactatttaggtctgatgctttcatggttggcagaagagataaatggcacaacattttagttattttttgtgctttttatagcctactaccagatactcctccatgggaatggcatacaagttgctgagtaactgaatcctaccaattcctctttcctatacaccactgacattcaaaggaggtaaaggtgacatgagaaaaataaagcatggccctctgaccctttagttaagcccaagagagaagctccataaccagaaagacaagtgaatctaccatataggaaaaaggaggtaggccatcaccacaaccaccaccagatgccattgcttctcttcagaagacttggcattacaaaaaaggaagaaagaaagctcaaggcagagagagattagaaagcaacaccggggacccattcacatgacacacactatctagggctaaaaaactggagcagatggtgtattacacttgaatggttaaacacttgctcagggtgttcagttcagttttcagttgtcatgggcagtttgagctccttccagggcctccatagtagaagtatgtgccccagtcggcattgttaccgttttgcacgtcgtagcagttcgattgctcagtgaatgtgcccacccccttgggggctttcaggttgttggtgctgtccaccacctgtatgttcttgaagtagcttgacttgctgaacccttcctccgggaagtgaccgctgcccatctgcgtcgacgtgtgcacgccatcgagctgcgagtttaccacctccccgccccactcgatcatcgacgcgctgtcgccaaggtaggagaataggaaggatggccaatagccaagaacataatccttgccaaactgcatccaccagttcccctcctttggatcctgctcatatatatgtccagcaaatttcattagagcaatgcattagtgcattactaaaaaatccaatgtaccaatatacagatgtatttagacattaaaaccaatatatcaatatacagatgtatttagacattaaaaccaatatatcaatatacagatgtcttcaattatcaatatacagatgtatttaagacatttgcaccgacatatctggacttcagtacacaggcattgtgcccatttagtactacaataggatgcctcgcattcatgttgtactaagcaaactatgtttgcactcattactcgtgctcaatggaaatgaaaaacagcttgctttctatcttgcactttgctcggcacttgcttgcttgctgaggtgaaaagtagcaatggttctttcttttggaaaacaatgaaactagagtaatcattaaggataagaaaggctgttgaggaagaaaaaaaaagtattatgaccacactaccacaggggcacagggtgaggaggaaactattttcaaagcccaaagggtatcagccaaggagcacgagtaagagcacagcagcaagtgggcagagagattctctggcctgcatgttttgtgacaactctgaacttactactactactactaagcgggggcatgtggtgagtaactgaatttctagtttaattttctagctcaccttccaaatcattatactgatatcgtattgggagccagagtagcttgagatggggaagatgctggctcccatggcgatctcactgtttatctgcacgaatcctgcacacaatacgttgtagcaccctgttgcctggtatgcatcgctctgcagaaacccaggtttaaacacaacgaattagacatcaatacaagcacatttcaccaattcttcaggctttaattcattctggaatgaacaaacaaaacttacagtccagtaagtgaacagcctcgtgttgttgtcgccgtagaggtcggggctaacctgaagaaaatcaaaggaaaacacaaaagcagattcagagctcgtgagtgacacagcacgcggggcatcgcggcagaaagggggtattgcaaccgcaagaacggtgccgcatttactcgccaatgcaaaagctcacgcatgagatgagatgaaatcatgaacatgaacatgagattagtttctttcggattgctacctgccatccagcctcgatgctgttgaggtcctcgccgaaggagccacccaagatccagagctgggacaagctgaactcgttgggctgctcgatcttgggcgcccagacattgatggttgccttggcgccgtagtacttgtcgccctggacgtacgcgatggcatgctgcaaaacaaagaaagataaattttcacccaggcaaatcagtaaatgagccattgctggtacccgcagtgcaacaacaaacattgcaagcatggaggtcatagcgcatcaatggcgaccccctctcattcctgggtgaatatgtgattgtgacgtacctggtggccgccctcgttgagcaggttggggtcgacggacatggggttgggcgccgggtgccgcttcttgccgtagcggcgcatggagctcgcccggagcaggtcgtcccgcttcgtacgccggattgggacggtgtcctccgggcacctgccgccctggtgccagagctggaccatgggcttctcgccgccgccgccgctcttggattcgtcgtacaggccatcgggatggtagttcggcctcatctgcggagagcatgatgatggtcaccgccattgttgcggaatccaacgaattgaggtttgtagatgccattgttgcagctgaaggtttacctggatggtgtggttcttgaggaagggatgatcgaaagctggctggtgtgagatgtgcacgcaatctatgatgtccccatctgggctctatttgattccacagttcgaaaatgacacaaatcagatgtgtttggtggggtaagaattgccagagatagctgcttgggtatccctatgaaaacttgctaaattttgcacaaagttaagcaagatagaagaacttgagaaaagaacaagcacaaagtgacagccaaaaggaaagtcacaaaatctttgctggtacaattttttgcatatttttcacccaatgtagccaaaaggaaggtaaaggttttgaacgaatggtaaagagagaaagtgaattcccccaagatcaaccacaaagagccacagaaaagacatcttctcttttgaatcagaataccaccttgcactttgaacgattagcccaagagcaaacctaccaccttgctcgtgcttcctcccaaatcctctccccccaaatgaagctacacacgcttaactttgaccaggacgacgaacccatgatagataccaattaaaaaaaaagcaaattcaaaatcttcacacatgacgcacctcgatgctcttcaccgccggcttgttgagccgcttcaggtgccggtgcgccctccccgccggagacctcgccgccgccgccgcgcacgacaggcagaccaccgccaccaccaccaccagccaccccacgccgccaccgccgcgcgcggtggccatgtgcggctctcgcctcctcacgccgccaccgctccctcctcaaatcgcacttcacttcacaccccccccccccccttcctcttcaccgacgaactcacctcgccgccggtgaccgcgccgccgcagcccgagggccgatttgagaaattcgaaacaatgcggggggtgcagcagcaggagcagcagcagcagtggatgggtgggtgctggattcttgggcggctcgtcgtcttccgctacagcagcagcagccacgaggatccaagtgggcagtgaagcgaagacacacacacacacacactctctctatctctctctctctcagcttcatcagctttcgcagattacgagctttatttttggggcttctggactggaccaaaatgccctccatgattcgcaaattattacgggtaccgggcattccacgccaggaccacgggtaacgcccactgatttgtggggtccgaggaaagcctttctcaagaaatggagtaatagccgctgtgttagtgaaaaaaaaaaagagtgaattgtactttgggctatgttttattgcgatagtttcactttgaactaccctgtatacaatcttttcacgttggactaaataattttacctttgttgcataatggaccaccataaatcttttcgctagtgatgtctagcgtctctttcgacaaatgtatggcatgcatattggtatgaaagtttactggcatgtcgttaacaatttgctcgaagtcatcgaagaactgaagatatgttttggggtggttcattgtgcaacaaaggtaaagttacctagtccaacgtgaaaagattggacaaatggtagtccaaagtgaaaattttggcaataaaatatggcccaaagtgaaattaactcaaaaaataatgtactccgttccaatgctaaattatactacagctatttctaacttagtataccttgttttaaaataaaattatttctttatctgttctcttttttttaatcaatcacaatcattttctcattcatttatttacctactttctcttcgatcattttttatatactttttaatagccgtgtccaactaaaaatatacttaaattctgttgtgattctctaatcatttttatctactttattaatacatgtgtctacctagaaaatacttacattctcaaaccgaggaaatatgttgttttgcgatataaaatccaacactatctatattagtgagtgatactttaaagattatactatctatatctttagtgaccaccaaatttttacaaaatatattggggctcaagaaaaccacttcccacgataaggtataaatattagtttgttttttgaacttaccaattaatcgagtggtttcatgtatcagacaacatcgagtggtggccgtcaatatttgaaaccttcatattcgtttcgcaatccggcttaaatttgaataaatggaaatgttgttgtgaagaaaataggtagttagacataatttttgtaataaatataaatgttgttgtgaagaaaatgggcagttgactgtaatgtcgcacaatgataataagagttaaacattagaaaagtccacaccatcaacatgacaacatgcattaaatgtattaattatactaagattatccataatatgcactggcataagattaattaatctaagtcaatgagacttttttttccttcggacttcatgccagacgatctatagctagcatgatctagctttgactattacagttcgtcgtagtgcttcctagattttctgtcatagctgactctcaccatctcaaatccgtaatacgtttgtctttcacagtttgttcctagatgtttatgcacgcattgcacggtggttcaaacggctaaacccgacttcttcctcctcttggggggcaaaaccctgggtatggttggtaattttctttattcgggccactcacgtgggcccccaccaacctgcccactgtgccgcggccgggcccccgttccgtttcccccaacacggccccaccccccacccgcggcccggcacgtgggagcagccggcactcgtgccaccgccccacccgctgaccagtgggtcccatcttacgtggtgggaccggacgcgtgagcttttcgcttctctctctctctcgcacgcgcgacgcgagcggcggtcgcagcattggatcccggcggggggcgcacgcgtgcctccgtgcaccggctaacgaaagttttaaggaaagtgattaggcagtgcttaaggtacggtgagctttggaaaaggggaccctgcaaagtgcacaccatgcttacagtactgatatattacagttaagtcattttgtttaacggtagtactacgagtagtaggtaagtacagtactgatattgcagttaagtcgtttttatcattacccgcatgcgaagacatgctaatacgtattaatggtgtcgagctagtatactagtatactctagtttttaatgacattcgtcaggtctacgcaagagaagtaactcaactgtcccgtcttcagatactccttccgtccaaaaaaaaaagacaatttcatgcctaacgtttgaccgtccgtctttcaaattataaaaaaaaataaaaagacaaatcacgcataaaatattaatcatgttttatcatctaacaataatgaaaatacgaattataaaaaaatttcatataagacgggccgttaaagttggacacgaaaatccagggtttgtcttttttttatgacggaggaggtatgttcaaatagaccccacacaaatacactatacggtatacctggataagatagtagtaggagtacattataaaaggaacattgtaaaatggctggtgaaatgaagaccgaaatgttaacctatcctataaaaaaaaagtaacgatcaccggtatgacacgtttagcagcaaaaagcaggtacagttctacgtataaaactaaccgcgaccgtgcactcatcactccgttttttaacccggcctttgctccagaatgtttttcacgctagtaacactaatcagaggagggtgaggactaaacgtggagggttaaaaagataaacatcgtctggtaacaacctgacaacagtaataatagtgcttgcacagtcgccctgcctgccacgatggctggttgtcgaagcagtaacaacagcacatcacatgcattggtcaatccagaccctgctaatgctacgaccgttgaccggtctcgtcttgaccggatcttacagcatcggacctcttggtaaacgggtaaaaaacctagaaatacagcagcagtaacatgctaaacagatggatacaaaatttatttagtatcggagtagtattacgtgcggtccatactggccccacctgtcagtaggccctttgcattaggacaggctttggatgttttcagtttggtccgtagtagttgaaatttttttcaccggctcagaagacagtcataataattcgaggcacacctatacaaataatgagctcaaatagacactaatagattttacttcatccacaagctgaatcgcccgcgaatataaaagcatataaccacgtcagagaaggaggaatccatctctcttctactggcttttcttgcacaagcacttgaagttgaagggcacctttatgtacaatttccaaactacaaagaattgaagcaaggctaccaaaagccagtgattctatacaaatggtcacttcccaacaagcggtgcaagaatcgaatcattatccaacatagctagctcaacaacgcactgaggatgtgcaaaaatgcagcttgtgtactagcaacacacacgcaccaagatggatacgaacaattatacgtggatacatgcatgggggctgatcggttagcatcagggcatgggggacaaagtacaaagcaggctacaagttggggataaggaaacccattacacgtcagctttagccttggacacaggaatgcataccaggtaagaacagtagaggagtcatgggcacaatcacaattcaaagccgttatatcacatggttcgctgtttctctcagtgagccaccctggcaggtttgtccagttatgataaagaggctaaacagataaacacacagggcatcattttcagtctccgtatgaacaattgtttaatgtcataaactcctgaagcagatttttaatatagggtcgcaactcacaagtgacatgcttgatcggttgatcctaggagctaggactccataaaggtactatatatattttgagatgttgagcaaatagtcacattgtaacagctgctatttaagtgctactgctaaccagctaaaattagcctgtattgacagagatggattacgtactaataactctaaagttccaatcagtgtcattacatacatttattcagggattgcccccatcctaatcactctccatcagctatcattcttgaaaaaacaaatcacctaccaagatactccctccgttttttaatagatgacgccattgactttttctcacatgtttgaccattcgtcttatttaaaaaatttacgtaattataatttattttgttataggttgttttatcactcatagtactttaagtgtgatttatatcttatacatttgcataaaatttttaaataagacgaatggtcaaacatgtgagaaaaagtcaacaacgtcatctattaaaaaacggaggtagtaacatgcatgggtctgcgactctaaattcaatctacgcaagcttaaaaggacattactcaacagcaacattcaaggggtcattttcttagacaaaagggtaatttacatccaacgggactgcgtgcatggtctttgggctgtaagctcatttatttgagtgctttcctgctgtgtgtggttgagctgccaaatcagttgcctcaccaaacgatagcatgtgcctttaccaggcatcaggcatatgaacggtgattcgtgctggacatggccctctctagtttgtaccgcaattccatgaatggttcttaaactttacttgcttaactaaggcatgattttcctgtaccacaaaactacaacacaacgtggtacagtgtgttccaacttccaagcccgatacttaaatctgactgtgaataggtttcaagtaattgggtttcagttctagaaagatctcatgctgcaatatgccaccagacgagttcaatgaaagcttaattaagcaactaatgccaggcaatctacctatttgtaacagaagattcccagaccctagttccacttagcagtacttttcagccttcaaacagagagcagaaagagactttcagtgcatcataaatcgtaacagtataaaagacccaaggccagaacggcatagtttctattgggcaggcatatcgcttgcccgtgaagcaattagttgcctaggagactaccaaccaagcttatttatcagtactcctctaggttccaaagttgagattaatggctatcgtccagtgtctacaggacagaaagagcagagacacgcaataatagagccatggctaaaaaagcttgtgttactatggtagcaccatttgcctttccatgataagcagagggccagaggaccctacgtgttcacggttcatgaggccactgacatgtgcgaggttggtcacacttcaacacttgcaatgagggcctgtttcttctcccagtctatttaatcagctaacgaggtatttgaacgctacatttcaactctagcaaacaatttattagaattaaatgattacggacatgctcaattctatgaaaaatttgatataatcaacctaaatcatggatatcgtataagataacggataagtggaaaggcaatctttggtcacataggaaatggatgctttctagttaggcagtgagcaatttacacaaatagtgagtagattgaaacagaacgatataaacaagctacctcatacacttcattatagagttggaaacaaacataccttcatggaatatagcattttatatctcttgcctcttcaaagcttgaaccgagagaaaaagaggatatccagaggcagtaaagctggaaaagggaggtgacataagatcttcagttaccttgataggtgatcacaataaacaggatgaaccattttcactgtaacataacagaagcacaaatcacatgcaatgaatcagagatgtgctcacatgcgatgaatcagatatgtgctctcactccctccctctctctgctgcaccaccttgcccaaagcccttataatatttcttgacttgggaaatgcaattccacaaactaaataagtcgctaagcagacacaaaaaaattgatgactacacatatagttgccaaaatgcaatgctgaatcattacagaattagtgcttctgactaaaatccacttcacagacagaagcacaaacaaaagttttctgtaatcaaagattctccttgtcttcacaacaatgttcaattcctgaacaaaaaaaatatgacctattttctttctttaagactatattaatcgttttattaccaacatttatggcaacctattttagtataggaagaatggaacattacctttactcaaaaaccgacatggtacagagcacagctgtaatccgtcagacagcaaaagtaatccatcagacagcaaaagatgacaagatgatagatccatttccttgttctgtcctgtccttatagagagaaagatgtgctaaataccagtgtactcacaacgaagatgggcgcttcacaatgctgtgtcatcattcatcaagtataatacataacatattttcaacaaagaaaacagccatcttcaatcaatatctggaattgcatttcaacttttaaatacagtgtgtggcgttcatcagcactacccagtgatgagttccacaataaaacaatgcaatcataaaaatagagcttctaacctatggaactattatcaatgaacaacctcagaacgtgttaggttctgagtgctagatgcaagggcgaatgattttgcatcaggtacagaatgcaagtatgcattcaatctttgcacctgaaagcccaaaagttgcctcccacagagccttattcctaagcaacctgaaatagacgaaaattagagatgatgggggatcaacaaaacaactcaagttttaaatccagaagaggtcctaagaaatgaaccacaattcttaagcctcaaacatgcacgcctgctttgtgagggtgacggaaaacatattaaaagatcaatgtgcactgaaatatggaagttgtaagttgtaaatctcttcacttggttactttatttcccatgcaaaaaagaatggttttagcacattactttcactaaaaaatgatgcattctagttgagctacagcttgactttaactgcgcacaaaatagtcccaaaatatatagttctataccatcttttagaagctagaaaactgtcaaggttgagtagaaaaatctactcaagaaatatacccaaatggccaaatgaagcaagcacaatatatattctaaaagttcaaaacaaattatgaatacagtcaaactgcacgaactaatgttgcatttttcttcaggagtggccagagatccatctagcttgttttgcatgactgaatgagcgcattcaacaaaaggattttattccagaagcatacttcctccctgagcatggaattaggcccatcaaccaatttaagaaaacggcacatctaatgtttccagcagattgaccatacaaggcaccacccatcatcacaatgaaggtggaaacagcaagcaattatgcagatgcagacagaagtttgagaactatgtccttctcatcatcatcttatagctatcaaactgctgtcagccagaatgttgaacactatcaggttaacctttcaagtctgtcagggccaactgtcattgattgcacaggaatgaggcatacgcaaataactgtatccactactttctagtttctatagatgccaacatagattgaataataccacaacaataggctaaagtaaaacacggtatgcaatcttatgcaagttcacggaacagacagtctaacaaccttatatcagatttctaataagtcaacatggtacaaatcaattgagtgtgcatagtgttatagaatcactctctccacttaaagtagtgaggttggatggaaaattattttaaaaaagaaaatattaactcaaaaaaggtaattaaattctaggttcattctgatgttatcaatggttcgggtctcatttaactatattagctgactaatttgactaaactacacctaactgcatctgtagaagatggtaaataccgatcgaacaatgaaaatgcacactaatccaaccaaatatcagcagaatttcagcacatgatgacctactgacctacgtgagatatctcctccagacatattgaggattagcatcatataaataaatttcagcggcttacaagttatactgtctagtaagcaggtccccataactgagtcatcacatcacatgtttgaactttaaattttactgtggtttgttcaagtgggcgacctaacgaatgcccaatgagttcgggtagttagactactgatcctgaatttgcaaaaaatttcacaatttgacccttttgcaaaaactattttacaaatgaaccgtcagcaaaacttatttcaaaaataacccttggcgctgaacttagacacctcagcgccaaatagcgtgacgctaaatatgcattggcatgctgacttagtctcccatccgcggtggcacggcattcagcgccagttgacatggcgctgaagtgtctaagttcagcgccaggtgatttggtgctgaccaaaagagtcatttttgaaataagttttggcagcggttcatttgtaaaaaaagtttttgcaaagggacaaattgtgaaaatttcagctgaatttgtgtcatttgtcactagagctacatattatccagagttccacaattcacaattcctttccacacgctaggattgctagactatgaacaaatggatacgaaatcaaaggcggtaagtgaccagccgcgaacctcaatcgaagtgaagatgaacaatctccccgtcctcgatgtcgctgtcgtcatcgtcatccgacgaggacgaggaggaggaagggaaaggggagtacataggttcgacttcgacgaactcctgaggcgggaggaggaggaggcggcgcgggtggccttgcaggcgaggggagaggaggcggggcatggcttggacggggacgaaggggatgcagaggaacgcggcgaggcgggcgaggaggtggagcggcgcgcagcagagcagcccgaggacctggtcggcggggagcgtctccgggttgcacgccacgcgctgccacgccgccgccgacgcccgcgccaccgccaccgcccaccccggccgcaccgccattaacacgatgccccaaaatccaaaatccgaattcccctcctcctaggatgaacctaggggtgtcgtgacgaggaaggcacgagcgcgcgagcgcgcgtggggcctcgccggccgccgggccgccgcgaggatctcgccggcggggctcggattcggccgcggcggcggttttccgtcgttggatcgatcgatcacggtggctgggttggcgtggcgaggtagccaactttatctactcggatgcgcacgtggactaggggggaggttgactcgacggccgacggcgacgggtggaccccacatgtcggtgggatattccttcttccgggcggaacgctcggatctccgcgatggctctgcggagaaaatatctttcattccattttttacgggaattttgtgaaaattaaactatttcctgcaaaatatctgtaaaatccttgcgttagtaaaggagtcctaaagcattctagctgagattactgcataatgaaccctagctaatattagggagtaattggtaattgaaattggtttaaaccatgtgctacttgtcactgcgctattaagtacatctcaagagcacctatatatccatattcaaatcttgaagttgtttttttccttttaataggagtagaagggcatgtttggattgctatcataccaaattgttggtagtgtcaaattttagacaagttttgacattaccaatattttggcaaagatttctattgatttggcaagttttggcatcaatccaaacatcacacaagtactatttaggctaccaaaaaatttggtagggcaagatttggcactaaaccaaaacagcccgaagttattttagctcttatggatttcaacaggccaagagctctattacgctctcattactattctagatcgtgccggagtatatttgacaaccaaaagctgatactttcatggacttgaacaagctgagagctctaatgctattttaggggtttacaaaaccgcgcggtaaccttttcagtttttgaaaccacggtatgtctcgtggttaccgtggtaaccgacttaccgcgggggtgcggtaaccgcgccaaaaataataagaggaaccctaactcgttaggaagaacaagccggaagctctattactatactagctcgtgctcgtcaattgtcataaccagtagctgctcaaatgaaaggctgcaaaatcatccatgacatatgcaaaataatactctctccatttttatctcattttacattataaggcatattaacttttttatttaagtcaaaattgtttaagtttggctaagtttataaaagtatagcagtacctttgacaccaaacaaatatattatcaaaatatttttcatgttagatttaatgaaactaatttggtgttgtaagagattatacattttttttatattagaaaaaaagtcaaagcgtattataatatgaaacagtgggtgtagttgtaaacataaagcaattctttgctcaggtgaagcacaatatacatgaataatcgctcaaatgcgactctgcacaaacaaccatgaccaagaaccatggcataatcaaaacaataggtggtaaaacaaaagccattctgagcaaacaacagacattcttctcatgtgaagcacaatacatgaagaatttacgacaatgatgtaaaagaaaaattgttgctgttaaattaacatatttgaaaaggatgcgaagtaatcagtgacgaccaatgcatcacacacgaatatatatgaaaatggaacttcaaaatgagagacagtatcatgagtcatccactgcattttatttgatgcattgtggtgggaaaaaacagcagggcctatcaagataagacttcagggaagggtcctctggtgaaggggaagggctcccagttcttcacgctctaatctctccttcttcacctgcaacaagggggggaaagggcatttagactagcacaagcttcaaatgaaaattagctgcacgtcataaatggctaatgggtaatggcaaaccataaaattaaggcctaggaatttcttaggtagttatttcagttgttttttctatgtacaactaattgaatgcagtgggtattgcatggttagattgcatacaacccctgaggagttagaaggatactagaaaataatagtcacaacccatgactgcaaattttatagggatcacgcttcttgtaacccagtaatactaaaagcgaccatgcccagcaagataataaacaagaaaaaaaaggtgatcgatattcatgccgacatgcaccctcgaggatactcaagaacaaaagcaaatttataaacacacaatatcttcagcttagagtggcgtcaagaggaaaaccctttttacatgaatttaatagactgccatttcaaactaatctgaatacattttacccagcacaagagaaaattacaaggctatagattacattatggcatgctaatgtataaccaaatgcaacaagacctcatactaagaattataagggtaatgcttaatgtaacttggcattcaattagagcgtttgtgcaatgaacaagtgcaatgacaaagagcatcttcagatacacttaccagatccatcatgtcactcaaatagcctctgaatggtgtctgttgcgcctgtgcaaatagagagaatgtttcagaagcacatcagtttaccgggttagtacagataatgacaaatgtaatggtaatcactggctcactgctaaagatgaaagatggcctaattgtgtattcaggttcttaggtaagaaattttacaagaatacatgtgtaacaagctgtaactccgaaatcaagaattcgtaggacgaatatacaccctcttcacaaacaaggaacaagttttgtaacatatgttaacccgaatcatgcatccacaaccttccggcctaaaagaatcatcaacatcatactatacccaaaatgagtgcatcgatcccctttgctctacactcatttcactttacaggcaataatcgggataacctataatttacgtatttgttgcgtgggctctcaaaaaacacaaacctagaaacccggccaccctaatctgcacaccatcgccgcaaaaactagatcagggcaggagggaaatgaacggacctggtcgttttcggagaggtactggtgcttcatggagaggtccatggcgcgcttgaggcgctggtggcgggcgtcgaccacctccctgggaagcctctcgagcgcctccttgatgtccagatcatgcttcgggtcgtacagatcgtcgtacctcaggcctaacaacggatcaatcacacatacagaataacaagaacaaaatcccatcaaatttccagatcaagaaagccccccaccccccccgaatcgagacacccagatccaggcgagacagcaaaccctaccgtatttccggaggcgcgaggagatcgcctgcatgtggaggcgggcgagcgggttgcggcgcgggttcacgaaccactgcgagaacgcggacagcatcgacgacatcgtggcggcggcgggcggcgatccggcgatctctccctctcttccttctctgcggcggcggcggcctccttcgcgtcctcgcttttgtgggggaaagagagaggagaccagtctcgggcccaagtcgtagggaggattcggaaaaatgagccagatttgtgaattgtaataggccaaatgggccgacgaaggaggagggcccatatagttaaattttctctttctatattgtacaagtagggttttgttatttgagcgacaccttttctttttcttttttgacatgatgaacatcagttttagatctatggctttaataagccataaaatatgcataaagaaaggaaaaataatttatgggtaaaaacttttgtatttatattagtaatggtttaaaagctaatactggaaaatagacaaccatgaacaaacctcaaaatcaactctaaagattatgttccaagattttaattttggtgtggaggataggctaacaagagcacgctagggaacttttaagatgcaattttgagttagggtagcacctgcagaatgatttaggatttaggcaggaattaattttgtttattctatgttcttccttttgaagtcctcaaattcttagtagctagattttttcaattgtagaccaaactgttggtgttaggattatttcatatagaatacttgccaataagcactgcattggttcaagaatagtactagttttgacattgatgtgcagtattatatggtacagaacctttataattttgcctttatataaacatatccttccaagttattttcttatgggcactatgaacacgtgtgggagtgggaaggaattggccagacacaatacatccaaaaacacaattgaacctataaaaaataaatcagcaaaaaaacagggagagaaaaatacgtgctaccaaacttcataccattaggtaaggcatcagagcatctgtatatacaaatacattaaactcaacctcactcgcattcacatcaaccaaaggtgacatttcaacctcactcacaaagccacaagacagaaacatcaatacacacaagaaaggcatataaacatctgcctattttgtccttctattttttttgccccttcaatcttgatgccattgaaatcatgctgttctatacagaggtaatggccgagtaaacggcaaaatcacagaaaattcatagctgccatcatccttgctctgttcttcaagaaccctagagcttcagcttcatcagagctgggtgacggtgcgaatccaccaatatggaccatagaacatgcacatcctcatcctggcaagacttgacatccttgtacagaatgtgcattcccctccctgccaagaaagcatcaagcacagcaatgtcagggccataacaacgttagaaggaagaaacaagtcgatttcaccgcgtaaaatgatcaatgaaaatggctttgcaatcgcggaaatcaccaagaggagttgatgcatgttgaaagaatgagttctcagaaacaacttacggtttcgacgtgcggaatgcgcacgaacccagagcttcctcagaggggagaagagggagtggagccaccccatgaggaagccctgctgagacctccggctatggcctcatagagaggaggtgaaaggaggaatggagcaagctatgcaaaagaaaagaaataaaaggatgggtagttagagaggaagtaaccatcaggtttgcttttggcacgaggtgaagtttagtgcactgtacccttcttctgccacattgtgcttccttgcaacccaatcatagtgctttcagaaattttattccggtatcttgtccctttccacttcttactcttcctacctcttttctccatttaaaagagggcatttttacacccccccccccaaaaacaaacctacagaataattcaaggtacatgacaaccatagcatccatagcatttcttgtttgtatcttctgagtgctgccaagcttaagattttcacaccaaatttgagggacattttttttaattcaacctgcatccgctcgcgtgttttgtgcattactaaggtgctttcccttttttaaacaaaatgggcttcacaacggcctttgggtccagttggatatataatgcaggaaaagacattttcagacagagagagagagagagagagagagagagagagagagagagagagagagagagagagagaggaaatgcatttggtcttaatgatatcatgaaaacatagcatgaaaatacatttttcacagattttaactgcaaactcacatgtatcacatgaactaattatgctaaacttatagtagattttgcttggacatttgggtatagcactaactcaatgttcttagcttttcgtacaggaaagctgttgctgatttggatggtttttaagactataggtagtcaaaacaaacattatcttgcctgctttttggatggtttttaagactataggtagtcagcacaaacattatcttgcctgcttttacgaacaccattacaaatttgtagtgttatatttacatttataccataagattcaagtaactggccatcataacaaagcatatgtgtgttaacacgaatccagcttcaaagtaaacatgtaacttttgaatatattatgctctgcgacaagaaccataccttttctgctactgtctgacctgctgttgatatgtcgtatgccgcccttgtcaataaggatagacatctttgactcggcttcttccaccagcaaaatgagaaggttgtattcaactatgacatgcaacaattcgttgagtagaagattggagaaaacatgtgaaaatcaggaagcacgagcagtcgagcaccaaccaggtaaatttttcatcaactaaaacaatagaaataaaataggcatccctacctgttgatgcctattcaggctctatgctgccacaaggcaaatgccaatcctggcccagcccatgttgcactcacaaatgcttaaaattttgatgttcgtactctcctaacatggactcactaacttgataaacctgtcaattatctgaattgctccttcttagaggatacagtaatatgaaaggtggaagttatggatatcgtttgtaatatgtatataaccaaagaaataaagaatctgcatggcctacaaatccaatatttggagtttatctacaataatctacatagacttcttctaaaaataaggcagcaagatgatggagacgatgacaataaatggtacatctactgcatactgttactgattatgcaatgtcttccatttagatagatcaacatcctttttctttcctttccatttcttcttctagttggaacaggatatcatctatttttggttggaagagaatttatactcctaaataagattactgtaccaaacaggcaaacaccacatggtcactttccattgtattcatatgctattaagccacagtaagattactgccgtactaaagtcatccctccatattactgtacctgactaagaaaagttggaacagttccttgttaaactagcaccgcaatccggtaggtagtagtcagtacttatagtgacagaaaattccattcatatgatgtagctatcaatggacaatcactagaatcagttgtgaggttcttctcaaatgtcactgttaaaggactatgtttgcattgaccagaaatgcaatcttgtgtattgctccaaacagtagctacaagaaattactgaatgaatggacaggaactaacagacagaatgctgtctgtctgtgtgaaactagtgaaaaccaactgtcagagagctgaatattactcccaaaatatcatatatgaaatgcttccaataatgtaggaaggctaattaaatttaccaacaatgaatcaatgaagactacaagattgatttaaggaagcaaagtaagccggctttgcaacccaatttacgttgagcaaaacaagttctactgaagtatatcttggatggcctgtatatttgggggtctagcaaggccgtaagaccctaaggagtactttggatcttaactcagctcaaggcaagaaatttccagttccatttggtaattttggttgcaaaccaagagcttttctgattttaacgatagttcagtctgttcctttgtactactcacaaaataagttgatggataaaaatgccaacttacagcatggttaaagaaaggacttgttcagttaaccacttaaccaatgataccatgattaaaataatataatattagcccatttcatagattcatgatttgatcagagtttagacattgttgtgtactgttaatgatgaatttccacgatcttctgttcaaagggaagcatcaatggaattagatacactcactagagttaaaagattatataagcaatacaaatggtgtacctttcaggaaaaaaaaagagatttaaattcatcatagatgacaagataatgtcctatttaatgtttaaaacgtcaaagctgatgtggtccaacagttcggaaagctacaggctgtttaatttgattgttcatcattgctaatgtcaatgcgatctcctaaataaagcacactagagctaagccaaccagcttcctggttagccaatggccattgaggcacctcacttcagtttgtttttttttctttttgaaacccacctcacttcaggtgataagaacagcaacaataacggtagatcatcactttagtagatgtatagaacgaaattacacagaatttgaagtctcttcactgagttgcagcatttgaacttcaggatcctcattggtgtgatatgtttcctgaaaaagacagacacaatcagatgtctgtagataagcataaaaaggaccgccattagggtaaatagaccttgatgcgcgcgtattccatgagtcttgattcctcaaaatccacacttttccacagggatcaaagttatatcatgatgaactttacaagtttgttgatctccaagtaacaattgtgactgatcacaagataatacagggaagaacaagtagtagaaatcgtctgacgatgttgctattaacaaataatctatatccgaactttgaagtactttacatcatgacaacattctttcttggagcattgccacagtaaactattgagagcattaggagcaaaaggaagggaatttgagaatcacaggattgtcacagaatcttgccaaactattcaaacagtgtttataaaagatggcaaaaccaagaaaaattgaaagaacatatattggagagcctccataacatttccaagaattgacactcaataaacatcccgttagcactaaaacggaggcaattgcagaagcaaattatgattctgcaagaacctattcaagcttccatgcatataggatcagcgagaaaccaagaccctgcaactgagactccctaaaaacctgcgagtatgaccaaggcatcgacttctcaggtgcttggcatgtctgaaacatgaacaccgcattgcttgtcgtcaatccaaacagccaactgtggacatcccagaacacctccacgggcaaaccatccacaagaattgtctggtttcccctaaatttccaagccagacgcttcacctgcatgacgggcttcttgtcgacccgtatctcaagacatggatccttgaggctgacggtgtcacactctatcacaacatcatggaattgaccattttcacagaattgtgccttggcagtgtaaatcttcttcccatatatgtgctccctcctagccacaaatgcagcattcagcatcggccggtttgcgccggtcttccggtatgcatccttcttcatgtcgccgagcaggagtatcagctcaaggtcaaacaccacggcgacatagaacccttccattggctctggcccagcaccaaacttggcaccggacaggtcccagaagatctcaatcttgccgtcctcgacgtcaagcctcttggagcccttcttcttggagaagagccatggcttgatgtctgccttgcacaggcactggttggacagatcgtccacgccaatgctgagcccttgccccatgaggctcttgctccaggtcaccgagatcacgcatggccggcccgagaactgcgcctggtagaggcaggtcaccagattctgcgccgcgccctttccggcgctcgacgacgacgacgacgcgtccgcgatctggacgccgctctccccgaagcaggaagggaagtccctcatgctcgcttgctcgcgcctttcaccgaacacctggcggccgccgcagcagcagcacagcgagaagctccgctccgccgcctcaccgcatcaacaagcgacccggcggcgagctcgcctcccccgcaatgccggcaacgaggagaagccgcggggagatcgctcgctacctcgagtggccgcgagatcccccaacctttcaccccaataaagcagcaccaagaaccgcccaaaaagcaagcaagcgagcggaggcgattgatcccgcaagcaagattccttcacgaagccgacctcttccaacgcaatcaatcaagatttgccgcgaaaccagcagcaaagcagcaatctttcccccggagatttcttcagaagtttccccaagaccaccaccattaaagcaaaaatgatggaagcttcaggtgcttcttcacccaagataagcctttgaagactttgaagaagaagaagaagaagaagaagaagaagaagaagttccaagatgtggaggaggattcaacactacactacaccactctactctccctaaaagcatcaagcaacaagagaggcaatgagagaagctagcaaacaagcaaagaactgaagtagagtgggggagagagaggaggggaaaaggagacaagaggtttggggctacagcctactacaggccacagccatacaagagatactcctcctctcctaccactacaccacacacactactgtcactcactcacccaactcaaggagggcagggcagtagtggcagcagcaagcagaggagggggagcagttgctgtggctaactgctgccattactactgttaccataccactagctgttctttcttcattcatgcaatgaatggagtggtttctaccatttcttctttgcaagcttttaaaaaaaagagtgagggcgtgtttagttcatgctaaaattaaaagttttgttaaaattagaacgatatgatggaaaagttggaagtttatgtgtatagaaaagttttgatgtgataaaaaagttagaagtttaaagaaaaagtttggaactaaacaaggcctgaactaagattcagttataaaatcaccctcttgggttcaaattctcattcaataaaatcaccttcttgtagtagtagaggttgcacaaaatctttggctccaggtggtacttgctctctttggtcataggccactgcctagctctactacggctctactttctctgtgtcactgacatgagaataccagctctcaatagttttatttttctctctctcttgtatgtattctggaccagttcacatgcgttacagtggaaaatgactggattgtatttgatcccccttgctacaagcactccagtgcctactccatggaagccccatccttttttgttgtctcgtgtaaaagagcatatactatgcttgcttttctatataaaaatgtcgaaaagataacccaatcacctgaatgtaactagtttaaaacagggcatttaactatttatcacttttagattttaattgctacatctaaaagtggtaaatggttaaatatctcgtttaaaacaggttcatgatatcttcagtggttcttaacaagacatcacaagattcagaaccatcaatcctttacaagtcttgatatgaaattgtattcattgatttattcccagcctcactaaaaaaaattcagacatgcgtatgtatatacgctactaccattttaatggttttcttgcttggtttactaaaagatagagccaaattgagtgcctttagcttactagttcgtagtatttttttgccatgcttgactttgttgcaaatattcaagtggaatacatgctttctcaatcatgtctttctcaatcattctcaatcttgcatgattgagaatgaaaaaaaaaacttgcttattttccttaaaactagtaatatacccatgcattacaatagaggttgtatgagcccatatgactaggaataggttaaacatgtgaattgaaatccaatcactttcctccggtggggtgggagaaggggtcgaaaggagaattgagatccaaccgcttatagacggtaggagaagaggaaggagggacaatttggctttcaagtagtagagaaaattgttctaaataaatactgaatatagttgatcctctccaaatattcctggccagtaggaagattaaaaacaaaaaaaagatgcagcaaagtagggcaagtagcacagtaccactaggggtttctctgccgtatgctaccaacatgtggaagtaaagaatgtagggatccaaaatgctggagtagctacagcatggcaagtggtgaaggcaactgaaatcaatgagaaggacaacggtttcctttggatcagggaccccatctcatatctctcgtctgtttaactgcacgcccacgaggccgcatttattcacctcctggagatccatccacacctcctcttccattctgcttcgtctccaagcaaaggtaccccaaaactttggtaaaaaatatttcagttaaagatgaactacagcacagttctggagtatctctttcagaaatttgagaaatggtatgctagttctttatgttactcccttcactcgatatttttttttccttttcaacaataaaacttattggttgtacacttgtcggcagagaccaaagatgtaaacaatttttttaaaaggcttttatgttattatatagaattgcagtcaagtgttttgcttttcttttcttttttagcatcactcatatgttttagagaatttaatatttccagttgctgatgcttgtgtatatttagctgaataatgaactttactcgactagttcattggcctactggacttaaagaatcaatcttggcgagcttaattaattcaggtccacaggaacaagctcaaattttcagtggaacaagcttaaattttcaaagtgacatggtatatgcacactttgtcttttaataaaacttctttatattgcacccacttcacttgaactaaagtgatatcactactaatgtggagtagcataccatatctcattgagggtacaaatttggttgttcatggagaaaaatactgtttttagggccccagcccaattactctccaagaaccaaccaacataatggtaggtattggtggtgttcagtggccaattcttttttctctgacagggtgttaatgtgatctaccgtagtctcaaagctgaaaacaccaatagtaaattatttggagtcaaaggtgaatgtacttggaaattatttagtaatagtagcatatagtagatggaatttgacctaacctttgctactcctatactgtcaaataccaataggttagttccagagatgcaggagtggagaattcttaagctcactgtctctgaaaaaaaatgtaaacaaagagggattcagttcaagtcctcaactatatttttttcttgcctgaaattcgaaactgtaaaataggatttctctccccctctttctcggattcaagctccacctgaaggaagatctctagtggtattcacagcattgtagcttgtgctgtgctgttacgaggttgttttcttgctcgagagcattagaaaaatggaaagcttcagatcatgacacatcatgtgttgatcttagaatttgccgtttccaagtagaataatgttcattatggttgtcactttgctttctgacctgctggcaattttggcacattatcatgtccatgccaagctttggatgaacagcccagaaaatctgtgtgccgctgagccatttcagatactggtatctaggaaaaggtaagggaagaggaattgtttggtgatggcaagaagttatctgattatgtatgccattttaatcttgatatttgatcctctgaaataatagggagaatgattgatttgtgacaattgatcatcactgtcttacaagccttttttttcccagaaaaagaatggacaagaactatctgaatactagtactatgtagtacctatttaacttcttttcaagaggatcctctttgttattaagaaaggattattaggttttgctgagtactgaagttattataaatatgcaagcttttctttatatttcagccaaccaaaagatataggatatattattttccaagttaatttatttctgattcggttgcaatgatcacaagaaaagggcaaaggtagtagaatactttacaccttagttacaggtaaaaagcctaccagctagggataaaaaagtaacagtcgcaactaataagggcttagttatgataaggatggtgtattcatggtacttagctgcaaggagcaccaggtgttgtaaattataataatgtggttacttaaggggaaaaaaagttaggaaatacaacagataatgtcttctttttttttaaaaaaaatatgttagctcattttgtcttctatcccccatgaaaaaagaaatgtttattttttttcatgaaatggaaggagctatgccttaatgcatcagagtaaagatagcaaaaaaattatctcaaaatcatacatattccttatgcgcatcagaacatctccactagtgtttgaaacttcatggaggacagtgggccttgttagctccataaaagagcattgtaaatgtggttgtaaattgtaatgcgggagagcacctgcagcggccgtggcatattgtaaattctttctaaaacttttaatatacttcgaccggctatggctatcgctggcccggcgaaaaaaaaaagtttttgaaacttcttggaattttgcaagagacattacaatttacaaaccatccaacatgatacaaaattcccaagtttgaaaccaggcctgaactaaagtgctacaagtctaccacggtaccacctactcaccgactcaccacacgagagagagaaacaacacatatgacaaccttctatcccgacccacattcagtgactcagatgacccccacatgtaactgagagagaaaatcgcattcggaaagtaatatcaaatcatcaaaatatgccccccaaaaaacactattgttcaatttggggaatttttctagggttagcctactcagctcaccccttcctcatctattctattagcataacactttacagataggtccttggtacaatacatatttacaccaacactccccctcaagatgggcaaaaaatatcaatcatacccatcttgttacatattgattgaatctcactaggacctaacccctttgttagacaatcagctagttgttcacatgacttaatatactccaacctaagcaccccgctatcaatcttctccttaatgaagaacctatcaatctccacatgtttagtgcgatcatgctgaacagggttgtttgcaatgctgatggctgatttattgtcacaatgaagcatcacagtgtcacttcttagcactcgcaattcagtcaacaagctcctcatccacaacatctcactcaagctcaaagccatagctctgtattctgcttctgcggtagaccgagccaccactgcctgctttttgcttcgccaagaaacaagattaccaccaacaaacacacaataacctgatgtagatcttctatcatccatactactcgcccaatcagcatcacaatatccttccacatttagatgcccattcttcctaaaccacaatccctttccaggagtccctttcagatatctgagaatcttatgaacaacatccaagtgaccagttcgaggatcatgcatatacctactcacaacactaaccgcataggaaatatcaggtcttgtatggcaaagatagatcaagcgtcccaccagtctttggtatgcttccttatcaacaggatcacctgattgagcacacaattggtgattcctatcaataggggtagtacttgcacggcacccaagaattcctggatttgttcacagattccaaacaaacttcctttgagaaagaaccatcccctttgaaggacgagccatttccatttccaggaaggaagggaaagggcccagatcctttcccttcaaagccttttcc

SEQ ID NO: 81758 - DNA, 747 bp, Oryza sativa
cactttatgcctgcttggagccttggagcaaaataaattttcatgccattagcagatgatctacgaagttttatgcttggaaagggggttccgggagaaaacctttactctatgtacttgctgtaactgttatttttttagtagttaacatggacgtatcaaatgttaaaccacctgttgagtctgagccaaacaactgtggttttgtagtccaggatgctgcattcactggatatgtctcagatgatttcataatatttcacttgtaatgcacctttctgttaaagctcttaaatttcttgccactaattgaccagggatgggtatgcacttgcttcaggtggtagttagcaacatttctgctgatctggatgataattctggcaacagcctattcgttatgagttcagctccaataggaggaataaatcagtcttcattagaaagatcttccagcaacaatcaggcattgcatgggaaaagctcaattgctgggagccctgaacctacatgcattagaaaatcaatgtcttcactgtgtgtcaaaatagcagcactggaaacatttgaagtacttctgactctggtatgtgtataactgtatatttacgcattcttttgcttaagcaatcacttctcatgcttaagcgaaatagatttcttttactaatacattgtagttaaacaagagtgcataactgtctaattcacctatttggctcctcaactagattattgtaaccaaat

SEQ ID NO: 81759 - DNA, 718 bp, Oryza sativa
tttagttgtaataattgatacttcgacgactttggttatcggagataagacccgatcagagcatgttctctcttagatcgggttcttatttaccgtagaataaaatatgataaaaaccacgtaattaacttcaaaattaagcactaaaatttaaaatttaacttataagcaaaactctaaccgaaaatgatggggatgaacgtgttttagtgcccgcctgctctctgtgattaaaagagaagtgggcttgctacccagcgcagctttgtcgttggcaccgtagcccgtgggtctacctacattcacctaacagggctcagcccatgcgatgcaactgaacgtacggtacgtactgattcctgaatattgtaggagtaggagcctaggaggcctcgttcgatgtgttcgaatgattctattttctgttaacacgttactaaatgatgtattcgatgtgaaaattttttttatataaattcctttaaaatatcaaacaaatctattatttagatttataattgttaaaactcaattgatcatgtgctaattgatttttcattttccgttttctggctacatcttcatcttcgtagagaaacgaagaacaccactccactcgttgatatacgataggatggtattttgtgtaatttcggcttatggtggaattataatgcccaaacaacgcgctccatttctccatttctttttagccgat

SEQ ID NO: 81760 - DNA, 3163 bp, Oryza sativa
aaagtgtgggcatttgctagtttgtgggtaataatgcttataaaagaaaaaaaatcagtgtgcaatgaaaatgctcctttggtttttaatagttaacattggacatatgcttaatcattcatcttattaaaaaatataatatgtaattatgatttattttatcattcaagttatttaaagtatgacttaattttttttatatttgcatagattatttttagtaagaggaatgtacgtaaaaaagctaacggcatcatatattgaaaatctgttaaccgaagagattgaaccttcgaaatggttataagaaatgttgatgtcttaaaacatttatcttgagattatttatttatgcactaaaaatactcacacagtacaacaaaaacctcatatagagacactttatagaggcacttcaaaaattgcctagaaaacttttactctggagacattttcagctcagtttattagattctattttgtagaggcattctttcggcactgtaaaatgcgcctgatatgtaaaggcattttcttgggatatttcaaactatgtagagacactttttggatgataatgtgtactaaatgaataaatataagcaactaagggcacaaacatacaagtaattaatgacatggatttgagttggttagtgcattgaagataaaaatgattcgtccaagagaccatgagttcaatgcatgacaaaacgcaaaggaactattttattcttattttttggactggtttcatatgtttgtggtacaatttaatgtttctagaaaatgcctctaccatcttataggcattttataaaatatctcttcgtttgtagagacaattcaccataagacacctattagatattttttaaaatacctctacagtattgtaaaggcaattttcttgtagtgacaacactagtgtctgtagtcacctttgttctagtttttagcatttttgtcgttatggttaactcctccattatcaaggcattttgtgaagaccattcatcatggcataatagattatcataaggtttttctttagatgaaaatcgcatggaaaataggttgtggtggcgccagggtactatgaggcttgtccatcgagggatgcttcttttgtgtgatatctttacatgtcggtctagagagtcgccttgtcaacatatggcagatgcagctggtgctgcgcggtgctaggacattatctgtgccgctttgcacttcttttcctacttgcccctacacgtggtagagaatacggtttgaactttttttcacgacttcctcaaataatccaataagacatggcatgaccaccaagtataccaaacaatatctaaaacaaagcatcaaatgcaatgatgcaaaactttacatatcacctctatctgttacataccacttgtacaactaagacgcacaccaaaaagagagaaattgatgagataatgagtcagtcctcttgtcgatactccgccggtatgtggggtccaggcaaagatgagtcaggtggggcccaactcgatgtcgcacgtgcacttcctttttcaccaaccccaccgagaagttgctataaaaggaccaacaatctttgcacactatcctccacaagagaaactaggatcttcaagtatagctagcattgcgccctcatttcatccatggcaatgcagctgtccttgcctgtcttgccaacgggttttcgtttccatccaaccgatgaggaactagtcatcaactacctccagaggcgtgctaccgggctatcgtgccccatccccataatcgcagatgtcgaaatatacaacttcaacccgtgggagcttccatgtaagccatatgtgtagtctagtgtgcattaatatttatgcttgattatagaatggatgaacttaccaactactatacacaatgtgttaatgatattggtgttgcagccatggctctatttggggaacatgagtggtacttttttacactacgcgaccacaggtaccccaatagtgtgcgccctagtcgctcagcggcgtcaggcttttggaaggccaccggcactgacaagcccgtccaagttgctaacatgcaaagcactcctgtagctatgaagaaggcacttgtattctatgttggccgcccgcccatggaaaccaagactacatggatcatgcatgagtaccgtctcacaaacacgggagggtccactgcctcccacccatccttgtcttcatccaccgcacacccttctgtgaaggtacaaacaacacaaactatattgagaaattattttttttcttgagagaatggtccttcgtttttagtgtgtcgtctgtttagttatgaaattctttgacaaggtaatacatgacaaaattcgacttctgtaacttgtagaaaaaactaactacactcctccttgcaaaagaaaaaacagagtacatattccattcctagtcgatctcaatcgttagttcatcatatatgcaaggcttaatatctcccccttttttactgatcttaccaatagattaaccatgttatcatggatctatatgcgtatatatgcagctagacgagtgggtgctatgcaagatcttcaacaagtccccagagccggacaacaccgcaccaccatcaaacgtcgtctcacggttacagtgctcgccgccgctgccgccgccggcggcaccgcccggcaactacccgccgctgccggtgggtgcgacgaacgacggcggcgtgttcgccggcgccggcgacatgctcttcaccatccaagagcaccaggagggaacaccatcgatgctgccgccgatccctaaccttgagccaccggcggcaacaattgggaattcctctctcaatggcactgctgctgctgctgctgctgctgatggccatggccgccttgaggaagaggacaccagcgcctacaccttcaccgaccaggaaatggagcagatgctcatggacctgatggaccaggatttctttggcaatgatcaaccccaggagtgaactgtgtggtggagtgattttcatatcattccatagctctgatctgtgctggagagtgaatttagtatctattgtaccagatagaataaacccagaaaagaaataaaagaaggccaaagaaaaaagcaaaaagaaa

SEQ ID NO: 81761 - DNA, 9163 bp, Oryza sativa
aagcagggctttcttttgtagtttgccatctcaatcttgcaccgtgatgttataaaaaaacaaaattaattattgtgctacactgtacttttggctgtgttcggcagcaatctttcccaactcatcttcatcgtcttttgcacgcaccctttttaaacagctaaacagttacgaaagttgttttaaaaattatattaattcattttttaaaaagtatctaacacttaatgaagcgtgcgctaactatttacttcgttttacgtgcacgacagattagttccaaacctcacaatctgaacacagcctaaaacgtttcgggaagaacgcatgctagctgagcaaaggctctgtttgaaacttgccgccggcaaccttagctctataacttggccggtaggagggcgagccttttgggcctatttagcacagctagagttcagccaaacagtttcagctctatctaaaagggagcgaagttgggtggtgctctctcacaaaatgaactagagaggtggagctgggtttaggcaactctataactccactccagacccaactcctgaagcttatttagcacagctagagttcagccaaacagtttcaactctacctaaaagggagcggagctgggtggtgctctctcacaaaatgaactagagaggtggagctgggtttaggcagctctataactccactacagatccaactcctgaagctaaatttaagagttggggctctatctgttactcttaatttcctagacaatgatatgtttggggaggttgcagcggagcagcacttgtctctggcgaggagcccagttgcaacgaatgggccttaggttgggccttattatgggctgtatgggatcctccctcttgggcctagtttagatgggcctcaagatccacatctatggcctgaagaactttttgtcaaattatggcccatccatagaagctttaggaaatgtaattagttcattttaggttcctcatgttgacgtcaactttgaaattcatccctgaacctcaatttgctaaaccagtgtacatgagattccaaggcagtatagtgctcggttccgactaacgtggtggctgagtcagcgtgagatccacatgtcaaggcacttcaatctaatataaaaaaaaacaaaaaaggtggaccccacatattagtgacacattctccccttctccctctctttgtatgccagcccaaccactccccattttgccggccatgtcgttcctctcgacgttgttgtacgacctctctgccagcgctgagcccaccctcgacctgcactctcacccttcctcctccagtcctcctgatcccactcaccagttgacctaacagcaggcgggtcgaaggccatcaaggagttgcatcgacgtcaaaggcggaggagcggccgccagaggccatccaggagctgcattggcaccactgtacatgctagctttgctcatggcggtgaccatctcgtttccgctgctgctcctgctcaacatgacaggagtattgttcacgccgcgcactcctcctctagctccgtccgccttagccagcgctgaggatggagaaaacgccgactttttcttcttccccttcctgaccctctacaagagtgtccatgtcctgctgttcattgacacggacacagtgccgacgtcaatagacctggccaccgacattgcgtctggccttgttgtcctcctctgcttgcctaacctcgccaacctcatggtggggaagcacagcagcgactggtggtggtggtctaccatgcaagcacgttcgtcacggagtcagcaacctcgttgaccccctacttctggggggaagcggccggtgccaccgaagacgcgagacttggaggccggccacccttctccttgccgccagccgaatgcaggacaccacacgcggcctgccttcatgaggatgaggaagagaggggagatgggggaagaggaaagagttggtgctaacatgcggggcccacgtgggtcccatactaactcaacacatatgaccaaagttaagcaccacattggacaaaatcgggagccatactgccttgggataaaagttgatctacttttgcaagttcggggacggctatacctggtatcgtagtctaggggcgaatttcaaactccgcatcaagttaagggacctgaactaaacttattcataggaaatttccatctctactcagcctacaaaggtgttccctcttccaatatagtgagttagtgacttatcctattaataaccaaaaactaaccaacaatccgaaattctgaatcatgaaatgattacctatgcaattagttgtgctttaaatggtactccctccgtcccataatatagcaatctaggacgggacacttcatagtacaacgaatccagacatgcttcctgtactatgaaatgtattatgaaatgtcacgtccggtactaggttgctatattatgggacggatggagtaataaggagacatatacaagtataatcgtataaatggtttgtttatcctaaagtacttcataacaattactataaaacactcattccactcgtaaatatttgatgtttaggataagctttagctaaacttttaaaattttaaccaccattaacttttcaaatgcttaacaaaaaatgggattcgattttgacttcaaagtactatcataataacatattttcaaaaaagattttataaacttaattcaatataaactaatagccaaaattttaattttttttactaaatcccattctaaacgttaaaaaaaattatggctggaagaagtaacgaatcacatgttttttcttatctttttaggacgagctaagtgtgcttatccattaattagagggaataaagtacatggaactatcagaagtacaagggaaaaacaaaagagaaattaagcaaggaaagatacttcacggttgcaaagtacttgccaattgccaaaacatcattattatcagaaaattgtttatatagtccttatttgaaaaggaggtaatattttcacctcctctcctaacatcctaaccttttcttttcgcgtcaatttccagtaaggttaagccagcaaccaaaggcccagtgaacagcgaaattcattattaagtgagtgggttgccatgttagcattgttcccaaggttgtggccaagtatcttcatatgcctccttttctctacaagccttcagataacggagctgcctccttaggtgcaatatctgtcaatataaatagtagctctacttagaatagaaggtagtgtttttttttaatcatgagatatgcttggaagccccctactaagaatgaaagcttgatagaacgggaaaaagatatgtagataggtgtttccttgaattaactgaagtaatggatcttacggttcttttatgtgaaagtaaaactcagagctgtgaaataaaatattgggtcactatgcgggatgttgggtttatgtgtaaacattgatttagaagatgactatgtagaaaagcgttatatgattactagagacccttgtttatctatactacttcaaatgttagtagtggtggtgtccattcccgcatcacccctaccactaatatctgagcctcacagtctatactattacaccacctttcaacaagtcatcctccatttcactatttgctcatcccaaatttgaaaatcacctacttgtttaataagaaaaatcacagtaccacacaaaaattaattaagactaaataagtgcttattaattgatttaataagctagcaacttaatttgttttccgtggaaaaaacatattggtactttggtagagagcaaaggtaaacaatcaatgcaaggttctaggagtgagacagcacacctccagtttaagaggatcaggaagatcgtccgtagaaacaaggctctgaaattcagctttcaacttctcatcttcaatgcacaaccatgtgctaggatgtaacgacagtaatagaacagttagaatgtctgtgtttgatggataattgacagtttcattgctcagagttgaattgcagaagcatgtttcagtcgaggatatcggtgaaagcttatcaacatgtccattgccttcagataccactttgcctgtaatgacatttttaagcccctcatcattcacttgtgtacatccggaacaagtttcactgaaaaataatccatctcttgatgacagattcccacttagcaatgcggttgcttcacagcacacactggctgcaatctgggaaatggaatcttcgtccgttaaagacgagcaactacaacagggctgcttagaacattgcagtttgtggaccagctgaaaaagcttagtatcacggatttgctgtaggaccttttcctgcaagcgaacatacaacattaacttggtgaacagaggaaacaaaactgacccaaccaacagaaatggaaaattaaaatgaccttcaggaaaggcatttcgttagcctctttacttgggctggatcctccttcctcttgtctcctaacttcaatgacccatttgataaaatttccagcattgggaggaagatgattcactaaacgggaaagaattgttaggacattgtctacgctgttatccctcaaaagatttgggacaacttctatgcaatactttgccatgctttgccagctttcatccctgcaattctgcatagcattgaaaggaatgagaaaaaaatagatcaagggtgacacttgacacttacatatttgattcaccaagcattggcatgttaatttaccactgcacggatcaataaaggagcttcagtattccttgagataagcatgaacctaccaaatatgaagatgccgacatgttaaactcgccaactacaaactaatttgcccatttagtctaaactgacacatcattgcatagtttcaggacaaaacacgtaggtagcgtgatattaaggccaacatattgcatatctcaacttctcaagagccccaatgaccacgtttaagtgctagacggactgagcatacaccctacagcattgtccaaattttcttcattaacgctaaacggactgagcatacaccctacagcattgtccaaattttcttcattaacagtaataaactgataattgcagagcagtgtttcctgattcctgattcctgacagtcgatgaacactagataacccaaattaatacagtcgcttaatccaagagctgcattgttacaagacactaatcccaacgctgcatacaagaacctctaaaacacattagggccctttgaaacgtaggattttaaaaacacaggatttcgataggaacgagttttaacaaaaatgaaggattttgataggaatggattgaggaattccataggattctatagtgtcggatcctttatttcaaaggactatttagggaaaattcctacaggatttgagaaacacccaagggtcttccgactagctccacaaggtggtgggctagacgacctgggttcgaagcctcaccccttctaattatttgatattagttcattgcctaatattcgcgtctttttaattcctacaggatttgaaattctacaaagttctaatgtttttcgttcagatcaaggggggccttaatgtccacaagagacaggaagatatactagagaatatataccccctgagaagcccagttgcttcatcaatcgtgttcatggcttcccaaagaagcggcagcggaatccaatgaggagggtatttgaagcgagcgacatccaggatcagcgccatgtcctgcccagcatggtagccgccaatcggcgagaaatgccctgttccagtctgcatcgaatccaaacaaacatcattcgttcagaacgaacagcaaacagaaatcgtcgaatttcgagtttcgagagaggtgcggacgagcaggcagcaacctggccgagaagcttccggtggtaggaggcgactagatggcaatcctgggaggaggcgcagcgcagaaggtggcggcggaggtcggcgagcgtggcctgggcggcgcggaaggtcggacgtcggcgccggagcagtgggcgaggcaggcgaccttgccgaaggtgatcccctccgccctgaccgtgtcgaggtgctcgcagcagtcgagcatggactcgtcgaaccaccgccaggggcccttccaccgccgccccgggtcgatgcggagcgcgttgaggacgacggcgagcgtggcgaggccgcagaaggccggctccgactgcgtctggaagacggagacgaggctgaagaacccctgcatggtgcccccctggagcgcctccgcgaacagccgccgcccctccgccgacgcgaactccaccgccggcggcgacggcagggcgcgcccgtacagcgacggcaccgccgccgccgcctggttgctttccgctcggctgcttggtttagacgccattgcggcaaaagctttcgtctcgtctcgtgtcgtggattccgagtattcgacctcgagcaaagggaatgtgcatcgcattccctcggcaggtggtaataggctggatagggtagggcccaagaaccaaaaacccaagggctctcaactccgaagccggagaagtccaagttggatagtgcttattaaaacgaaaagaaaagtaaaatccatgttattataatattttttttcaacaaacacatccttttatttgaacgatagactccgagaagtcattagtcaccactcaccaggcggtttacatatcccaatgttccatattcgaggtgagggaatgatgagaaaattgatattgtcatattcataacgaggtttcgctggaatgccactctcaaatgtggcttcatcaaaataccatttttcaaacgaagctaacttgtcggaatgccatttcatccatttcttatcaatagatgattttttttccttgtttttgtcggtgatttgaccaaaatacccctatagattccatctcttcaattgcttttctgttcgtcagtggcaagccaccatcgccatttcttctccgttgctcctccccaagcctgcattctaacgccaacaccatgcccccttcctcaattcgctctaggggcgccactccctgcgcccgcactcacccaggaggtccaccccacgccatcaatgcattctccgacgctgaacccacctctaggagcaaccacggtcgcaccaatcacagccgcacgagcatatgtgccttctacccgagctcctccttagtgacgtcgctgtcatggacctccgcccccatcgcaccagtcacgcccgtgcgggcatatgtgccttctacccgagcttcttcttagtcgtctcgctgtcgtggacctccgcccccgtcgcaccggtcacgcccgtgcgagcatctcccgaacacgacgtctccagcacctctgctcttccccttcctcgtttcgctttgctcttctccccttcctgccatcattcgccatctccatcgccaacgaccctctttctcacacatgtgggtggataggccaaggcaaaaaggtcggtgtatgtgtcaaaacatttccaaatcatataaaatggacaaaatggcattccggcaagttggcttcgtttaaaaatggcattttaacgaaaccacattcgaaagtagcatttcagcgaaaccccaccctaaaaatggcataatatcaattttctcggaaggcagaggtgctagctcgaggcttggccgacttggccatggcagaggttgtccagccatggtgcacggtaacaaggcgttgtccagagctggcgtcacccacgcagtgccttcctccaaaaaattgattatttttcttttgtgtcgatgggctaaaactataatgttgcagggtcctataacaaattttatcaaaaaaaatgattaaagcaacttcacatatactatctccgtcccatattacttgtctttttgagtttttatttgtcaatatttaatcattcgtcttattcaaaaaattttagaattattatttattttgtttgtcatttgctttattgtcaaaagtactttacatatgacttattttttttatatttgcactagtttttcaaataaaacgaatggtcaaacgttgtaaataaaaaaaatcaaaaacgtcacctattatgagacggagggagtatataactatggatatggcatataaacacaaacaatatatgatatttataaagaaagcatcatattgttcgtgtcgtatcataaatcacatggcacagaatttattcggatacaaatgcaggatgattaagaaggccacatctctatagattctgctactcccttcgtcccatcccataatataagagattttgagtttttcttgcaacgtttgaccactcgttttattcaaatttttttgaaattattatttattttatttgtgacttactttattatctacagtactttaagcacaactttttattttttatatttgcaaaaaaaatttgaataagatgagtggtcaaacgttgcaaacaaaaactcaaaatcccttatattgtgggacggagggagtacgagatactccattaaggttgtgtttagttcagcgcaaagtttggattttggttgaaattggagatgatgtgactgaaaagttgtgtgtgtatgacaggttgatgtgatgggaaaggactgaagtttggatccaaaatttggatccaaactttggatctaaacacagcctaaaacatcatctgtctttcgctgctactctaccacaggttctattgcgcttgttttttttattctggattctggatctttatttccacacttttcaagctaataaacagcgcatttcgaaaaaaatattttttttcttcaaatacattttaaaacaactttacaactatatactagttgatttattcatcaatgcattaacttttgtaggataaaaagatgtatggaaactttggacattattttgcacttaaataggtcaaagctcctcgaaaaagaaaaaaaatgtcgagacacacctgaacggctagaatttgtggttggtttgcaaaaataggtgcactagagttcatcgtattcggaaaggaataatgaa

SEQ ID NO: 81762 - DNA, 18769 bp, Oryza sativa
cggaaccctaacggcgatggtattttttgaacaaaattgtttgtgcgatggtatttcttggaacccacacttgtcgatggcatttctgggacttggacgcttgtcaatggtatttcttggattatctcaatttttaatcataagaaactagggcatagacttcttctagttttcaagaatacctaataactatttttctttgcgggaaaaacaggaaaatatattattcataaggcaaaatttgctataggataccgaaagattgtggcatttgccgtgagacacttgaaaatcgtgtatttgctcatggatactgaaaaaagtggtaattagctgctggacacttctcccattattttattatttccggtcaaaatagagaaataaactatggttaaagacaagtttgcccatgggttcacttgtcaatctttctctctgtttttcttcttcctttctttgtctgtccatctctttctcattgcgccgccgctgagctccgccatggccgagccatcgtgcgtcgtcaccgtcggcggtgaaccccgggtttagtgtcgaccaaaccgagcatcgtgctcctgctgcaccgcctcctcgccgtcgacgatgggagcagatcatcacgtgctctagatcatcacgtgctctagcctgagaagcttcggcgagctgctcacgcgagagctgaacacacggctgcaattgagccccgacacgtccgtgctgtcgtcatcgccacttcactccctagcagcagtaacggccgcacacccggcatcgacgtcgacgctcaactactacgcgacgttgttcgacggcctgcagcggagcacgacggagcacgacggcgccggcggagcgcgtgctgctcgggatggagatccgcagcgtggtggcatgcgagggggcggagcgggtggagcggcatgagtgggcgtgacagtggtcagcgcggatgaaggcagccgggctggagcgggtggggctgtgctacggcggcgccatggaggcgaggaagctttgccgaccaaactttgccgacctcatccgtgctctggaatgccgccgtgcgtcattgccgtcagcggcccccgggatgcgccgccaccggcgccggcaccgccccgccgtggccgagccatcccggctcaggccggccgccgtcgcgaggaagaatggggaaaagaaaagaagagagagaggaagaacagttcgtgtccaagggtattttggtacttacacagctctttctctctccattttgaccgaaaataataaaataataggatgagtgtccaacagctaattaccacttttttcagtatccacgagcaaatacatgattttgggtgtctcacagcaaagaccacaatctttcagtgttctgtagcaaattttgcctattcataaggagagtccacatcaagaagatgtgaaatgagattgcagctgttatcaggccagaaaggttaaggccttacatctgcccttgtttggaagaaaatgactaacgctattttgatataaattagaagtttggttgaaattgaaacgatgtgacggaaaagttggaagtttgtatgtgtaggaaaattttgatgtgatggaaaagttgaaagtttgaagaaaaattttggaactaaactcggccatcgatgaactttcatgactttgatctccctgttacttgacacgaggtcacacacctccttgactatgtaaaatcaaatatgtttttaattatattctgtgatgaacaatatgcattggagattattggttttgatatttggaatttatttgtgaagtggttttggagatgattggatttcacaggtgatctacaggtactgctgattgggtccggtcagaccgggcacgggttgccggtcagaccggcggtgatcgagcgaccagaccggccagctcgcggtttgaccggccgacgctgtgtcggtttcggtttcgggttgtttgtttgggtatccatgattgtttcatgattatggcttctagatggatactatgcgtatgtaatactgttgtttgctactaatgaattaagttggggatagcttggtctcggaatatggtttctttgtttgttctatgtgtaggtgactcgagatgccgggagagtatttgcggtgatggaccgggagtcggcttggggataagacgacgtttgtggtggtcagagatcatgcgggatactaaggctagagtccaatgcatgtggttggtgaagattccatatggcatacgatggaggtattgtgtatgaatgggatgcggagtcgaatttggaaggagtcaaaatttggtatgattggttatgtaaagtttgtttcttgtactatatggtttcctatgaggattaggacttctagtatgagattggttcgtggctttaggctgcctaccttgggtataaataaagagggagcgtgagactttccggcatcgcttttgagagcaatagagttgatagttgagttagggtttcgagtttagtcgagatttttgtaaggagtgctgttgatgtactttgtaaacacatagagaatcaataaagtcgtcatccattttaagagttcttcgatttgtgtttcaccgggtttcggcggtcaaatcggcgggtgacccgcggttagaccggcggcggcaacagagagtggcaggcgatctcggtggttcgaccggagttcgatctcggtcagatcgacgttcatcaggcggtcaaaccggcgcatacacttcggtcagaccgcgatccgttaaatttgagggtaacttttatttccgctaaatgttttggtttttgggcataccaaccattcaccccccccccctctggttggcttagttctgatgtttcgatcctacagactagaaaggctaataactatttaatgtgctatgcggatgaaaatatatgaaatataatagctacacaaagttttttcccaatatagcttcactttgggccatgttttattatcgatgtttcgctttgtaccaccctttaaccaatgttttcatcatacataatcttgttttggtttcactttggatcatccgactctcttctcaagtatatgaatgacctcgagtataccagctgctattcgtgaataaactggccgctattcgtcaataacttccttagctgtatgtagaccgcttctttgacatatgataaattgtatgtagatgaataaaagagttgacggtgatttaaaatgccacataggtaaaattacccggcccaaagtgaaaatattagttgaaggctgatccaaaacgaaacatcgacaataaaatgtgtcctagagtgaaatttactctatattacttagtttaattttttaaatgtgttaagaataaaattagccagaagtctatacttaatgccaagtttggatttattttttatgtacaataaacaatttgtcgcaaactttatgttcagagatgttaaactaaatttacacaatttgcgccatcttctctattgtatcggtcccaacttttccaccgtctccgttactacatgaccctcttatcttactcttatttttcattagtgtgcttgctttgaaaggatatgtgtttatgagttttaaattttgaattaaaccaatacctccacaaattattatgaaattgtcctaaatttagctattttaccatgcaaattttgaagtgttagtataatatatacaatttgttgtacccaatattaatttactcgtagggtcttgataaaaagtacaatacaatactatttttatggattgtttttcatattataccataattgggtggggcgtgtacagtagcaagcatggtcagtgctcagcggaaagccatgacgatggtttcaaccatccaagggggtccgttccgttcgtccccgccacggtcacgtcatgtgtgaaatcagccgaaccattccgagggcccagtggtcgttcaacgcttcccacttgcccccataaatctgtttgactagaaaataagcgctccgtttggtgcgttttatttataacctgtgtatttttggatatatttatattgtacatttaactctatttttttttatgtttgtgtttaaatctacatttgatcgttaattttgtttaaaaaatatatggttatcatttgttttgttttgattaatattgtgactaatattattttgaatatgactatattattacatatttgtataaaaatcttaaataagatgaatggtcagacatatatttaaatatcaacgttatctaactaaatgaataaaataattagtttaggctaatcatgttgatgacaatttattgtactttcaataactttattaaaattgatggtttcaaaagtaatactacaaaataagcatatttttattgcttatatatatatatatatatattaaagagagaatttagtgtatatgagttcgaaagacgactgcgtttgcgttcgttctggttccagctacccgcctcgtttttcgcgcgcacgcttattaaactgctaaaagatgtgtttttataaaaagtttttgtacgaaagtttcttaaaaaaatcatatttatctatttttgaaaaaataatagctaatactaggtcccgttcttttctccaataagagttagatgaagattaagattttcgtggcacggttttcaaattgctaaatgatacgtttcatgcgaaaactttctatataaaagttactctaaaatatcatattaatctaattttcaagtttgtaataattaaaacacaatctagtatcacctcgttttacgtaaaaaacttaatattcatcttcaggagaaaagaacaccaccttaattaatcatgtgctaatggatcgctccgttttctgtgcacactgttctagatagaacctccagcaacaaacagatcgttaagtggctaaaaagagtgctaactcagtgcgatggatcctgcatgcattccacgtttcattacgtactctctttctatcgttatcctctctacccaagtcaccaactcaccaccattgctctctacatcgcctctcgtttgagaagacaacttccacactcccagccatagcggcatacacggatgcatctagcgcagccaccgcagcaccgttacggcgctccctcatctcgatcgcccgacggagagctggaccgaggaggtgaccgtcgccggcgcatccccggcttccccgcacgagtgccgactgcgcccgtgcatctcccgactcggctatattctcttgtccctccacggatccactcccgaagatgcttgcttgctgttgctgaagatatgtgctgattggtgttgctaatgcattctttatgttcttgtgtacctgtatagtgtgtccgtggatccggccacgtagatcgagcagccatcgcccctcctcctcctcatcgcccaaaacaggtgacaccttgccggcggcagcctgcggcactgtgagtagggagatggagatagtaatctattttttcttgcgattgttttctgggatttttttctccaatacttcggacttttctagatgagatcgcacgtttgtaaaaaacccctctcaaaacttgtaatttacatttaggtccacagaacggtttaaccgtcgatactcatctaacggctgtggataggtgcgtatacgtggcactttctacagccaagaatcaggaggagagctccataagagatgccatgtggcccaattagaagcctgggatctgaccctgaaatcggtttataagatttgacctgactaatccctgtcaagttcacaccccctacctcggtaaccaaggaactattccatccgtacacaaatataatcacttaatatctactaatataataatttataatactaatctcattatcatcttcagtagaaacgaacaccatctaattatcctatcaatcacttctcgtttaatctttttcatcttaccctcaatcattcttacacttttatctactctctccggttttattttaattaacgttttggacaataacacggactataaaatatatctttgatcttatttttctattataatatatacaataaataaatgcatgtttgctgttattatagtgttttgaaagacaaatctatatatattgttctaatttctttaaactaaatatttttaaagttattaatggtcaaaattataaaagtttgatcccaaccttacctaaaatgtcaattattatgcaaccggagggagtactcctcatgacataaagatcttttctcctctattttactcttttctaaataatctaaaaaatatctaccgtatattatcatttcaatgccgtcaattgagcggcgccgatgtccactgcccagtgagatggtgagctcgtctcggttttctggagaccaaaacggaagaagagaggaaaggttgaatgaaaaaccatggtctttgatcgttgctgttcatttagcatggaatgggagctataaattttcattagaaagcttagttggtgcttaagcacaggaattttgcgataagcgctttcagattatacaaagaaaatatcatatcttgtgattttttttaaaatacataggctaggtgacaaaaagattgcgatagcatcattagcatatttatagttctcggacctaaaaaaatggacttcgttttatagtttttttactatatctacatagactaggggcatgtttagttcccaaacaaaatttttacgttgtcacattgaatgtttgaatacatgtatagagtattaaatatagacaaataaaaaaccaattacacagttcgccaggaaattacgagacgaatcttttaagcctaattgcgctatgatttgacaatgtattgctacagtaaatatttgctaatgatagactgattaggcttaataaattcgtctcgctgttttctgtcggaatctataatttattttgttattatactacgtttaatacttaaaatatgtatccgtatatccgatgtgatatataggggcaaaaatttttgccaactaaacgaggtctaggtgaacgtagctcagtttggtgcagaatatcaagaatgtaacaattcaccggcaaccatggctttcgtgctcgctttggtgaagccatatgcttcatggtggacatcccctttagcaattagcaaaggtgaggggaatataacattttttaaatactactaacattgtgtgaaagcaccaaccgaattttacaaagttggtttaatatcgaaagcgcttagatacgcgcctaaaccttctactttgcctaatataggtgtaaaatctttctcaagctaattttacttttggtgaatagtcaaaacacacgaaatactggtagtatcagcttccccataataaatgggtgagattaatctaacaatactaacatgcaacccaaatggtttaattaatgctccgttggaaaaaaaaaacctcaatcacattctattcgaagcacttttttcttaatttctacaaatctgatttcttcatggttcttacaaaatagatgttgtccaaacgtgggctcgccttttcttcccataaaatccatctaattccctggttttattgggctagtttgaaacaaactaattttaaaagaaatatattaagcgtatgttttttaatagttaaatgaataaatagctgaataattatgtgatacaaatgaatcactccttcaattctaaaatataacaagttttatttagatactaacaattatattttaagacagagatagcaactcttataaaatttaaaatatatttaaaataaattatatatatatataatatttttaattaccaaattcacatccttgataagtttcaggaagcacgccgcgttaatccattcatgcttctctaccaagtagaatgggactgtttggttggtaaccaaatttggcagccatattaccatacaaaatgggaaaatgtactaattcccaccccacccccctctcgaactatcgcggtcgaccgaattgcacccccgaaccacaaaaatggacattcttcaccccaacaatgtaaaccggacgaattaccctcctcgacccaatccgcggtgggtttggtctacgtggcgtacgcgcggcattccagttagcattctatttatttaaaaaaatgtgggacccacctgtcatacactcatactctctcttctctttctcattctctctctctcccatcgtcggcgcgggatctgggtgtgcgggagacagcagccgcggaggagttggccggcggtaaaggtgggggcgccgtcggagaggcgcggcggagggggcccgacgggaagtggatggccacggggccggggcagggccggacgtcagagggttgcgggggctgggtccgccgccccaagctctgtccttccccgccaccctcgtcctccccgcacgcatgccatcgagagggagggggcccgagctcgtccgccccccaccgccgtcctgctgccctcgtcctcctcgcgcgcacgccaccgagagagagggggaagccacgccgagctccgtccgccccaagcttcgtctgcccgcacgccgccaagagtgagggggaagccgtgccaagcggccgcctcctcatccgctgccgccgccgccaccgctccgtgtcccccgctgccgccgatccatgagagagagaggaagagtgagatagagagtgagagagaagagagagtatgagtgtatgacaggtgggtcctatattttttttatataaatagaatgctgactggattgtcacgcgtacgccacgtagaccaaaaccaccgcggattaagtcgagggggtaattcgtccggtttgcatagttgggggtaaagaatgtccggttttgtagttcaagggtgcaatacggttgaccgcgataattaggggggtaattcgtactttttcctacaaaatgtgaccaacaaaccgttcatcataaatgtaacaacattttgactagaagctaagggcctgtttggttgataccctgagtaccatgcctgagaaaattgcatgcctggcaggcatagaagaagctgatgaagatggcctggtcaggcagcctgacattttacttgtttgggttgtgacattttacttgtttggttgtgtacctttgcctgagaggaagaaacatgattaggatctggatgagaaccgctaagtcaggtactaattataattagaaggagggaaaaagaagggataaaagaggcaaaattgcatcgttcctccaaataaatcaatgtagtacccagcttttgataaacaaatcacttgtatacatcatgaagggaaaacagaacggtaaaacacaagaaaaaaaaaatccctaaatccacgcatctagcaaaacctgcaacaatttctttcagctggttggcaattgattcaatcaaacaaaccatgaaagccttcagtgtcttgcacggtatcagatctggaatggctgcagtgcctgcttccttcccgtgcttcacgcgaacggcggatacaacagagcgaagcagcaggatgcagagggatccggcgagtcagcctcttcctcggtgaatccagcaaggatggaggtggctgattcacatgacggcgatggagacaacaactgcagcagctccgcgtgacgatggcggcggcggcggcggcgggggcacgcgtgtggctgttgaaatcctatcgttctctccagatagaagaagaagattacggtggtaagtggattcgcctggagctcaggcgacctatttggctcaggctaacgacgtgcgggaggacatcaagccaggcgtggaatcttgagtcccagggagacaaccaaagaacctcgcgttatactcaggctagtatcgggtcaggcaatttcttcccagggcagcaaccaaacaggccctaagtctatgacatacaaatccaatagatattaaagtgtgttgtatcataactgtgctaaccaactaaagtctagactaataaattatgatatatcaaagctttggcgtggcaacgtttgatagacaatcaaacaacttctgcatgccctaactcttttttttttaaggaaatgccctaactcttgatattttcgtcctataaaattgatatttagtacttgtcggtgatatgggcccgggggtatcatgtttagagggaggaggctgcccccccaatgccacgtggccctcccccaaggggagtcgggcccgaggtagggtggcggccactccttcccaaagactagtcggaggaggctaccccccgatgccatgtgaccctccccggaggggagtcaggcccgaggtggggtggcggccactccttcccaaagactagtcggaggaggttgtcccccgatgccacgtggccctcccccgaggggggagttaggcccgaggtagggtggcggccactccttcctagagactggatgaaggagactgccccccgatgccacgtggccctcccctgaggggagtcaggcccgaggtggggcggcggccactccctggccaagactagagggagaaggctgccccaggcgccacgtggccctccctcgaggagggatcgggcccgaggtcgggcagcggcggccccctcccgtgactaggggtcaggctcccccgaccccctctttaggtcaccacgtacaggtgcccacctacccgtatttatggtgacccgagcagtcgcgccaatgcggcttgcagtgtactcaaccggtctgtgaccggtcgaatgactgatgggactgactagtgtgcctgtgcgctgctcgtgtgttaggcggcatgcagcctgacatatcccatcaaataatgatggtgagaggttctcatcatcttatcccagctggagtcggtcctcccgctctggttaaagctaggctcccttttcccggtgtaataggagcccagaagttttcacccattaaatggtgaatgacatgggcgctccccgtgtcaggcggcatggtgtggtaggccccacgaccaaggcgacgtgtatacaacttccaagttaaggaacaagacaggcatttaatgcaaagatggtaatatttctcgaggaagttaggttgttgggcctatttggtatccccttgaactataaaaggaggaccttgcctaccgagaaaagggacgacgctcagtaaacctgaactctaggagaagaagagcgagagtgctctccgtagtttaggaacccttgtaacactcaaccataatcccaaacacaggagtagggtattacgcttctcagcggcccgaacctgtataaaccccttttatctcatcgtctttggaggattgaaccccctcaagatcacacagcttcgctcaccaagccctcgaatctcacccgctgcccccggccgaactcacaaaggggggcctcacggttccctgatggaggagttcattcttcgacagtactctatttgttctaaaatataagagatattgggcggatctgacatatcctagtactacgaatctggacagattcgactctcccgtattttttggatggagagaatatataacttcgtatcaaacttgtggttacaagaaatatttcatattattcccttcgtctcataaaaaatcaacataataccgggtattgacatatcataatactataaatttaaaccaacatgtaacccattcaattttatgttatttttaacgagatggagggagtaatattttagaacgggtatggtggatttttttttttttagaaaaagcactcgtgttccaagtcccaactcggtcttccccagttccatctgtccacacactccacagcaacaggcttgcagcctgcacaacagtgcttgtgtagttgtgtcgcgtgtgtgtctgagagagagatcagagatgagggcgggcgggttgactgggagagtagaccaggaagtcgtcttcactgaaagtccgtggaatgccgcgtccctccatcgaaagcgagaggggccccgccctacactgccaaacgtccctctcccccagggccccaccaccccttgaaccaaaaaaaaaaaagaaaatctctcgcctacgcctagtagggattagtagtagtagtactactcctcgtcgtcgtcgtcctcgccttctcttttgacgggcttgcctcccctcccctccctcctttgccccccgcgtccaagtcttccttctcccaccatcgtcgtaactatctcgttgttcattcgcctcctccgctcctcgtcttcgggtgtgcgggctcccttcctcctgcttcttcaggtgagacgagctctgctttttaattcttgttcttgtgccttggtgtgttcttgtggggctttatttgggggtgtacagtggatatgatcttcgtgagtggttttgcggtttagtgttcttggagcgcaggaggatctcccggacccggaattgttatgcaaggatggagaggtgaatttcgggggtgctggtagagtggtagtacggcgatggaattaggggagaggaattctgttcgtattgctgctgttgttgttgccgatgcgtgggtttcttgaggaggaccaagggttcgtccaggactcatccgcttggggatttttgatgatcatacgcgaatcatttcgagtggcggagaagggcggccggagtgcctgaccacttttggtgcgagatcgaagagaaaagatagtgtttgtttgtttggatggtggtggtgccttcttttgggggatatttttttcctcgttagatttttttcgcaacaaaagtagggcgcctttttgagacacgagagaagccgagatattaaaattagagaccttttgatcgctctaaaatagaattgattgaggcatagaacgatggttttgtgtgttagaacctgcttccagtagacgattctttgttactcgttctcattcatgcatctacttgttcttccttttgcctatcttaataattagaaagtttaccgcttgtgtgatttgctttgtctaaggtggggatcagttctctactgatgtagtgatgttggctgcttacagttgggattctttgatgttgttgttactatcataaattaagtcacaatttccatcgtactaggataattatactgtggcacactaactttcaggctagagcatcgtatgtttacctgtaatttcgtgacatggtgttattgattcttgcaggcgactgctaattttgaagtgccatttctcatcgtcaaggagaggtggcattaatccgcagcaagtgctcgatgacagatcattattatgctcctctgaggcttattcttctcttgatattgagtgccacctgttttggctctgaacttgatgttcagtgcttgaaaaccatattccagtcagtgaccgatcccaatggtatactcaaatcctcatggagttttgtcaacaacggcacccctggttacatctgcaaatttactggggtggaatgttggcatccagatgagaaccgagttctttctttgcgtctcggcaaccttggtcttcagggtccatttcctgcaggccttcagaactgtactagtatgactgggctagatctgtcgagtaacaactttacaggactcattcctcaggacatctcccagcaaataccatacttgacatcactggacctctcctacaataggttttcaggccaaatcccagtaaatatttcaaatatgacatatttaaacacactcaatctccaacataaccagttcactggtcaaattccactgcagttcaatcttcttggtcggttaacatcattcaatgttgcagagaaccgactatcagggcctattccaaataatctaaataaatttccgtcatcaaattttgctggtaatcaaggcctttgtgggctaccattggatggctgccaagcttcagcaaagagcaagaacaatgcagcaatcattggagctgttgttggtgttgtagttgtgatcataattggcgtaataatcgtattcttttgtctgcggaaattaccagccaagaagccaaaggtcgaggaagaaaataagtgggcaaagagtatcaaaggaactaaaaccatcaaggtgaaaataccctactattactatttatttcccttttcttttataatacaaaagaaattttgtgtaacattattcgtaaaagaagctaacgtaaacttcttactgtcatggccttttcaattattcaggtttctatgttcgagaatccagtttcaaagatgaaactaagcgatcttatgaaggctaccaatgaattttgcaaagagaacatcataggtactgggagaacaggaactatgtacagggcagtgctacctgatggttcttttcttgctgtcaaaaggctacaagattctcaacattctgaaactcaattcacgtcggagatgaagacacttggccaagtaaggcatcgcaacttagttcctctcctaggattttgcattgctaagaggaaaaggttgttggtgtacaagcacatgccgaaaggttcactctatgatcagttaaatcaagaagaaggcaaagactgtaagatggattggactctgaggttaagaaccggcattggtgcagcaaaaggtcttgcgtatcttcatcacacttgcaatcctcgagtccttcaccgcaatataagctccaagtgcatcctcctagatgaggactacgaaccaaagatatcagattttggacttgctaggcttatgaatccaatagacacccaccttagcacctttgttaatggagaatttggagatcttggttatgtggcaccagagtatgcacgtactctggtggccacgccaaagggtgatgtgtacagcttcggtgttgttcttcttgagcttatcaccggcgagaggcctactcatgtttcaactgcaccggagaatttcagagggagcctagtagagtggatcaactacctatcaaacaatgccctcctccaagatgccgttgacaagtcattgatagggaagggcagtgacggcgagctaatgcaatttctgaaagtcgcatgttcttgcacaatttccactccaaaggagagaccgacaatgtttgaggtctatcagctcctcagagccattggagaaaagtaccatttctcggcggaggatgacttgatgatgctgccacctctaagcacagatggagaaacccttgacgagctcattgttgcccagtaactgcaaacccaatgttccacagaaggcaaccaagtggaggttgtttcttctgcgcgtcattaccatgcttagatgagtgaggtggctttacatgatgtactattaagtagtatcagtatactgcatccgctgtataatttttgtagcttgttgttatctaccattgggaggtgctagcagcagcaatgatgatctttcactcaaccgatatggggatggggtattaactactcctaatagtagtttgctcctcatgtgatgggaatatgccatattggcatttattcagtcatttttcatgatgtcatttgtacttacgccacgggatgaggaatactgaacgtcaaaatgtgtggaatgccaccttatgatgtcttccagccaaagtgcacctgagtatgcaagcaaacttgggaatttcattatttcaacttgcagtgtaagagtagtgggtcattgtcttttgtaaatgtagtatagcttttgctggttgaaactattttttttcttggtctataaaagcttcttttcatgctagccacttctattgttgaaatatgcagaaatatcaagattaaagaaaagaatggtgtaggaatattgcaaattaagcagagttatttttagcttataaaaacatgtcacctttatttggtcaaaactcttgcctggtcttaaagggccgtgtgcgttccagggaaattcatggacttttgtagtggttatctggttgatgcatctggaaatactgatattgatgggaaaaaatgctcctcttttaagtcgtttttttttcttggtgggggtggtccagaaaacctcttacacgtatgaacaccggtcaaaatttttgacttcaacgaatgttatatctggaatcatcaagattactgataaaaaatacctgcaagaaatattaatgaaaaatcaaggcgtatgcataccgattgctagatagcgttgctttggtgctctctacgggtattattataccactagtattattaggagtaaattaataactaatatactttttcatttatgttttttcttggctaaatcgatctatgatcacccattacgctggcatcgctcatgtttcatgaaaaaacaaaaaagaaaaaaaggtttagtcactgctaaatgatgattataccccttcgcacccttttacatttctactactattaactagggtggttgtataaatagatctgaacccttcgatcaaatgagatcaatagttcggattattttctaatacatgtagagagtaccgtaatgaggctcttgctagaagtatttcgctgctatttatttagtggacacataaaacttttgctctctgaaaaaatttcacatgtgacttcagaagcagcataaagtttacgggcttgttcggtttgtaggatttttcaaaacgtacgaataggaaaaacataaaatagtataaaaatacaagtgcaaacctaagaattgaaaaacataggaaactttactatggttgtgtagcaaacaatacaatggattgaaaacattgggttagagtggattatatttttctttgttttcccataaaagggagggatagaaaattttcatctggtgcattcctttgaaacgaacgatagtgcactgtccattccgaaggactatatattactgtacttttccttcacaataagccctagcagtgcaagccacgcttggcttggcgtgccttcagcctattccaacaaggattttggaccaaaattcatctctaggtcacccaccccacagtgctgtacccacgtcttcctcctcatcctaatccccacgccgcttttctcggcttttcatccccacacgctgattctcgccagaccgcctctttcctctcccctctccacctcaccgacggcggtggcggcgtcctcgatgccggaggcggcgcggtggcctcgcttgcggaggtcctcgaggcggcggctcagatctggacggacggcgacgcggcggcacacgtggcggcggcggcggctcggtcgacgacggcaacctcggcggttgcctcgtcgtcctccgcagatctggagcggcgcacacggtggtggtggtggtggtcgtcgtcgtcgccaccgacgcgcggtggtggtcgccgccgacgccgcgtcgtcgttgcccgcggtggcgcacgccatccccgccagccggactctccctcttcccggcgcgccgcctaccccaacgtcgagcggcggcgacatcctcgggacctggcgaagaaccggcggcggctgcgcagatttggagcgtcctcgccgtcctcaacgacggcggcggcgccgcggatctgaagacgtggcggcggtggggggtcctcgccccgccctcctcacggacggcggcggtggcgtgtcctcgccccaccctcttcaccggcgacggtggcgtggattggagctggcctcggagtcgcgcgttctcgtcctcgcatctctcatcagtgggccccgcgctctactttttaagcgaggttctcgttccttcgctggtaaccgaagaagctattgaagctatgggacacacaaactttttttgccagcgaggacgaaggaacgctccatgtagacgaagtaacgcccactgtgaagggccttacaatccccttttaaattttttttacaataacctgcagcagaagttttccaaattaaaaggcaggataataaatggttaacaaaattctagatcgaacgaacatcgttttcatataagtggcatctttttttttctttttaccattttaattaatttatttatatataaaatttaatttttctaattccgttccttgcctatattatgattgccactaaatagttaaaatctataaatatggaaattcctaagtgacctgcaaatcacttctgtaaaaatggcattgtttcggatcatttccatcacagtttttattacccatccgttccatattgtaaggctttctaacattgcttatatttatatttatgttaatgaatttagacacatacatatagcattgcaatgctagttatggaaaaacatttttaaaactgataaaaaatggttaaagcaggaacataaagcatctgtgagtgttgggttcggcggtgagcctcccccaacagtgttgcgaaccaaagcgaggttttttcgcgggtctcagaaggggaagcagccaagcttttcccgcgtcccgcgacgagggttttgggtccgccgccacccaccgccgccgccgcccgccaggtatgcgtctccctaattccccatcttgattagggatttataatagtctctttgtggggatgggggaaaagtacttcgcatttcacctgcatgtttagcattcagccaggtcccctagttttcttttttttggggatgaaaatgttgatccgatgtgaagtttttaggaattatttttagttttttaggc

SEQ ID NO: 81763 - DNA, 2161 bp, Oryza sativa
cgaatctcgaacgttcatttctcgatccaacggtagttttcaagttttcactacatatgtggtttgcactagatattttccccttttgttctgaactaatcatgatacctttggatgaactttgtagattttttttactaccggcttttactaaacttgcacacattaattttcagttcgaaagcttgagagatagatggaaggcgaggatgagtctccttctcctggagagaatgagttgcctttgtgggggcatgttaagatattggatgggttcgctcctcgctgtggaacaaacatgaggttcctatgcgactattgcagttgtgtctttcgtggaagctattccacagtgaaggcacatttgcttaaaatttctaaacaaggtgttccagcttgcccaggagtgaccttcaatatcttaatgaaactatccagtgaagttgatgcagcagaagattcaattctaatccaggtgcgtaaaaaaaggaatgtaacagaatcttgtagcagtgactattctggtgacgaaccagaatcttgtagtagtgactattctggtgacgcaccgtgtatgggcaaagttattgtacaagcgaaaagaaaaaagagcagagctgaatgtcgagataacttcgatgctcagtttgcaagaatgttctattcttcaggttactaccttaaacttaaaaacttgtatattttccttttgggaacatgcataagtttgcacataacagggtactctgtttatgttgtatccatcgcccttcactttttgttttatcttagcaggcttgtccttcaactctgcaagggacccatacttccggagttcattttcttttattttgaagaatattattcctggttatgttcctcctgattgcaaaaggttgaagacaactcttctgcaaaaagaaagggctcgcattgaagacttactaaaacccatcaaaagcatgtggaggaaggcaggtgtgacgatagtttctgatggttggtcagatattcgacagcgctcacttgtcaacattctggctgtcaatgaatgtggacccatttttctgcaagcaattaacaatgaagatgaggtgaatacaaaggagtacattgcagagaagctcattgctgttattgaagaggttggtccagaaaatgttgtccaagtgatcacagataatgatcctgtttgcagagctgctgggctgctgattgaagaaaaatacgatcacatccaatggatgccttgtattgctcatactttaagtcttgccttgaaggatgttttttctcctaacaatactggagatgttgccttcaaagatagccattggatttctgaagttgtagaggatgcaattatgatcaagaatttcataataaatcataccatgatatcatctatactgagtgagttcagtaagttgaagattcttgctatttcgaacacaagattcgcttcagatcttgttatgttaaagaggtttcggctgatcaagcaatctctaataatgttggtcatcagtgacaagtggtggccggtttactgtaatgataacatggagcaagcacagcttgtgaagtacaagcttactgataactcgtggtggaaacaagttgattacattctttctttcactgagcctatatattcgatgatgcgcgtgacagacactgaagagccacgccttcatcttatcaatgaaatgtggaatactatggtcgagaaggtaaaggctgccatttataagcatgaatcaagagagcctgaagaggagtcagcattttactctgttgtgcatggcattctagaagattggtggagcaggagcaaaactccgctccagtgtttggcgcactcactaaatccaaggtgaatcttgctttgtagttaccaagtgatttgtattcctgaagccattatttgatatatatgcctctttgtggtctcttttgtaggtattacagtgacagctggattaatcaagctgctaatcgtctacccccacatagagatgctgagatttctcgagtgaggaataattgcttgaggaaattgttttttactacagacaacttgagaactgtcaagtcagaatatggagagtttgctcttctgggaacaaaacattttagcttgaattcaagagctgatagg

SEQ ID NO: 81764 - DNA, 12088 bp, Oryza sativa
gtccatgttgatttgcatgtacagtagcatatctctattactagaatatagcaacacccactcttctagcatttaaaatttactccatgtttcatattataggttgctttgtattctttttctagtaattttttttaagtttgatcaaatttatggaaaaaatacaacgatagattcaacacaaaacaaacatattattaaaatatattgaattttacttttagtgaaattaatttagtgttataaattttgctagattttgataatatgaaaatgttttattagaaaaatgtcaaagcgacttaaaacgtgaaacggaggtagtatgtcgaaacgtagcaatttctacagctaccctctcatcttaaccaattacaacaatctctcatttaatttttcccatctattacctcatctcaactacctccatcccaaaatataaacatttggatatgaatctgaacacatagttatctaaatttaaagctaaatatgtttatattttgggacggagggggtatctggggatggctaattggcgcgcgcgccagctagcactccctcccctcgcgctagcttttctttttcgcaattttcctttttcgcttttacttgattttttgttaatcttctacacacgttttttcaaatctttaagttgaaagtttttaaatctttaacttgaaagttttcaaatcttagcttaaaaggttttcaaatcttaacttgaaaggttttcaaatctggacttaaaagttttcaattttgagttgaaaattttcaaatctcaagttaaaagttttaattttcaaatctcaagttaaaagtttttaaatcttaaattgaaagttttcaaatcttaaatttaatttgaaagttctaaattggactttaaagtttgcaaatttgtagtgaaaaggaaaataatgttttggaaaaaaaaagtttatcttgattggcctaatttatactacctccatttcaggacataagactttctagcattgcccacatttatatataatgaatctaggcaaacatatatctctagattcattaatatatatatatatgtgggcaatgctagcaagtcttataatatgaaatggaggaagtagaacctaattacgtataaaaattaagttaatcacgctgtcagggttatggataccacatacctaatagtagttgactaaatctcggcacgactcaccacataccatatcctatacggaaacaacctgcggatataggaagagttccggataaggaaagacaaccagagttctatatggaaacgacaaggactactctgattgtatccatattggtttacctagttctatttgtacaagggacacctatgggtataaatacaagactccctaggaggaaaggggacacacccaccatagaagagacaatcaacacccaccacaatctacggaacaatagatcaagacagaagatcaacatacaagccaatatacgctaagacaagccgccgggtatcgacatcagagatatgcctggatcgaccctatccggaacctacagaggccggccgtagggacgcgttgtctctgatctcgccgggcatgaactcgaggaagaagactaccctgatgtcgactatgagtcagatcttcagaccgccatgtcgataacagttagatatgctacccaaatattgtactggtgtgattatgatggataagagcaatgaccggcttcgaccaacaggatgtagggttattacccgataattcaggggcccgaacctgtataaaaatccctgtctccatctcttttacctcaatctcgcatatatcatggtaccgacgatctccataccatgcaaataccggaatcgcgacatcaaacgttgttagtggcgcgccaggtaggggattttggtgctttaggatttcgacgagatgggttcaaaaagatggattcttcaacaataagctactcgactacttcgaaccagggagatccaacccagccaaagtacgtcccccaacgagatctgaaccatcgtcgtcgataattcgatccggcgagatcgaccaagatgtcaccgccgcgggtttcgagactttcagccgagtccgattgctttgagaccgagcgcttgattgttccgtctcagacacaaagtgctactgacaaaacagaatactactacatgtcgcctgtatccgtggtcggattggatcgatctcaagtgcagcagccggacagccaagcgagaagacggctgactacatcacgtgttgacacatactccgtatgtcagcatgcatacagtgggaccgatgtacagtattgcatggtgtgtaccgaagagctgagctatctcagccataggtatgcatacatacgtacataggcatgccatctacacgtgccaatcgctgaggacaattcagtttggctaaaaggtaattagtggattgatttattaattaatctattaatttcatagatacatccggcatgtatctacaaaggtatacaatattttatctgcaatttatcatatctattcagatcatacagcattgtcagatctataatttattatgtttacctacaatatattttttatacaatatctgttgcgcgggtgtccccgatgttaaatcgactacgatctaatgctgagggctcgctctgtcttcttctgtataaatcatgcttgtttacggtctacataatgcctggtatttacatctgctcgttatatcctgataatactagaagatccatgcaattttttagtacatactcgatattctccgctatatgtcttgtcttctagaaaatatttttcaggaacaattgagcactcgaatagtttgtggtcgagtacaccgtattatcgagaacaacctcgacaaatgcagagtcgtcgcgcccaacctaccaacgaagaccgacgacctatctcatagcaccggccatggctggactactcgagaaaaggttgttaacggatagttcctcgcgaacgccgtcggcttgatcacccgacatgattgcgaatggacgtccggatatgctacaagttgggtgtgtgagtcatgctggccatatgagatgcacatgtaataaaccaactctagcacttccattggtgttcgagagatgattctactcgctcgctggttctcgaaccagtactagcaatctcccgcaccgcaaacctccattggtgttcgagagatgattctactcgctcgctggttctcgaaccagtacgtagcaatctctcgcaccgcaactttcattagtgttcgagagatgattctactcgctcgctggttctcgaaccagtacgtagcaatctcccgcactgcaacctccattagtgttcgagagatgattctacacgttcgatagtcctcgaaccagtacgtagcaatctcccgcaccgcaacttccattggtgttctagagacgattctactcgctcgctggttctcgaaccagtacgtagcaatctcccacaccacaacttccattggtgttcgagagatgattttacttgctcgctggttctcgaaccagtacgtagcaatctcccgcaccgcaacttccattggtattcgagagatgattctactcgctcgctggttctcgaaccagtacgtagcaatctctcgcaccgcaacctcagatggtcgtggtacgattacaacaataacgcagcggtcctcgcaccacgacttcaaatgatcgagagacacctactcactggttctcaaccaatcaatcgtagtgatctctcgtacatttacttctagtggttgagttacgactactacctggttcttgaccagaggtgtagcgattctcccattacctctacttcaacaaagttgatatcatgtacacaatatcgccaagtgttttacccagagatcccttaccacaaagacacctagcgttgaaacctatcctaatgtccctttacgccatcttgacaaggcctccgaggaacctgagggaacttcggctggggacgcccagagcggataaggccttgtaggatcctttagagacgaaagaccatgtaagatctggtcgtgtaagagttctcaccgtgcgtattaaccaagccgtgtaatcggaaatggattttctaacttcacggctgggggctaggatcagtgcttgttcaaccgaggcaggtcaaaggttcaagagctttatcctccgagaacgattctccgacgacaaggctgggggctacggagagtgtataactcaacaaactgactgatcgaagtcggtaaaagagtagacgctcatatacaaaacattggtctgtaagtttaattcattttcagttttccattcattctataacatgttaccctttgagcgttcgctcgggggctatttctatctaatattcttttctgagtattgatttcaggaaaattctattcgacattatcgaaggctccatgtctctatggttgtacaccaagatcaactaaggcgagtacgagaaatgttgacaaggcttcgtcgcagattctacgccttctcgatcactcgagaacagttggtggatctcgacaaggaatacggaatgaaaaaatggtgtacccgccgagataaaatttcttgacttcaatccaaattctcgattacagcaagacgggagacttagtcgtatgctctgctactttcttggttgacgtcggagattgactcagacaaaccctttaggtgcccgcacgaggctgataaaggaagtctaatgttatctttgaactcaccgagaacggtcacgtaagctcgataacagttcctccaaggtctgcagttgagaatatgaactcgctcatttgcattgaagtcgggggctactgtcagggttatggataccacatacctaattgtagttgactaaatctcggcaggactcaccacgtaccatatcctatacggaaataacctgcggatatagtaggagtttcggataagaaaagacaaccagagttctatatggaaacgacaaggactactcggattgtatccatattggtttccctagttctacttggacaaggggacacatatgggtataaaaacaagactccctaggaggaaaggggacacacccaccatagaagagacaatcaacacccaccacaatctacggaacaatagatcaaagacagaagatcaacatacaagccaatatacgccaagacaagccgccgggtatcgacatcagagatatgcctggatcgaccctatccgggacctacagaggccggccgtagggatctagcgctgtctctgatctcgccgggcatgaactcgaggaggaagactaccctgttgttgactacgagtcagaccttcagaccgccatgtcgacaacaattagataggctaccccaaatattgtactggtgtgattatgatgaataagagcaatgaccggcttcggccaacaggatgtagggttattacctgataattcaggggcctgaacctgtataaaaatccctgtctccatctcttttacctcaatctcgtatataccctggtaccgacgatccccataccatgcaaatatcagaatcgcgacatcaaacgtcgacacacgcttttttccttccgtacatgcggcagatttgttgcgtcgaaaaaataggaacgtttttcatagagcttgcttcgttgtgaaaaaatggaaaacgcgttgcaaaaaaaaggtaaatgcgtctgtgtagaggccagaaaacgagcgcgacttaacctctatgcgctaattaggattcgcgggagtatatatcaccaacttcacatccatgaataatttcagaaatccttatatttgaaatctttatatttttttatgggaacggacaaataccgtgcaaaaatggaacgttaggaaactaatcaccttttctaaaaaaaaaaggtaaaagaagaaaactaatcaccttaggaaacagttctggcaagtgggccctagctgccaggcgatgcaatgcacagctagtactactcgcgagtcaccatccatctcatctcgtcggcgagtgagcttccttcgcgcgggctgaggtgaaaaggtggagagggtttcccgcgtctcgcgacgagggtttaggcccagccaccgccgccgccgccgcggtgccagagccagctcgccgcgggcaacaggtatgcatgtccggcgcgcccctcccctcctcccccctgccccccattctctctctttccctctgcgtgtgcgcgtgctcgtgcttccttcgcgatggcggtcggatgcggaggcgttgcgaggggggaagcgcacgagacgttcacaggtttcctggactggttaccccgtcggcgaggagtgatttccccccattgagattaggttttttttttattttgacgcgtgcattttgaggcatggtgattggggggaaatattgcatccgatgcattttattggtgggagtgccaattttggtggcaaaatgaaaaatcaagtgatctatgggaggttgttgttgatctcctatattatttttagatattttttaggcgaccttctggtaggttttctttttctttttttaacaaaatctttcgttggtgtagagaggaacttggagcttcaatgggggaacctagtgttgcacggtatgtacattttcctgggattttctaatatcgagcaaaaaaggagcatttgcatactcaccttgtaaactgtttatgacatctttgtaacagttccaaagactgtgatatggagtatgatgatagttcttctagacaaagtggcgagcctttgtgggaacatgcggaaggtgtggaacgatctgtcgattattcagatggcttgccccctacaagcaagggtatgtttcagtcaaataaaagaaagagcaaagctgcagatgaggatcttcatatgaaacttcgaactcgattggatgctgaagttgctagaatgttctattcttcaggttaataccttaaacatgaaatcttcgtgttcatgttgtatggaatgccattgaacgcatgtttcaattttcaggattatccttaaaggccgcgacggacccattctttaagagcgcattctctcgtgccacctccatgcctggtttcacggctgaagaggatgagcatcaagatgaccagccttccctagttacacaaatgttcttttccataggttaacatctcaaacttgaaggtctttcagtttgtatgtatggattgtcctttagtatcattcatatttgcaggtttgtcccccactattacaaggaacccatattatcggggttcattcgctatggtcgcgttgttccagattcctggatatgttcctcctggggtcgaccagctgaagacaactctcttgcagaaagaaagggctgacattgaaaacatgctgcagaccataaaaaacacgtggaggaaagcaggtgtgacgattgtttctgatgggtggtcagattttaaaaggcgacctatcatcaatatcatagctgtcaatgaagctgggccagtttttttgcaagcaattaacaatgaagatgggtggatgtggatgatggatgactacattgcagagaagctcattgctgcaattgaagacgttggatcagaaaatgttgtccaagtgatcacagacaatgatcctttttgcagagctgctggggtgctgattgaacagaagtacagtcacatccaatggacgccaagtgttgctcattctttaagtcttgccttggagaatatttgtgctgctaagaatgccgaaaatgttgtcttcaaagactgccactggatttcagaagttataggggatgcaaaaatgataaatgattttataagtaatcattctatggtactatccatgatcagcgagttcagtaagctgaagatacttggcattgctcacacaagatttgcttcagatattgtcatgctaaagaggtttcggtttgactaagcaatctcttatagggattgtcatcagtgacaagtggtccgtttacagtaaagatgacgaggggaaagcaaagcttgtgatgaaaaaaacttactgatgaattgtggtgggatcaagttgattacattcttgctttcacagaaccgatatattcaatgatacgcatcacggacactgaaaagcaatgcattcatttgatctatggaatgtggaatgatatgacagagaaggtaaaggctattatttataaacatgaaggcaagggggctgatgaagaatcaactttttactctgctgtaaatggcatttagtagattggtggggcaagaccagaactccactccactgtttagcacatgcactaaatccaagatgagtcctggtttaagttactaaatgatttcttttttaagccatgtaatatcactatcttttggtctgttctgtaggtgttacgccgatagttggattgatgaaggcgctaatcgtcaacccccacatagtgatgctgagattaatgaaatggcaaatgactgcttgaagaaattatttcctgctgcagatgacttgacggcgattaaagcagagtatgcaaagttttctcttttgagcacggagtttgcttcctcaggtacaggatgctttaacttgaattccatcactgatagggatgttcttgacccaaaaacatggtgggtgacccatggcagtccaacacctaagttgcaggagctagccctcacgattcttggccatcctgcctcggcatcctgctgtgagagaaactggaccacatataaattgattcgcgcagccatgaagattgagagccgtcctaaatgggttgatgatttggtgtttgtccacaccagtttgcggctttggacaagaaccacagttttactatagtgatccagagtcaatgttttgggacattgggggtaacgccgatattcttgcaagcttagtccctgctgatttacttgagtttgctgacttctcactcgacgaacctgagttcgagcttgccattcttgaagggctggaaggtgatgatttggcatgaagatggaggtggattggtggaagactttctagaatcctagctcaatctgtgaatggcctgatgccacctttcctatcaggctgtcactcgggtctaccttgtcttttggggaaagtggtgtgttttggttatgtacttatgtggccactctggtagtatgcaaaactttgcagtatgcaatgctactacctccgtcccaaaatataaccacttttagctacgaatctggacacggttgtctagattcatagctaaaaatgcttacattttgagacggagggagtatatagtagtggtagtgatggactggtggtagactggaagtatgcatgcaaagctatgcaatggcaggtagtggtaatggtattatgcaaagctatgtgataagactttgctattatatatgcaaatctgtggaaactggacggtttgctttttatgctcgtgtcattgtgtggaggtcattttgagtgcattcttcacctcttccaaaacatgtttggattcacctgaccggtgtatagatgtggtagggtgctggtctttatgttctttattttggtttttgcgtggtccatgtgtgcattttggagtacgtgaaatgtgacacggtgtggattgaacagccaggggctgttcgagggacgagtggatccttttctcccttgcatccattcttgctggtggtgttcgaatctttctctcgctccatttacctttgcatccatttttgtttgtagtgtttaaaattctagttcttatttttcagttgtttggaggcattggttggtggtttggtgacggcttcgttgtaggcctggtggcatatggtctcgtatatcggtggtcagtgcagtgtgttagcccattggtgtaagagtcatcgacatgtggtggtgaatttgcttttctttttctaattatagccttcagggtgtgtagcattgtattttttttcctgatatatctatatgaaacatctccctgattggtggtgtttgtttgaaaagaaagtttatgtggtgctatggtagcatgtagcatcacgtttatgtctatggtggtaaaattaacatgcaaatctatgtgagtactttggtttggttataaggagtaccaataacacatttgatagttttgaggggacgaaaaactcagtataactataaattcattacgtgtttgaaggtgtgtgctcaataactatggtgtagtactactactacactataattaagtacacggttgatttttttttcaatctttgtttgcacgaactcaaagcggattcaatgatccagaaatcaagagtttttcctctaaaaactgtcacgagttttttttaaggaattccgcgtgcaatgcattttgggcttgtttactttgatgctattttcaaccatatcatttttaagtaaagttgctaaaaaaatgtctacatttagtttgttgccaaatttaatcaatatataagaaatcctattaaaattttaataatattatcatcttactaaaattaacgcttgggtagccctcactcccgtggatttgccaccgtttaaccgcgccctctttgaacgcgggagcttggactttgacccggtcagctaatcctagcaccaagcaaaaacgacgacttggtcagctggtcctcgtaatgtgaagttgtgaaccgccccacccaaatttcccccaaatcgacgacgacgacgcccccaattgctcgtcggcacaagcaacaaccgccgccgcgccaagctaaccctagcccacgagatgcccgcgcccgcgcccgcggcgccgtggcccgtgtcgcaggagatctcgtccctggccgaccgcctcctcgcccacgccggcggcgacggcgacggcgccgcggggatgcgggacctcgcgggcgcgctcctccggatccagcccgtcgcgcgcggggtcgagcggcgcggggacgcggggcagcgcgacctcgcggactggctcctccagctcaagggcgccgtcgccgaggccgacgacctcctcgacgagctcctcctccgccgccgccacgggagccggctcagcccttcgttagcgtcctgcttagctcgcggcaagccgccctcccgggagctcaagcgactggtgggcaggatcgaccgcatccacgacgtctccgagcgtctcgttgacgccgcggcggaagaagaagccggcgaggcgggtcgcggcgtgaggtcgccgaaccgcgtgaccggctccgtgctcacggagaggaaggtgtttgggcgtgagaaagagtgtggcgaggtaatcagcaggctggtggattgtccggagaatgcatgctcttctgctcttccggttgttgcaatcgtcggacatggtggaatggggaagacaaccgttgcgcagttcgtttacaacgatgagaggattgaacagaaatttgatatcaaagcctgggtctgtgtctgggatagatctgatgccgcagagctaacaagggagatattgcagtccattggtggtccggatgatacgctgtacggtgataattctgccaaattggatattctgcaggcaaaacttgaagtattggtcaggtcaaagaggtttctactagttcttgatgatgtttggaatgatgaggctaagatggagctggagaataaggatctgtggagaaaggtgctggcacctcttaggtctgccgggagaggcagcaagatcttggtgaccactcgaatgaaactagtagcgcggtatctcaattcgactcatgttgtctcccttgatgtgttgggaagcagcgactgctggttgttgttaaaggaggctgctctgggtggagaaagcaaggatattcctcctgatttgcaagagattggaagaaccattgctgcaaaggcaaagggctcccctttagtttccaaggctcttggacagatgcttagaaacaccacgagtacatggaggtggagagcacttttggatgcagaaattagtcataacatcattatatcgtctct

SEQ ID NO: 81765 - DNA, 3708 bp, Oryza sativa
ctaagatctgatcctaatggccatttaacaattgtgtgaattagtgattattacagcagaagtgtgtgatcattgagtatgtttattaaaattctttgaagtggtggaatttttttacactgccaccacatgtttgtcactgttgttggtatagaaagtacaaattttcattctatgtgatatcaactgtttattttcaagcccattctttggtttgtcaaggtgggaaattcaagtaaaggcttgttttgataacctcttgtgcaggatttattttcaatttgttcaaggctgttggtattgcacggaggaaattcattacctactttttttttaaccttgcaatgtcatattgataacccatgtatccccgcaaaaaaaatattgataacccatgtaatcatgtcatcaactcatgtgatatttggagtgccttggagtgtattggctttgaaagctttgctatcctgtatttcccatggttattcatcaacagacgattgcacattgttgctttctactctgctagtggagggtatgttaattaagtccattgttggtggatgattatttgatttttgaccatgttaatggattaaactaagatcaacatgctatctgtagatatatatatctgacttcatatggaaattcgattgtatattaaacaatgttatgaactccaaaataatttgcatattgagaactgcacaagctcaagggaactttagtctggtctattatagaaaaatggcaaaaactgaggtgattaaaatgagaggtatgagagaaaatagaagagtaatacaatttttaagtaaacaatgcaacggaaagtaaacggttgatgtaaatctccgaacaaacgaatacagtagacatgtgagttcgaatagtttgctctatggttagcagtttccttttttttatatatatatttggagacatgtcgcaaatcagagtaaaaaaacagatttgctaaaaatatgtcgccagtttttgtcaaaaaatagtcgattttgtgacagtacgatttacatcgagattcgtgctagtgcaaagtgtcgtgacggagggttgaacccagaacttcgaagtcggcagacagagctcctaacaaccgagcacggtattggcattcactttattgccaaaacaaattaatattgaattttgaagtacttatacactaattaccccccacattcacttacacggcacttacgctataattacatatgtatttattcacttacacagcacttgcatatcacttacactataattacatatgtaatttagggacttacaatgtaaatacatgctgactattttttaatgaaaaatatggttccataaatatagctactcccgttaaaaaacacacaaagtaaaattatcacaacataatccaaacacagccatgcgctttccaggtgccactggatcgcaatgcttgcgatatacatgtttgagcctagatattattattattctttctaaaaaaaacttggacaacagttgatagtgtgatggcgcaaaaaagaaagtaaaatcatttacatgcacctagcaacaccaaggtatacttgcccacttggttggttgagaattgcgtatgccaaaggtctagagtttaactccctccataataagcaacacttttttaccatatatttgttcactgtttcagcattcataacattgtgttacttttgttcactgtttcagcattcataacattgtgttactacaggcgacagcaacatatatgtaggtgttactatacagttcaagtataacataactcgtatgttttataacacacagcttgtgttgctattgaactatcttgtaacatatgtcttaaagtgttacaaatttatattgaactatcttgtaacatatgtcttaaagtgttacaaattatgttacaatatgtaagttctgtaaaatgggtgcacgatgtcattccagaaacaccttatgccataactgaaaatttcatgaacaaattattcaatgagtataataaagattacattacccatggtgagtttgaattattcaatgagtataataaagattacattacccatggtaagtttaatatagattacattatcatggtgatgatccttgtctgctctcagatggtactgatacatatgcccttgttaactaatatatagtcatatttcctccaaaagtatatatagtccgatcataaatggtatggacattatcatgccgaaaaccaccctttaacaacaaaaatgacaaaagataacaattttaagacatattattgatttggttataaataattaactctgataattaaatctaccagtagaaacttacgccgtacttaggacgtctgcatgcaatccatattccaaatataaaggatgaaataaactgaggtattgcagcatacactcatttcatgagaaaaataaaaaatatgaagaaaaagttaaacaattgatcacaatatatcttgttttcaaaaagaaaacagtgacaaaaaaataactgattataattaaaaagatcaatgaattaattaattacactcatttagtttttaaacttcataacacttgcaaatttcactcgtaaactagtagcagttaattgtgtgtacttgtatgatggctactcggaggacatcaccacggatggcaacgacggcggatcctatggccatggcagcgggcccgattatgaacttcagaaaaaggcccagaagtgtaagtcttggtccacactacataatcctttcttgctggcccatgaataatccttaggaaaaatgaaagaaaagaataagctggtttagtacttttaatgtaaacgtgcattttttttcttgacatactgtggacagagatatattatagcccttacatacatatagactaaatgacatactgctatatgtttagaagtgcatgtgtgcaaacctacccatactgaacatagccagccccagccctgatcttgacattatttgcaccgacccctccaaagctggtggcaaagtgaggtgcgacctgctataatattaggcacagatgtatatattagtacatatagattaattatatttatgagcatgtacgtacggggatacttattactcgtttacctattggagatgcaagcccaggagatgccgattacactggcgtgtagattgggattacaggctaacttgcgtgccaccgacttgaagagcggtaacctagcaccattcacccctgccactgtcactgcctcctcccccttgagatcttggttcgtggcatctgaaaccccctcttcgaggctttgcatatcttcgctggtacccgagccaccgacaaccgtatcatcatctatgaaggacccttcttcatgtctgttagactcgtcatgagcgtcggagacgaaagctttccttacttccaggaccaccacgagtgaggtgagccacactattgcctggaagattgatagttgtaccacaatttgccctgcccagttgccatacatggccctcgccatgggcatgcccacaaccaaagaattggtgagtgacgcaagagaaaagccgcttatacaccagtcggtgacagcggcgcataatccctctttccggaatttcaacataacaccaatgctgattgcggcgactataattaactttgctatgctatcagc

SEQ ID NO: 81766 - DNA, 745 bp, Oryza sativa
tacgtatgattgttcaaattttatgatactgtaggaatctaaccttgttactatgattcagtaatattatcatagatgggtagtaacatgctatgttactttaaaatttataggtcgttactgcacttttggtaatagcacataataaatattgcaataacagagaaaatgtaataataccagtgatgctataatagtaatgcttgtgcagatatagaaactttaaagtcccaatcttcaaagagcaatatttcttacataatatcttatttttctaatccatttgcaccataatgttcataaaaaaatatttaatgaaactagatctatcgtgactatattttgacgtcattactacgaaaagcacatgtgttactgcatactgaccgtcacgttactacgtaatttctacatgatgagggcaacaaagaggttaaattgggttgagccagtaagttcgagctctgcaatctatttttcctatatagttggttcccactacaagaataactcctataaagctgtctccaggttaagccacgttatcatcaccttacagccgttggatcaagtgccatctttgttcgattcatagacctgatagaaactcaaccagtccaaagtccacccagacacgatgaggaattgctagcgttggatcagcttgcagtgagttagaaaaatggagcgttttctgtgcgtcaaatttaggaaactgattaaggtgactgaggagcccatctta

SEQ ID NO: 81767 - DNA, 1291 bp, Oryza sativa
gtgcttggataaagtgtttagtgtgttccttttgttagggacatattaaacatgagtatgagttaaagatatttgagatgttgtggatctttagccatttttgtcaagtctcctgattgtgtaacacatctggtcgccaccttcgagtggtttgacgggcacatctcaggctgaagttgactggcaggctaaaggcccggcaatgtctcacatatttttctctcggagcgtcgaatgtcttaatatgtttgatggaagaattgtgattagctattcatccttcaaatatactaaggggttcggagtgcttccgacaaaaatatacttgttctttttgtggcaaagatggatatattgttggtttttgtttcagattagctcataaacagaaaaaggagagagaggttgcttttgcaaaatcaaagtggcaaaaatctggttttccctcgaggaaaccggtcagaccgtagtgggtcccgtggtcagactggcaaccggtcaaaccggctgcagagtctcgatcagactggacaccggtcagaccaacggtgaagcggcggtcagaccggcccccggtcagaccggctggacacccacggtcagactggcctcggagagatttttcgaaaaattattaaactgtttttgcacgtggatatatgcctattggatcttctggtcgtgtgtctcagtactggattcctaaatttttattatcatctaaccccagtactgaggcttcgacatatgcttgtgtgtaggctttggtggcaaggaaggagaacgtgtggatcgtggattccggttcttcgcgacacatgaccggtgataaaaattggttctcctctctcagaaaggcatccaagactgaatcaattatctttggtgatgtttctacaagtgccgttctcgctacaggtttggttaaggtaaatgagaaatttgaattgaagaatgtagctttggttgaggacttaaagtacaatttgctttcggtttcacaaattgttgatgaagattttgaggttcactttaagaaaactggaagtaaagtttttgattcttgtggtgattctgtgttgagtatttctcgctatggaagagtgtttaaagctgattttgaaaatcctgtttcacctgtgataacatgtttggttgctaagtttgataaagatgtgatgttttggcatcatagacttggacatgttggttttgatcatctcactaggttaagtggtttggatcttgttcatgggttgcctaaacttaagaaagatcttgatttggtttg

SEQ ID NO: 81768 - DNA, 21230 bp, Oryza sativa
tattggaccagagtgaatctcttcattgtaacaacactactactatgaactactagtctactacgttctaccgtggatgtatacgagtttgctcatcggtttcgctcgctgttggtgattgtcttcttcttcttcttcttcgtggtacgtagtacggcgtacacactgttgatgatggtggtggtgtcgccatctggtgggacgtacacgccttgttctcttgttgattattagtgcaactccgtgatctggtatagtaggaggctagctttaattttgctagggcgatatctcaaattgatcgcgcccgtagctttgtcgcgatcaaggaatcgatcgatcgatcgtgtctagattttctgttttgttttgttattatcatctttcttgtttaattggttgggtgctgtagcgtggagtggtctgtaagctgcatatattgcctgtgaatgcaatgtgtgtacgtatttgccagcgggtctgatattctcgatcgatttgtttcgatcacctcgtacagtggtatgtactttcgttcatctagaatatgagatgctgcgttacaaggacgcgatgtgtgcgtcagtcaatttgcttactatacacatggaaaattgactgacgcaaattgactaacgcaaattgaaaataatggcgtttttattcttgtttgtccatcatatatactatacacattcagacgaaatgtttgtacagagtttggctcaagcttgtacatactgtttttcatttgcatgttgtttccatatactaccataagcaaaacacgtatttggtatatacgggcaggtcctgggtgctcacgtttataaatatgtgatatagtacaattgagaaattttatgagattagtggatttgttcatggacattgtctgttgagaccttgagggtgttagttaaggccttaaggggacatggctcatgtcactagctaatgtgtatacatgtggcatgtgtgtttatgtgggttccatgtgtttgccaaaacagtgttctcattggcattttatgtctggacaaaagcaaccaccaagaatgtaccatcacctggacatgcatggaaagtggcccttgatgatgtgcttgagatggaaactaatgagcggtaacacaggtcgaaagcgcacaaaccgtcatagatatcaaactagagtagatgaaaaggtaccaaagcaaacgtcataagagcagtcgaggagtggcggatgacatcggtcaaataggagataggcaaaattttctacaggacatgtaaaaaacgtgtaattggctaagaggcaccgtaaaaacgtgacacggctgattgacactctaaaaattgtgtaattggctataggacaccggagacaatattttatattttccagatcaaaagaggtgataatatttttcaaatggcgagattgtccctgccatggagcaccgccgccgccaattcatcggatcggattgcctccgcacctacctcgctctctagcctcctcctcctcggcagccgtcgaaaggtccacggccagaggggagtcgcgctggaaagcctgcatatgtagtacttggttgtagtgtaggataaaaagaagaagaaaagaagccaacaaggaaaagaactcacgaatccccatccgctctttgtgaactcctgccccactgtcctgaactggcagttgatggagaggaagagctccacgtatggcagctcgtcgacgatggccgccacgacgccgctctgcaggctggaggagtagtcggtgatggcgagctcccggaggcgggactcaggcacgcccagctcctgcatgaggtagctcttggcgaaggagccgacctggaagccgatggggtcagagctggcgatgaggccgtccagaccctggatgtccgtggacagctactgcaccatgaggatggaggtgaggctggccgttggtcgtcaccgtcgatgttggtcctcactgaacgaggagatcccggcgctgctcgtcgccatggcgttggtcctcgctgaatgaggagatcccggcgttggtcctcgccgtcgccggcagtgataccccggcggagcgccgccgctttttccgccgcgtaccgagccgtcccagctcaggctgctgttcctctgctccgccgcgtgcgtgaggaagaaggaggataggagagagatgtgggccccacttatggttagtaaatagtaatcaccctactaattaggaacaaattagtccatgacgcgtggggcctgatggttaaaaacctattaaaaattagattaaacatacactgtccatgacacatgggacccaccggtgtttaaagaaggaaagagaaggggcaagtcaggcatttagaaaaatatctcacctcttttgacctggaaataataaaaaaaatgtgaccggtgtcctacagccaattacatgtttttttactgtccatcagccgtgtcatgttttcacggtgtctcttagccaattacacgttttttttgcatgtcctgtggcaaattttgcctaggagatatggtgcgtcatgagggaggatgttaattacttgcaggcaacaattgtgaagtatcacaaggggagacagggcaaacgaagggagagaagggaaaatgaggattcgggtgagtggagggaaaaaagttgcgcatggtaatgagtggggttagtttttcttgctaggtcctctctatggaattgttttttttttcaattttagcattgtgttgtaagatttggaattttgttatcttcgcccattaattaaaaactcatggccttcttttgaaaatgaaggaatactaatggatttgtactagctagaggaaattgagctagcatcctatcaaaaccctagaaaatgtttacattgcaaatgagtcctaaaggggtttctaggaaaaaaaagaattaataaatggatcctcccccaagatttttgagattttagataccagctagtactagtattaattaactcgtggcagcaaattcaagctaggagtggataattttgccatatagctctcttttttaatttcaactgaacctgtcggttcaaacaacgccaggttttgctagagctaacgctatgcgtttgggatggggccaattttatcaccatctcttcgtctacatctggaaaacaataacctcccaaccctgtatcggtcaagcttctactgttgctatgtgttctttcctgtgcaagcatccgaacctcccctgcagaaaggctgtgagagacatgtccagttgtttgtttgccctagaaaagggaaaaaagggagcaatggggtattgtagctggagatacttccaaaaacaaagatgtttccttgcccaaacatttatatactcctatcctacaattggatggagctgtgacctacctgtgcattgcatgtactgtaaaagaaacaagagagagagagagagggaaacaaagcacagagatgagtagtatgtgtgtgtcactgtgtgtaagtgagagagaacaaatagcttggggatcttcttttcacgaggagaggatatgtgtgtagatggagatcaactttttgggcgcacttgaaggctcaccacggaatggccgacaaaagtatgtctaggcaaggttgatggatggatggaacatcagatgtacatgcttgctacctgctgctgctgctgcacacacaaataccatgagatgttcatgtcaaatgatgagcttttctcatgcatctcttggattgaaagggaaagatacatgagagggaatcaatggggggacctggaatattattattgccgctagtcaggcatggaggaagttgctcttctgccagagcaggccgggacgacacactgtatgcgattgcctatcttacgagttgtgctgcctggggttccgttcgtttctgcaactcgggcaagcaactccctcgttaattctttgtggatatacttatcaaactattttaaggtacatttcgtaaaataaaactttatatgtaaaagtttcttaaaaagatcaatcaatttctaagtttatataattaatagtcaattaattactcgttaatgattttctttttcatgccatgaaaaatctcacctgagttgttgaaacgaccatgcccttaattctagcttccaatggttacagcttcttatagaatcaccacctcttctaaatgctccatccaatttaaaatataaaccctctgccctataaaatataaaattttatacattaatctggatatagtctatgtatattctcgtataaaagttgatttattttgggatggagagagtaagtatttctatgattcaaattttacatcataatattataaggattcatgcacttattcccaagattcatatcattctattgatgattcctaagacaatgaaatgcttgaaataaaaactaagcaattcaaaattgacaactgaagttatttacatggaatcttttgacctaaccttagtatttgtgtaagaacaattttacggtacttgagaagataccatgaggtactgccttttcaattgtaaatttgatacctcgtgatacctaagtactatgatataccaaattttacactaaatctttggtaccccatggtatctctcaagtacaataaaattgctcatttgtttaaacctaaaaatttttacattttggaaccgagggaagtggtccatatactcatctagactatgtgaatcaatagctataggattcagaatgaacccagctagcagcaagaagttgggaaatctagttttgacatactcccactagctgatgactcaccaagcgatggcggagacaaggggggaatggatggagtcaaagctccctcaaataatttctttttttataataggaccatctaactaattaggtaattataaactgaatagtagggtgttagaccctctccgatattcttgggctccacccatatctaaataatggctagtatatggcgatttctcttttgctaggcccggtgctaaaaaaccaactttcttaattctcataatcgtcggccccttgccaattgattttgacttactccctccgtcttaaaataagtgtagttttacattattcacgttcaacgtttgaccattcgtcttatttgaaaaatttttatgattcgtatttttattgctattagatgataaaacataaataatactttatgtgtaactaaatatttttaattttttcatatttttttcaaataagacagacggtcaaacgttgggtacggatatccacggctacacttattttgaaacggaggtagtacttctcaaaactttcaacccaaaacagggccttagcttcatctagacgacggatcgatagatggagggttggtgtaacgtgcacttcacgggcactgcatgcatatcctcccctttttttttttttttgtcaatcttacccggccctcgttaccacaaactcatgcgtttcatatatgcagtttgcaggtgtaaatagattgcttttcgggcaaaacaacaccgaataccatgggaagctagcttgcgtttgatccggcgtgcgaaagcaggacgagacgagagggggagcagtcgatcggcgcggcgcgcggtagctgctggaggacgggtcacctcaacgggcacgcgtgtgtgagaattttgcaggtgggggagaccggccggaccgggcaggccagcaacgtgacccggactccacgtaccccttgtagtaccatctgccacgcagaaacacacaatcaatgcgacgctctcttgcgttgcgcatgcacacacacgcgcgctggccactggccacagacggagtactgcgttggctgcaagtactgaagtacattggtgtctttttcgcgccctgccaaaatgtgtatcggtagctgcctgaataattcgtggggaggaactttgggagatatggaaattattgccctgctatgcaaagtctaatcaacaccagcagcagcttcagtctttgtcctgaaaagttggatatgccggtgccccaaagtacaacctaccgctaccgctggcctggctggctgaccaggccggccctcccgcgcccagtaattttccttcaacacaaaaaacatctttctttttttttaaagaaaaaacgtagagctggctattttatactcgatctattgcaaaataagcgcaaccataaatttcggtgtccaaccttaatcgtccatcttgtttgaaattttttcatgtttagtatttttatagttattagattataaaacacgaatattactttatgcgtgacttatattttttagttttttttaaaaaaaataaataagacgaacaattaaagttgggacacagaaactcatagttgtgcttgttttgggaataagggaatatatatttttgaaacacattacatacacaaatgcttataaacacgcgcacacagttgaccttgtgaatacatacacatcttttctctatgagcaaccaatatatcttgggattgatgaagtcaccaccaacgtttcgctgtcgacatataccttaaggcttacgaagacactacaagcactccacaatcgatatgtaccttgcgattgatgaaatcatcacgagcaccttgctgttgacatatacatcacctacacctggaaaaattagccataaatgcgggtacccatgctaaatctaagatttcaaccatagtttatatgtttcacgaaatgaaatctaaccagctacgctatgcaaaattcacaggtagaaaatatttttgtaggaacaaaataagcaaaatcaactgcatgtgtaaaacggcaccctaaaattccatggaacactaacatcaatcttaaatatgcaaatcatatattgtgcctctttaacttttcaaactgtttaagttatatcccttgctcgaaccggcctaatttggcctatatgactccaatcattaaaaaagaggatcttttgagaaaataaaaggtgagggcgagtccgacatgtcacttcattagttttctcctctctttcaccttcttcctgatctaaatttttttaagaaggcaaaagctacatcttgtatatatagggggtgtttggaagagaggggctaaaccctaaactcagtacatacgaacccttgaataaataagaattgagaagtatgaaatgtgggcatcataacaaaaaaagaaaaagatcgaaccagtaagactaatgtatacttatttatacctttgagaggtccacttagactattatgattttctctttagctacgtaggttatataagattcaattcaatctaacaagcggactggactaccttcggcggtgcctagcctgtaatgcttgcaaagtcgctaggcggggtgataagatgaaagaaggtagtatgtgcatctcaataggcctaatcgccttaaaactagacccccagggggtctcccggctgaaacaaatatgccctattttccgatacctgattagttggtgtggacaagtaaccctgaatctggactgtcgctctatttgatcctcttatgttggcccttctgcatcatccagcaaggctcggaagtctgagctattaaggtctagttgacgtataagaggccttcgatatgttaagggagagaggggagagtcattttagagttgggtgggaatcgttgatagaaaatttttttccctgaggtatgatagcgtctgaactaaagaaagggaatatggaaagtgaatgtggtaaaggataccaagagccctgaatgatttttaggcgtcttttctttgaacaaataaatctaactctctcaaaaatataagtccatctcctagagacttatatttttgagagaggggctaaagtttagcccctctcttccaaacaccccatagtgagggagtaaacaaaattaaagtatgtacatcgacgtgtgaaagtcctcgcccgacttaaaaaggtcaaagtacgtaatctccccccaaatagaaactcttagaacttggacgctcctactttgacccaagccccagcctcctatttgattttgcaatcacggaggttggggatggcgatgtgtcgaaagattctagtgttctgctcgcataatagcacccaaacgatgagggtctatattctgaattttcgtccaaagattgatgaattgtcacagatggtcctccgtggttatctttaggctgctttcgaacctcaaggttcccaacctctctcactttctttcgcgcgcacggttttcaaactgttaaacggtgtgtttttacaaaaaaaaattacgaaagttgctttaaaaaaatcaaattaatccatttttttaaaaaaaattagctaatacttaattaatcacgcactaatggactgctccgtttttcgtgcggaggggatggattcccaacccatcctatcaaacgcagcctagtgtgttcagatccctgacccaaatgttttggtatagtgcattcgccacagttctgttcttctattttgaggccacaaagatgtcaggtgctacgagttcagagtttggttctttaatcactatggcacgccaaaacttttcacccctggaagtaaatagggccttagttcgcgagacgaaatgttttggtgtgtcacatcggatatacggacacacatttgaagtattaaacgtagactaataccaaacaaattacagattctgcctataaactgcgagacgaatttattaaacctacttaaaccgtcattagcaaatgtttactgtagcaccacattgttaaatcatggagcaattaggcttaaaagattcgtctcgcatttacacgtaatctgtgtaattactcactccagtttcattttaattgacgctttggacaattacacgctctacaaaatatacctttgaccttatttttctattataatatatacaataaataaatacatgtttacttttattatagtgttttgaaagacaaatctatatatgtttttctaaactaaatatttttaaagttattgatggttaaagttataaaagtttaacctcaaccttgtccaaaacgtcaattaatataggaccagagggagtagttttttatctatatttaatactccatgtatgtgtataaacatttaatgtgatagggtgaaaagttctttgagagagtgaaatgtgcgtgttctagccgccgatgtaaatgtggagaccaagagtcaaaactgtaaacaaacagttggagcaactccagtcagcaaagccgcaggagctgaaggatgatgaccgagagagaggctcagaggccgcgaggaaaaagctgacaggaacccacttgggaaggctggcaagaaccgaacgcgacgcagcgcggcgaagtcagcagcttccctccctgctctgctctgcgaccgcggccggtcggaccgacggaagctcgcccgtcgtcgtcggcgagctgtaactaatcgcagtttcttcagagttttctgaatgatgcttatgatacatgtttggaccacctccactgcgtgatgaggaccatgatgacactgcgtgacagccaccgttattagcacgtcaacgactgactgtaagtactacctatgtactgtactactagaaaaaacgtggagattattagggttggttcaaaaatcacaaggaagttgcttgtactctcctggtcctggcgtcctgccgtccttggcgtggagagagacatggcagtacgggtacggcactactcacatcgctagtttcaatttgggccagatctcttcccctgcatcactactacgtcgtccagtgtagtttgggccgtttgtatttggcccattacccccaagccacaacctgaaaagaggcagcaattctcagcgggaatgtctgtgtgtgcgtgtggagtgcgagctccattagcacaagatgccaatcccgtcgcctcatcacgccatggcggcgagcccagctctcgcaccaacccgcacggtgccggtactgccgccgcgcgggccgtctcgccaccggaacgccgcggcaccgccgtgtcggcctgcgacggcgcggatcggcgcgtctccaggcgacggcgcggccgcggcagcagcggctgcggtggagcagggcagtcggagcgaggagaaggataggaagcgatgcctgcggtgcgggagcctgtatctcgacgaggacaactcccccaccgactgcgccttccacggccacgtcacaggtagccaacctcgcgataaatatcttcttctttctccggttcgtggctatcttgggctagtgtagtgtgaagtgtgtcgacattttggatagacgcccacaacattttaacacttataagcatcttcaaatgattagatcgacgtattttgaaattaacgaaatgaccttatataaatatacattatatagcactgaaataataattagctgtaaatataagtatctattatattattaaaacagttttgaaaggaggcaccacgtttgccgtgggggttagaaatttccacattaatcggagaaaaaagaagaaaacgaaaagtagagtccaagtagaaatacaatttaaaaatatctgaaattcggaattaaaaataagcaatattgaaagaagtttccaaataagaacccaatatgagattaataaaaaatcacaaatataataatataatatatacaatactcataaattatgagaaagagaaaaaaaaaaagagctcacagagagaagaaatatcacatagtaggagaaaagtaggcatgaaacggcggaaaataaagaaaatacgacatatagtagagaaggaagtccaccatataaagaacccaatacgagattagtcaaaattcaaaataaaaacaaaaattagaaaagaaaaggataatccaagtaggaatgcaatttaaaaatagctaaaatacggaattaaaaataaggaatattaaaagaagagttcatataagaactcaaaacgagattaattaaaattcggaattaaaataaaaataaaatctgaaattagaaaaaaaaagagttcaagtagaaatacaatttaaaattagctgaaattcggaattaaaaataagcaatattgaaagaaggatgatataagaacccaatacgacattaattaaaattcagaataaaaaataaaataatatccaaaattagaaaaactaacagagagttcggaatacaattttgaaacaactaaaattgaaaataaaaaataagaatattaaaataacacaatatggtattaattaaaatttggaaaaaataaattctcaaattagaaaaagaaaaataagatttcaattatgaatacagtttataaataactaaaatttgggataaaataaagactattgaaagaaaaaaccatctaaaacacatgacaagataaattaagtaacagacctataaaagagtagagtggtgacgattgatacgacatataaaaactgttaataaaacaccaaatataatcctaatgatgattaaaaggagggacgacatgtaggccgtgaagcaaacgagcaaggcgattgccgggacttctagaaagtaaaaaaaataaaccccattgataataatattcgatttttaaaatctcaatgacaataaaaaggagaagcagcgggcggggtgtataggagtatagttgtagagccaccgacggttgacaagacttctagaaaataaaaaatgaattccaacgatagttatgttcgaattttagaatcacaatgacaataaatagtaggcggcggacgggccgtagaggagcatagtgacatcgtttgatgggacttctaaaaattataaaaaatgaaacccaaccagataataaactctaaaaactataaggtccaatttttaaaggttcggaacttcttaaaaagtaaaaaaaaaccaatgataatcatgtttgattttaaaatctcaatgacaaaaaaaaagggaggcagcggccgagtggtagaggagtaaaatagcaaagccgctgatggtttggcgggacttctagaaagtaaaaatgaacccaaacgataattatgttcgatttttaaaatctcaatggcaataaagagaagacagtggacgggccgtagaggagtataatggcaacgtttgacgggacatctagaaattataaaaacgaaacccaaaatgacaataaactctaaaaaaatataagatccaatttttaaaggttccaaggagaatgaatagaaattgtggtagatcggacaagcaaataaagaaggagatgacataagaagtagcaactagtgtgacttttaaaaattatataattagaaacacggagatgataaagtttgatctttcaaaatcttaagacaatgagatagctatttaataaattttaagtaaaatcatacttaaaaaaatatatgattttgtttgggtgctagccgcgcaattgcacggaccacccagctagttactgttaaataagacttgaatctatcttttgacgggtttgcaggggagaaggggttgttctcgctgtcgccgccgcaccaggggatcgacggcgaatggagcgacaagagcggggtgatcgtgtacaggtggaacgacagggggagtcgcccaaacaccgggagagacaactggaaggggaggtggagctgctgccaggagcgcgacgagggcgcgccgccctgccgccgcggacgccacgtctcctacgacgacggtttcaccctctactagacgcactctctcttaagtacagcgacggtttcaccctctactagacgcactctctacagcgagaatgtgagaggaagtccccaaaaagcattcgcaatgttgattctgtacgtcagtgtcagatcagtagtgcggagtgtggtaatcaaatgaattgcagctctaaatcacacatgcatccatgatgctaacaatggaatcctctatgtccagataagccaatgtctcgaaactaaccgctgcttccagtaacagtggaagggcaggggaaaaacactcctccagtttgcaatccatcatacgcaggggaaaacataccagctcacacttttaagtagcattatgctgtttatctaaccacgaatgcttccagtaaactgtctttaggggatgataaatagacttcataatcgcaaacagaaacaatatgtaggataagataccatgctccattacatcctaaataacccaccattacaaaattcagtctctcagaaaattgcaactcagaggatgatcagacacgggagacaagaaacagcacttcatgatactaggtgaagataggagtttacgcatcctctgtgatggtacccttgtcgctcacgtagataccatccaagaacttcctgatatccttgttcttcacgtggcatttctgtttacaagcaaagggaattttgatcaacaacacaacaagggcacaaacaaatcaacaagagcaaaacacacgataattgataaaatatcttgtttcactgaaagcatggaaaaaagagtgctcgacgaaccgaaaaatagaagataaatcacattggcaaaaaggtttgatgtataatcatggtgttgtgcagacgccaaattcaaatagggatcagacagtggataacaaactgtaccctgagcaccgacaccactcatggtttccaaaccaagaacttagcaatgccaattagcccaactacaaaagggatcttggttgttcaagaaatggatttgttcgtcacaaatgtgttaacgtaacttcagtactgacataacagacagatggtgaaatggttattaaaacctaagtagagcactgtaaataatgacattcacaactgccaatgatcaaactaaggacatagaacatcatgccgccttagcagtttcaacatataaccttaagcagcaaacaacagaaacaagcaggcaggcatgacttgttaaacaattacaaacctagatatatcattggagcaaagagaactaattcctacaaccatggcaacatgagtacataacacatgcaaagatcaggactaattaggttatattgcatcatatcagtattagaagaccaggaaatctccaatctatagggagaagaaacgggatcgtatcattcacctggttgatgagggctgctgagcgagagacgagctcgatgtcgttgccgtcgaggacgagctcgtccttcaccttctccgaccgcaagatggtcaccccctcgagcatgtcaaccttcctcacctgaaacacaaagcatacagaaagacgcatcagatttgagagatctgtgggggagatctaggatgatccacgaacagcgggcaaatggaagtgatccaaaggtgggtttcttaccttcttctcgcccaagaagttcctgatctcgatggcggtgttggagttggtgatggaggcgttgatggggaagtgagcgtagacgaagcgcatcttgtagcggtagcccttggtgacgccggtgatgaggttctggacgtgggagatggcggtgcggatggcggccatggtgcggcgggtgccgaaccacgcgtccacctgcagcttgcggccgccctccagcagctggaagtcgaggttgaggtgcttgaagttgcgggtcagcttcccgcgggggccctccaccgtcaccaccttcgcggcgacctgcaccgtcaccccctccgggatctccatcgtctcggacgccaggatggtcttcatcttcgccggcttcctcttgccccttcctcggcggcggcggcggggtagaggggagggtttgggtgcttgctcgagagaagggcggcggcgcggggaggagtgggcttttaatatagtcgacgatggcgcaggttagggttttgatcttcgccgttggatcgagacattaggtcgcgaggtgatgactcactgggctgctggccttaggccggccccaattcatgaattcttaggcccactaagaagtatgtcaaaatttggcccatctgtagatgcgctgggctgcaggtctggtagctttgcagtccaagcaaattgagcccaaaataatgggtttaattccccgtggaactcgaatattcctctcttcctccggagtccggagtccacacacactcatattcccattatttcgctgcagttgctgtcgaaatcgctctcgctagcctcgctcgatctcggcgcgacgcgacgcgcgcgcgcacaggcaagcggcggccggccggccggcatggtggtctcgtacacgcaggagcacgtgtaccgccacccgtggcaccgggtgaccgcggcggcgtggcgcaagttcacggacgcggacgcgcgggcggcgccgctgtcgcacatcctcgaggtgcacacgctgtcccgccgcgtcgacgctggatcggggcgcatcgacgccgtgcgcgccatcgcggggcgggcgccgccgctcccgctcctcctccgcggcctcgtcgccgccgccgacgtggtgctctgcgtcgagcacaccaccgtggacgggcccgcacgggccatgcgggtgatctcccgcaacgccaacctccgggcgctggtgcacgtcgaggagacctgcagctaccgcccgcacccggagcggcccgacgagtggacgctgttccggcaggagacgagcattcggtgcgcgccgctcgctgccgtggcggcctgggcggccgagatggtggagcggcggtgcgcggagaggttcaggcagaacgcgtcccaggggagggaggtcgtcgagacgatctgtgaacgcctcgcgcttgcagatcactgactgctcggtctagacgaagaacattctcaaacttcaattctgcttcggcatcgaaagggaaaggatttgtctagagattgccagttgcagatttgcagcattttcgaatgaaaaaatgtcgtttcttgatgttgcgaacactgtaaattgtaacgaagttttacatctgcgggattccacgcgtgggagcgccgctctgtcccgagatgtttctctaaattttctgcgtttggaacggcatcgaatgcgccgacctgtcaacctgtgaagtgagacacgatcgcctgagagctccggacgttgacacgatcacctgagtcctgaggctgaggtgagaagagcgcggcctgtgccagaaaactccaggcgtggacacgatcacacgacgaatatgcggacggaaatcgaacaacagagcagacgtcgtcgtctgaacaggtattgctgaaatctttccaggggctctgcctgtttcgttatgccgtggggtcgcggtgggccaaataaagatccatatttgtgcacgagaaaagctgccataatagcccacgaaattcggcttgccctaagcctgtaagcctaattcagcccataaatatcgacagattgaacagcccatcatgataccacccatttcacgttcggaaaagtacaccgaaggtccctcaacttgctaccgagataaaaaacgtcctcgaaccgcaaaaccagatatcaaggttccttaacttaccaaaaccggttacaataactcattcggtggttttgagcccgtttttatcctacgtggcagctgagtcagcatgtaccccacgtgtcagactgccacgtcacatctcttccttggtgtactttttccttcacggggaggagtcaaggggggttccacttcctttttctgttctttcttgttttattttgtctctttctctctgtttcttcacttcgccgttctctctctctgcctttttttttcctcctcacgcgtcacacgcgcgcagcagaggaagggcgccagcgacgcaggtgatgggcggcggcggtggggaagaggggccggcagcgtggaagggggagagcttggcggcaaggagagggagcctggtggcggcgcggttgcacgcaggaggagagaggctgcgaggcgcggcggcttggcagcgcggccgggagacggcgcagaggggaggaatcgaggtggcgccaggcggaggagggagggaagggagtggcgccgggaggagaaggacggggcgccaattggagggggcgccagcggcggcatcggctccgattgggtgatggccggctattaacgacccaggcctcgtgtttttcatcaacaccggcgcatcgccgcggcgcggcggtcggcgcctgagggaaaaggggtggctactcggcggtgcccgtctaggtgcgacgacattttggggtggatgaagacaagtagacgacgacgatggcggctttagtggcgaaggcggaggtggttgcgggcgcgcgcgggggcggggaagcagctgcacgggggacggccggcgagcgcaagcggcgggggaggagcagcgtgtaggcggcgtgcagcggagcggcgcgcgggcgggcggcggcggcaggggaagcagcagcccgggcggtgccgctccactgccttctccatccttctccgccggcagggagaacagctcgccgccgccggcgagttcgaggacgaagtcgaccgctactggccgccctccccagacaagagggagagaggaggaggaagggagcagcgatcctgctcctcgtcaccgtcaggctccctgctggcgtcatgcagtgagtcatgaagcggcggcgcaagagtcgaggccgccgcagggggcggtgtggctacatgagggggcaagaggagggccgccccggaagagtcgctgtcggggagcgccaaggcgattatcgcggccgcatcaatgttcgatatgatggacgacgaggtggcgtcgacgacagcgtgggggcgcggcaaaactgacgcggctgaggcggcgtcggagctggagctcaagatcatgtgctcctggttctacagtagcggcttctagcggagcccctcctccggctccagctcccacgcctcctccctatgtcggaagatgacgacaacgaggctggcgtcctccgcttggctccgccaccccgtcggcttcgggtgccgtcactccgcccgcgcgtctgctcaccgccgccccactccgtcccgccaggcgccagcttcgcgtggcgctggtgactcagcgacgaagaccaaggttaaagcaccacggtggacaaaaccagtgccacgtaggataaaaccgtgtgaaatactgccctgggactacttgtgaccggttttggtaagttaagggaccttcgatatctggttttatggttcgaggacgtttttttatctcggtgacaagttgagggaccttcgatgtactttttcctttcacgttggaccaaaaaaggcagcccagttttcagcgtgtcccctacgcggcccaatctgcaaaacgcgcacgcgggcatcacgacgactctcctggaagccggaaggtgcggtcaaaccggcgtcgtccggaagcggacatcggccccgggagcgagtaaacgaaggttgacggctcgacgcgtgtgcgaccctgaactgtcccgtgctgggctggcgctcgtgctcagtggccgggagacacgcggtggcgagcgtcacacacgtgtgaagcgcagcgtcgccgccgggttcgatcacagccgccgccgttcgacggaggatatcacaccagctgccggccatccacccacaatcgccacgtctaaactccacaaacaattatgtagtaaactcctgaagtgcaaagccactagtagcatcatcctgaactggaactttatgagcgaaaaaggagcacttggcaaaggtgattctagggtcaagggatagcaatccaaagccaatcgaaatatcaagtcggtccgcaaactggaacggacacaccgacgctgacgctctctgttgcccgcaagacggacggtgacgtgttgcggcagtaatatacagtcctgttgatatcttcggttggatgtggttttcctggttgtcgtgcttccggtaaaggattggtacagccagccaaggcggctttcaaaagttatacctgcagctagttttctggtactagctcattgtcctgtcagtcacttgagcggtactcgacctcatccttttgagcaatggtccagcctttcgatgcctttatatcatggatattattccacgccgacttcaattttccagggaacagctaattcaatggaaaccatgaaggattaagcattaagcatcttaggttatttttgagggaccgaattaagctcaattaacatcgaattatgatgtaggtatatataacatgtgttcgtcaacagcccggttcgttcgtagctcatgattagccgaacaattacgtgtatatatatcggcaggacaaatcattggtcgagttggttgccggtcgatcgattgggcggccggccggccggctgccggtcgacccgttgtcggcagcgtgcgcaattaagcttcccctgaatgatcaattgatcatatgatcacgaccatgcatcttccaacctctgcaagttagctccaatgctctatccaaagtacccgacggatcatccatccatccattcctgcttttgctgctacctatccaagggcagagagatatttcgcgcattccggcatattttcctcgctctcctttaccccaattcgattcgatcgggtgaggtgatcgatcaatcgatcggttgccgaattgtcaatgtactcatgtggggaaagtttcggttcgctccgtctctcgcgtggcgtcgcgcgtgctgttccggcgtcttttccgtcctctctggggcaaagggaatccgcttatccggggattctcttcgtgcgctccggttcgcgtgtctcctcgtggttggccgccttgtactttgttaattcaggacgagttaagctcagcgaggccgtgaagtttccctgtaaaatcgggcaacaaactacgccgtgatttcacatgaaaacgccatcagcgcgtggctgcgcggcgcgtatgtacggggcaatgtattgcgtacgtagctggaccaaaaccggtccacgaatcgtccttctccatgtcgacatgcgtacagccgatgcatatatcatatacagagagagaggccgtgatttagtattctcaattctcggattgcaatttggcttttgagtgtgtacgtacgtatgtgtgacagtgacatgggcacggtctacgtagggagggagggggagaaaagaagaagggggggggggggggggaaggccggccggaaggaaaggaatggccatgctaatccagacagctcagcgggcggaaagcgacgcgaggagagctccacggcagcaacagcagaaaggggggatcttttccttaatttttctcatcgcggcgtcaggcagatcggcagaacgagaacgtgcggtgaacgggggcacgccgcgccacgccacgcgacgggtcgagaggccgaggacgacgacgggttccaacttccaattcccagctagaacgagagcttgcttagccgacccgagacggcgatgcggcttgccgatggtttggtttaccgctttgccccggttcttcgctttcccgttttccaccccctcccctcctctttcggtcgagcatatctcctccccgcggggtgggctacttggctacttgcccgggtcccgtgtcctaaaaacacaacatatcttacggggaaaaagaccgttccacccacacgtctccacacgcttagggcctcaccttttcgtttatacttatacttaaaatttaaatttttaatattaaatttaaaactgattttaagtctttttattaaaatttatctttcatcttttatttttagatcgttaagaatacatatataaaaattttatttataaattatttttcgtttgtaaatatgtcatttcgtttattcatgaaataagcggaacgatagctccactgtactactcatccagtacacggtcacaggagccagtgagccacggctacccatctggatccagctcctccactcccagcgccgaactgtggccggcagcgagccatgagtggcggcatgtcacgttccgccgtgacgattctaccgtagtactacgcccgtgggagaggcgaggcgaccgacccaacggccgtgcacgccgtttaccgcttttttggctgcggaatccacccgtgaaaccgagggccgcgttgccgccgcgccaacccccc

SEQ ID NO: 81769 - DNA, 1029 bp, Oryza sativa
ggattaacttcagtgtacgtccaaagcttctgattcagggcatgccacttggttcacttccgcaaccaacaagatatacaatagtaaaatttataagatgatagccgatcggccgatcggccgataggccgatgttgtatcgtatcagttgatgaacaaaataatcagctacaagcatgaaggatactgtacataaattagatttagattgaatataattataaataacttttctttaataaaaccaatcctataggtcaaacccaatcgatgaagcataagattaataaagtttaaagtcggccataatataattatataacctaaattactagccaatggaaagatgcttgtagattagacctaaaatacatgcgatcggttgtagaggtaaatgtcatgcatttactaattctatcattttcttaaatacaagcaattacaatagatcgggccgagacaacattaattgcttataactaagagtacgtaaattaataactatatggatttatatcgtagccgatgaagtaacttaggtgattaaagataacatatcggatgtagctctgatacaaccttatataagagtattgtttcaattaaatctactaacaagtttcaatcccagtagatcggacctagccaagatagtgtgagattagttaaaggctttatagattaaaatgtttgatatacttgtataagatgatagatatagcaaattaagtaaaagacagcgagtaatctaaaataaaaatagttatattaggtatgaccagctgaaagtccaatgctatcgttattggcaatccaagagcaagttaggtcttacaatttcaattacaacgtagtaggtcaaacctaactaatgcaacatcaagttataatggaagtcgtaaggtctaagcaaacctttgattgtttctcagggtggtagatacactaaacaatctaaatcgacgagagcaatttagacgatatcggctatatctaggttgaaccagtcgatatagataaataacattg

SEQ ID NO: 81770 - DNA, 24018 bp, Oryza sativa
gattctttatgcatgccgtcttgatggctcacattaacgcagttactcccagtgtccgttacgcgaaatcatcatcatcattcacttattataatgtgccttcgatccacaaaagctcatgtcattcgtcgttctctaccatccttgtttcatccgagctttcacttctacaaggttgtgtgttctcctacgggatccataggtacgactcaaaatgcttccagttatttcattgttagggtgttgtattcttcttcgcctccttttcatctctttgttttttatatgtacagaacggtatttcgtgatgcgtcacccacagccttcctctagagtgtattttgcagctcctgtcgattttcgatctgcagagataatcccaatatgtagcacttccagcctttttttactgttaagtttatattcagttcaagcaattcccattgtgtgaattcagttcaagcaattcccattgtgtgaatatacttcagttgttatatttggtcttcattattgaatcccgggcttctcagaacatgaacatagactcaattgatcatccagtaactcttaataaagccattggaaaaacaagactttttactgtaggaatgaatactgattcatcttctaattctaagttccctatcagctaggtacttaaaaggagtttctcaattgatgatgctatgccaaatcctatgctgccatttgaaaaggaatatcatctgaacatgctatttattattggctcaatattccaactgagttaatttaggggcaatttcgtttctaaccctacttcgatgtctaatattgattttacccctacttttagggttttcgtttttgcccccacttttttggaaccgaactatcgttttacccctactttggatggtgaagttaacagtgttaagtaattggcaaaaggacatttataccctctcatatctctcttcattaattatatttttgccccattttatgcatgtagctttagaactttatttttgtgagtatatttaaaattaaatgaagcacattgactaatatctaaagggaacagataattacattttacaaaatgttgtcaaaattttgtttaagttctatcaaaatgctgatttttgtcaaaatttcatcaaattcagaatttatccaattttttatattagtcaaagcgcgtcatctaattttaaatatactcccaaaaataaagttccaaaactacatgtataaaatgggggcaaaaccacaattaatgaacatacatgagagggtataaatgtcattttgtcaattacttaacaccgttaacttcaccatccaaagtaagggtaaaataagcgtttggttcaaaaaaaaaagtgagggtaaaaacgaaaaccctaaacaataggggtaaaaatcaatattagacatcaaagtaggggcataaatgaaattgcccctaactttaactacctaactaattcaactttccaagagcaaagatcaactccaactcccaccaccaatgaaatatacaagtagcccaaggtctattgttctctcatatttatctattcatcatatccatataagactatacttactaactgctaatgacaaattcatttcagcacacctattgataacacaggagtatctaaagatagtacacctccagaatcatctgcaactgtcaacatatccacagaaaagaatatatgagaattgcatattctaactacttaattaaatacattcatttattcattaaatactttttttagtttgagtcagaccttaaaatttcatagaaattccctcagattaagtttcagtattgtttagcacaatttcaaattaattattgttgttcttattgacaaatgtgcaggccaaatttataacatggaaattattttggtttgtaacatatttttttgtagtcaagggatttcgatcatttatctgcaaagggatatactgttgtaacataaatctggtttctttaggtctacaagtgatataacgctgtaaaaactcatggtattactaggttgaggttgaatggcagtattgcactactgcagcaattgttaaatgaacatcacttgctgctttctttcctgaggtcatttctgttgcctgggctgcatcaagctcaattgtgaactgaatgtgcatcaatctaagaacatgagttcgccatgccaaatggataatatgtagaatagttaagcatatgcttaagccattttatttgtaatactcttcctaatattcccacaaaatagcatctatcattatcttagttgagtccaggttaaatatgtgtgttggttaaacagttcttgattctatgaatcaatctttctcggttgggacagtagctgcatgtagttaatcgatcaatgtgcaattttttctatccttgataattaaggatgtgcggttggtgataactaaattagcttcagtagtcccagtagatatactcggcacttttactttacataactgaagctactatttgctactactaaataactagatttataagctatagcaatttgttacagcaacacatctacaaaataaagcattgatttcagtaaggactccgttgacaaaactaaaaggtatacctctactgcacatagctcattcagttatttaaaatttactcttacaaacattttattcctttgcaataattttcttcttcatgggagtaccaaacaacttgatctaccttgttggtgatatgggcccggggtacgcacagtagagggaaataaccttcccatctggcggcgtggccgtgcggcctggcctttccccacctccatggagggagatcaggtagcgctgaggtggccaggggcctcggggtgccacgtcacccctctagggggcgtgaggcatgctgccccaaggccctcgcctggcctccacgtggcagggtaagtgggcggcgcaggagatgctgtcctgcgtcattaatgagcagtgccccaaccgtccctcgccgcatttaatgcggtgtgggcggatgcgcggcaccgctcgattgacgcatgtcaatcaaccttgaccagtctgtgaccggtcgcaggcgataggacgggcggtagtgcccccacgtcccaccctgtgtcaggcggagtcggggcaggtatgccccgtcccatcagcacactgccaagtgtgccccctgtgtgtgatgagcccaccaaagtctccatgcatttacgagggaatgacatggatgttccccgtgtaaggcggaggacggtgtcggaccccacttcgggacagacaaccactttacttccggttgaaggcacggatagtgatctgaccagggccatgtgggcccccctcccatggaggggtagatgtgaacggtgcatgtggtatccctttgaactataaaaaggaggaccttacccaccgagaaaggggacgactctcgatagcttgagctctagaggaagcatagctagggtttcccaggagctcaagatcccttgtaagaattccaccataataacacacacaggagtaggatgttacgcttggtagcggcctgaacctgtataatccctcgtctctcacacagatccgcaagcgatctagtagttagaccataagcggagatacgctcttgatcatcgcgccttatcccctggccaaactcacaaaggggggacgtgaggtttcacatcccccgctagagaggatcactcctcgacatacctattggcaaacgtcagaaggaagagtttgtacttctaaccctccttccaaattgcaaagtgaaaatataatgctaattccaatttcttatgaaccatttcaaacagcaaaaagatctaaccagcagtgagcgataagttaacacataaatctacataatatgcatggtacttgctctttacagtacttcagatacaatacatcatcatacaagcaaatgtcattatgattcattctaatgcattgtccaacgaaatttgcagctcaatacataatatacaacttaaagactacagacgcttccgaataatcatatgccttggttactattttcgcagtcacgctctattgtaatttgttttcgttgtcaggctatgtccaaactaaatactctaggtgcttccaaataatcacatccattgtgttaggattatggataccacatacctaatagtagttgactaaatctcgacaggacccaccacataccatgtcttatacggaaacaaccttcggatataggaggagttccgtataaggaaggatgaatagagttatacatggaaactacaaggactactcggattatatccatattggtttccctatttctacttggataaggggacacctatgggtataaatacaaggccccttaggaggagaggggacacggaacaatagatcaagacacaagatcaacatacaagccaacatgcgccaagacaagacgccgaatatcgacttcagagataagcatggttagtcccctacggtgtctacggatactatcaggagagaaatagcgttgtctttaatctcgccggatgcggattcgaggaggaaggctaccctgttgtcgactacgagtcagcacttcagaccgccaagtcgacaacagttagataggctaccccaaatattatactggtgtgattatggtgaataagagcaacgactggctttggccaacatgagtagggttattacctgacaattcagaggcccgaacctgtataaaaatcctcgtctccgtcttttttactacaatctcgcgtatatcctagtaccaacaattcccatactatgcaaataccggaatcgcgacatcaaacgtcgacacattgattattgttttctcattcccagttccctttcatgctaacaaaactttcgtgtatcctatcatataatcaaagtaatatttacatattatctttagaatccttttattttcaatacaaactattattcttttttttcctacaaagttccgcagcaacgcgcggggtaccttctagttaatagatagaattaagttgtgatgcaatggtcttcacgattcctttttaacttggtctcttttcgataggcttctctcaactgatcaacttcttttattaaccgaatccataaaaaaccgtaccaaatgttagcgttaacaaacatatgatcaaatgttatgtaaaaaatcaacgccgtcatacattttgaaaagaataatatataagaagtggccttttgtgttagctagctaagctaatactcctccgtcccaaaatataataacttatagtatttagaatttgtcccaaaatataacatcttcttcatcaatattctctccccaaccaatcacaactcttcaccattcaatttttccacctacctccacttctcaactaatcactagcgtccgatcatttaattttatttactttcttaataaccatgtcgaagacagagggagtagcaattatgtatcgagaaaatggcttatggaagatgcacacgtacaggtggaggccgcagagatagatggagctacaaggagcatatgtgtaccaaaaagagctacatgtatgtgtaataatccaaacaagcacgtagtacaaggagctagtagcacgcacatgcatgtagatgggtataaactcaatctctagctctcactggtacgtacacctcaaaaaggagcaaattaaacgagacgaacacacataacaggaagctagctggactgaccgggccgatcaataaccatacacacatgcatgcatggtgatcgatggacctagctagctcatcttttattccagaatacagatactactagtagtattggatacagaattcggctccacacacatcgacccaggtggcaaccggcgcgctgctgtatatatatgatcatcgatccgatcgatatagctcgatcacctcaccctgcacacgcacagtacatatatatagattagatgatatagatacttaattatcatacaaagccatgcgtaattatatatatttaacggaatatataggattagatgattaattacctagagcagtcgatggaagcgctgatggtgtaggggacgctgacgccgcacttggaggggatgctggcggcgttgccggcgttgagccccttgatgccacgggcggcgttcttgaggcagttgcaggcggtgcgccggtcagcggtggttctggcagcggacttgaggctcctcacgccgttgcagcaggccgcggaagggccggcgccgccgccgcgggcgtaggtgaggcaggggccaacggctgagttcacctggccgcaggtgatggccacggcggcgtgcggggcggcgaggagcagagctgccaccacggcgaccaacaccaactgtgcacgggccatctcgatcgatccagaggatgctagctagctgagctcagctgacttggctactgcgcttgatgctcggtgttggttaattaccttgctggttgctgctgcgagagctaggatgaatgaggagaatacgcgggaatgaaggggcttaagtagatatagagatgcatgtatgtgtggatgatgcatgaacgcaggaggagcaagcatggccggtgtatggtgtttagacggtgcgtctgtccatacattcattcaatgcgattgggagctagcttagcagcgggtggttgggtgttggtgggaatacaagagctatgtccctccatctacagtcgacagcattttatgccagttctaaaaccggcaccgatgactttcgatgaccgaagtcatcggtgccgtctctatggtgttggttgggatatctggcatctaaggggtttaacaagcactaagaggtttaacaagcaccaattaaagtttaagtaatagtgatggaataatccctaaattttactgacaacttcgtatcgctcatatttctgttgcctggaagctttttgggagtaaggtatatcaagtgtatatgaacaaagaaatagagagaactaaatagtcgaatcacttcgccatttaattttttattgttcttgttcgtgtatgacagcaaagccttttaagccttaccattaattttctaagatatttcaagaaattcaattcatatattttgcaggcatgattcaaatccagatgtgccaaggtgatgggcgtaaagcagccacagaacagatacatcatacattagtgtaaacagaggaaggaaatgaggtgcttacaggagtcagatcataggcagacatcattcaaacatatatttgtaagagatcaaccgacatgcatataatttgctaaaacaaagatgctccactggaaatcaggacctgaaagcttccattcttgcctactccttatccaaaagaatttctcccgacttctcacctgcaattatttatcatttttttagtgaatgtcaattatttatcattctatagatcaatcttaaaaaagagaccattatggatccatacattttgttttaggctaaacatgtgatccatcttttttccgccttctattaaactctgtcagtgatttactccagagaactttgttgtcttacagtggattgacaactcatgtgtgctgtgaacaatcaattggcaatttttgtaacctaggtggcaattgtgcagtgaacaatcaattgacaactcttataactatagatattcatttttttttctctaaggaatggtaaatgatcttttttttttctctaacgacagatattatacaaccacctccgaatatatatcaattgttgtcaaagatgtatatatcatcgtaaattaaacaaccacctttgaatatctacctgaaaaacaaattattgtcttttggcagatttggaattccatatatagcaaatggaaaatctaagtccttactatgtcttttttgtcccttcctcctcgttgatgtaacacgtgcatcggttatctccgatacctccctctaaaaagtaaactaaataaagttgagtaacaaccgtattcaacaagccaccactacaagatacattagtgcatatagggatttaagaatggcttagtttatttgcatcgagctggttgtcacaaaccatttcattgatccatggcttagcgattttaactgaaaacaaacgttatgtccacgttaatatccatcaatgcgagctgcatccacctccccaagctttctcctggttccgtttaccctcgtgttcaattttgacttggatgtatgccaacataatccatataccttcccaaatttcatataatcaagtttaaaacttctagactagtcaagagtagtagatgtcctgatgctccttcaagcgtgagcatagatattcgaatagatttatttttttcaccctacaatagatgtatgctttatcctcaatctgtagcgcacccaacacgtaagatttatcacggctcaggctttcgatttcccttgcattacagcacctgcgccaaagacaattaattctcattcatcactggtgtactttttctagtaacgtttgaatattcgttttattcaatttttttgtgtaaatatgaaaatatttatgtcatgcttaaagaacatttgatgatgaatcaagtcacaataaaataaaataagtaataattacataatttttttaaataaaacgaatggtcgttggataaaaagttaacggtatcatacaacaataaaatatggaggtagtagtatgtaattttcaccgtatattttctctgaatgggaagcagggttatacaacctatttacccgtgtacgcgttaattcgagtggattaattcctgttgggggcaaacgtggtcgcttgacacgcggaaacttctccaacctcgtcgccggaaatccttgaccaagcttcattcccacgagcttctcaactttccatccagtaacacgataacacggccatagtccctaacacggcggcggagtcaaataccatctcgcgctttcaacgtatacttggcattcgcccatcaagcacaagttaggctgatcagtgatcactattatcccacaatcaacacctttttcttttaggcttcggaatcatcaaaaattagctaccaaaaaagatgtgccaagtgctgacaagttccagccaagtacataatttattgatgaacaataattaaagcagaaacatgcaatgcgctttctgagccactgcactttgagagagcagactcacgcggcaaataaattagagtatcatagattgcacattttcagaaagtaccaactgttgtgaatattttgagattttaaatatacataaaaaatcgagaacagaccttaataaacattttttacatgtcgttctacagtttacacgtgccaaaagtggttactttgctcatcacaggattcagttcacaaatttcgcagaaaagaaacgtgccagggggaatcgatgggaactttgatagactgcaaattttcagaaagctagcattcttgaatatggataaaattcttaaaaaaaggcattcaattttttttttaggctgaccacttcttctgttgtacctgtcgttcaacaacgtacaaaagtataatcaaccatgtaagcgagctttacttttgtaaaaacacatttacaaaaggaaaccgattgtaaactgaatcttcttgaaaacaaaaccgattgtaaactgtaaaaggaaaactagacagcagacacactattcaattatgaattatcaattccttgcttatgttacgccgaggagaaaattgttcgtcgaagactaaactgtcatttaaattcttcaagtaaatatttgatgaattccagaattgcttcatctttatacgtttccgtgtcattgttatgttactcaaaaccaagctaatattatctaaggctaaataacgaggagttattatagtttagagctgaataatgttggttttaaacgcgggatcattttctaacttcggttaaattaaattcactttttctgtttctctatatgtggtttcatatccttaatacactgacactttttaaaaaaaagatgtgtgagaggaccttatacttgagataaatttaagttatgtgacaattgttaccacagataaaccattgctcacaaaatatatcaacagaaatagagatcaaatttgcccaaattccagaatccaatccggcctcatgtgataatattgaattcaaacggaccataaatcctacacatgagcttcattttgggcatatgcgtacttgatagtaatagtttggaggtgtttttccaactaatccaacctcacctccaaactacaaatgaaccaatgacaatggcagaaataagatgatgcaccatctgtaacagccctatgaacttgtaacttcatctataacccaggtctgagtgggtgtgtcccaacttggtagagcatgatcgtagggaccacatggtcatccttacatctatttacaaagttaggtatgcgttcactatttctcaggttctgctagattaacagttagttactactccgtccgtcgcaaaatataacaatttctagcctttaaaatttatcctaaaatataacaacttctccaccaacattctcttttcaaccaatcacaaccccccaccattcaattttcctacctaccttcacttctcctccaatcacaacactctcccatttaattatatcaacttttattaataacagtgaccaactataaaaatgtttatattttggaatggatggagtactattttgcctgtaattgcacgtatcagttagaccgcctagctacttgtctttggaaccccgcttttgtgagtaatttagattgcttattcattttattattggtagttctcaattgcttgtaggaacaaatgccattggggtttggttgatcgtgccctgacaagatcacgagcatccttggagttagtgtaatgatcactaagatgcatcatccctatatagttatagtcaagtcgttaacttattttccaaactatcatcaaaatatcaggacacaagattaggacacctaagagaacttcattcaggaaacaaagtaccaacacagaaaaaatcgctccaaaaaaaattacattcaaaatgaacaaaatcttctacattttcaccgatgctgccattgataaaagagaggaggaatatagaaccaagcatgaactccaacgcacaatgacttttgaagaccgcaataaaagcaaaatgtagatgcacagttgataaagagatgctaaattttacattggaaaatgatatttctgatatattttcaggcaccataaaacctcttaaaaataatataagaagagtgattgctttgctgatcacttagttcatcaaaagatttttcgatgctaaagatcagattagaattcgaggcttttatataaaaattcatataattaattaacgtataagaaacaatttagtttgcagagataattgaaaaagtttctcatagcaatgataacatttgctgagatcacagatttgtcaggcaaataaacgtgctagctaggggaatcaaatgggaactttgatatgatggtcaaagtacagacatctcattactacatatcaagaatcggccagagcccgttcccatttctttttccaagcacagaattatgccctgtccaaattcatcagggatctggcaacaacgcaagtacagagactaacaactgactagtagtctactacgtgcagctgaccaacagctaacaacccaagcgtcgtcaacgtgtcacacctcgtccgccgccgccgccgtcgcggtcgtcgccgtgatgccgctggcctcgccggccgaggaagcagcgacctggttccggcgctcgtcgagcaccttactcgccttgaggtaagcgatccttgcccagtcgtagcagtgcagcgcgatgtatactcccaagccggcgatgatgccgttggcgatggagaaggtgagcggcatgagcaccatggtgacgaacgccgggatggcctccttcatgtccgcccactcgatgtccttggccacgcgcatcatcatggcgccgacgagcaccagcgacggtccgacggcccacggcggcacgctcgtcagcacgggaccgaagaagagcgacgccaggaagcacgccgcgacggtgatggcggtgacccccgtccggccgccctcccgtatccccgccgtcgactcgacgtaggtcgtcaccgtggtgctcccgagcgcggcgctcagcaccgtcgacccagcgtcgaccaggaacgcacggtactcgccgtcgaacccctcgacggcgccgtccgtgaatccgccgtactcggccatggagtacattgtccccgtcgtggcgaggacgtcgacgtagaggagcgtgaacacggcgagcagcgcgttgccgtggcggaggccgccgaagctgagccgcccggcggtggtcgtgatcgtgtggaagtccaccaccttcttgaagtagtcgaagccggcattgcccgccgcggtgtccgggaacaccgtcacggcggtgcccctgatccacgacacgacggtgacgaacacgatgccgtagatcatgccgcccttgacgtccctggcgaggcaggtggccgtgatgaggaagccgacggcgccgagccagaatgtcgggctccgcatggagccgccgaggcaggcgccggtggcagggtcggtctcggagcacgcggtgagcgtcaccagcgtcgacgggctggcgccgacgaggccgacgccctggtgcgcctgcagccccgtgaacgccaggaacaagccgatgccgaccgccgtggcgaggcggatgttgcgcgggatcatccgagcgagcctcgaccggagcccgacggcggacaggatgaagaacacaatgccctccaccatcacgccggcgagcgccgtgctgtaagggattgaacccgagccatggaagccgaccatgttgtaggcgaagtaggcgttggcgcccatcccgggagctagaccaagcgggaggttagcgagcgcgcccatggcgaaggatccagccatggcggcgaccgccgtcgcgacgatcaggtcgctcttggtgcgcccaaggcactgctcgtacccggggttagacccaaccgtgcactcggggccgggcacggccgtggagttaccgacgaccaccggcgtgcagtcgctcacggtgcacggcccgccggagtcggtgaggatggcggcgttgacggagatgatgtacgccatggtgaggaacgtggcggcgccggcgcggagctccttggtgaatgagctcttgcgcgcctccagcttgaagtacctgccgacgcgtgtcgccgccacggcgcggttgacggcgtcctcggcctcggtgagcttacgccatggcgatgacctcttcatctttctttctttctttctctctctgtgtgttcagcccctattcgtgtcgactcttaggattaggagaggaggatctcttcttcttataggcgcgaatagagctaaagcttatttgccttgaacagaatgttttgggtggtgggcccacacttggtgtcctttgctgggaatggtgccagcacataatttaataggggccacttttcagagagctaatccctcttatccaaaatggaactcatcatgtttgattttttttcatgcagattagtgtgctttgacgactactgccgtatactgcatgataccacgagccatgctacgaaacattaatatctccaatctcaaaatattgatacttgtctacatacataaaataaatattattagtatatgttttaggacggagaggtagcttactaataatatgcaaaacaatactaatacatataggtaaaaagagcttacttctcgctcacaatctttctataatctttgaggtaaggtaggaaattaaggtgatatcgtggagcatcaaaggaacactgaagttaattaggagtcaattttgtaaaaatatagatactttgattaaactattgcaaaactacaaatttaatgtgcattcataaaaatacaaatttagcaataaagttataacaaaactatgtatttaaagaaataattatttattgtctatcaatcaacttaatcctgtttttccaaatttgtttatttgaccttgtttttttttcaaaattgaagataaatattaacttattctgtgaaaacaagataatcatgttaacaaaggggcaaattattttttttactcttgctcattaatttgaccatgctatataaaagtttttttatttgattctttgacatatttgtaataaatttagcatagctttgacaaatttagtttcaatttgacaaatttgacaaaaatcaaattaagaaaattgtacataattatggcttaaaatttaatagattcccacagcaaattgtctttttttttgtccattttgaattgcatccaatgaagaaaaaacagcaaaaagcaaaaacaaagttgagagccagtccaccgtcgcccatgctccctgccgcggtgccacctctccctctgcacgtcactgccaccctgctcccttcacacaccaccatcgatccctccattcgccgtctccgccaccaccgtcgctccctccgtgcgctgccacctccacttccaccgtgtgccactggccccgctccctctttgcgttgccatcacgtactccctccgccctggttaccatctgctacgccaatatccagagatgctggatgagacgaatagaggaaaaggaatttggggatagtatgtcgtgttcttagaggccactttgtcagtttagcatataaattcatgtttttatttttttctaaatgaaaccctgacattgtttgaaaatagggtcaaacggcaagtttgattttgaaaagggggggttaaataagcaaacttgaaaaatagtggttgagacatattttagatggaggaagtgataatttatctctacactataaaatagtgtagtattaaagtgagccactagacattaatgtctaatgctactcatctacttttttttctcgtttctagccattgaataagtagcacttcatctctttcccgttttctcccattcttgcttcctacgtattaatgaagagcatattagttattatattctaatggtccaacaaattcatattagttttattctatggcttaataaatatttttagatacttgccctatcctaatttctctgtaaaaaataatttttctatacaaggaaccctatagatcgcagatgaacagtaactgtcgcatatgcaaaaattgacatccattttcatagaagggaccttaaaaagagcgcatgcaaaaattctattttcgcagatgggcatgttaaggggccgtctgcgaaaatgagcttattttcacatgcggtcctcttaatgggccacatgcgaaaattgcagagctcttaagtggtccgcacgtaaaaataccctctcttctcgacaaatttttttctccctctactctcttttccctctcatcatttcaaaatttttctaactcctctaccatctctctcttcctctcctctcatgttattcactcctgcctctcctcagctctcctctctctctttctctcttctctctcttcctctccgagtggagcgggcttcggcgggcagggagagctgcaacgatggtgagggcggcggatccggcggcgccccctcgagagggctggattcaccgccctcgtgagcggttgcagcgacggcggacaatgagggcggcagattcggcgtctccatcctcgggagcggctgctgtgacggagggtagtgactacgtcgacgacgagggacactagacgaagttgattttggagttgagatttgatgagaatgtattttatatctacgcatatatatatatctctagtaatttttcatgaatttacaaaaactgatatgcatactactctcactatctcttagctctattatggcgcatatatcttatctatcttgagaaagccaaacaagtcatgtcctcttttttttagaagggtattttttaccaggcctctatatcctctctagaacctatcaggggagaaaaacgaaagagaaagaagggatacataattaagcgtgttttcgagtcctaagacgtaaaccactgagagacgatccatcgtgttcttctgtactcatgttttgtttatagatatggaataattgtatctaatggatgctacagtgtaaaacaatcatgtctttacagaatcttcttatcaacgtttctatttgtattgccaagcatatattatgcaacatacgtatatgactttttattacaacaagccaaaaattctaatgaacatgccatatatacctatgtttcgaaactcatcagcagacaaacattgcgagatggtactccccaataaaataaaataaaatatcgcgaattgacattctccgacaacacgaggacagtgtaccttttaacttgtagagaacctgctattcatttttgcgcatatatatacaaagcgttgacataagctgtaagcatcaggctaacatgcaaagatacgctatgattcattttgaaaaatgcgacacaaagcaatgtcaaattgtgtctacaacgctcacacctaggttgggaatctggaggacgcacatcttaatgtgattagtgcgacattttagagagaatttcttgttcaatatccgcaactttaaacatcaccaaaataaaatcatgtgatcccatgttggagagactgcttaatttgtcaaaaccgtcatacctttgttccctcatgcatgatgtggatgttttggagactttctgtaattcaaaacgtcaaaccttattggccaaatatgctgtcatacatcagttctttttaccaccgtatgttagaacacactacaaacgttatacttcgctctaggacaccacaaaacgctccctatttatgtcatagcataattcatcaattaatataaatcattttcaattcacacttatctccctaccctcttccatatcctccctccctaccatctcactcttagacgaccatcgcagtagcattagcatatatagtctactatctccaccagactaatttacaaacttggcctgaaactctcaacccttccctttctaacacctccatacaaaacgattcgatacacttctactctacattagtatccctcattataaatctatacctatactaatcagacacttttttggagctctcacgttaatcaggaagatcaagccattgattaaacaaaccataatatgtcaaccgttgattacaatctaatccaagttccacgcggtgggtcttttaaagcccatgtaacctatattgtcaagcccatcgatatgatccattcacgcacgcattcttttttctttttcttttgaacttgggtatttgtttctttttctaaaccgatgagtccatccatatttactgagatcgatctgatcagatgcagtggaagatacgggagggcacagcatagccatcgcgctggccggcagtggcaaacaacggagaaaggcaggaggaaacagtacatacaagcacatcgtatgccagttatgttctgctcgctcggccgcggcaaaggcgaatatatcaacgttatcggatctagcagcacacaatcactaaggcgaggttgacgtgcggccggtgagcgccggaaaagcacacaacgtcagccgaatgctaattgttgttttctccattgttaaggtttgattctaacttctaatttccagttcaattctctttacatgcatacttctcatctgtcacagcgtccaataggaattaatctacgtcatcaccatactgtatatatttttgatgttcagatgttgattcagcatcaacaagttcgcaatcacctgacaagccaatccatggtcatcgtaccataataattcatagaagtcttccatctatttgctttgacaaattcgctggcatttaggaagatccatagtggtcgccgcatgtactattcatgtaagtattccatcaatttgcatagtctaactttttatctgtatttgatctacttttaccattcttcttatattcactctctccttaaatataagcgatttcaagagattaggaatgaaggaaaaatgaagataaagtttaaaaaggggtgaaggggcagtagaacgatggttagggataagattgatcgaaaaatattaaatgagaggtggctttacaaagttctactcttaaatcccttatatttgtggatagaatttgaagtctaggatcaaaaatatttgtggatgaagggagtatatttgttttaaaatgtatttttttcctatgtgatatgaatttgctacccttattattatattgttaaaaacttttttcatatttatgttcaaaaatatgttcggactttcctaaactatccccgcaaaaaaaaactctctgtatattatttagttgattttttttgataatggaacgtaacattccggcctttactcaaatagctacagccaattattacagaactcacacggaaagtttacgatagcagaaacaaagctaagcaaagacaaactaatagacaccaacagaagaaaaagatcccctaactactgaaatctattagagaacctccacctgatattggcaaatagatgcataattatattatttagttgattcatcataaattttgtgttatacaggtggtcatgcaaaggcaaagggcatggaaaaaaacaatagatatgcatgtgcagtttttttcgataataatgcatgggtggaaaaaagcaatagatatgcatgcgttgcttcagtaatatacatgcatgcatgaaaaagacaaatggtgtgcagtgaaacatggtttattttcgtccctattttccaaaaccatggaaaaaagaataatcccatgcattttgctgatcctactttatcctaacatggcacacaatgaaaaattattggacacggaaccaatccatattaacattatggtaggacagtacagcagagttcttgatttggctcctagaactaatccattaatatttatacgtagtacatggtttcctcttactatatgttaatactatatgttatttgattttgatcctttattatgccatgttctcacgataaataagtatatatatgtgtatcatcctatatcactataatctgttgtatgtttcatccagttgaacaatttatgttttcattgatattcattacttcagaaaaatacatcattcctccaacaaattcagatgaagtacttttcttttaatcaatgttgagggataaacatgactaaaattgttttatttattattaatctaataatagtatattgggacattgtattaagaaaatatgccattggaagtcatactcaaaatgaattaaaaaaatatgaattttatcgttttaagtattctattgattaggaatcaatatttaacaatgtatatttcataaaactcttcttttaatataatctaagagccattgtaattagaaaagaccacatattcatacataactaaaattttaatatttatgatgatataaataaagagcccgtgcaacgcacgggttgacggctagtgtttactaattccttaggcccaagctagctacaccattggtaggcactatactttctttgctataaggcacaacccatcaatacaaaattaagataatttttgcaattcatataatttactattcacagctagcccaaatttccatctgcctgtgaagatggctaaggccatcttaggatcatagaccatatttgaaaacctatctctgcaggttggttcttaagaaaaccatccagaagaatagggacactttcgctaagagtttttaaggatcctcctatgaaaattatgatttgtagagatggtttcttaagagaactactcgtaaaaatatgatgattttcgcacatggttctcttaaagaaggatctgtaagtcaattttaaacagaagttcactttaaggaaccatacttaaaaatgggggaaaaactatttcaaggcaaagatatataattctttcatatgaagtaggatgatgaaaatttcatatggaggcaacttgttataaatgaacaatcatattaaaataaatatcctaataaggaatatggatacgaccatatgaaagaaaattttgtatgggtcatatacaactctggtttagcctcagtaggactttaaataaatttcctataaatttttaaagtttggttatttcaaaagaataaggaaaaacgtttcacaggtgaactgcgtatactaattggttagtaaagacgattctcctaacaaactgcctttaaaatgaaaagaagacccatatttttctaaaaaaaattaaacacgcatatgaacttgtttggagattaaatctatatgcaaattatatcactcggtcagatttaaaaccttttagttgaatgtgttttcatttgatatcgtttaggggcgaatattcatcacaagctcagatctactttttaaaaaatgaatatttgaaattttcaaaagacatcagatggaaacatgctctacaccaaaattgtagggcttgacaacatctacaactatgtcattgatgatctttttatttgattttgatgttactaggagtaagtgttgcaggttttaagtaccgtgaagtgaaaagaatttcatctatctctaattatcatgaagttctcgtaggtatagaacctcctatacaaaataactgtgttctagaagccctaaatcatatatggttcatacgccggtacaaatcggttgtaaatatgattttcccagtattgtgtaaatggttgccttggttcatagtatgtctagtatgattgggcagtcattcctctttttactgtaccaccgcactactcccttcgttctagaatgtaggaacctgggacatcatctagtccaatcactacgggagaagtgatctttgcaggtcggctgattttcataataatcccggttctaataagaaccgggactaaagattgtttttagtcccgcttaaatttttttttgatctctagtccttgttagtatctttagtcctggttcatcccctctcagaggcctgtcagggggctgaggatctctagtctcggttggtactaccaactgggactaaaattcaaccagtcttatataatccttaggacttatcctcaaatcctctaccgcaaagtctttctccccatcttcctcctctctccctctcctctctctcttatcctctcctctattcttgctcttatccactctttccttgcagaggcggcggtggtagtgaagaggcagtagcgaagcggcgcggggccggcagcggcggccggcgcaacggcgggccagcgctcgcggcaggcgggcaacgcctctgagacttttttttgagaatttgtgtttcggatctgagatgtatttgatttgtgtgtaatgtgaatatatgatgtatttgtgacgaattttttagaatttgtgatgtaatttttttaagaatttgtgatgtatttggagatgattgatttgaggatttggacaggatccttttgatctgtgacgtgataatcgatttgggatttcacgatttggggatgattgggaatggagtgaaatcaatattcaatgttaaaaacaatgaaaaaaagaaaaaaaaaggagcaaccgggcctagcctggcttcatttttagtcccgattggtatggatttttactcccggttatttcacccggaactaaagatgggcatctttagtcccggagtcgtagtcccagttgtataaccaggagtataggggttcccaatcatgtctaaagcccctttctccattagtgaaatctgaatatgacccatgttcagatatgttgaattaggtgatgtctactttgctatattttagaatggaggaagtatatcaagaaaaataaccacacgatcatctaccgtgcaaagccaacttccaccttttcagcactagttatctcacctccctgttgctagttgtgtctatctctcctatgttgtctgtggctctgtggtattttaattttacaggtaaagtaaagtatagggaactagcacacatgagacagctcggtgtggtagttggccaatgtgggccactggtaaaataataaatgtttacatggggaggatgcatagccacattgttgaatgccatttagcaaattatggccacgttgttgaatgtttattagcaaattatgactttgacggtatgtttcagcaaatgatacccaaacaaaatttcctccggatatactcatccattttctaagatatgacaccgttaacttttagatatacgtttgaccattcatcttgtttaaaccttgttacaaacataaaaatataaatcatacttaaataacatttgataataagtcaagtaacatcaaaataaataatagttacagaaatttttataataaactgaatggttaaatatatctaaaaatcaatggaggtatattgtttaacagagggagtatcaataacgcaacccaaaatagtcaaacggcagcattcactttggttaggccagtttcaaccttttttcatgagtggcttgggcaacgaagaaaatgaatccgaaaggtgatggactcattgataaaatttacgagctttatgcccttctgcctaatttccgaatgacttgacctaatggttaactggtaagtaaacccctattttcaaactaacaagcctaaaagggacatactatatgactgagcttaggcaaccaccatatgcacctacctaagcaacagacaaatggccacaactgtctaggaaattagcctgcttgccgcacatcatgtggagctagtgcattagttgagatgcacaatcttgcactaatcaacaattaattaatctatttttttgtgttataaactatggccatgtagatttttaggaggaagtaagtgatcttttaataatactgtgtggacaatatggttaattaataacctaatgcatggacaacatagttaataatttaatgcatggacaatatggttgtaataatttaatctatcaactggtacgtgcgtgttgttggttgctctgctgtttcggaggttgcggcctaagctggatcttcggctcgtgaacgtgatcagacgactttctatgtacgaaatgtcgttttaatattcgccaaggatacttagtgctagtctggctctaatcagttcgtattcaggtcagaattcgtcattgcagattccttcatatatatcatagtccccgtgcacttaaacaagacagcaaaaatatggtggatcttttcggttggaatgttgaacatgacaagtgcatacctgcccagctttgcatacaggccagttgtccggatactcttgagcaacataaagaaaggggtcttcgtgtgtagtgaaagcttacttgttagcatgaatttgggttttatcttctcctagatagaaacgtacgtggagttgtgtgtgccgctatatcttcacattaattattataaacccctccaaaaaaagagaaaaaattaaggcacttgattgccctcactgtacacccgtgtttccagatatctcacaggtatattatttgtgttcttttgatccatggacccttgttttttataatatttatgttattttaaggcacctgatgatgtaaaagatacaattgcttaatataatttttgtgcatttgtatggttcattttagggatgagaatgtgtcggataccaacgggtgcatccgcgacatttcttttcatttttcttatcgagaaacagaaatacatacaaaatatgaaacc

SEQ ID NO: 81771 - DNA, 5465 bp, Oryza sativa
cagcccaaccaacatggtgaggtattaccgtgatatctcctaatatgaatctcttcaacatctggatgtggtttaaggccttctaagacctcagcatcgacagaagggacacttttgccaggggagttccattccaattccagcacctttatgctctgtttcttgcttaatccagctttgctggcctcttctttgcttgctacaacatcaaggttcttgatatggagctttcttcggagatcattcatatcgttcaagtcttctaatgtatgacccttttcctttttaacatggaactcaattgatccctggagatggatcatttttccaattccgacaattttcgatgtgtttgtcctgtttatatccaaatggcggagatatttcaacttccacatgtcttttggaaactcctcaagctgacacctcttagggatatatagggtctcaagaaggaaaagttttgtcactgattttggaagctttgtaatcgtcttgcaaagagaaaggtacctcagatgtatcaactggccaactttatctgataattcaaccatatcacagccatccaaaccaagcacacggagacctttcaattccttgaggacatcatctggcaatggaacaacggaagatgaggaatgcttgagaataatgaatgtgcgcaacctcttgagctcggcccgacctttgagctgcatcaccgcatcactggtcacagataagtgacggacagtatcaggtatgcgtatgtcttttttctcaaactctacactttcaactcttgcgcagtcaattcgagagacattgtcggccaggtcatgcatcaggtcgtggatgtagtagtaagttcggcggccttccttgcgctcatggaagaatgattgtgccacaagttgattaaagtactccttccctacatcctcctccaattgattcttcgtatcatctggcctgaactggataaaacccagggccatccaaatcttaatcaacttgtcacgattgaacctccagttctttgggaatatgctgcatatcgcaaagcatggttggatgtgctcctgcaggttctgataacacagctccagtgtggagctaacattgtcatatatttccatcttcaagatcctcttccactcagtcaaacttggtttccgctttagcatgccaccgacaaccttggcagccaatggcaaccccttgagcttcacagcaatctgctccccaatttccttcaattccgggtgcctgtcaacatcattgttgtcgaaggcaaacttcttgaacaacaaccaaacatcagcgaactccagcccattcagccaaacaaacttgctcgcattcagcaagtctgccacaatcctcttcctggtggtaaccacgatcttactcccagctcggccaaatctgaggggagctaacacatcagcccacatatccctgtacgagttctcattctcatctttattccagacattgtcaagaatcagcaagaaccggcgcgacgagacggcctccttcagccgccgctgcagccgatcgaagctattcgtgtcgtcggggagttccgcggactgcaggatttgcttcgcgagatcgagcttgctgtaattgcctgcgggacacacccacatgatcagatcgaaggcctccttcacctcatgatcatggcacaggacgcgtgcgagcgtcgtcttcccaatgcctccgagccccaagatagcggcgacggggatggtgtcatcggcggcggcgctccgatcctcgccttcggcttcgggcgtgctgccgattagccaagacaccaattgctcacgctccttgtcgcgcccaaacacctcaccatcctccagaatcgagccggtgaccggaccatccgaggttaggagcgtgctgctcggctcgccggaacctggcttggtcagccccgccgcctgcatcagccggccggagttcgcgcggatgctgctcagtttctccacgacggccttgagcctattgaccgactcgtccttgccaacgagctgcttgccgatcttgccaatggaagaagaccctagtaggctgaccttgccgtcgttgggggcgagcctccggtaggcgaactcgtcgaggacgtcgtcggcctcgtacaccacctccttgagctggcgcagccagcgtacgagctcacagttgcctctcccgccgccgccgccgccgaggcagcgctcgacgcagcccgcctcggcgcggagctgattgagctcatcctccagctgcttgagcgcgtcggggacgccgccgttgagccacctgaacctgtcggaggcgcaggacctggccttgtcgaccactatcctgatgaccgggcacaccagccagccgaccaccgccgcctcccccatctggtcagtcggccgggccgccgtcggagagcgaagcaaaccgcgggggagattgcggacgaacagtggtggactggtggtggtggcgagtcttccttcaagtcaccggctatggcagagagagagagaggaggggtttgggtgggtggtcgggctgaggagaaaaccatttttggggcgtataccctcgccatttcggggcgccttccccttccggcgaccgggcggagaggggcgttgactctgaccggttcacgccgctgggcgctggcgccgcgcgggcgtagggtctctcccgcgactcgcctcccgttccggccacgtctgctcacccgccgctgctggtgtggcgccgcgccgcccaccgggccacggtccgccacagagctcgccatcggcggcaggggcggagtaggtgatttgggccgtgccgtgccggcccaccatgctggggcggtggcccaagcacggcgtgccgtgccgagcccggtctggcacggaaggcgcgggccatttgtccacctataggctggaggaataagttcacttttggtccctctatttgttgcccagtcccattttcgtcccttgaccataaaactgggtatgacccgtcctccaacttacgaaaaccgggtaaatgtggtcactctatggttttgaaggcagttttcgctgacgtggcgcctacgtggcttgtttgactaggtcttcgtcccacgtgacattgacgtggcacttacgtgacaattacatctcgaaaaaataataaaaagtgtggccccacatgtcagctgcacacacaaaaaaattaaaataatggggcccatgtgggccctacatgttaccctcactcctctcttcttccctctcccttctctctcttcttccctttcccctctctctctccttcccgggcagcggatggcgcgggtgggcggtggagcaagcgagctctgacggcagcggtgggcgtggtcggcgtcgcgccttgacggagcgcccccggtccgcgtgaaggtgagcagtgcggtggcgccctggaagatggcgatgaggatggcgaggagaggggaagccgaggggggaaacgagcgacgaggaggaggacttccttgtcgggtccgcccgggacgccgccgccttcttctctagcgcagtgctcactgctggggagccccccctcccagaatccgccgccatccgtgtcgccgccgccgaccacccggacgccgacctctaggcgccgctccctcctctcccgccgccacgcgccgctccctcttttcctgccggcggccatcagggagaagggcggcggacggctaggtgagcagcgaaagagagagatggccgccgccgccccacaagcctcgcgcgtcgtcgcctgccgccggccatgcgctgtccgttgccacgccgcccgctgccggcgcgctgtccgccgccgctcgccgctggacaccgcccgacgagaggagggagcagagagatggggagagccggagagaggaggaagaagaggattggatttggtcatttgagaatgacatatggggcccacgtgggccccaccatatttatttttttatgtagctgacatgtgggacccaccattttaaaaatttttcctgtggctgatatgtgggcccacaatttttattattttttcgatatataattaccacgtcagcgccacatcaatgccacgtgggacagaaaactaatcaaacaagccatgtatgcgccacgtcagccaaaaccaccttcaaaaccaccgagggacctcgtttgcttggttttcggaagttgggggacgggttgtacccggttttgcggtcaagggacgaaaatcggactaggcgacaaatagagggacccaaagtgaacttattcctaggctggaagttgggtggtgatgggtcagggtccatgggctctttcacaacccacctcaacccttaagagcccctttaaatctgatgaatgtaaaaatggagtatgaaaaacacgggattctaataagaatgtaagtgcaaaacagatgattgtaaaagggaaatttccaagaggttagagctattgctaaatttcttacaaaatctctataggattgtccattccatagggatttcaaaggatcacataggattcaatcctttgttcaaaggccttaataggaaatttttctataggattgaaattctccgaaattcctatgtttatcctccgaatcaaaggggcccaaatattttcagcacaaaaactacttataattttcagttcaaccattcttagatccaaccgtcacattgtgtaggtcaaaaagttagacccattaccaccgttgcgcaaaggtagaaaggagtgggccatgacccatgtatgtggaggaggcgtaggagtggcagaaggaaaaagtccattttggcccgtcaccgtcaactattgatcgaatctgattggtaatcactcaaccataaaaccagagatatcgtatcccaacagcttgtttggtaactcgagggaaggggattaggagtttacacgagggaatttatgatgagattaatatgggaatttgatttttaatcccaatatcttgtttggtaggggtgatagaaattgatagggagtttaattggagattaggtcattaataaaaacggatggctgagatttgtttagacaaagtaaaggaggaattccctcccaattacctgcccctacctaggtattgaaaaggtgggagttcctttctcaattccccatccccatcccaccaaaattcccatgtctcccaaccaaacaaaacatttaatagcctcattcctctaaacttccaatccctcctgaaaactccctccaaccaaacgggccacaagtgttaaaaccagggcccaaaatgactcccttgattttagggttgttttagatgacctgttgtaaagttatgatcaagatgatgagtttaggtcaagagttgttgcttgaattcatcgaaagtggtgacaacaaaatgtgacggcaataaaaaggagaatggagtaaacaattctgaaggattggaatctg

SEQ ID NO: 81772 - DNA, 15325 bp, Oryza sativa
cggtgagccgtggaccgccgcttcggtttccccctttccctcccctctctcggccgccgctccgccgtgcctatggccgccgccggcgaccataggggcgcgggcgcgccgcctcccgccgttgcgccggcgtgcccgccttcgggcgcaccgagcggctgccgcgtggggcccggctgtcagccgcccgcaccctcgggtgcggctgacgcgtgggacccacggcgccgtccggtgtgagcccgggtgcgcccggtccaccgtggaccgtgaggctgccgcgtgggccccactcccgtggacccggtccgcgcgcccctcccctcggctgacgcaataagccctttttaaattaaaatttaaatgaagaaattcgcaaatattcatttaaagagcatataaacttcaaatggtcataacttggccatttgaactcggaattggaccgttcaagtctctaatttttccttaagaagtcaagaacccatttttgtgctttgttcctgcttgttatatggagtttagaagagtaaaagccttttcttttttttcgttggtcgtgtagacgccgcagcttcggaagatccgctcttcgtggaacttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttattatgaccttattattgttattgttattatttccttgttccccctagaataaacaaaaccccaactagtggacactctactcatggtactactagtatgattttaggtagatgcttcgctggttaattaggcaacattaggtggttttacaactctagactttgggaatattctcatcacctggacactttggaatggatggattattgtggaattggattcacacctccccctctattcaaaatcctcaaaatggttttaggctgggctcgaggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatagacgaagtcgggggtcgatggacatctctagggcaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggattaaggcaggttcgtgtgggttcacggccttgattaataatattgtatagctctggaatcgtgtttacaaaatagctttgagcaactaagtgtcttttaatgctgtttactgcaaaccctaaccctttatattataacccccttgtactcccttgcatttatcctgcacttgtgggtgtgtcttgttgagtacggtggttgtactcagtcttgctcaattttttcccaaacccagaagaggagcccctggaagatgaaggctttggtgtctagctcgtgcctgccgtcaagcgcctgtggtcgtcgctctagtcttccgctgtttcccgtttgtctttgtgtgtgctgggccttcgccgcccatgtaataaattaactatttacgcttccgcttgataaactctgaaatatatcaacttttggtgtaccttgcctcctgggacaaggaataatacacgcacgtaaggaacgcccgttgggttaattccggtcgtgacagaacgcgttagcaaactatttgccgacggcgttgaaaggttctgcgcgttcgtggctgatgcacctcccgccctactcgatttcttcatgggcagatctgtggcagcaattcatcaccaacttccaaggaacttacaagcgccacgcgatcgaagacgatctacacgcgttaacacagaatccgggcgaatctttgagggactatgtttggcgctttaatgagtacagaaatacaatccccgaaatcaccgacgcctctgtgatgcgctttgaaaaccggtgtcagagatcgctatactacccaggagttggcaacaaggcgaatcacaactactcgaagattgttcgaggtcgtcgatcgatgcgctcacgcagacgatgcactgagacgcaagaatgacaagctgaagacagggggagagaagaaaccaaccaatgacgcacctgaaccaagcaagaagaaaagtggcaatagtgggaaaaggaaagctcaagcggaagtccttgcgtcggaatacgagcgccctcccaaacacccagacccacaaggcagcgacacgaagagaatatggtgccccatacacaagtcgaacatacattctctagaggattgcctcatcttcaaaaagtcgctggaaaagcaactggcattggagaagggcaagtgagtacgtgtagtcgagaaggccgctgaagcaaccactcaggactcggactcggcgtacccagattccgatcttcatgtctcgcacatcttcggaggttccacggcgtactcctcaaagcgagaatagaagaaagtggagcgtgtgaaagtgcattaatccccctagtgggttttggtgattaatgacaaatgtggttaagggactaatgagttcattgagtgactttcaggtgcattagtccaaggtgtggaagatggatgcttggagacccccaaaaggtacaaaatcaaagcggaccggaactcgagaagtgcataggatagtttatcttttgaaattgagtttttaggaaaaaccgtactattaagaggggttccaggtgatgctctgagatatatcaagtgctcttagtgtgaactaagtgtcaagtttccctaggagtcatttttgcaaatactccatctgtccaaaaatgcaagtccggaacttcctgtcttccgggtccggaagttccggtcttgtgaaaaagattttcctaagtgtagttcggaagttccggtcttccaggtccggaacttcctgtctagtttccagttcaaatttgtgagtaacggctagatgacgtcacctagccgttatacatatacagctagtttccagctcattccttggccattccactttcacttttcacctagagctattgctagcctctcccaagtttttcttgccttctccactcaatcaagagcctaattcttgtgagaaagagagattgagagggagagaagaagatttggagatgtgtgaagactaggatcttgggtgagcacttggaatatctcgtgggatatcatctcggtgcttattactcttggagatgatctcctagacggttaggtgtcgcccgcgagaatccgttgcatattgtggatgtcccgggtaagtttgtgaaggatttcctctcctccgaaagggaacaaggtaagttagtgaagttcttgtgctgagattttagaggctttccaagtagagaaatccacacttgtggtggatttctagaagtaggttgagttggatcttggtggtcactcaattctagaaatttgcctaggggtgtttggtgttgaaggctgtggattttctctggggtttttgcacaagtgacgcaaggggttaatcgagacccagctctttggagctcctcaacggagagtaggatcgcaagattcgaacttcgggaaaaaaatcgctcttgtctctttctgtgatgcttctgtggatgattctgtgatatatcctctgcttagaatacctgtgcaccatcttgtgaagattggcttagtctcttgtttcgaaatttgaatttcatctctgttctgttacccggaagttcctgtcttagaacaccgtaagtttcgggcctgggaggccggaagttccggagttccttaccaggaagttctgggtttgtttgaattttatcgctgcgatttgtttttaagctttcagggacagcctattcacccccctctaggcttcatcagcacgttcagcgtgaagtttgttcgacatggcagggggctgcacccaagatgaagtggtctgaacagaagatcgagttttcagatgaggaccaccccaaggctgctgttatcccaggacgatatccgatcgtggtcgaacccactattcggaatatcaaggtagcgcgagttctcgttgatagaggcagctccatcaatcttctcttcgccagcaccttggacgcaatggggattccacgaagcgagttgacacctactgatcaacccttccacggaatcactcctcagtcatcgtccaagccattgggcaagatcacgcttcctgtgactttcggcagagcgagcaacttccgaacagagcagatcacgtttgatgttgctgagtttgacacagcatacaatgccatcatcgggagaactgcactcgcgaagttcatggccgcatctcactacgcgtatcaagtgctcaagatgcccgggccgaagggaacaatcactattcaagggaatgcaaagctggcggtccaatgcgacaagcggagcctcgacatggtcgagcacactcccagcccacccgccacagccgagccacccaagaaagtgagcaaaacaaccaagacgctgaaaccagacggtgcaatcaaaatcgttctactcttcagtgccaaccccgtcaagacagtcaagatcggggcatcactgaacgagaaataggaactcgcgctcatcaccttcctccacgacaatgctgacgtattcgcttggcagccgtccgacatgccgggggtccccagggaggtgattgagcataaactcatggtgcgacccgatgccaagccagtaaaacaaaaactgtggagatttgcaccagatcggaaacaggccatacgagaagagctcgacaaacttctcaaagctggtttcatcagagaggtactccatccagagtggctagccaatccagtcatggtgcggaaggccaacgggaggtggaggatgtgcctcaacaaggcgtgccccaaggatcacttccctctccctcgaatagaccaactggtggactcaacagctggttgcgagttgttaaacttccttgacgcttactccggctaccaccaaatcagcatggcaaaagaggacgaggagaagacagcattcatcacgccgttcagtgtattctgctacgttaagatgccgtttggactgataaccgcaagaaacacttttcagcgcatggtccaaggggcacttaacgatcagcttggaaacaatgtcgaggcctacgtcgatgatattgttgtcaagaccaagacaggcaactcattgattgacgatctatgggaaaccttcgacaacctccgacgatatcgcctcatgctcaatcctgagaagtgcacgttcagagtaccatcgggcaagctgctcgggttcctcgtctctggcagaggaatagaagcaaaccccgagaagatcaaggcaatcgagaacatgaagtcgcccacaagactcaaggaagtacagaagctaaccggatgcatggcggcactaagcaggttcgtcgctaggatgggagaacgaggacagcctttcctcgctctactgaaataataagacaaatatgtatggacacaggaagcagaagaggcgtttatcgcactcaagcgcaacctgtcaaatccccctgtacttgtttctccccaacctaatgaagaattattcctctatattgccgccacgccctattctgtgagtactgtcattgttgtcgagagagaaaaggtgcaaagaccagtctactacgtcagcgaagctctccacgacgcgaagacaagatacctacagatccaaaaactgctctatgcagtaatcatgacatcaagaaagctacgccactacttccaagcccacagggtcacggttgtctcctccttccctcttggtgaagtcgtgagaaacaaagacattgtcggccgcattgcgaaatgggtagtcgagctaagccagtttgatgtccactttttaccacgaacagccatcaagtcccaggttcttgccgacttcgtagccgattggaatatgcctgaaaacaggttagatagtcaaaccgacaacaaaacatggacaatggcgttcgatggcgtactcaacagccaaggagcaggtgcggggttcatcttgacatcaccttcgggagatcagttcaagcatgcaattcaccttaacttcagggcaaccaacaacacagccgagtacgaaggactactagctgggataagagctgcagctgcacttggagtcaagcgactgatcgtaaaaggggattccgaactagtcgcaaaccaggtgcacaaagactacaagtgctcttgccccgagttgtccaagtatctcgcagaagtcaggaagctggaaaaaagatttgatgggatcgaggtccgacacgtatatcacaaggacaacatcaagccggatgatctagtacggcgtgcgtccagatgagagccactcgaacccggcacctttctggacatcctgacaaagccatcagtgaaaaaagcaaacgacgaagatagcccaatcggccccgacatcagctcgggggctacagaggtagagcgtgccattgccaacatcgagaccacggacgactggtggaccccactcattaaattcataagcagtgacaagttgcccgaggatgatacagaagctgagaaaataacccgtcaagcaaaaatctactgtatgatcggcgacgatctatacaagaaggcgccaaatggggtacttctcaattgcgtctcgtccgacgacggccgacatttccttctcgacatacatgaaaggatatgcgagtcacacgccgccggccaaacattggtcagaaaagcttttcgacaagggtttttctggccaacctccctcaaagacgtttgcgacatggttcagcggtgtaaagcctgtcaatttcacagtaaacacacaaagctaccagcgcaagcgctccagactatccctcttacttggctgttctcgtgctgggggcttgacatactcggaccattcccacgaggacagggcggctacaggttcctattcgtggcgatcgacaaattcactaagtggatcgaagtgacacccacgagggaaatcaaggccgaaaacgccatcaaattcatcaaagggatattctgcagatacggcttgcctcaccgcatcataacagacaatggctcccagttcattagtgccgacttccaggattactgcatcaggctgggagtcaggatctgcttcgcctcagtttctcaccctcagagcaatggacaggtcgagagagcaaacgacatagtactacaaggaatcaaaacccgtgtatacgacaggcttatgtcacatgacaagaaatgggtcgaataactcccatcggtactatgggccgtgcgcaccacaccgacaacgtccaacaaggagacacccttcttcctcatgtacggcttagaggccatgctccccaccgagctacgatatcagagtatacgagtacagaagtactccgacgaggatcaagatcaacagtgaaacgacgacgtgaacctactcgaggaacaccgagaacgagttgccgtcagggcagctagctaccaacaggcccttcgccggtatcacgagaagcgcatccaagcacatatactttcgatcggcgactacgtcctccagcgagttcaaagccaagcagggcgaaacaaactctcacccaaatgggaaggaccgtacacgatcacacaagtcttgcagccaggtgcattcaagattgcagatggcgatggtcgcgagttagcaaattcttggaacattgaccaattgcgcaaattctatgtataagtcaatagtatccatacttgtaagacatcttacaacttcaaaaaagcctattttcaggtacatatttcaatcaaagtgtcccttcccgatgatcccttacccagatgacacctagcgttgaaacctatcctcatgtccctttacgccgtcttgacaaggccgccgaggaacctaagggaacttcggctggggacgtccagagctgataaggccttgtcggattctgtagagacgaaagaccatgtaagacctagttgtgtaagagttctcgccgtgcgtattaatcaagccgtgtaatcggaaatggactttccaacttcacggctgggggctaggatcagtgcttgttcaactaaggcaggttaaaggtccaagagccttatcttccgagaagaattctccgatgataaggctgggggctagggagagtgtatgactcaagtgactgttcgaagtcgcgaagtgagaagacactcgtacacactccatcaagagtaagaaagcttagttagatagatttcttttctatttcacaagtatttcttataacccacaaaaaattcaaaatatattacactctaccctgagatacttgtcacaggatacggagtctaccaagaaggccaacgccagtccatcgactggaagactttctccgcaagcggcgccatcgacttcgccagctggtctatctccgcgggagttctccgagaacgtgcaaacccttcgtggaggaactcgaggtgcagctgcggacgatgatctcgtatacaggccagcacgtgccctcccgcatatcggctcgaccgacgacactcttgcttcaaggcctcatcgatatgcttgccgataccttcaagctgggcgtaggccccattcagccacgagatgtatccagccgcaaattccttgggatacccgcgaggtactcggagttccttgcaaactcccgccatggctgtacaacaactccggaggtacgagttgaaccacacctcgcgacctcgaagtgcttccacggcccgatccttcttcacttcttacatagtcccctcgagttctgccacctcaaacttcgtccttcagtattgcatgcgatgatctcggtcggcaagcacactctcgaggtctgctcagcatggaaacgactaagtcaagctgtccgcctctctcgagaacatggtaaactaagtcaatccaaataaaagagcgaagggggtggaaacaaaaaggaccaacctaaggaagtcatcgccatgcccgtttccacgggcagattctggtccacgacgtcctgtggcacatacggctcaagcgcaaagtgccggcacgagtacaggcaactcaggctgcccgcgctgctggacatcctcgacatcgacatctctacacacaatagcaaagtactcggaatcaaaatgctaaagaaaactaaggtgataactgcacacacaaaggcagttggaaccgacgaaagttttacagagcatgattgattaaagagtacatgcaaactgaagtcctactctttgaaaagtgggagaacagactctcccagatcaccgactttctccatcacgtccttacgcgcgttgttagtagccccctgatcttagatcctctggagatcgagttcagggtgtgccaaccatacgcacgcgaggacgtggcacatcccggtgtagatcctgttggacttctcctccccgatcctggccgcatgcctagagatcgcctccatcgccgtcgccagttccgcgagcgaagtcgtcagcgagaactcgtcggggttcgccgggatggtggtcgtaacaccacactcccccgcgagctggtgtaggccggtgtaggtgacccccagcgaaacacggatctccgacaggttgttctcgagttccgacatgcggttctcgagcccctaccgttgccgctcgttgccggccaccagctccctcattttctggaggtccttgcgaacctctgccaagtcacgtgccagcttgtcggcgcgttctttcgccgacgacgccgccaccgccctcgcctccgcaatctcgcgacctatgctgcgagcgccggcctcgaggatgcgccccatctcgacatggagctcctcccaggtgaggacgtcagcaggcggacctcgagcgggcacaagatcactggcaggactgctgggcgttacctcacggctcctgggcacgaccacgacatctgtcgaggccaccgcaggagacgcgctggagttccctccggacccatcttgcaccgccttcgcccgcgctgccctacgaaagattgccatgttggccatcaaaacaagctgccagaatttcgtccacttacttctcgccaagtatcaccagcctctgctgtcgcggaggcgggggagacacatccgaggcctaagtaaaccgagtacgatgtgaggacgacatcttccgactacgcaatcgataaccaaagaggcttaccgatggggtgggcgttttctggcggttgccgagcacggaggaaaacttcctccctttcctcggaacattgccgcaactggtcgtggcagcagcggcggcaatggccacgtcggacgcctcctgggcgacgccctctttcaacaaagccgcagcctggtggtccacgagcggcccaatgacgttagtcagagggagagcctgcaccacatgaagttaggatgcgatttaggaagaaaaagataaagggtcattgattacactcacgttgattgcagcttcgcgctcagccgcccctttctcacaaagaggggcggggacgttgctcgccgtcgtggggccgctgaccatcacctggccgacacggtgctccacggtctcgctgttcaaacctgtagatcgggaaccagattttgataagtcaggaggaatgtgcgcgtaagggagggaacccagaatgcaagaaaaatacctcgaggagatactcgggtctcgtcctccggcccagagtagtcaaaggcgggatgggctcgagcctggagcggctggatccgtctaccaatgaagtcggcagcgacttcataccccgacaaccctcgtactccgaggtcatcgatgatatcaataaaagactgaagggatggggtcaaggcgggtttggcggtccaagacggaatcttatctggttgttcctcagggacaacgaagactgcatccgaattctctatttgaagatagaaccacctcgcccgccatttactacgagaagaggggcactggaaggggatgtatcgcgacttcaggccatcccgaagtccgaaaccaacacacccggatacctttttaggttccatccagcgcaactcgtagtagaaacgaaagaggtcaagaaacggctctaccccaatgtaggcctcacagatgtgtgaaaaaatgctgaggaaggctatggaattggggttcagatggagcacagaaagaccgtagaaattcaagacgagaaggaaaaactcagaaggcggaggaagaaaaccacagagaatatagtcctcaaccgcaaccatgcggcccaagacgggttcaggttcagtacctcctggtttcctctccatggtcccgtaaccggggagagcgccttcctcctgcaacttcttcagggatgcgctggtggaagtggacttgtcgaggtccattgccgccggggatcggcggagaagagaccgagacgagtaagttagggttcgtgcggaagcgaaaaaaacgaagagcgtttggaggctagaaagttttcgcaacaagcggactccaaaatggattcacaaaactcccttaaataggcacactaccgacggtgcgaattccaaggaaaggagatagatggccgccggaaatttctgggtccgttacgcgcggcagttttggaacttcaatttaaattcactcataaccgttgaacttcgcatggtgttgtcgactattccttgtctctacggttcttacaccgagaacgaccagtcgagaacgacaacaactccaacatcagaagtcgcgatcggttacatgagttcatttaagcagaagtcgggggctactgtcagggttacggataaggcataccctctacccttggatatacgctatgcggcaatatggtatatctgcgcgtgtacggacgttctctgtatacgctaaggaaattcatcacgaagtccaccgatggaaagattcctacccgtataggactgggtcgtcactataccgtgcagggtccgatgtctccgagttctacttggaaaccacctggcttgcgatataaaagggacccccgggaggacctaaggcatcgaatctcatagccaagacaaccaccacagcctacgaagccggagcctacaggagccaagtcgccgggtgatctagtcgaaccaactcgactacgatctcgtcggtatcatcgagttctgttattccctttgtaacttgtggtttccactatataatcccataccaactggattagggctattacctatcaggggcctgaaccagtataatccctgtttcctgtttgcttgatgtcgtactacgtagatcctcatatcaacgtacctcaataccctctatatctggtttacgggtatccccgtcgacaatatgagagaagatataattatgatagccgcacacatcatgctagttattcttaaagtgacaaaacatttttttataaacgatgaaacaacgttcaaatttgaaacaaaaattaggcacccaatttataatcgttacccaatggactccctcctccctctcactctattggtgccaggtgccattagtttgattcaatatggctgtgttcgcgatcctacaagttcacatcttttattggcttgtttttcacgcgaataattcccaaactactatacgatgtgtttagctaatacttagaacatagtggacacatcttaataatataaatctgaacaaaccttctgtctgagatttctaataataggatatgtctcctctggtattgggttattattttgtgggacgtgaaactatgtggtaatgagtcgtttcattttacaagtataggtttttatgggccacagcccaaaggacttttgggccgtatgagtcacccgtctcggcacccgcatatatacggccagtgggtccaattgacgagccgttcaaacttccttttgtgatgcagccatttcgccgatcacgacgaacggcaaagtatatgtatatatatatatatttttttgagaaacacaatacaaacgcaggcgctcacaacgtgtgcacactcacccctatgaacgcacacacgcacaccctacccctatgagcacctccggaagactggaccggcatatccctacccctatgagcacctccggaatactgggccggcctatgagcacctccggaagactcaccccttatgagcacctccggaatactgggccgacctatgagcacctccggaagactcactcctatgaacgcacacacgcacaccctacccctatgagcacctccggaagactgggccaggcgcctcgctgtcgatgggtacgtcgcctaccactgaaagaataattagccgtaaatgcgagcacccgtatcaaatctaggatttaaacccgggtgggctgtttccaccacaagaaacctagccagttgagctatgctcacttcacgaacggcaaagtatataattcttcagttccaaaaaaatttcttcatgtttcgtttgctcccggtcctggatgcctcaagcagtcgtagattatcagactatatagaacggccggccaaggaagttaatattaagttgggatcgattggacggcatactaattaataccgaaattctatccaaaactgttagtctcatattttcgcttatacttatacttatgagaaaaaatttaaattttcaatcttaaatttgtagtcgattttgagtttttcatcgaagtttattttttagcatttgcctttagatcactaagaacatttatataaaagttttatagcaaattatttttgtttgtaaatatatatgttgaataagccaaaatacgtatgttttaatgtttaaattttgcgatgactgctagtactaactaccccatgctgctagtttatcacagctccatcgtagagtttttttttcttcagtgatcatgacaacccaactaagctagctagctaccagcagctgcatgaatactagttgagatttgataacagttatgtttaatttgtaatggttgccagctagccttactgcgggatttgctagttttatcatataatgaaatcaatgttttaaatgattagatgcaactctttgtatatacaaaatagatgataatacggcttcatatatagcttcttttattacaatacaattcatgttttattttttgaaacgccattgtgtattgttatgatatatgaaagttattttcatgcacaatctggtagtgtagcactactctacttcatcttaagcatgtttcaaaaatgagtttggattcatgatacctaattattgtatgttatccaattgtttataacaaaacaaagctcacatcttatgtaataattagagttgtatttagaaaaaaaatattagtattatctttgaggatttggatgtacagaatggataacaatgtcacgcatgattatgagctataaggaggtgaatggatgattagctagcttcttgatccaatggcttaaaattgttgatgatgtggcttcttacatgtcttgttttatatgagcaaatgcttcttagtgggtaccaactatataggaagataggagtgaacccaattaattaaacaacatgcagcgagccacattatttacaaaagagtggccattggattaccattacttctaatcacagccgtgggatcagctctatgtttaacgacagccataaatgtattaattgtagcttaacatacattgagaattttattaattgtcttgctttgatttaatgtttttttcctggtgttttagaaggatttctattgcttcgggata

SEQ ID NO: 81773 - DNA, 1561 bp, Oryza sativa
agtgcaaaaaattttatggctggaggtacgtagacagactacataatcatgaaattaaattgcatctagcaattgttaattgcatcctcaccagtaagagtgaacaatcgaaatcgtaatatggtgatttatgattttttttagatgaaatactgcctgacatttgccgagcagtgttgtatggtgatttatgactgaagcagtctaattccacagttagtaaatttaaatgtactgataatgcaatagaaatgtaaaaccaaataaccataaacaacatccagtcattcagtgttcatcagcactgctgtgcttaacattacgttaaattgtgtatgcagaaactgtatacatttctttgtgtcaatatgctttttatcgcgtccaatttgatgcatagtacactttagttttgactgtgctaatccaggtcattgagtaattagtccctaatctatccatctcctacttattcttcctgtgatcattgccaccccaaactctgaggtcctcatcgatgaaaatgaggaatgagcacaggaaggataaggggagccgggaacgagatagatttagagttgataaaatgtacaaggaccatcaataaattaggaaacatagatagattcagagtttggggtgattcatgcagatgcactaacataactcagagaagacaaaaggtaaaacatagatgcagagatgacaaaatgtacaaggaccatcaataatttcgctactaacatccggtcaagccaaaaggtacaacgtagatagatgcagagatgacaaaatgtacaacgaccatcaataatttcgctattgacatcccgtcgagttgcttaacagaagatagagtagaggggataatgtggacccccgtttttataacaggaatcattcgtgtaaacagtaccatttccctggatcaagtagtctggtacagaggagttcatagctgaaataccaaaagcacatacacgggagtctagtgctaattattacatcataagcccgcaggcattgtcttaaatcatcggaccgagcggtccagaatacatccaaaagcagaaatagataaggcagcggaattcaggcagcggcatgccattgccacaggcaacgaccgtactaagacctactgagcgccatcgtcttcatctccctcctggtagtaggcatagggatcctccgaagcttcatctcccgcttctgattaattttatatttgcaagggtgagtaccaaccgtactcagcaagtcaccacagcaacaatgcatatgaaaggggtatttcaatggatggctatggctcttttgcgctaagccagttatgtaattcttttcacaaacctaagacctagcattgactgatcaaattttagtaccagtgtttgtatttaaataacgacgggtctgtccaccattcattgtgatcccaaagatagcttcccgccattgagtcgtcatggttttttgaggacgtccaccttcccttcttttaagaagtgctccatcagcataaaaatcatcatgcaatatcccatcccacacaggttaa

SEQ ID NO: 81774 - DNA, 1549 bp, Oryza sativa
ccagtgagaggagttctggcgctcctaggaaagagaagtctcacacacatattaaattatggttcaagttaagttctctctctcacacactcatggcagtcctaccaatggcgacaccgatgtagggcacgcctctcggccctacctcaacggctgtcccaccgtagcgcacctgcctcactcaggggtgaatcatctatgcagggatactgcctcgctcggctatctactccactaggtctatacccatacgagaagtgcggttgtacgggggtcgtttcatgcttaacttcatggctcggtccttaattgaccggggacggtactagccttttccagataccacccaaatcctccgtccgccccagtcgaaaacagttatttagtttatttctcctttcacaaatcatgtcctcaatatcatggcaatgtggcgctcatgtctccacatgccgcatctcaattaccttcccaaaggtaattgcaagtaggatgttcatctttgcatgcaattttatttgtaaacaaaacaatttcgcaattgggatcaatatgttcaagaatagtgatgacttgccttgctcaaggtcttgcgggtcttggccttcacccggatccgtggctccctcggtctctaaaattatgtgcgaaagaacaatttgaattcgattagaattcaaataaaatccaaataaatccaaatgaaagtcgaatgcgaaagtcgattcctttattttaaggcaaacccaatttcgattcaaactattttgcgggtataaatgttttgttgtcataagtttttaacttaatctacccgagcattatatccatataataggttagagatttctatcgcgagctaaatatcggacgaaatcctagaattattatatgatttaatttagtctatgactaaatgattaaatataatacacggctaaaatccctagtaattaaatccgaatttctaccgtgaatcgattacttatagggattacccaaaaataatctataataatctataagaattcatctatttgtttagttattaattacatctaaattactaccgcgaattgattccttatagaaattaccaagaataatccataatttatattaaattttgcaattctacgactataattaatctataattaaattctaattattttaaattttctaaacttcctaatctccctctaatttcctatttatttccttttcctttttctcccttccttttttttctttcctttcttgttcatttctttttctctttttctctcttttccttttcttttctttctctcctccctcccggcttctttctctcttcctcggcttctccctttctctctctctaggctccctgctacccggggcggcgacggcgaccgagcaaggggaggaggcggcggcttaccgacggcggtggcgtcgacgacggcgcgacgacggcgcacggcgcatggcgcggcggcacgaaggcgtcggtgcggcggcacgacggcgacagcggcgcaaggcggcgacgcacggcgcggcg

SEQ ID NO: 81775 - DNA, 8083 bp, Oryza sativa
tcatgaggctcttttaggatgaagcaagatgaacaccaacatgcgcccgagttgcaacgtcgttgcttaataaggcttccgcttctcaatcttcaggattggggccatcatctcagctctcccatgggttcacatgtgcttctaggacaagttgataacaaatataatattaatgagaatgacaatcccattcatttggaggatgtcacattttgaggtctagttcttggtcgttgtaatgtcttgtctattaattatgttttttcggaaagtttattaattatgttgtactaaggttgtgacttcttgttttatttatagacaataagctgaagaatgagtttgctatgagggaaattgcctctactgcaatctccacagaagccaagcgcacggtcatctctacggaagaggggaagagagaatatggtcccaaggcagcaacacctaatgatgcttgtggattcctggaaaggtaagatgatgatagaaaaaggtttgctagatgaacactaaaacgtaggatatttattttggaaaaaggacagaatataccattaaacttgttacctcttttatttgctatatttttccttttttttcacatgtgtgttatataattctctctgacttaaacaattcttgctttagaagcaaatacaaaagaagataacgagtagacaagtaataatgttgatcaaatgtttttcttgattagaaggaaccaatgggaaaagaaatgcaaaggcaaggataggataaagcagttaagaaactaattagcacaataaatgcctattattaagtagtttttgtgcaagtcatgctagttgccgaaggactttctggtattgatatgtttgttgatgtttgtttttctggtattgacatgtttgttgatgtttgttttgtagtggaatggagtacaatttgcctcatagccccttctcatctcctaccaaggcttccaatgttgcagcaacagctcacactagtaacatcagcagcagtagtagccctcataaggtggcctcatctctattcctcccaacatgcacccttgagctgccccctacaactcatgcttccttcaagcgccaaggtaaaatcccaaaccaaatctcttccctaaatcactgtacatttgcaattccatgttgcatttgcaattactgcagttatataagatagactattttgttgtatgtcttcagattctctccttgctgaggagtagttggtttataagactacacatagtaaaggagagggggcttcatctttgctgagtaagtatcagtaattccaacctttttggagtgaaacaggaatcaactagtcaatattatgtactatatataatctgcctcctgtccaagtcttgatgatcgtgttattggtttgttggtgttatgtgcagggaaagcattaacagatcatacataacgagaagaatgccgacaaagaaaggaaaaaaatttagcttgttttagctatagttcttgggtatatggtattactatagtaccagtctttcagctcggtgtcaagaacaaagtatcaacttgtatgctcttttaaaagtatgagacaatataataaaaatatatcgtagctcatgtagtaataacaaatactagcagtgtgaagtggcactgctacatatacaaacattgaagagagcagtatatcagcatctgctactaaccaactgtttctatttagataaaaatgcttcacgaattgcttgatacctgggtcgtagcttgtccagaggtggcagatgttccttcacgagtggcaagcccagaaaaccctccatccatgcagacagccaagggaacttgtcgctggtgatcagcctgacaccggtgatgtcctcatatatcggaatcacatacgacagagagcccagagacaagtcgacgaacccgatcctctctccaccaaagaatttattctcatggagcaccttttccagaaccagcagctgctccatggcaacttcctatgcgtcctcctgctccttgccttgtgtggtgaaccacttccaaatcggaggtgacagctgcaattgtggatcaatgattacttgaaagtttagacttgcgaaaataaacaaaaaaaatcgctgaccttgtccagcccaaatttggaccagaaacgtgccatggcacgttcatagtgatcttcaggcaagatacggtggccggagtcagtggcggatccacaaaatcgattcgttggtgtcataacgtgtctatcggtgtcatattatgctaattatgcttagattatgatgttataacatatggataagcagttttgctataggttttgccaaaagtcatcggtgtcgcctgacaccgacctgagtactgtagatccgcccctggccggagtccttccaaacgtcatcgatgaactcgattatgacgtctgatggtttgccttgatagatcagcacagggaccttctgatgcacggggttgcactccagaagcaggttgcccttattcctcagatcttcttcgatgtcatactccacgtgtttgatccttagtgcccatatcactttgacaacgtaggggctcgaccatatgcccaacagcttcatcttctcagctccctcttctagttcttggtgatccatggttaagattgcagagcaatgctgtggagtgagggtttcagtttgattaatctgctacatagtgctaatggttttcttgtgaaggagattagtttcaaagtgtagctaactagctatgagttagctttggtagcttgattttgaagtactctgtctgcactctgcagtggcttcttgctttgacttttaagtaatatgtctgcatcatgttaagttccactctatccaaacctgaataaggcaataggtgtaaattccatcatttttattacagtattgagatatttgtttaaagatgtacaattaataaacttcaattggatgcgttgaacacttcataatctatctgctcataattcgtaatagtaactgccacttaaaatgagcaaagagcaaacaaaggagtcagacatgagcacaactatcttgcgcattacgattcagattaagagcaaaaaagttaaaagaaataacaagttcaggatatcagttccaggagattatatatatcaaaaccatactaattttctaaggtttatctaaaggaagaaaaataaaatggagtcactgggaatcagtgatgcatctcatttgcattttgcaatttgtaacttttcctctttcaatcttgataacatttggtcgacctccttcagccaacccggcaaaaaataaacgtcaatttacctacagttgcaaatgtgggttgcagcatatctgcttgatatagattctcaatagctactcaaggaaaagacaaagattcagaaatcatgaaatatatatgtttgatggcaaaactccatctttcagaaagtactgccaactgaaacttctaacaatccatcaagtggtcaaagatacacttcactaaatcaactttagttcttataaagggggcactctagggcttaaagtggttaagtgggtgtgccctataacaaaattcatcaaattaacacttgtaatttataatctgccaccgaattattgtcatacttgtaaaaaaaaaaagaagctaaaaacaagtaatatgaagaagatttcctgaagaccagacagtaagaagaaagcgaaatgtccaaatgttttgtttggtgagctattctcctcgtataataatatcacaaattcagctatctagttcaaaacttgagactggcaacctcttcagctatctcctgaagttccaatcctaaacccttcctgtacataccacagatatttcagctatcatttatcatctcaaaaaaatggatttatggagcaaaaagcttcaatcaaatgctaaattcctatgtgcataagataaaaatgtgtagttacactgcaccgactcgactccagaggacaagtgattagtacccaagtattttgaatttctgatacatgtagaatgaagtgcagaataactgcaaatatgtttgtttggttttttctattacctcgaggtggaagatgtgtgtcagccggcggccgtgccgacagcaccgccggtccacgccgaggatgtctggatgtgggctttctttacatgggctttgtgatgggcctggcccatcaccgtcagcttctccatccgtgcggcctctcttcccttcccttctccacacgaatcggacttcgggggttcttccgccgccgccgccccgccctcgccgccggcggcccggacgatgttgggccacctccggcgatcctcccaccgagtactcattgccaacctcgccgtctactcataagagcgattccttttcgctgttcctgtgctaaagccctttctctttttattccgcccctctttctttctccaaatctactagttgccggactactgcttgcctgcttgtgttcttgctccatttaccaacccagataatgtcatgatgcagccttgttttgactgtaggcacgccccaagtctgctcaacattctattatttgttttactgggcactagttgaactagtgaaaaacataggggtttttattgtctttcctctaattctccaagcagtgtgaacactttaagtaactaacccctaccctttggaggtcttcaagattctcacatcgacagattaatgtaacaagcactttgctaacggtagtttagcagtgtctgagagattagtctaacatgtttaagttgttattgatccaacatgcattcttaaactggagaataaatcaggagtttttagcctttctgtcactgtaatttcttgaagagattgcttcttgctacctttgagccattggctaattctattactaatctcactgctctctacattgtgcaggatacagagttcacaaattgaggtactattctcctttgtcctttccttcggacaacattttacacccattttacaaagtcatccttccatttatacacctgtttttagttcatagcaggctggtgtagcaaccataccaccagaaatttctctgcagatacaagtaatagagtttcaaatgatcgagggcatcaatcaaggagttgaaaccaagtcttgtgaaggtatgtacacaaagttaaaactgtatacttatctttgtgtgtctttcatccacaagtttttaactttatgggtatttcttagttgcttagtgtgccaaattggtccagttacatattcctgtcatccttatggagttttgggataattttctatttcttcacagttaatctacatcccatgttaccatggcacattcccttgtttatgttccaggttactcccctaaggcttaacattcaacccgtttcatttttctaatccaacagtttcactaagatttctgtcattacgatggttttgtttttgtctatattatgactcgtcttttgagactgctaaatggttgtttttagacaataggcatagactgctggatgtttcacagtcctagagttctaaaagatcgatgattgattattgaagaaattgtctttgtattgcaggatgatgttgcaatcatcgaacgcatacaaaacagtacaaaggaattgagacaaggcccagttgggaaaaatctgtcatcggcggagaaaaggaaatttcttgtcaacactgtacgtgcagctagttttccatattgtctggtttattgtttgactgcatcaagtctccacgataattaggtttataattgcttcctggtacacatcaaatctattttatttttatgagtacataaatctactaactactggaacttccaaattgtagctgcttgacctggaagattcaaaagaaggtgtttacagcactctggatgcttgggttgcctttgagcaggattttcctgtggcctcaataaagcaagcacttgtagctcttgaaaaggaggaacagtggcatagaatcgtccaggtttcggacattatgatttgcttgattttaatttaactttgtggatctaatttgaaaaggaggcttcgtttgtgcacccagaattaaataaatggctaactgcatggttaggtgataaaatggatgtcgagcaaaggacaagggaagactatcagaacatatgagcaattagtgtgtgcacttgagaaggataatagagcggatgaagcttgcagaatctgggagtttaagatagcccatgatctacaatcagttccatggcggttttgccgtcttatgttgggtatttactacagaaataataagctagatagacttgtcaaggtatggatctcaagcccttgtccatcaagtaattttttattgttgtattttaagttgatgatcctctgtagaagtttgatgggtcttgagtgatcaatgatgccgcttagtctcttacagattgcatagtatgataaaacctacttacgtggattacattacatttccctgtttttggtgatgatattagctcttcaagaatcttgaagcatgtggccgtaaacctccaagcaaagatatcgtacggaaagttgaagatgcatatgaaatgcttggtttagtggaggagaaaaaggaattgcttgagaaatacaaggatttgtttgacaagccatcgagtaatgacaaaaagaaaggccggcagttcaaaaaggttgagaagaacatcaagccggcttagacatgtgatgggacacgcctgcacctctaagcttagagcatagaacggaaacatctgaatagaaatctgccagtgaagttgttactctttcctttgggatgagaatctgattatcaacagttaagattagaagtatgcatggtagtgcagttaacattgttgtgagtcattttccttcgtccagatttgttgctgacagtgcatccatatataatgggatgagaacctaatctaatgcagcaagtaatagtatttgccgtatgccctctgattgtgaatacaccttgtgtttgttaactgatgcctcatgctcaatctctggccgcgatccttcatcagcacttagaaaaaagaaggcaaaatttgctacaggacatgcaaaaaacgtgtaattagctaggagacaccacaaaaacgtgccatggctgatggatactaaaaaaatcgtgtaattgactgtaggatactggtcatattattttattatttccagatcaaaagaggtgagatattttcctaaatgcccggattgtctcttctctttccttttctcattcgccgggaacgcgcgcggtggggcgaggtcggcgcgagctcgacggcgatagcgggcggcagacgcacagcgcaacggcgaggccggcggggccgccgccgacgacggcgaggtcgacgggcctggagcaggcggggcgctgagtgtccgctgaggagctcgcgccgaggagcgggacgaaagcgttgagtgagtcggtgttcgcggcgaaggcgctgagtgtccgcggcgaagacgacaacgacggcgagggcggtggcgcgtcgccaccaactccctctccggcagcagctcacgggccatcaacatctccctggacaagaggaaaactggccagctagtagctagcagcagccaagcacacgccggcgagctcgctccaccagtaagaagatggctgctagctagctccttcagacttgagagcttgagcaggcaacaatggtgagctccttcagacttcagacttcagagcttgagcaggtagcaaggaggcagctgcagccggcgaggggctcgatctggtctctaatttgcaagtcggcgcacgcacagacgcccgcttgtgcgtgccagcaggcagtccgtcgtcagtcacaggctcataggtgcgagccagcagacaggccgaccgccatcgaagccgccgccgccggacatatgtgggccgcaagccgagcggcgcggatgggcgcccatgcgacgtctaccacgcggaagcacctgcctccaacaccggcaatggcgatggatcaaatcgatggaat

SEQ ID NO: 81776 - DNA, 9154 bp, Oryza sativa
  unsure (1)..(9154): unsure at all n locations
agggtcttgaccgagagcaatcaggagtggagttgtgaagatatagaccgggagaaggatgactgcacaacagaagagaactagccatgagcgttgtagatagacacccaacatgtgatattgcttggcgccatatgattgtccacacaatgtttctaatgcgctcgccatgccaagctgcaatttacaacaatgtgcatatacggttaatttgtagtatatactgtttttatatgcatatcaatagatgacttatagtgcaaattaatatttagtaaaaagaagttttcataggagtgacttgtagtatggtctggttatgttttatttgtatattccgttcaaaaaatctaggtaaagacttttgctattgttgcacagctagtagacagaggtagtacaaactactttaattacagaagaaaaaaatatatatcagaagatccaacaagaatacacatgaaaaaagacccggcaaaaagaatacatgaggtagatgctatatactccttccgtccctaaatatttaatgccgttgacttttttaaacatgtttgaccgttcgtcttgtttaaaaacttttgtgaatattattaaaaaatttgagtagtagtagtatatttaacaatgaatcaaatgagaggaaaataattaataattacttattttttaaaataacataaacggtcaaacatatttaaaaaagtcaacggcgtcaagtatttagagacggagggagtactaattaatgtctggagagaaagccgtgcaagggaaggatggctaggtcaagagtctacttcaaagttttactagtaatttgaaaatccaaggaggcaaggtctcacatgattaattttcttcctgcagtatgtactatatccatttttttttaaaaaaaaaatcgagcctatagcttcttagctatagtacaacaatgctggacaagatcgaacactctgttttgaacctataaagacagcaactgaacatccattgtttgtctcaattaatcgatgggcaaattaaagcacaacaaaaaacttccagcgcgcgcggcgctgttagtctctgaatcggcacaattaagtcaaaacttaacgtcatcaaagtcagcttttagaaataaaaaacagctagttgccgaaaacacgaaacaggtaaaaagaaagatcaatttgaattgttacaacgtagtaataataatttaaacccaaaactgtgtaatgataactctgtaataataagtaaaaagggaatcagcggcatgacttaccaggatgccattgctgaagcgcatgaggacggtggagacgagggcgtagcggcgagctcggtacccccgatgtgtccgatgaacgcctggctgatgacggtgacgccgaaggaggagaagcgggcgcagatggaaggacccgccaccacccacagcttcttgttctcctccaccactcgccgcctcaccgatccaacctcttcttcctcctcgttgctcgccggcttaggctccagcagaggaaccgtcggcctctcatcatcctccgtcgtcctctccattgctactctgctctgatagctagctctccagtgcacaacaatggagatcgatggagttaataggagcaggaatatactttgagttgcagatattagtagctgtctgaattgaagaaggctgcagggagggaaaagaaagcatccatcgatgatgctcaggtctccccatctaccgtttaatggcggggccagagacgatcgagcgaggaagtacatgattggccctgtggttgctgcagatggtgggtaggtagggagggcagtgtgggaagaaattaataaacaattacacaagccctgttcttttctttaaaaaaaattggataaaattttggatactagtaacacgcttttcgtacgaaaactttctatacaaaagttactctaaaatatcaaattaattatttttttaataattaaaacttaattaatcatacattaatactatcttattttacgtaaaatacttaattatctcatccaacgatgccaaccaatgcgtcccggaaaaaggagatcacgggaaggaaaacgttacatcattgcatggagacaccatcgacatcgagtcgccgtctcgtgtcggccatcgatgaacttttttttcgaacctttttattttttaaaatttaaaaatgaactcttacaaaatttaattttaaaactagaccttttaatggtactggctggtctgatgtggcgaaataatattgtcaagtcaaatgaggatgaacatgatagtttatgatagtttagtttcgttatgccagccggggtggcgtggttaaaagttttaaattttaaaaataagttttgggatgtttatttaaaatttaaacacaaaaaaggttaataataaaaaaaatggccatcctattcatcaattcatgccctgtgaccttgttctcgtcaacccatcggcagcacaccaccaccagctaactcacgatttaattcaacatcatggaatatagttcaattgcatcaaatcatatcttctgctatctagtagctgtgtgaattgaagaagggaaggctgcaaggaaaggaaagcatgatgctcgcgttttatatccgcacgttttctaaactgctagtatgtattcttaaaaaaaagttattttaaaaattatattaatttattttttaaatttaaaataattaataattaattaattatgtgtttgtgacttgttttgttttgcgcatattttcagtcctctctaatactcttctctctaacacaacctgctgtgagattgcccctaaattatatatggttctgcagatggcgggtaggtagggatgacagagggggaaattagttgtactaccttgtaagtatgattaggattctccgacaacgagtgatcaaattaacaggaattaacagttggatcgtgtggcaaggagggcaagcacgtgttctttgctccaacaaaaagttggactccaaccaaaagttggataaagattaagatttttatggcacgcttttcaaactgctaaacggtgcgttttgtgtgaaaactttctatatgaaagttgctctaaaatatcatattaatctatttttcaagtttttaataattaaaactcaatcaattatgcgttaatatcacctcattttatgtaaaaaaaaacataatttttatcttcatcttcacaagaaaagaacaccacctaatgtgctgtcaatgttttcttatcctactaaagctttctatacgtagtccattaatgggatgtttgcccggccnnncngcannntgnnnngatnnnnnnnnnccacccctacccccacgccccccccccctccgccacccgactccggagcagttttggtccaacgtggcacacacgtggtaatccagtcagcataaaaaaataaaaaatggtagggcacttatcagttctgcatcttttctaggtcaccacatgtggacccccgtttttataacaggaatcattcgtgtaaacattaccatttccctggatcaagtagtctggtacacacgagttcatagctgaaataccaaaagcacatacacgagagtctagtgctaattattacatcataagcccgcaggcattgtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaagcttcatctcccgcttctgattaattttatatttgcaagggtgagtaccaaccgtactcagcaagtcaccacagcaacaatgcatatgaaaggggtatttcaatggatggctatggctcttttgcgctaagccagttatgtaattcttttcacaaacctaagacctagcattgactgatcaaattttagtaccagtgtttgtatttaaataacgacggttctgtccaccatccattgtgatcccaaggatagcttcccgccattgagtcgtcatggttttctgaggacgtccaccttccctcctctcaggaagtggctccatcagcataaaaatcatcatgcaatatcccatcccacacaggttaagaatttagagtctagccaagtgtaatacacgtcccggtgcacaataaccgcgagcactgctaatcgaatagatttggtttactcacactgcagtggatgtacactttacccgcactccgcgactgcccaacacatgagcctcgtcccaacacatgagacgcgccacggcaaagccttttgataacctcgcattggcagtacccgctccatgaacttaaatcctcatgcactctaggcgtccatgtttctagcagtgagaggagttctggcgctcccaggaaagagaagtctcacacacatattaaattatggttcaagttaacttctctctctcacacactcatggcagtcctaccaatggcgacaccgatgtagggcacgcctctcggccctacctcaacggctgtcccaccgtagcgcacctgcctcactcaggggtgaaccatctatgcagtgatactgcctccgctcggctatctactccaataggtctatactcatacgagaagtgcggttgtacgggggtcgtttcatgcttaacttcatggctcggtccttaattgaccggggacgatactagccttttccagataccacccaaatcctccgtctgccccagtcgaaaacagttatttagtttatttctcctttcacaaatcatgtcctcaatatcatggcaatgtggcgctcatgtctccacatgccgcatctcaattaccttcccaaaggtaattgcccaagcatatagcatttgacaaatattagtatgcttgattctagaatagcatttctaagcatttgtcatagttgactagggactcatacgtaaacatggttatgaaggaataaggggtaaacaataatcaaggcatggcataatcgcaagtaggatgttcatctttgcatgcaattttatttgtaaacaaaaacaatttcgcaattgggatcaatatgttcaagaatagtgatgacttgccttgctcaaggtcttccgggtcttggccttcacccggatccgcggctccctcggtctctaaaattatgtgcgaaagaacaatttgaattcaattagaattcaaataaaatccaaataaatccaaatgaaagtcgaatgcgaaagtcaattcctttattttaactttattattcgcgaactaaggcaaacccaatttcgattcaaactattttgcgggtataaatattttgttgtcataagtttttaatttaatctacccgagcattatatccatataataggttagagatttctatcgcgagctaaatatcggacgaaatcctagaaatattatatgatttaatttagtctatgactaaatgattaaatataatacacggctaaaatccctagtaattaaatccgaatttctaccgtgaatcgattacttatagggattacccaaaaataatctataataatctataagaattcatctatttgtttagttattaattacatctaaattactaccgcgaattgattccttatagaaattaccaagaataatccataatttatattaaattttgcaattctacgactataattaatctataattaaattctaattattttaaattttctaaacttccctaatctccctctaatttcctatttatttccttttcctttttctccctttccttttttttctttcctttctttttcttttctttttctctttttctctcttttccttttcttttctttctctcctccctcccggcttctttctctcttcctcggcttctccctttctctctctctctctcggctccctgctacccggggcggcgacggcgaccgagcaaggggaggaggcggcggcttaccgacggcggtggcagcgacggcggcgcgacgacggcgcacggtgcatggcgcggcggcacgaaggcggcggtgcggcggcacgacggcggcgcaaggcggcgacgcacggcacggcggctccggggtgacggcacggcggcttcgaaggtggcggcgtggcggcacgacaacggcggcgcgtggagaaggggaagagggagaggaagggggagatggagtggggaaaatggggaggggtggagttttataggggagaggagggggaaagaaagagaagggaaggggcgacgcgacggcggcgcggcggcgcggggcgcgaggcggcgatgggatgcgcggcgacgggacgtcgacggcggcggcgacagcggcggcgcgcggctcggggcgggacgcgacgggcggcgacgcgacggtagcgcggcgcgacggcgacggggcgagacgacgggcgagcggcgatgggacgggcgggcggctcggggcacgaggcagcgcggcacggggcgcgtcgcggggtgatggggcggcgcgcggcgcggggcgcaaggccggctagggcggcgcagcagcgatggcgacggcgacaggcggcgatggcgacatcggcgcagcggcaggcgacggcgcgacgggacggtgacggcgacggcacggcagcggcggcgcggggctcggggcatggccaggcgcgtggcaaagaagggtctagggctaggtaccgaaatcgaacacctatgaggcaatgaaaagtgacttttcctatttatcccgattttagtgtattttccatataaatttgattccacaattcctaattttacatatgtgcattttactcaatatttgtgttatcttaactaatgaattcaccctagattaatattactcatattttatttttatataatttatttgagttttaattagggttaattcttattccatcgtatttaaatttaattgatccaaatatggtcgcgataatattttatttatttctatccacacctaatctttattttaaatttatatttattttaccaatttgtttttaaggtttattcctaattaactattctttactcacgattaataatcttcgagatcaaatccagataaaataggcgaataagatcggcatgatgcaattaatttaaaaaggtttttgaaaatctgtatttttagagttttgattttgtcggtcgaattttcagggtgttacagataatatggtgacctggtggagttcatggttggtgtcttcaatggggatgtggcagcgaagcaggaatccaagcccagtttcagtaggccaacatgcagctggagcaagactgtaagaggcggcatcccggtcgggtggcctgagatggatcagatggcgtcgcataggcactgtattgccgatgatggcgccggcgggctagggtgcacggtggtggcaacgaattgcattcagcggagcgatggttgctgggagaaagtcggggagaggagaagcgctatttcagggtggtgcagtgtgggaggttggtaacgatcgctatttttgtttttaatcggtggttacatgttgcggagcaggagattgctaattgtagggacggatttaactcgccacataagccattggatgaaaatatctaatggttaaaagagaattatgtacaatttagtggataaaactattacattttatatcagtatatctctactatattatacaaattgaagatgtttccgctggaattttgatacgtcattcgtgttggtttttcagtttgttgtacatcgtctatacacaattcgacgtaagtatagaataactattatacactctcctcctatctcaaccactcctcctcccagcccaccccaactggcccacaccattctatcagcccatcctgcgtgcctccactcagagccgcaggtgccactccccgtatcagtgtcttttttctttcctttttttcgttttcttttctcttgatcatcctgatcctctccctatccttccaatctcctctcttttctctccatgttctcttctttcctcttagttatctctttcaaatttctgttatcataaaaatttttgttttgatattatcaatatttaaggtatatgtggcaagtttgtaactttagaaatgtttttcatctatattaaaaaaaactttcactgattgaataatcaaaatttcaatctttggtcaatgaggtatagagaaatacgcatgcgtcaacttatggaatagccacccaacgatttgtgaggctatggaaatgtgtacaaaagagattctttgtgtgatgcatgaagcgagcgcaactaggttcaatgctatgtatgattcctgattttgttttgtttgtcttatttcggtttgtcgtttaaattagtggagtttttatcaatcatgaaaattatcttcacttgttgcagtattttttgctagtatacatatagatataaaattgattctttggtgcaaggttttgtgccaagcatgaaacgctatgattcgctttgtctcttaactctgaacgcgcaatacatttagcttgtagtaatatatgcttcttttattttactttcacactatctgaactcttagaaaaaaataattatgatacgattgtgtcaggtcaaatactcaaatgtgcaccagatgttcagtcttttacatacaagacatgcgtgctcatgacacacgaacacaaccgatgatttctatgatagtaattatatatagaaagctgctatatattcaaacgtacacaacttggagtctaggacaaagagcatggccacctcgatctattgatagctcgatccgttattaacatactacttatatatcatgatactcagttatactgtaataaccagcacacaaacatcgatcatacaaaaaacgatatcctaacttccaaagtagctagtacatcgatctcaatatcatttgtatatttctcgaagccgttttttgggtgacacagcttcaatagctgtacccaatggccaagccgcgtcaatgtagtactccccatgcttcaccttgtctaccagcgttatctccttacttggatgtagacctgacatcc

SEQ ID NO: 81777 - DNA, 7775 bp, Oryza sativa
aaaaaggaaaagttgtgcctaaagtgttttggataataaagtaagtaaaaaaaataattccaaatttttttttgaataagacgaattttcaaacagcgtaaataaaatgttaaaatctcttatattagaggacggagggagtatagacgtgttaatttggagtgttcaggggcgtacaatgtggagcccagtgagcagcgattgctgcgacggtgagctggagtggtcacgttgccgccggcggccagccggccggccaccgtgtgtcctgtttggttctcgccgttgcacggctatcacaccggcggcgcatgacaagtgagaaccgcgtgtagttttgtttaatcaccggctaaagagagccgcctaatccgattctgtgacgctggtggtgacctactaggctaccaccaccgacagcctctgcctggaatgaccagggtcggggattcccagagaccactgaccagtacgttcacctcatgatccaagtgaataatttcgaattcttcgtttcctactccctccgtccattttaatgcaattataagttttttattcaactttaattattcatcttattttaaaaaaattataattagtatttttttattagatgataaaacataaacaatactttactttacatatgacttatacttttaaattttttaaaataatttttaaataagttgaacgattaaagttggacacgaaaactatatctatatttaaaatgggatggagggaatatcttttccattatcactgctttttattaacggtcattatcactgctttaattgttgccttgcaagggaatgttttgctttcttatttatcgttagcacgttttctaatctcataaacaatactccctccgtttcatattataagacttgttagcattgactacatttatataaatgttaatgaatctactatgggtacgctggtacaaggatctacgtaatacgacatcaagtaggcagaaaacaaatattataccggttcaggccccttgataggtaatagccctaatccaattgatatgagattatatgatggaaaccacagattacaagggggatagtggaactcgacgataccgacgagatcgtagtcgagttgattcgactagatcacccggcgacttggctcctgtaggctccggcttcgtaggctgtggtggttgccttgattatgagattcgatgccttaggtcctcccggggggtcccttttatatcgcaggtcaactggtctccaagtaggactcggagacatcggacccagcacgatacaatgacgacccagttctgtccgagtaggactccttccatttgtgaactccatgatgaatttccttaacgtatgccaaaaatgtccgtatacgcatatgtataccatatcgatatgtgacgtatatcgaaaggtagagggtataccttacccgtaaccctgacagtagcccccgacttctgcttaaatgaactcgtgtaaccgatcgtgacttctgatgtcgaggttgttgttgttctcggtgtgaggaccgagggataaggagtgatcgacaacgccctgtgaagctcaatggtcatgagtgaatttaaattgaagtccaaaaaactactgcgcgtaatggacccagaaatttccggcggtaatctctctcctttccttggaattcgcaccatcggaagtgcgactatttaagggagttttgcggatccaatttgaagtccgccggttgtgaaaaaactctccagcctccaagcgtccctcgtcttctccgcttccgcaaaaaccctagctagctcgtctcggtcctttctccggcgaaccccggcggcaatggacctcgacaagtctacctccaccagtgcgtcgctgaagaagctataggaggatggcgctcttcccggtcgcgggaccatggagagagaagcaggaggtactgaaccccagcctgtcctgggtcgcatggttgcgatcgaggactatattctttatggttttcttcctccgccttctgaatttcttctcttggtcttgaatttctacagccttttcttgctccatttgaaccccaattccatcgccttcctcagtatcttttcgcatctttgtgaggcctacattggggtagagccgtttcttgacctcttccgtttttactatgagttgcgctggatggaaccaaaaaaggtgtccggatgtgtcggtttccgacttcgggatggcctgaagtcgcgatacatccccttccagtgcccttcatctcgcagcaaatggcgggggaggtggttctatcttcagatagaagattcggatccggtcttcattgtttctaaggagcaaccagccaagatttcatcttggactgccaaacccgccttgaccccatccctcaaatctttcgtcgatatcattgatgacctccgagaacgggggttgtcggggtatgaagtcactaccgacttcattggtaggcggatccagctgctctaggcttgagcccacccagcctttgactattctaggccggaggacgcgacccgggtttctcctcggggtattttttttgtagttgaattgactcccttatgtgcgtgttcctcctgacttatcgaattctggtctcgatctataggcttgaacagcgcaaccgtgaagcgtcgcgtcggccaattgatgatcagcggcccgacaacgacgagcaacgtccccgtccccctttgcgagaagggggcagtcgaacgcgaagctgccatcaatgtaagtgtactcagcggcccttttgcattttacttccgggatcacattgtgacttcatgaagcgtaggctctccctctgactgatatcatcgggccgctcgtggatcatcaggcggcggcgtcgctgaagggaggacgtcgccaagggaggcgctccgatgcttgctgtccgctggctggccatcaacgaggtgggtgaggcaacgcctcacctggatagggcgctctggtgcaggggaacgcttctcacgcacaaggggtgctccagggcgtttcgcaaggtggggcataccttcgctccctgcggggaccgacccaaccggtgccccgcgtgggcctttacgcgaattccccaaaatttcccgggcttccgatgattgtgccttgcggtacacgtgtcgaacctcgatcccatcgaaccttttttccagtttcctgacttctgcgagatacgtagataactcggggctagagcacttgtaatctttatgcacctggttcgtgactagttcggaatcccctttcacgactagtcgcttgactccgagtgcagctgcagctcttatcccggtgagtagtccttcgtattcggctgtgttattggtcgccctgaagttgaggtgaattgcatgcttgaattgatctcccgaaggtgacgtcaagatgaatcatgtccctgctccttggctgttgagtgcgccgtcgaacaccattgtccacgtttcgttgttgatttggttgtctgacctattatcaggcatagtccaatcggctacgaagtcggcgagtacctgggacttgatggttgttcgtggcacaaagtggacatcaaactggcttagctcgactacccattttgcaatgcggccgacaacgtctttgtttctcacgacttcaccgagagggaaggaggatacaactgtgaccttgtgggcttggaagtagtggcgtagctttcttgatgtcatgattaccgcgtagagcagttttcggatctgtgtatatcttgtctttgcgtcgtggagagcttcgctgacgtagtagactggtcgttgcaccttctctctctcgacaacaatgacagtgctaacggaatatggcgtggcggcgatatagagaaataattcttcattaggttggggggcaacaagtacaggtggatttgataggtagcgcttgagtgcaatgaatgcctcttcggcttcctgtgtccatacaaatttgtcttgcttcttcagcagagcgaagaaaggttgtcctcactctctcacctagcgatgaacttgcttagtgccgccatgcatccggttagcttctgtacttcctttagtcttgtaggcgacttcatgttttcgattgccttgatcttttcgggatttgcttctattcctctgccagagacgaggaaaccgagcagcttgcccaatggtactccgaacgtgcacttctctggattgagcatgaggcgatatcgtcggaggttgccgaaaacatctgtatacgcgtatgtataccatatcgatatgtgacgtatatcgaagggtagagggtataccttacccgtaaccctgacaatatgaaacgaaggaagtacatattttagaatatatatatatatatatatatatatatatatatatatatatatatgaaggttttttggaaaataaataaatatatttttcaagtgtataacatttattactcaattaatcatatcctaattacttccatccgaaaggctaaagcaatttgcagcctaagtcaaagctaaaatttaaaattttaaacttaattttaaattattataggtgctttttaattttaatttctgaacttaatttgaaatcactaattgtagaaatacaaaagtcgtatccaaaattatgtttcgttgccgctattaggcgaatccaataaacgtaaccctatatattctgaaaatatctttaaatatactacctctgtttcaaattgcaagttattttaacttttttaagtcaattaaatttatagaaaatttacctctgttttaaattacaagttattttaacttttttaagtcaatcctctttagatttgattaaatttatagaaaattatagcaatgttttcaaccaaaaaaaaaactatcagaagctagacgtaatgaaataaatttagtgctatacgtattgttatatattttacaatcttgataaaaaataaatgacctagcacttcccaactcacttatttctattgtgcgcgcatgctttttaaattgctaaacgatactttttttttgcaaaataaatccttataagaaagttgctttaaaaatatattgatatttttttaaaaaataactaatatataattaattatgtgctaattaaccgttccattttccgtggtgcacagcccttataatataaaagagggagtacataataaaaatttaaaaaagactcgttatttggagaaaaaaaatggttgagatgccgtggaaagcggcaggtaggctgaccgcgtgcggtgaaccgactcgagtcgagagagggtgcctcgaaatgcacgttgatataaacagcccgcagcgaaaccaccccaaaaaaccaaaaacccaccacccccacgcggtgccactgccaccgcccctcgccgctgacgaccgccgccgccgccgccgcacggacattccgcacacgcccgcggggggcgggcggcgccgcgtcgctgatccaacgcgagcacgttcgtcgtccatccatcctcccgctcggatttggagtcggcaaccgctcgggctcgcgtcgcggcaactgaagcggcgaaattgcaacaggcacaggcaggtgaggtgaggagcattctgatatattattatttttttttgcccccaccacctccgccgttccgcttccccggcccgaatcatcatcccccaatctagttcgtgtgcgctgttgtgcggtgtgggatttcgcggtgtcgtattggattcgatattgggttggttggttggcctcgtttgctgttttgattgttgattttcttctcctctaataactgcacgcgctgatcgtttctgtacctgcgacatggatgagatgtccgcatttttttttgttcgtaattggggaggggaagctagccgtatagccgattgttagtatgttttgatccgcatttgcgcattgatcggagatgatagttttctcatgtcacctttctgtttttttttcctttacttctttcgcgcatatgattggcttgaattctcctgcactagcggttacctgataaaaaaaaattctgcgcgtacggagcatcggaatgtgaatttggggaccatcggtggcatccgaaatttgtcaatatatatacactagtatgtgttaatcttgaacttttacatggtgaattgctctagccatttgctccatccatccaaagtagtatcactgcacttgcctagtatttagctgcttcgtgtggtgattggtgaatgtgggcaatgactaggaggacttggggttatttggtatggaatccagtactggatagctcactgtcactggtggccagtatgcatattcatcatggattgtggttagctttttccaaatctgcggcttgtcagatctgcctgtattatagttattgtacagctttatgtctggggctctttcgcgccgttgggacctcaaattctccaatgcaatccaagtcgcatgatggtccaagaccagcgtgccccactgccatgtgcttaacaaccaccttcttcctgagatcgactggacaaggaagcataattgtactgaattctcgtgttattacgtcggtttaaggtgaaaaatcttgcttgagatgcttctttaaggtggagattctgcttagctgtacagctgttgagacaagctggagatcagttattcatttgatgtcctatcacttgttcaatgttatgaagttatgaacatgggcttcttagcgttttactctgggtgcagtgtaagttatttatcttctctgaacttgtactgcacttgtagtacattttcttgatctcttcagttaaagcaatttatgtacaagctgttttgtgcgtgactttttcctgtcataatcattatgttgcagggtcggaccacccttgaaagctcttttgctatcttgctcattgacctgatcaagttgctagacctttgctcttgttactaactttcttggtgttatatacaggtatcaagtttctagtgcactaaacaacctttgagatgggtactgtagagaatatggaagggagagaagagcgttcgactgatgtggaacgggatggtaaacaaggaaaagaagttgaatcggactatgaaccagctagagactctgtttcatctcagggtgaggctaacagcaatgaagataccagagccaaaagagtctcaagggttccaaagaagctagtgaagaaagattcaaaggaaaacagcccacgctcaggcagaattaattccaatcgccaagtgcagactaagctgcaatatatatcgtcaaacaatttgcagagcaaatctccaaagccaaacaaaacatctgatggtgctaaaaccattgagataacaaagccagatacagtgacagttccttcttgtccttcatctgaggtgtctgaggagatggatgataaacccattgagaatatagtgacggatgataaatccattgaggatgtagctgatgataaggccactgagggcacggcctcttatgataaggccactgaaggaaaagctgctgatgatacgaccgttgaggacaacaccactgatgaaaggagcattgagagtggcactgatgataggaccattgcgggtatagcagctgatgttaaatctagtgaagaggcaaaggagattgatatattggatgaagccccaaattgtgatcagagtactgctactgacgaggaaatagctgatactgaagaaagcatagcttatgatggtaaat

SEQ ID NO: 81778 - DNA, 13871 bp, Oryza sativa
ggatctcccaccgtggtccacctcgcgtcgattccttcgggattcttgatctacataagttgatgaaagctcgtgccaaatggcttcacttggcacgaacccggggaacctggttgacaagcaaagacgaagcagcggcgtccagagcgcgacggtgttccgagttacgcggtcgcgttcccggagatcggctgcactaaaagaggcgttcttggtggccgttagaaacggcattcagagggaattacagaacgcttattgaacggaaatggagctcaccggattgcgacggcgtcgaggacttctctcaccggcgccggagttggcacccccgttcccggcgaatccgaggcggggtacctcggttcttccgcgaaacgagacaggggcgagagagagtgagagttggtcggccggtcgggttaagtacggtcgccggcggagatggggaggaggagctcgccctcttccgcgctcaacgcgtgctcacacgcgtggcgcgcggggtctgagtcgtgggcccgtgtggagagggatgtgaggctgacaatggggtcccactaggcaagagagaggtgtagaaggaggaagtgttggacagggctgaacctagcctaaggcactgacaagtggggccaactcgatggaaactaggccagggagagagatatgggtagaagaccggtaaacttgatttttagattaattttcggaattattttctcctctaactttgtaactacataattcaatgtgtggaccaaattaattagtgctgattttactggaggtaaatgattacacctagattccattttatttggttgcactcaaaaataatgggtggactgctcacaaaaaataaacaaagatgggctattagaaagctagattgaatttttaggaggcttaaacagagaaggaaaattctagaaaaattacatttattcatgataactaatctagtatttgaataaattattttccatgttcacttatgtgcagttaaatgtacttttggatgaaatatggttttagccgattaaaatttaatttgatttcttttagttgtctgcttcgaccgattaatttgagatatcaacttgagtgttaacacgttaccaaattacggaggataagtttgtgctaatcattgtccacattaatttttccatgattttatcttgcacaaaatattttagagaattaagttgacctttatttgtatatgtgttcccacttcataattgcatctaatattattatagggattacattaaacttcttttagactgagaagatgatatttgagtttaatattaagtccacatgttatcacccaagattaacagattaactataggtttgtttagtgaagtaattcttttagattatgctcatgggacctattatggaatgcaagaccaaaactccaaatgcacaaagaactcgagcctaggcatgcattatgtacatgtatgcttgatgacatttctagtctaatgttgggaatgaaaagattttattttgttctcaaattttaatcatgcaatggattaagttggtcatcacctaaattaaaacggaaatttttggctctcaaaatttggagaagttaacctctaactagtttgacaagaaattttaagtcctaaaatttcgggtatgttacacaaatatgattatcgataaaatgaaagattgcccatgctgagtgagatacagattttgtattgcgcttttgacttttgatgttggtagttgtagatgtagggattcagttgatagttagccatagaactcgaacttgccatataccacgtgggatagccgtgtgcagtgcaatcatgcgttgcaatttgtcagtcacaatcactgggatgcatatgtgtggaataacttgaagaaaagacagattcaaggaggttacatagcctagatttgatttataaggacaatctccagagaatagcattgcttgggataagtaatggtcaatttcgcttaactgaaagaatagtattgttttagctgcatgattttttttgaaaagggcgtctaattattaaggacaaacaaagaagattacctttttgccttctgtactacaaggtttcgacagagaaaatgtgttttcttccagcacactaacatgatcagccaatgatgctatgagatttagatgagtcctcaagtcagctttcatttctgcatgttgttcctggatgccagtcagttttttctgcagttacctttttgccaattatttctattggattatgtatagtttatgtgacagtatttgttacccgagagcccagtcaggggttattttctcgatagtggcagggctcttgtagatcaactagaggggaacgcgcgctttgcgggctgcaccattggtgccattagagagaatcagtagacataagttctggtaggtagctaaaacaatgttctttgtaagttcagtgaaggacatgtataagtataacgatatgttgtatgcaaattgtggacagtaagtacataacaaaacctgccatttgtttgattacaggataggcagtacatggtagctttatagcagtagcattgcaacagttctgctagatgagcacatacaactacattacagatggctaaattctaatgtggtttggatgcttttgcattaattgccctttcccccatgaattcagaggattgcattactgctttactgcaagggccttcttgttgatgtgcaaacggaaggcacacatttttttttactacgatgaattgcttccacttatgcatagttactcgagaagtgctgcaaaaatacaatttttgtgtcaatactgggagtcaacaatcttgtggcattgaactactcaacaatattagtcctctcctaattttcttttcctgaatgtgaataaaataagttaatggagttatttttgtggcatatgttaaattgtaaggatgaatgcagtagtggtgtaatatgtgaattaacctaaggagcaccagcaggtactataccaattttagaccaatataaggaaatcaatcaaacatctcaatgacagggaaacacaaaaaggttttcaaaaccgaagtaatgatttatccatactaaaaacacaacaaacatgtaagcaacctaaattgttctcttagtaattttctcataatcatgaaagtgaaccaaataatttattcaagaacatatttatccagcaaataaagttgaaatggacaggattgtaaatgtcaatctatcaagttaaactattggttttgggttgtgcatcttttacatagattataggtatgcgattttaatacttaatacattgcaagcacaacatttttgtgagcagatactatcagtatgtttaaaggaatatcatgaaagttcaagctagtcaaatacataatttggttacaagggcaacactcaacgtcaactgaagctttatggtagcacgacatgttggttacctattgttgaccacctgaaatgatgatgagcagaaacaaaccaactctgcttccaccaattcctacacctataaaaaaagtaaattacttatgaaaagatcacatcatttagtatgtgtccaaattgtccagcacactatcgcacagcctatagcttaacaatatgtcacttacttaaaaagcaagctgccctgctgaaagctcagaatgagaaatggcactcagcagcagcaccaatagaatgttaaaaagagttaatatataagcaaaggcctaatcaaagtgcaaaattagcccatttggaaatgggctgaacaaataacttgtactatataaaataaatatgtagtttgttcgaaaggggaaaaaattgtcttgcaagcaactgtgccactgtcctagccatcatataaactacatcatactatgttttcaacttaatttgtagaaaagcagggacaggtaagcaaagcttttgctttaaagtcgcaatggacagattgattaattgtatacttgtttcaccagagagaaccagtagctaataatagaggttatatcttaaaaacttcatatagctagcttgtcttaaaaataattacatagtattttacaaacttttgaatgatattttcaattttaccttgaattaagggaggtagaggtaaaaaatagtactaaatagttggtggaaaacatatactccagatgaagggctatattaaatcttttgaagattgcttttgttccctttcctccaggctgctttttgtcctaataagatgcaatacaacaaacatgtggagtgcagtgtaagtgatagggaaatgattcattggcaagagaagggagaagagtgcataactgtatatcgtttgccatcagctatgtccaaatatgccagattggggcgatccatccctgcagctcttcaagcgaagaaccataaaattagtttaacagtgggcctataaaacgtaatctggtagttttcttctgtcaggctagcaacacattttatgataaatagactctacaaccccagaaataaacactccatatattaacgggcatatttaagaaaaaagaacattggaaaatccatttgttgttttaaatttcctgatgtctattaatatgggttttcatcctttgatgaacaaaagcacattagtccatcatggatttagagccaaaccacttccaagaacattttaggtgggcatatttgcaattgaatgaacacacaaaccctatagtgttttgttcttatgtatttacaaatacaattttggtcaaatttatacaatgaagcaagcataagaaagcaacaagaggcaagcacatgcaccttgtcaattgtggaggccttcttggagttgaaggtggacgtgcaagtgtggaggcaaagtggaaggacagcttgaagccaaccgctggtccacgattttctggaagtaccgctgcggtggatggaggcatccttgctctgccctgaactccctctccttttttactcttccatagctattagctgctgcgaaggaagcaattccataaacacatagctgctaccaatgaaaatattgttcagcaaaggatgaaaacagatagactacttaggaatttattgaacagtttcaaatatcacaccatatgatgagctaacaaaatagtaataatcaatcatcactaggtttagcaaaaagaaatttagctgcgaacttctgttccaattatttttctatattttcatgcaaatttagaaggaattgtattaattgcaccaaaaatagtcaatgatctgaaatcaggaaagatctacacatatacaaagcaaacctgaagacatttttttatcaagagtgcagcatcatttttttctagatggaagggtcggattaaatttaaaacggaagtgcagtatcacacagctggaagagtgacaagcatgattagtgccgcgccaacatcgagaatcagatttaacaaatactttccaccaaacatacgcagctcgaccactcgctggttggccctgcatacacctctgctgttgtactattaaatgaactcgccatccattcctaggaccagagtgggtagccatacagccatgttgaccacgagttaaaacatttagatcaaactgacaggtgacatttaggagctaatgcatctaagaactactttagttctaacttaattggtaaaaaatttaatcactcaccatattatctgaacataaaaaattgacacaaaacactaaaaccagaacttcagtcctatatttcaactgtattatcagcattgaatgaataaaatgtagtatgtacactgctagtaaatggataagaggagcactttttagtggctcctggttgttctaatggaatatagcttatagttctcagtaatggaaataaaaaattctgagtaattgaaaatccaagcaaatttaacacttgaaccacgtcaaggaaagaaaaggatacagaaacagatatatacctatgcaagatccccaaagcactttttgtaactttgcatgattaatctattgacaaatgcaatgcaggactttattcactatcacattagtaagataaaggaataaattgaatcactactggtcgtgaattggaagcccagcctgggcatagtaatacatattcgagaacaaaagatgcacaataaatttgaagttttcaaatttgaattgaatgacatctcagcaaatgtactacatccactacatagtagtctagcagtaattttcctcaaaagtaaggtacacatcattgaataaaaattgcttcctgaatttagagaaagatttcatgaacaaatgaaggtaatagacaacatggcttggttacaatgtgatctaggcatactacaaacaataaacagagagctctagactttgtgttggcctacggtatctgcagtagctagcttcaagttcttttcaacagaattatcctggtaaaatggttgtacagataatatagttactccctccatcccataatataacgcatggttaaagttgacacggtctccaaaactaatctttagcttataatttctcatatactataaggtttgtagccacaaaattataaccatatgaaagtaaatgtaaatctcaatctaatgatataatttttaacaaataaaatacatttcatattatactaaatggtggtcaaatgttttaaagtttaaatcttgaaatgcgcgcgcgccttatattatgggatggagggagtaccattttgtatggagcctaactcttatataattcaacataatgaaaaaactaaaattaaatgaaatcaccatgcaactttgagaacttaatcaataatgcatacttgtacactatgttcgtcaagcatttcattgagtatatgatatacacaagcatgtgtagaacatgagtgtccggttaacttaccttctatttcaaagagttctacacaagcgattgtaaccaagatcgagatcaaaccatcttgcctgtaagactgtaaagaaaataaaagcttttgaacaaaaaggagaagaaagatgtattacctatcattctaacaagggtcgtccgggtgggtgcacggcacttaatggcgccttggatgcgctctgcgagccgaggcgctgagctgccgtgaggaagagggtttgcagcctatgcccttcagccccgtaggcctgtgtcctctcgtcccttcatgaattcaccggctgctcagctcagctcatggagcatgggcacataatgtctctctctcggatcatcgtcttcaaaacctgtgttcgctacaggacgatgggattgggaacatgcagcgcagggaagaagtactctattaacgcgggattatgtaagtactagttatttttttaaaaaaaatagatcaatatgatttttttaaacaactttcatatataaacttttttaaaaaaaacacaccgtttaacagtttcaaaagtgtacgcgtggaaaacaatttttcatggcgttaccctgtaattttcactaggacccatacgcgaaaactgccagcaaaaacatatctaggggtgggaggccatggaccaccagcgaaaaccgatttttgctggcgaccacgctaagatgtccgccataaataaaaaactctattttttcgagcggacctcttaagtgtccgccagcgatcgctggtggtaggtaataaagaccgctaaaaaattttttgaggcgaataaaatccaccgcgcgcccaccgcctagtccatcctcgtccttatcccttctcgcagtctctcttcctctctcccttctcgcggtctttctccgcctctctcccttctccgtctctcctccctcccttctccaccgccgctagctcgtcgccaccccaccaacgccggctgccgtcgcctcagctccaccgccgcatatcgataaccgctagcgaagatcgatatttccctggccttttctttgtggcggctgcaatttccgctaggaaaaacctaaaatagccgccacaaaagatgattttcgtagcagtggagtgttgggaacttgctcttgcaaacacacggagtttctataagaaattgatctgtgttgtatatatatatttttaaagtggccaggggtttgtagtttagtttcgattatccccaaggataaagataaattagcgacaatgaatctaaatcaacatcccagcgccatttgtcactaaaaaactatgaggaaatggtttaattagaataaaaatccttggccaagaaataaatctaatagtattgccacactcaggaaaaattataaatctaatagtgaaaagcaaggcctcacatggaaattacaccgccagacaggccgaacactactacacagaaggttttctcgtgcggtcgaacggattttcgcgtgcggagcttcggcccgtctcgagcagttcgtctataaaaatcgttatttgtgcgtgcgggcggcgcaactgcacggaaaaataaaaaatcaaaataaaatcgaaaaaacgaaaccctaaccctagccgttgccgccttcccgtcatcgtcgccgtcgtcttcccgtagttgccgtcgccttcttgttgtcatcgctgttgtcggagggctgccgcccccatcacgccgccggatccgcgcggggggtggccgccgccgccggatccacgcagggggcggccgccgccgccttcgcgacgccagatccgcgcaaggcctccgccgccggatccgcgcggggggcggctgccatcgcctacgcccgccgcacgccgtcgtcgccttcgccgcgggctgccgccgtcgccgtcgacgcaggccgccgccctcgcctacacccgccgccatcaccgtcatcgtcgccttcgccgcgggcagccgccgtcgccgtcgccacaggccgccgccctacatccgtcacgtgaggagaggagagaggagtgaggagaggattggaagggcacgcatgaggagaggataggagaaagagcactgagagaataaaggagaggaatgggaccgaggcgtggaaaaaggaaaattttgaagtgggtaggagggaaagaagggatgattatttttccgtgcagctctcttaataggcccgcacggaaaaattggtttatttttctgtgtggttcatttaggaggaccacacgggaaaatcgattttcccgtgcgggtgatagcccgacacccggtcccctatttttccgtgcggttccacttacgaaccgcatggaaacaaaaggggacggcgtccagaaaaatcaatcctctagtaatggaagagccgcccatttgcacatgtgattttcgtaaaagaagagcatgtggaaatcaatttcataggtggttttcataaccgagaaaaaaaaagatacatcttacgaaggggtctaataacaaattaacaaattaaatccggtttcctcatgcctaaaagagcaactgttagcctctgagctatgatgcgaaggggtctaattacggaggggtctaataacaaattaacaatttaatttcatatattgatttagtttgtagcatcatagttattagaccgtaaatgatagtaaattaaatcaacaaattaaatccggtttcctcatgcccaaaagagcaactgcgagcctctgagctctgcggtcccctccccaatcttccccattcttccccaatccggtttccattggtcatcaccatccgcgcgattcgcacaggcttggagctcgccggccgcgctaccgagtccggcctccaacgaggaagggatgaagccagaggacgggaggaagagaagtgcgacggcagtggcgaggaaatgtcgtccgtcggtcccaaagcgaggaggacgaccacgccgagcgtgggaggagaggagagtcgggatcaccgccgtatcgccgccgtcgtcgagttgtcgtcatcgacgcccaccagatctgcgctgctgtcgtcgattcggtcggtccggcaccgccgcctctgccgtctcagcctcctcgaccgccgccgctccggatccaggccgtcgcgttggcctcctcatccaccgccgctcaagatccacgccgtcaccatggtctcctcgacatccgggcggcgctggtgttcgtcgtcgaggtgggggagagaccggcagcagtggagttcgtcgccgatgtggggagaggccggaggcggcggcggcgccggtggagctcgccgaggttgggtgggtggggaaagtggagaggggttgtgcttgtgcgattgtgtgggggtgcctgggtagcaaggtagggttgagattttgtatattttctccaccgtaaagtgttaactgtaaaatttatacttgtttataaattgaaaaaagtattagggctgaaatcaaaagtgataggggctgaaacgaaaaatcgaaggcacccatgagaccatttgcaatgtggggaaccaaaatttggatacggtgctttttagcctatgtggcattttagggcccatttgatttggaggaaaaacatagaaattgtagagaatttcaatcctatagtaaaatttcctatgaagccctttgaaacaaaggattgaattctatccaatcctttaaaattcctatggaatggacaattctataaagattttggaggaaatttagcaagagcttcaacctcttgctaactttcctttgagtctatctctctcatccaattcctgtgtttttcctgtgattcaatcaaacggtcatttctgtgtttttcctgcgttttacaatcctctattttacacttacattcctatcaaaatcctgcgttttttctattcctatattttctcaatcctgcgatttaaaggggccttagtttcctcgagtgggtagcttgcattgctactacccttattgcgctccagaacccataccggactgctccagtgaaccggtgccagcgttgttctctctgcaggcggctgcagcgacgtcttcgtccttgctgtcccagccagagctacaccgcgctagcctctgcccgtcaccatggcgctgtttacttcacgaaaaagaaattttttagatatcacgtttgaccgaatgtcagaagatgtttttttttatacgaatgaaaaaactaattctataactcgtctggaaatgacgagaagacgaatcttttgagcctaattaatccgtcattagcacatgtaaattactatagcatttatggttaattatagactaattagtctcaaaagatacatgaaacgaagaagaacggcaacaacttctcctgtgcctcgagtcctcgacaattgcagtcaccggccagaccccagtggatagccgcggtggtgatactccggtctgatttacaatcttgctatgggctgtctacgacgcatcgggaagctcctgatcactctaaacctggccggaggaggaagacacagcgggctgaatccaatcgttaacacgtgaatgaatggccgaggaatttccgatgacgtggcccatggaaggtcaagagatgcccgactccaaggtcaggttttgtcttatagagatagtggcccccatcaatggatcaacacgttatcagtcacttgctttccgctgagcgtacataacagaatagagcacgaaggcctaacgcaaatcgcaagggtaagaacggacctctcgccaacaaccattattggtacactacacgtcatcgccgtggcctctacttccgaagcaaaattgcccctccctctctcatttttaggggtggacaaaaaaaaccaaaccgaaaaaccgaaccgaactaattgggaccgagaccgaaaaattcggtcacaaattcggtcatcaattgtaactaaccgaattttatatggtcttttcggtcatttagttcggttaaccgaaataactgaactgaccgaatcactgtgaaagcccaacaccagccaatagcccattagctagaaaaccctaaccttccttcccacaccacacgatccttcccacttcccagtccccacatgcgccgcctctttctcgatctttctcctcctcctccccgcctcttctccgctttctcctcctcgcacgcgcctctccgccttcttctcgcgccgcgccaccgcctacctcgcaccgcgcctctccgcagaacttgcgccgtgccaccttctcctcctcgcgctgtgtcgccaccctctccccacacgtctgcgcgctcgcgacctcctcctcgcgctgtgtcgccgccctctccccacacgtctgcgcgcccacgacctgaggcctcgatgatggaaggctgatgggagacgcgagatggatgggatctggagttctggaccgtggagtggttgagatcgacgggatcaatggctagatggattttcttgatttgattttttttccatgaatcatgctctacttgctacttgctggtggcatcatcatattttagtccttcttcccaattgctttttcatcgatcttgtgcagagtattcttttttgggaattgctacacagctgccggctgaaaaaatttgttttatcagctgaattagagagcgttcgatttttctttttttttgcctggtttttttcatctggttttttacggacgatggaagcacctcttattttttaagtagtatacatatatatatatatatatatatatatatatatatatatatatatatatatatattattcattgtgttaagctaacaattaggtgaagagatgtcctataagattgatcaatataaaagcaaataatcgttccatatctctacattaaatgagagttgaaggtcatgaagatctagaatagcaaggtactgttagtgatcaaaagctaattttctttggtttttatttaatgggtttcgctacaattgtttttgccatgctactctggtgtgcacatttctcggtaagttagttcttactaagaaatgacccatagaccggttttctaccttggaagtggaattcgagggtcgctacaaaatctatgaaattggagactgataaaataagctagacaaaccaatagatctatacaaacgtgatgaaaataacaaatatatctaaaacaactgtacggttagagaaatatgaacttagccagaatatcggactcaaccgagaaggtcctaactaagccgataggaccctaaattgtgatacagttaaagatagaaatactatatcagataggcaacacttgagtcaacttgaatagaatatcagacttaactgaggaagttctagccacgccgatacaagcgaagttgacagaacttacttcctcgctagagattgaacttaaccaatgcagtcctactcgaaactaagaactcgcagggataaaaggtggcgatacgctgaaagtaattgtattgatcgatctatgaagatagattacacagatcctgggtgtacatatttatacccttgggttgatactagtcccgaccgaacaagatacaagtttcctaaagataaaagagaaaagatattagtcccgatgaataaaagttaaataaaagttactaaatcctgtcttatcctataatactatacaagtgatccccacttagtgtagttattaggattttgctgagttctagtgaagccacgtcactctttaatcccaaccgttcgatcgcgctgcaaacggtccgatccgttctatcctaccctaaccgctctgccttccttctccaccgagcgtagattctccgccgccgccgccgggcatactcctctccccacgcgcgtgactcctcccttccccaccagcccgcgctcgcttcctcccacatcgcgcgcaccaggcgtgg

SEQ ID NO: 81779 - DNA, 51473 bp, Oryza sativa
ttactgttccattatccatgcagaaatgagaggcaggaaaaaggtgagcaaggaaaaaagaaaggcaggcagtgtggctccctctgcttttgttggtgagccaacaagagacaaaaacatggccacactttggagagtttgggagggtggtctctcacggcataaagtcctaaaaaaggagggaataggaggtgatacggttgggtttgacaccggctgggcagccaagaagcagccactagtcctcccagacctggccaggagggtcttcatcaagaggttgaccctgccacttggatgatgacacaatcagttccaacatttcgttcatagttgattataaactaaaatgcttattagacatataaattaattataggtaaaacttttatatatgtgggttcttcacgatctaaaagcaaacgctgaaaaaaattatgataacaaaatataaaaagacaacttaaaatataaattttgattgggacggataagtaaaaacaaacattagggatagataataataggacataatgctacactagtatttcttatgcagttttatacagagttagattttaaaagtagaaatagatttgatgcgtaacccttactctctttatatacacaatttattttctatacaacattattgatcaacctacatcattactagatttaccacggccaacgtgtgtatgtctctctgatttttgtcaagtaacatatgatgtttttatgcttctatagtgaaaatgggggctctttttagcgtgctctctctctctctctctctctccatagtacatcatatattgtgacttgattcctgttctctttttttttaagtcggtgattattcccatccgtcttggcatataaaacctggcgtgttaacacactcccatgtagcaagtgtcagcagcatgtgtttttgagatatgtcaaatatgaatggaataggttcaatttggcatgcaagataaggtaatatgcatgtttgaagtcggtatatgttcatcctatattatacagcctgttttggaaaaagttgccatgtttatttttagttcgctgtagatcgtatacttttttactctgtttccactttcttgaaggatttttttttagatgcactttcttgtagcagttagaaagcttcatgtaaattttacataggtagaaattgtattcggatgttgccaagctaagatcgaagacccttgtatcatccatgaactaacgttgacatgtttgtttgttcgataaacccaatcttcaaaggtgctcataaggatatggaaagatgtattcaagggtaagagcgctcgcgtatatatgaatgcccgcacttgtaatatatttagaaaatgtattattatgggcatgtactaaacaataattctctttatgaatctattctcgagaataggcgtatcaagaatcgtgtgctctaatattgataaagtgatgaaccatatccgaggatgctattcctcgagaatccaacggcagtaaaaggtcccccaatgcatggagtcatggagtgtatgtgcgtttgtacataaaatggcataattatcgtgataaggatctcttgatggcataaggtatctttgatcaaacgagaacgacctcaccatggatgaatggatgaaggtgttgcaagcaagaaaaatcttctgaagttatctgcaagaacagtggataataccaatataccatctgcagattagtgccaaaggatttgtgaaatgtatgtgtcgccatgagcgcttcatgatcttcacgagaacttggccgtttctggaacctaatgttcccattattcctaccggtggaaattcctcaataatgctcacattttgttcgaatatacagaaggatctatgcattattatctgaagcagtctataccatttatgtactaatgttctgtgatatattcccctgagaataatctcctgaatcctgacagcaattgcaaatttttatgtcttagaaaggtccaaaggaaggtactctcagcagccaattaccaaagtgatcgtggtgcaggaacactattcctctcggtagctaaaatcacgtcacattattctttcattgggataagcttcacattattggcacctttggtcagggcgtatcactacaggagcatgaaaggatgaaaagacaaagataacggaattatgtgtaaaggttgcatggatatttattttgcaaaaggaattcaattagttagtgtggtggtctcaatattttgctgtccaaataataatattttcacaacccggtatcagattctaacacccaccttagataatactcccttcgctccataatggatgttctagttttgttctaagtcaaacttatctaattttaattaactttataataaaacataacaacattttcagtactaaattagttttattaaatcaacattttaatatatatttttaaaagacatatgtttcgtgttggaaatgttgctattttttttctataaactttgtcatacttgaagtttgactttggacaaaccaaaacattttacattatggaacagtgggagtataatctttttttttacactcaaataaccattttttctctcttaattacttggacgctagtgcatggctcttgcacaaatttagttaggtgaaagccctctacttctttgggggacagggaggactccaatctgatctctgatctgaactgaatgcccacataaacacatgagagttagacaaccagcccagacctgagtagcagatgccaagtccagtttttattggcctttcaatgcacaagaggtggtagctgcccacgtaactgcagggcccccgtactgcatagatgtgagggaagtgaagccggagccgtacggggaaacaccggcccgggcaggcaagcatggcgcaagattgagatcgccagccagcgctaagcttccctcccggttgacacaacagcatgaggctataggatctagcattctagcaccagtgcaagccaaccaccaccaccaccacgacgacgacgaccgcggctcaggtgggtaggccggtggccggatacctcacagccttgaccaaagacggcgtcgccttgtggccaccggccggctcacgcggcagagaggtttgcagggtaagcaaactcaagctgcttgcagccagccagggtgcatacatgcaagtttctttttgacatgtactacaagggaggctagtgcaaccaaaatagaagaagagatggattcagcggttggaacttggaacatcgcagcattttaaatttgttgagggtagattctggttacatttggacagcaagcgtactgggaaaagaaagggaaacaaaggttggttcaaaacttactgtttggaatctgagctccaaatgttacagccttgaccttggaccaccctttcctggtatctgtagagcgtcataatggccaaaaccatgaaaaagaacttgaattggatcttctttcccgtactcctgaccatattctgcaattgctattaaaccaccagcttccttatcatgcatgtacacagtaattggcatcctggccacattggtaacggcatattagagcttttgttacttcccgttttcagaaggacaatacaacaagactacacatatatgaaactatccactattgctgttgagctacattaataaactttggtcaaagcctaacaaaatggaatattaatgacttttgggagttgtgttttgaaaaaaaaaaaggaagatccccgcaaaaaaaaaaggaagatgcttaacagtcataacatgacaaaaaaaaacaaacaaacaagacagtataagtggacaaacttatcccaggaatcctaaaatggattaaaagcaaaccaactaaccatcaaccctatataaatatgaccaagagggcataagtattctaacaggttactgcacaaatgtatactgcatttgaaatggtgagagtaaaataactccaaacatcatggctaattctcaccgaagaacatgcgaagccattaacagttctggttcacctccccacacatgtggcttcctaatccgagagacatatgcatcgaagtccccctcaacaaacctgtgaattaatgtcatagcgaagcataagaatgcgtaactcaacaatatttagatgcagagtaactaacagaataatgaggacaggtagaactaaccattcagtctctgcccgtctcttgataaattcatcggcgacctaacagtgacaccatttaaatagatcttttacatgataaattcaccagaaatggttgcgttgcttccagagcaacatttagtatctaagaacagaatggatcaacagtagtacatcagcagaacattacaagcataccattgctcttaagtcatcagccatctttctctggagatcatcatcaggtcgcttacctgacctaatacatgcaccatgagccacagatcggaacaagcaccttccatctccaggaatgcctgagggttaccatgtgaatcaaacacaagtgagcagacgatgcatgctttaaccaaatgcatattgtatagtaattagaaaaacacgcacactgtctcaccagtaacagaataatccgtgcaaacttttttcccatgagcataactagtggacgattcagtagtttgggggctatcagtattattgtccacaggaccctcagcatttgccttcgcaggaactgcaaaacttaggaaaagtccagtgcctgtagctccaactttgtgtcctatgcttcttgaatcccagagaatactatacaacttctgacgtgagggctcatcaagctttagctttagaatattatccctcgcaggttgtctgccacacaactgtttccccgaactggcaaaacatgttcgcagtgattttatgttcatcttaggaggcaaaccaactaatctgatctttacatgataaccgactgcttgtgaacgagaatacttccataatgccatgccctgtgtcagccctccttgtaactgacaagactgagaatacaagctataagtacagcgttgtaaacagacagtaggtgtgtagatagccatctgcttcaggcagcaccgcgccaccaagtataagctgaaaaacatgtttcgatgaccaaaattaagaattagtggaacatgagataattcttacgaaaatcaaataaagcaagccaccaccacaatgaagtagaagatccaccatgacacaacggacctatgatagatatgattgatgtcaacattagtatcaattgaagaggattaaattatttttcagcacaaaaaatagtttcatcgttgacatatccaggaaataaatgtgtggcagatagttattagtgagcataaaagactgaatgtctccaacctctagcaatcgaccactttctgctgagattcgacaaaacaatgggaaggatgggcatgctaaatcataagcgcacacttgctagaacaaaagcaatttgtcctccttttctttgtcacacttgcgtagagaatccatattatcctcgtgaacttctcaggatgtgctacagggagaaattgccctcccaaatcccgagcattcgagggcatgggcagcagcgaatcactagaaaactattctcattaagattatttaagttcctgtcttggccgcgaagccgagatttcgtgctaccaggccattcccatgcccgaattcacaagactacaaccctaagctggtggaaaataatgcattatatgcacaattgaattcagcaagtgccaatgcacccaaaccattcccctcacccgggagagcagataaattggaagatagtagtaactcaaattagtcacaaattgcagaggataatgaagtaaaatccgcaccttagccttcggactgtccgaagcgagcggagccgaggagagacgcctgcaagaatggagctgacgaaagcggaggttattggggacgggagcgtgagccgaagaggaagggatagtggtggcgggagaggctttagacctccgttcccgcgaggggattcgccggtgcacgccgccgccgccgccggcgcagagtcagtcacggccactggcgcgccgccgccgcacgcgaggaggaagacgatgagacgacgcctaatcgatatccaccgcgcatggtagatcggacggttcaggtggacccttcggatatggtagcgatcctattccgaggaggcccacacggaggcccagctttgtttggtctttggtggcccgagaagagaagaggctcgattttgttcggcgggggaaaagtctaatgtgagttctcatataggagtacatttcaagtgcaaaacttggtatatctagttatctaccactttaattattaaaatattttaaaataacccccttgactgttttgaggatagttttcagtgatttggcatctaatggcagtctagtcataagatgaaccaaaaatagatagaggattcaagtgtaagtggtacaaaagaaagtaaacaactgtggtgcccacttgtcatagcccactcttattcttctctttcttctttcttttgcagatagcagcaggaacccgacaagcggtggagacgaggctgatgagcccagcactgatgccatctccctcacttccacacccttcctctctgcctcatggagggccaccgcttgcctacctcctcttcgtgtagctacctctacctcctccgtttatcatccctcttctccataacggcagtggcggggcggcaaggtgggaagtcagagtcgatgtaggattccccaagctctgccacccttgctgttttggcctcaccggccaccgcttgttgtccacccagagctccacaccccatctccctcaacaccgatggtgatgcttagggtatcgatggggaggggatgaggtcctccaaccttgccgcttccagggctccgtcgtctctccgggtagggctcttacgaggatgcgatggcgacaataagggatcgataagggcgccgacgataaatttttatactgcaacatgctcgcctgctccatcgagatggcctcttgaatgtaccttaacgtcatctacctccttaccggcatcgagcgtctgctccgaaagcacctcgacatctgcaagcatctcaagattaccaaccaccgatcccgcaagttggggaaagaaaaaggggagaaagaaagagaggattgttgatgaggagggcagaatctccaatttatgaggattgtgctacagggaagctattcactcttttattataagcatgttttcccatattgctaaatggtatttttttttcaaaaccatctatatcgacattttttaaaaataaatcaatttttcaagtttataatatcaccaattgtgttttctgtctcggtgagttgctactacagaaactcataccattcaaagcacggatgactggtcatttcacccacaactagggctccatatcaagccagttcagctcggctcgttatcctacgagccaaaagcctcgctcagttcgaaccaacatcatttcaaagttacaaatgtttgcatacaatataagtattaaatcatcacaaatttagcaaatgcaccattaatttcatactttcatataatcatctaaagtcagtctaaatatttaggcctatgaccaagtggagtggtgtgacaatgagtggatgggggatgagttaagttgagatttacgagtaggttaaactttagttttgacttgttaacaaacccaaacaagccgagctgtgcgagctaaagtgccatcatccttttttccagccctatccacgacccatccaacctgtgcaaccttggcaccgcattctctgatgttagaaaaactatgttagagggcagtggtgtatcaattcattgtcctccgagtatggaatgctccaaaaaaaaaagccaatgatgccatcgctcgcagtcactatcatgttcgctagcgtgcgagcaaggacaacattggatttttcttgggagcgttccatatttgagaaacggtcgatcgatgggctactgacgtactctctctgttttttttaaaaaagacaacctctgtatccagattcgttgtaatatgttgtctttttttagaatgaagggagtagttttcccaacttcagaggatctggttccgtgcaacctcgtgccacaactctcaaacttgtacaggcaaccaagaacacctgtgatctacattttgagatcaggtagtatgattgatccatgaatcccattatccatcatcctcgagtgagagtccagcacgaaagctgcagctaccactccagcttatccatctcatcatccattcccctcgcaacgaactccctgcctctcgctccgatcgtccgcgccacggcggcgacacgatgaaaccccgatccaactgacaaaattcccaagcgaatcctgtgcagctcgagtagaagagaagagagagtgcttcttggcgagcgagtcaacgtcacaatggcgtccccgctgctgctgctgcttccgctcgccgtctcgtcccttctgctgccgttcgcggcggccgcgcgcgtcttctccgtcgcggactacggcgcggcgggcgacggcgcgcggtacgacacgggggccatccaggcggccgtcgacgcgtgcgcggcggcggggggcgggcgcgtcctcctcccggcgccgggggactacctgacggcgaccgtccacctccgctcgcgggtggtgctcgacgtcgcccccggggcgcggctgctgggcgggaccaggcaggcggactaccctcccgagtcccgccgctggtacgtcgtcctcgccgagaacaccaccggcgccggggtcaccggcggcggcgagatcaacggccagggcggggcattcgtggtcacccccaacccgcagaagaacatcatggtgagctggaacgccaccggcgactgcgagggcgacgagtgccgcccgcggctcgtcggattcatcgactccaaggacgtcacgatccacgacatcaccctcaaccagcctgcctactggtggtgagcatttcttgatacctcaaatccattgctcaattcgtagtagaacagccaaaacatgacaacatttcccttgtcatttcatcctaaagatgataaatccggctaatttgtactccactgccctagatatcatctgattagcaaaaattacacagcatttgtgtagtgatgaggtattcagggaaagttaacaggctatatgcacttgcattccctgcagtctgcatattgtcaggtgtgacaatacaatgatccacaatgtgtcgatatatggggattttgacactcccaacaacgacggcatcgacattgaggattcaaacaacacggccatcactcattgccacatagacaccggagacgatgcgatatgccccaaatcaaccacaggtcctgtttacaacttgacggcaacaaactgctggatacggactaaatcttgcgctatcaagtttggcagcgctagcttctttgacttcaagaagctggtatttgacaacattacaatagttgattcacatagaggacttgggatgcagattagagatggaggtactgacctgtacttgctgttgtgtgtattgccattctgtgatattaggtagtacttactattttctctagcaagctataagatttccgcagcaattaaaatatattagattgttttcacggacatttttttaggaaaactgaaccttatgctgcatttgtaccccgtgtttatatagaatttataaattgctttagcaccatgaaatttttatacagcagcgaacctatcctgtatgctgaaatatttctattgtgaattttcatcaagtaaaaactgcaccattaaggtctttggtctagaaatgagatttgctttaagcctcttctaaactggagttttcattcctgcaggaaatgtgagcgatgtggtgttctcaaacatcaaaatgagcaccaggtactaccatcctttatggtgggggagagctgaaccgatctacatcaccacatgtccaaggcacccagattccaaagaaggcaccatttcagacattcagttcatcaacatctcatcggtatcagaaaacggagtattcttggctggatcgaagcacgggctgcttcgcaacctgaagttcaagaatgtcgacctaacctacaagagatggacaaactactcgggagggctgtatgattacaggcctggatgccaaaagatggtgaagcaccgaaccggtggtatgatgctggagcacatctctggccttgagatcgacaatgtgaggatgagatggtcaagaggaagcctcaaaggctgggatgttgatcctctcctcttccagccatcgacagtcgacaagctgtcattccatgactggcaatcgctggctgtcagtaggtaatggaagagcaagcctactgaacatcacatttgtacaagtatctgtatcacaatctgagtggtgattcttttctgaaacgtgtaaataaagatcacatgaaaggcaatggtcttaccatgttgataatcatcgcttgaatggcataaggttcttaccagtcaataaaaatcctcaagtcccaactccctgtaagcttcagcgaatgggcgagaatggctgctgaattgatttctgagtactgaactgactgaatcagatacaatcaaattcaatctcaattgtctataataaacctatgctgtcattctgatctggatttcgaattttaatgttcttgtctgttcatatttctgttccaacttcttgtttgcctgttaccttgcttactccataaagcgatgttgagttcagtgagtcagctgcgctgtgcattctccatggtaagcgcaaacacatcaagttttttttgaaaaaaaaacacatcaagttccatggagtttcgtcattttagttccagatcttggtcccgctgaactgcaaattttcccaagaaaataaaaaatttctccatagctgctgtcaggatgtcaaaattttcaaaaatccttcgttccaaacagttcaaattttctggaattaggagataactactaattccaaccttgcatacaaaaaagatctcattttttcgcttatacttatgcttatgcgaactgcttattatagcaatttaaaaataatttgttagtaaattttatgtacgtgttcttcataagaaaatgttgtaaaataaactacgatgaaaaaaaaccacaaaatcaactctaaaataaagttctaaaaattaaaatttacttcctccgtttcacaatgtaagactttctagcattatccaaattaatatggatgttaataaatctaggcatatatacaaaatatatactctctcattccctaaatgtttgacaccgttgacttttttttaaacatgtttgaccattcatcttattcaaaaatgtttatgaaatgtgtaaaactatatgtatacataaaagtatatttaacgataaatcaaatgataggaaaagaattaataattacttaattttttttgaataagacgaatggttaaacatttttaaagaagtcaacggcgtcaaatattttaggatggagggagtacattaatcaatgaatcaatctagataagaccaaaaaagtcttataatatggaacggagggagtagcttataagcgtaaacccaagcgaaacattgggagcttcaaaatcgagaagaagagtccaaacctccaaatccggcccataatgattattaacccgaccttttcagcccggcccaatgtacttgaccaaagcccagcccattttgcaactcctcacctctgcattgtctccgcgtagctgagcaactcttcccctttctcccccaaatcggcggcgacctctctccgatctccacaccaccccccgatctccaccaccaccaccaccacgcgggcgcgcgcaccaaccgggggggcttcgatgcgggcgatctcgtcggcagcgggggggatgctgcgggcgcggctgcgcggcggggcgcgcgtccgcggcggcggcgggcacggggaggggggcgggcggtggacgaccccggggcacgaggagcagcccaagggctacctattcaaccggccgccgccgccggcgggggagtcgcggaagtgggaggactgggagttgccctgctacgtcacctcgttcctcaccgtcgtcatcctcggcgtcgggctcaacgccaagcccgacctcaccctcgagacctgggcgcaccagaaggcgctcgagcgcctccagcagcaggagctggcctccggggaggcccaggccgagtgatctgcgcgcctcaggtcacctcgaaccctagaatactgcatctgttttactcccaataagatgtttgagatgtgcgggatgaacactgtgctcttgtttctgtttttgttctgtttcctcgtggaatttgtccaatgatggcgaatgccctgaacattttgaaatgctttgtaattctattattttctcttcctttagttgtgctgctctgagagttttcgtgaatttcacccgttcccaactaactcagttgcagatcgcatgttggggttaggttgagcaaatagttgaacgttgcttaagcattatcttattcttgatgaatgctgaatccaaactctaaacacgaataactatccctcttaccaaatatgttgagcatcatcgtgatgaatgctgaagccaaaccctaaacacgaatagctactcctcttgccaaatatgatgactgttaccttgttgctaaactgatcatggcgcggttaagctatctgaaaataacttagaaatatgccacaatgaatgatttcgtactgtagcaccggtggctgttatttgtttatctcctgtttatggtgcttaaatttctctcaagttcatttgatgccaagttgccaactaatctatcaatttattgaacatatccgtttgcatactatcacttcacatgaaacatgtgtatatcaacgacatgcactataatatcattagtttttaaaggacacactttcaccatcgcctggtgaaccatgaaagcatatcacatattaaggtcagatagcatgatatcgagggtccttagctactaccatagaccatgaccatagtgctttgtttttgttttccattttcttggcatcttgctaaacacaacaattgtaaacacgcatacagagaaatataagggttcctttgagtaggaagatttacattgtcaatacttcatttgcctaaaactaacaatgaggttagggaagacaagaaaatattttttttttcaattttgaatattttagctgatcagatttgttatcatgatgaataatgcccatgaaaataaggtccgctatcccagcaaggcttctgctgtttgaatgtttttcatgtatacataaccaatatggagctgacgattcttcaatgtcaagttccaaccttgttcttgcatgttgtacgagttgtagagttcttctaaaaattatcacattcacttttttttggggaaataattttaaaccctgatttctctcctattgcccataggagcaattccatttaactgttttaactgatctctgggttacgaggtttgattgactttgtagaagcttcaatcttttatgcagcaaattgggaaaataatcagttgtgctctgtactctataaggaattagttgcctgcctcctgccatgtgtaatatgtttggctagtaattttactttacgagcaaataagtggaggggaaaacactgccttggtgaaagtttcatagaaatctgtttaggcccagaatctggcattaatttgttccttcctacaatggagcatcctgcaatttatgctttatatttgaacaaccttgtatctttttaagggtacgtacttcacttaatgttttagtgtcttggcctgtgtagactgtagacactaaacaccatcccaccactgcaactctgttacatatttcttctttacaaaatgcaacctgtgtttttcacatatgccatctattgttactactgtaagcaaaaatattgtcaaactgtgttggcattctaacttttagcagaccatggaatgctagatgaatttgaggtgaactgaaagttctgaggtctaattaagcagacgagtgagttataaatatgccactgaaatatgaaactggattgctagtctgatataatgcgcatgaggaagatgcatatccacatatagtatctattttcttcttacatcaaagctagtaacatagagaatcacaccgtaaggactatttcttgtttcctggtgatttcttatgctttgagcagccatcctaggctcctagccagtctcagtactgtaagactgttagttactgctcaaagtggaatgtaggtatttggaatttgggatctacaaaacgatgatgttgtcttttcatgctttaccatttgtcttgcactttagacctggatcgacaacttattcatcctttatgtcaatgtagatttattcgcttgctttgttcaggacgcatctttatgagacctctttcatgaattatttgtacatactcatagccttcatatgagtacagatgctaacttttgcgtagatccaaagctatatatgtctttcatgaacttttgaacagttctgccaatccttttactggattcctttcgtcttttgttatctctgccctgcattttattatttttctccttgcctttttgcgcgacactagcacatttcttctgtttctcaaatttccctgtagtttagatctgctgtgtctgtgtgacctccatgcagatggtccataatttgcaagcacggtatttttaactcagaacttcaatttccgctgaattttcttataaagccccatttgtagtaatctcccttgccatgaaattcctacagaatttctgttgattcagatggagtagtcttctgtgtggttcaattaccatagcttgattattgtcatgtcctagaactttttggtgtggtccattatgtttaatgtgcagatgcggaatagggaatagctggcaaagctgttaatgacttaatgctaaccaaccactgtccaccgtccattatctatgatgacaattcttttctgtatactactcgtacttgtctctccttttcttctagcaagatttcaccttaagcagctggagtatactactatagagagataaatgtttggaactccctactacttttaagtcttcactggagacaaaatgcattatataaaaatttagggctggcttttgcactccaaatggtatgtatgatatggtcactcactcactcctattaggaattggtttcatattccattgaaattcactccatccataaaagacttgtggtgggttcctgtatgctgggggcatttaaggcctagtttgtttggtttgaatatagatgaatgggtgatagattttctaattttgtgatgatgttcgataaaaaatcaatctagatgagatgtgacgtttcctagtacaatgaatatggataggaacatgtccaaattcaatatactacttcctccgtttcacaatgtaagtcatttctagcattttctatattcatatatatgttaatgaatctagatagatattcattaacatcaatatgaatatggaaaatgctagaatgacttacattgtgaaacgaagggagtagaaaacatcacatcttattctaaattgattttttatgggacggaggggatacaagcgaatggattaccattattacaaagttggagttgtttcaaaataatattttaagaaaattatatatagaattctttatatatatatatatatatatatatatatatatatatatatatatatatatatggtgttcttttctcctgaaaatgaagatgaagattaagttttttacgcaaaactaggtggtattaacgtatgattgattgagttttaattattacaaattttaaaaatagattaatatgatattttagagcaactttcatatagaaagttttctcacaaaacatactgtttaacagtttgaaaagcgtgccacgaaaatcttaattttcatccaactcttgttgaagaaaagaacatgactatatatatcggttaggagcttgggaagcatatgccatggtaatttgttacaagagaactcaactggcctaggtaaaaccgtgccacaaacagtgtcggtagagcatgaaatgccctcgcggtgagccggtgagtagtcgcaacgtctgcatcgctgcatgtcatcttatctttctctgcctccggccattcttttggcctaaaatttctttgtttggcagctgtaatgggcgaagcaatgcttttaatccgataaagctgtaatgcgagacaaatcttcctttagcatcatagttctttgtctccaagaacattccatttccaccgtccaagtgtcatgtaacgtcatcacatcaccctcatactgtcatacagaaaaacttatataatcacattatttttactgacatgtggggccggctccaaaaggtcccgcacaatggcagctggactatagtgaagtcctttccgcttaattatgccttggcctcttgtgtgagcagctaaccatgcaagcgaagcgtccctgtactagaagccatacggcggcgctccgtacgtagatccatctgctctttggtcacactgggatgtactaatgctgtcaatcatttcgtgctaatttccaaaaaaaaactattcatatactggtaaggcatacgggtatcagtagtacatctcttgaacatgagcttcattgttgtcttgactctgaatatttgacggcgggataactacgtgcatggatttgttttagggtgtttttttaatagccgaataattcgtgataattattcgagggtaaaaaataattgattaaacataattgaaactaatttcgtaagaaattcatatatactaacaaagttttctgtgaaaatattactatttagaagttcgggaagcgtgccgttaaatagaatggtttcattccttataaaagaacatcaccttagtgggattgaatcggatgtaatttactctgaaaagtttcatgggcattattttgttgtttgtgtgaatttcacacaaactctaccactccatggtgacatcgacaacaaataacaatagatctatttttgcggggttgtcggtgaggtcaagggggcgtcgggggtgatctcgccgcgcctcttcgacgccgtcctccgcccactgcggcgtcgcctccgtgcgcacgctccccgtcgctgccggcgccggggccgctcccctcctccctcgtgctcctcgccaaggtctccatcgcctacttctcgtgagccacgggtgccgctgtccttgcccgctgctcctgccgcctccttgccggtgagcgtagatggatcctccgctgccaccgtagaagcagaagaagctggcggtcccggtgcctcgactgccgcaacgccgacgacaacctgctctggaacctctacctcctctccatcctgatacctggtaccctggtatcaactgatacctgttaccctgggtatcgagctgatactaggtatcaagccttggtacctgggtatcaggccttgctacctgggtatcgactgatacctggtaccctgggtatcgagctgatacctaggcatggtataccatatgcatggtatcaggtaccagatgcctagtacctaggtaccatccatgggtaccatgtgcatggtatcagataccagatacctatagttatcaagtacaacctggtacctgatacctattgtacctagtaccacaggtaccaggtcaaaggtgtgggaatggggagcacgtcgtgtcgccgtcgccgcctggctgaccggtggccacacgttcgttgcctcctcttctattctcccttccttagttcctctcctcaacgtttctcttctccttctgttgttgttgctgtcggtgggggcaaagaggaggatttagcgggggagttgtctgctgctcccgctgctctggggcgccgacgccgacgaggaggtgtgtgcttctccagctgcaaaggcaacacaacaccggcaagggaagcgtgcgataccatgaggagccggctaggtatcatgcctcttcacgttgacaacagggacgcaggacgctatatttttattttgtcgtgtgttttaattatcccgtgacatcacttttccacggtatcccgtgggctagctgccctcaaaatgaaaggcacaatgagacaaagacaaataaaaaaaaggttcacgattataccataattaaacagagaccacaaatatagatcagagggaccgcataaaacaaagaggagacctactgaatttattctagcgcatgatagtgtttttaagcaaggaattcagttgatattttttgtttagtaagataaagaaataaatattccgaccactagatctacattctacggtgtattatgaccattttagtagcaataacactgccaggtggttagtggttaacctgggctttctgccgatttttttttcaagtagtcctgattttcacattttgtttgtactgtttgaccactcgtcttattcaaaaaacttgtgcaaatatataaaaaaggaaaagttgtgcctaaagtgttttggataataaagtaagtaaaaaaaataattccaaatttttttttgaataagacgaattttcaaacagcgtaaataaaatgttaaaatctcttatattagaggacggagggagtatagacgtgttaatttggagtgttcaggggcgtacaatgtggagcccagtgagcagcgattgctgcgacggtgagctggagtggtcacgttgccgccggcggccagccggccggccaccgtgtgtcctgtttggttctcgccgttgcacggctatcacaccggcggcgcatgacaagtgagaaccgcgtgtagttttgtttaatcaccggctaaagagagccgcctaatccgattctgtgacgctggtggtgacctactaggctaccaccaccgacagcctctgcctggaatgaccagggtcggggattcccagagaccactgaccagtacgttcacctcatgatccaagtgaataatttcgaattcttcgtttcctactccctccgtccattttaatgcaattataagttttttattcaactttaattattcatcttattttaaaaaaattataattagtatttttttattagatgataaaacataaacaatactttactttacatatgacttatacttttaaattttttaaaataatttttaaataagttgaacgattaaagttggacacgaaaactatatctatatttaaaatgggatggagggaatatcttttccattatcactgctttttattaacggtcattatcactgctttaattgttgccttgcaagggaatgttttgctttcttatttatcgttagcacgttttctaatctcataaacaatactccctccgtttcatattataagacttgttagcattgactacatttatataaatgttaatgaatctactatgggtacgctggtacaaggatctacgtaatacgacatcaagtaggcagaaaacaaatattataccggttcaggccccttgataggtaatagccctaatccaattgatatgagattatatgatggaaaccacagattacaagggggatagtggaactcgacgataccgacgagatcgtagtcgagttgattcgactagatcacccggcgacttggctcctgtaggctccggcttcgtaggctgtggtggttgccttgattatgagattcgatgccttaggtcctcccggggggtcccttttatatcgcaggtcaactggtctccaagtaggactcggagacatcggacccagcacgatacaatgacgacccagttctgtccgagtaggactccttccatttgtgaactccatgatgaatttccttaacgtatgccaaaaatgtccgtatacgcatatgtataccatatcgatatgtgacgtatatcgaaaggtagagggtataccttacccgtaaccctgacagtagcccccgacttctgcttaaatgaactcgtgtaaccgatcgtgacttctgatgtcgaggttgttgttgttctcggtgtgaggaccgagggataaggagtgatcgacaacgccctgtgaagctcaatggtcatgagtgaatttaaattgaagtccaaaaaactactgcgcgtaatggacccagaaatttccggcggtaatctctctcctttccttggaattcgcaccatcggaagtgcgactatttaagggagttttgcggatccaatttgaagtccgccggttgtgaaaaaactctccagcctccaagcgtccctcgtcttctccgcttccgcaaaaaccctagctagctcgtctcggtcctttctccggcgaaccccggcggcaatggacctcgacaagtctacctccaccagtgcgtcgctgaagaagctataggaggatggcgctcttcccggtcgcgggaccatggagagagaagcaggaggtactgaaccccagcctgtcctgggtcgcatggttgcgatcgaggactatattctttatggttttcttcctccgccttctgaatttcttctcttggtcttgaatttctacagccttttcttgctccatttgaaccccaattccatcgccttcctcagtatcttttcgcatctttgtgaggcctacattggggtagagccgtttcttgacctcttccgtttttactatgagttgcgctggatggaaccaaaaaaggtgtccggatgtgtcggtttccgacttcgggatggcctgaagtcgcgatacatccccttccagtgcccttcatctcgcagcaaatggcgggggaggtggttctatcttcagatagaagattcggatccggtcttcattgtttctaaggagcaaccagccaagatttcatcttggactgccaaacccgccttgaccccatccctcaaatctttcgtcgatatcattgatgacctccgagaacgggggttgtcggggtatgaagtcactaccgacttcattggtaggcggatccagctgctctaggcttgagcccacccagcctttgactattctaggccggaggacgcgacccgggtttctcctcggggtattttttttgtagttgaattgactcccttatgtgcgtgttcctcctgacttatcgaattctggtctcgatctataggcttgaacagcgcaaccgtgaagcgtcgcgtcggccaattgatgatcagcggcccgacaacgacgagcaacgtccccgtccccctttgcgagaagggggcagtcgaacgcgaagctgccatcaatgtaagtgtactcagcggcccttttgcattttacttccgggatcacattgtgacttcatgaagcgtaggctctccctctgactgatatcatcgggccgctcgtggatcatcaggcggcggcgtcgctgaaggaggacgtcgccaaggaggcgtccgatgttgctgccgctgctgccacaacgagtggtggcaacgtcactgatggccttgtcaggacgtccagaaaggtgtcaggttcgagtggctctcgtctggacgcacgccgtgctagatcatccggttcgatgttgtccttgcggtacacgtgtcgaacctcgatcccatcgaaccttttttccagtttcctgacttctgcgagatacgtagataactcggggctagagcacttgtaatctttatgcacctggttcgtgactagttcggaatcccctttcacgactagtcgcttgactccgagtgcagctgcagctcttatcccggtgagtagtccttcgtattcggctgtgttattggtcgccctgaagttgaggtgaattgcatgcttgaattgatctcccgaaggtgacgtcaagatgaatcatgtccctgctccttggctgttgagtgcgccgtcgaacaccattgtccacgtttcgttgttgatttggttgtctgacctattatcaggcatagtccaatcggctacgaagtcggcgagtacctgggacttgatggttgttcgtggcacaaagtggacatcaaactggcttagctcgactacccattttgcaatgcggccgacaacgtctttgtttctcacgacttcaccgagagggaaggaggatacaactgtgaccttgtgggcttggaagtagtggcgtagctttcttgatgtcatgattaccgcgtagagcagttttcggatctgtgtatatcttgtctttgcgtcgtggagagcttcgctgacgtagtagactggtcgttgcaccttctctctctcgacaacaatgacagtgctaacggaatatggcgtggcggcgatatagagaaataattcttcattaggttggggggcaacaagtacaggtggatttgataggtagcgcttgagtgcaatgaatgcctcttcggcttcctgtgtccatacaaatttgtcttgcttcttcagcagagcgaagaaaggttgtcctcactctctcacctagcgatgaacttgcttagtgccgccatgcatccggttagcttctgtacttcctttagtcttgtaggcgacttcatgttttcgattgccttgatcttttcgggatttgcttctattcctctgccagagacgaggaaaccgagcagcttgcccaatggtactccgaacgtgcacttctctggattgagcatgaggcgatatcgtcggaggttgccgaaaacatctgtatacgcgtatgtataccatatcgatatgtgacgtatatcgaagggtagagggtataccttacccgtaaccctgacaatatgaaacgaaggaagtacatattttagaatatatatatatatatatatatatatatatatatatatatatatatgaaggttttttggaaaataaataaatatatttttcaagtgtataacatttattactcaattaatcatatcctaattacttccatccgaaaggctaaagcaatttgcagcctaagtcaaagctaaaatttaaaattttaaacttaattttaaattattataggtgctttttaattttaatttctgaacttaatttgaaatcactaattgtagaaatacaaaagtcgtatccaaaattatgtttcgttgccgctattaggcgaatccaataaacgtaaccctatatattctgaaaatatctttaaatatactacctctgtttcaaattgcaagttattttaacttttttaagtcaattaaatttatagaaaatttacctctgttttaaattacaagttattttaacttttttaagtcaatcctctttagatttgattaaatttatagaaaattatagcaatgttttcaaccaaaaaaaaaactatcagaagctagacgtaatgaaataaatttagtgctatacgtattgttatatattttacaatcttgataaaaaataaatgacctagcacttcccaactcacttatttctattgtgcgcgcatgctttttaaattgctaaacgatactttttttttgcaaaataaatccttataagaaagttgctttaaaaatatattgatatttttttaaaaaataactaatatataattaattatgtgctaattaaccgttccattttccgtggtgcacagcccttataatataaaagagggagtacataataaaaatttaaaaaagactcgttatttggagaaaaaaaatggttgagatgccgtggaaagcggcaggtaggctgaccgcgtgcggtgaaccgactcgagtcgagagagggtgcctcgaaatgcacgttgatataaacagcccgcagcgaaaccaccccaaaaaaccaaaaacccaccacccccacgcggtgccactgccaccgcccctcgccgctgacgaccgccgccgccgccgccgcacggacattccgcacacgcccgcggggggcgggcggcgccgcgtcgctgatccaacgcgagcacgttcgtcgtccatccatcctcccgctcggatttggagtcggcaaccgctcgggctcgcgtcgcggcaactgaagcggcgaaattgcaacaggcacaggcaggtgaggtgaggagcattctgatatattattatttttttttgcccccaccacctccgccgttccgcttccccggcccgaatcatcatcccccaatctagttcgtgtgcgctgttgtgcggtgtgggatttcgcggtgtcgtattggattcgatattgggttggttggttggcctcgtttgctgttttgattgttgattttcttctcctctaataactgcacgcgctgatcgtttctgtacctgcgacatggatgagatgtccgcatttttttttgttcgtaattggggaggggaagctagccgtatagccgattgttagtatgttttgatccgcatttgcgcattgatcggagatgatagttttctcatgtcacctttctgtttttttttcctttacttctttcgcgcatatgattggcttgaattctcctgcactagcggttacctgataaaaaaaaattctgcgcgtacggagcatcggaatgtgaatttggggaccatcggtggcatccgaaatttgtcaatatatatacactagtatgtgttaatcttgaacttttacatggtgaattgctctagccatttgctccatccatccaaagtagtatcactgcacttgcctagtatttagctgcttcgtgtggtgattggtgaatgtgggcaatgactaggaggacttggggttatttggtatggaatccagtactggatagctcactgtcactggtggccagtatgcatattcatcatggattgtggttagctttttccaaatctgcggcttgtcagatctgcctgtattatagttattgtacagctttatgtctggggctctttcgcgccgttgggacctcaaattctccaatgcaatccaagtcgcatgatggtccaagaccagcgtgccccactgccatgtgcttaacaaccaccttcttcctgagatcgactggacaaggaagcataattgtactgaattctcgtgttattacgtcggtttaaggtgaaaaatcttgcttgagatgcttctttaaggtggagattctgcttagctgtacagctgttgagacaagctggagatcagttattcatttgatgtcctatcacttgttcaatgttatgaagttatgaacatgggcttcttagcgttttactctgggtgcagtgtaagttatttatcttctctgaacttgtactgcacttgtagtacattttcttgatctcttcagttaaagcaatttatgtacaagctgttttgtgcgtgactttttcctgtcataatcattatgttgcagggtcggaccacccttgaaagctcttttgctatcttgctcattgacctgatcaagttgctagacctttgctcttgttactaactttcttggtgttatatacaggtatcaagtttctagtgcactaaacaacctttgagatgggtactgtagagaatatggaagggagagaagagcgttcgactgatgtggaacgggatggtaaacaaggaaaagaagttgaatcggactatgaaccagctagagactctgtttcatctcagggtgaggctaacagcaatgaagataccagagccaaaagagtctcaagggttccaaagaagctagtgaagaaagattcaaaggaaaacagcccacgctcaggcagaattaattccaatcgccaagtgcagactaagctgcaatatatatcgtcaaacaatttgcagagcaaatctccaaagccaaacaaaacatctgatggtgctaaaaccattgagataacaaagccagatacagtgacagttccttcttgtccttcatctgaggtgtctgaggagatggatgataaacccattgagaatatagtgacggatgataaatccattgaggatgtagctgatgataaggccactgagggcacggcctcttatgataaggccactgaaggaaaagctgctgatgatacgaccgttgaggacaacaccactgatgaaaggagcattgagagtggcactgatgataggaccattgcgggtatagcagctgatgttaaatctagtgaagaggcaaaggagattgatatattggatgaagccccaaattgtgatcagagtactgctactgacgaggaaatagctgatactgaagaaagcatagcttatgatggtaaatcagctgcatatgaaaagagtgaggaattagaatctaaatgtgaaaggttggagcaggaacttcgagaagttgctgcccttgagatttctctttattcagtagtgccagagcacggttgttcatcgcataaattgcacacaccagctcggcgtctgtccaggctatatgttcatgcatcaaagttttggtcctctgataagaaagcttctgtcacaaagaacttcgtttctgggcttgtccttgttgcaaagtcttgtggaaatgatgtttcaaggtaaagtatctgtaattggatatagtatgtaactctgtgtagcttatatttccgcataccatcatttttaaaataaatctttatgtaggttgacattctggctatcaaacaccgttgtcctaagagagatcattgcacaaacatttggcattacacgccaaccaagtcttgctatgaaggctttcagcacaaatgttaatgcaaagatgctcggtaagaactcttcaccaacgcggcggaaaaacaactacagtggcaagcatgctagacctgctatctggccattacctgatgattggcgggaaactggtacactcgtggctgcactggagaagattgaatcatggatcttttctcggattgttgagtcagtgtggtggcaggtaaaacctttcttatgctttctcggcactttttaggaaattgagtacattttattctctgtaaaactaggatagcagacagctttttcgattcattttgttgtcaattttctgaaggatgtttccttttcaggcattgacaccccacatgcaaacactggtgaaagatatatcaagtccaaaggctgggagtttgttgggacctgctttgggtgatcagcaacaagggaacttctccattcatctttggaaaactgctttccaagatgccttcagcagaatatgtcctcttcgtgctggtggacatgagtgtggatgcttaccagtgttggcaaaactggtatgtttaatcattgatatttaatttgagaagaataatcatttttgtgaagtttatgcatgagttgttttattattgtcaggtgatggagcactgtgtagctcgtttagacgttgctatgtttaatgcagtcctgcgtgaatctgcaaatgaagtaccatctgatcctatatctgacccgattgtcgactcaagagttctaccgattccagctggtgacttcagctttggatcaggtgcacagctgaagaactcggtatgtgcccaaattgcaaaacaactacgttcttagtttaaaaccacttacgttggaacgtttcctgtaactgcatgaagaacaaaccagaacatgtgttttaaatcatctcttccttgcaaacaaaaccaaatgttaatggaccaaatgcttcttcagatcggaaattggtcccgatggttgcaagataagtttggcatggttgctgctgcccctgagaagcatggtcaagcaggagatgagagtgatgacagaagtggtgctgctgatttttattctttcaagctgctcaacgagttaagtgatcttctgatgctcccaaaggacatgcttcttgaaaagtccatcaggaaggaggtcagtattcatgcttagtcactccaactcttaagttggaacatatattcaggttcagtgctgcagttaaaattttgtcattctgtttaggtctgcccttctattggcattccactggtaacaaggatactctgcaacttcactcctgacgagttctgtcctgaacctgttcctggaatggttttagaggagctgaatgccgaggtacgacgtctatttgctaaatgatattattgcattgtagcattacaaagtccaaatacaatcttgctcaccatatgtaatgactaaccaagatacttctatagtttcactctacaccttctcaatcagtgttggttgctaaattttcacacagagcttgctggagcgcttcacggagaaagatgtgatcaccacattcccctgcgtcgcggctcctgttgtctactgccccccttcaccggaggatgtcgcggagaaagtagcagacgcaggcgggaacgcggagccggacctgagggcctccatggtgcagaggagagggtacaccagcgacgacgacctggacgacctgggcaaccccctggcgtccctgtacgacaggagctctccaccctcaccctgcaacggggcctctcgttcgactacacggcaaggtggctctatgtcgaacgcgagatacgagctcctgagagaagtatatggtcggagaggcctggtttgagtaaccagtgaaagtgtggaacggaagacgaaaagagagcctcttggtcttgggttgcagatttgctgtgaggtgaacaaggggttggaaattggtcgggaaggaactgctttgcaacagacgctgaatgaacgaacagcacttggatatcctcatggcaaaatgctagagtgtttagaacccatccccccattcttctcatgtatatttgcattttgattctgttgaagtgattggttcactcttggcaaaaggggataaatttatttgttggtggtagtgaggagaaattttagtgagtggtcagagtgagcgtgacttctgcgtcagccatcgttcgatgggccgcctaactgatcacaaataggaataagttcaactggcgtccctcaactttacagtttacatcgatttttttttgacatcccttatcctctgccttgtttcactgatgtggcatcatagtcagcaaaaataaaataaaataaaatatagagcccacataccgcatctctttctttcctttttctcttctcttctctcgagcgggcgtggcgtcagatggggggagaggccgtcagcggcggccggcaaagcgagcgcgacggcgggcagagctggcgcagcgggcgggctctgttgccgatgttgtgctcgtcttgcatggagatcccctcgcgacttcgtggcggcgggtgagcgcggcgggcgacccatggatcgagctagtactacgtgctatggcccctacctctgaattatgctgctgctagagcttaggtgggtatcgaagaactggacactgcagatagctttttattgataatattaacttgtggcaaatgacgatcaagcgtatagcaatgagtgagagcgaagagttggtaagctaatgctactgctcttgatttggagcacacactatacggttgcgttgtattaaaccgcaacccaccccccaccccaccccccgggggcaacccacacccctacccctacccccacaccacaccacaccacactagcacatccctgtccccctcaattcccgtaatggtgttactaacggtactatcaatttctactgagtaattgttttactggtagtagtgtttgaatcgtcgtatacatacatgtgttggtcccacaccgtaactaaccactaatcaatttcccccccttttttttttggatctacagaggcaggaagccggctcggcagctgtggcatcaggaagcggaggcggcggcgacggcgatggcgtgctacagggaggaggcggcgtgctggatctaatgggttaggcggcaagaacgggcatgtccatgtctggcgaggaggcgaggacggtttcgctctcgtttccgcggttgtcgtcggctccctccctcaagcgagaaaagcaagaagcgcgctgcctccgccaaggctgccgacgaggcctccaccaaccgcacccgcgctacctcccgacgccaacccctccgctggatccccattgctgtatcgttctcctcggtgaggtggggacttctctagggtttggggattaggggatttatagggttcctctgccctccctgcgtataggaacgaatcagaatttggtttttctttatttttttctttacttcatgcgatgggattttgcatggtggttctgctccagatctggaagcttcaatggcatgggtatcatgtgagaagctccttgctggtggatgccccttgttcttctgttccagatgtacaagctacagggcgacacgagctcctgctccctgcactccataggttagcctgcatcgacgaggaatacttgaggacgccaggggtgaagaagggtgtagcctttgggagccttgccgccagatccgccgtatccagcggccccgcgcgtccccgacatccctcttgccgtggtctagggtgctgcgatgtcgtcttgccgtggtctccattcggtttgttctccatactattttaattggacatagtttttttgagtaattggacatagtttttttgagtgctcagactgttgtgggatctattcaataagctgtaatgacttgttgtctttccaattgctgaaatcttggaggttttttttcggttaatttggctgaataacaatgttatgcgatgctgtttgtgctttgattcttcaggtactaattagagatattggagccattgtttaattactttacgagcagttcaggtactttactagcaattcaagtgacaaatttggttcactaatctagttctagcagtacaaacaatttcagcttttcctagttttagagttttgattctggcatgaattgtatggggaatatgattaattcctgcacactttaggatgaaggtctggtctcatttcacttgagcagttcttgcacttcttttctttcaattgcgggaatgttcagatcattttttgcttaaagtacctgattcgttcttagtttgtgtgtttgttggcctaaatctttcttccaattgcacagctctggaactcttgctgaacagaatagcatgaatgattctagtgtagggaagttcttatttttattttttgttggatcatggaattcagcactaattatagactaacagtgttcttgagttttcaggcatatctctgataggctagtgttatatggttattatggggctcatgagttttgaattttggtcacgattttcaggactgcaaaatatgcagtgagatgtgtaaactctgagatatgtcatatttttacagcatgtgtacagtattcgtcgtagttttctgaaattagtactgcatgtcctgtgagatgtgtaaactctgagatatgtgatatttttacagcatgtgtacagtattcgtcgtatttttctgaaattagtactgcatgtcctgattctgaattttcggatagatgaaaactcaaaaagctcgatcgaatagcagttttctaaatttttgttgttcaaaggagcacatcaattgaattctttttttctgaacttctgactagatatgttcgctgttgaacatacccttttttctctgtatatttttgacagaacagacatcttcagactaagactaaggtctaaattttactgaaatgattaacttctaatttttgcaggcatcagcatctacagtgtgcactcttgcaggtggatgcacatcttgatggtatggtggttggtatttgctctgctgaagatgtacatgttctaatttttttggttgctcatctatatctgaattttctttttaattgtgaattcatttgtgttcaggaaactagaaaagaacatgagaagattatgccagtggtgatggtgccactggaatggcatcctcgacatgtccttcgtcaacgttcgtcgccggcagccaacacaaagggtcagcccaggacgaccacaccacaattgatgacaggcttcggtggcaggcgatgcgatgccctctggattgtgctttttttttgggtaccgggtgtatatgtgtttgtaacgatgatggcacgatcaattgtaaaaacaaagtccattatacccgtattcgtgcagtaaaatatttactaccttatatatcaggcccaatcaactactaagtaacttttttactccctccatgattggataatcccaatacatatcaataattttttttattccatgaatatgttgcttcttatctattagtaaatcatttactcatgggcgagtctctattagtaacgcatgtactcattgccaatatgagatgtggctagcaaacgatattcttatctgttagtaactcattgtgggccaagtctctgttagtaatgcatttactcatgggccaataagggaagtgccaaacaaatgttactcttatctgttagtaactcatttactaatgggctttgtctctgatagtaactcatttactcgagaatagtaactcgattacttatcaaaaacatactaatagtaaatgaattactaaagtcacacatattattgttggtggctgggctagcaaaaggtgcgggattgatacatcattcaatttttacgtatagtaaatatgttacttatcgtatattgcgccacaaacaatcatttagtaattaatttactatacgttatttctaaaaggtgcagggtgagggatgtggggtgggtgcagctgggggggtaggagggagggtgggggttgggggttgtgaggggagtagtttagttataacgcaccctaggtgccgtttagcacatccctatatatatatagacatcggccgctgggacaagcatccaccagagcttgtccgccgggtgaggtagcccaggttgttgatggtggcatcactccgccactccatgccatgacaaaaatcgtcagggctccagcggcagctcagggctcaggtagcggcgcgaggagcgcaaacaacggtgtgaatcctgctggagcgctgccgcaacgagctctgccgcctcatgcttccgcggccatgccgctctcctccgaacagaagtgggagagagagaggaggaaggttagagaagaggggaaatagagagagaggatgatatgggtctcactgcatatttttatttttatccgaacacacgctgatatgtgggtcccatgttttttctgactttatcaatgtcacgtagacgccgccacgtcaaccaaactgtcttggactttctttgcaccggttttaagaattaagggactcgtcatattgcggttcagggacgaatttcggatttggcgacaaattgagggacgtacaatgaacttattccttgtggcggagtcccttcctccgatccggccggcccgacctgtgatccgacgcagctgaagcacgcgggcgcgctgcccgccaaaccggtccacgggccacaacgtcacgcgcgagtactctccgtgcagcccgcgcgtcgtccatcccgcgatacgatcctctcgcgtggcgcgcgcgatatccccccgaatcaccgccaaacctgcactggttctctcgcgtggcacgcgcgcgttgatccaaacccgttgttgtacgtggtttgcggccggcagcttgcggccgccctgcgcaagcgcacacacattatgcatgcgacgcgcgcgatcggtgacgagtcgacgacgactccgcgggagttgacgataagagatcgccgcccgcaggtaggcatgcgcgtcaccatcgggggcggtcgtaactttgtccatcctcgcgtaggcaaacaacatggcaagcaagcaggacgtgtttgtgaattggctggcacaaataaaagcaagccactttacgtactcctccagctgttacgtaaaggacggacgccgcggtatctccgtgtactgtgttgtaaggccctctttgattttgtaaaaagaaaaacaaaaaaaaacatagtgattttttttttaaaaaaaagtttgagtcctactttattttcttatctggtccttataaaatggctcgagagaaataaatgtgaggaaagttaacacatgatatggctaactttatgggaaattttctttgaacctttttctctcctctagtttctttcttttgtttcctcacgaccaggagcggatctacagtgttatgacctgtctcagacggcaccgacgtctttcgacaagctatgcttaaattgcttgtctatatattataacactatattctaaatataattagtatgctataacaccaatgaacaaaattatggatccaccactgctcaccatctattgcaacgatatttatttatttatttctgtattttgcaattctttatttaacaattacatttatattataatcctaaccttttcatgtctgtttttatcaattctactacatttttaaaggggcccacactatatccgtgcatgtttatttcactcgtgtctttggtccctttttttcctcaacttccgctacttgcgcgccaccacacaatagatacgcaatcccaccacagcgatgcaaacgttcttacagttgtcattgtccaagcttctttaatttccacacatgctttaatttgttgcgcactgcacttacgagttacgacatctcgtatgatctatcttgcactgaggtaattaaactcatttccagttgatttaatttacatatttgaagctttcagttcccctatgtatgaaactgattataagccgtaatacttattagcgacttaaaaactaatttatcgcggtttaaattttatatatgtattttttgcttaaaagtcaacgcaagtaaaacaaacaattaaaaacagcaaaatcaaccttaaaactaagatttaaaatttaaattaactactaccgaagagtggaagctgtactatttagttttgatgaactctctctatatactccctccgggttgataatacttgtcgttttaggcaaaggcacggtctcaaaaaaacaactttgaccattattttctattataatatgtaaaaaagtgttaataaatatattattttattaaagtactttttaagacgaatctatacatgtggtcaccatatttgaaagacaaatattttaaaaataattcataatcaaagattctaaagtttgatctcacccttgtcttaaaacgataagtattagcagcccggagggagtagcataaactactcgctagcgtaaaagaaagctacctgcagcatgcatgcacccatgtggcaactacgtgtgcagattgaagacaaaaacttgagttgcttaattagaagctaagctctcaaacacatcacacgtgtgacatcatgtagagtaagtagctagtgcaatgcactttcacgaatcaaacgagttgacacggcttgttcgtccagtctactcaaattattgccacatgtgccaatgtcaaaccatgcaccagtactagtaatatatccaagtggctacatattggagttagctagctacctgatgatcgacaggagatcgatgaaacaactcaggcatgccatgataagataatgatgcatataaacacgtcgtattcatttgggtagatatgtgagagctaccccagtagtcattagtggcacacatttggctagaagatcgagagcttataaacccctcccctcccattggggactgtacgatagggtctaacattctagaatgagagagagagagagagaggttggatgttgagaggaccgaaattctgattataacagtttcaaaaggtgtaataattaattttatacctgtaattaatttgatgtaacatcaacaagaagttagggtgcttacattaacttagaacatgtacaataaagtaatgtacgtgggttgtacaatttgtacaatttgctacatcagatttgtgctagaggagagaagatgagagataagaaaaacgggatacatatttatagtcagatatagcacgaactttaataaactatgtgagagagatggaaggattatgtattaatgatacaatatatatctacatctaactattgtatgagcgagctaacaggttggctattggtgatattttaatttttggagctagttgttagctatattattaaacttgctcttacattgatcaattgtaaaatgtttttcataggtggaaaataaccgatgtgagacacaatattattcaagagatatgtacaggtttttttatttttggaaaaaaaaaatactatagctagctaggtgcacgggattgggattaaatccatgacccgttgaatgaaacatgcgtggactaaccaacgtacgtagcaaagcgaacattttacattaaacagcatagacgacaaccaaatattccatccgtttcaaaatgtttgacaccgttaactttttagcacatgtttgaccgttcgtcttattaaaaacttttatgaaatatgtaaaattatatgcctacataaaaatatatttaacaatgaatcaaatgataggaaaagaattaataactacttaaattttttgaataatacgaacggtcaaacatgtactaaaaattcaacagcgtcaaacatttcgaaacagagatagtatttgagtattgagctaatatgttggttaattaaggggcgctattgggcggggggaacctgaatcaaatcactcttttacgtccagatactagatcaaccatggatagtgctaagctatgacctcaagagattgatgcgtcaatgaaatagtacaaattaaagtaaattttacggtctttctatagtgtcattttaatcttttaaattactgagtgtactcataggtacaacttaatatgctatccgagttaactttcttcgcgaacgtgcaactatccgagttaactaaaaggtatcgagttcaaatattgatcaatgaaactgaacaagaaaaattgtcttacatctccgtttcacttgttaaagtaatcaaatcttaatcccgcatagacaagtgaaaaccacgtctaacctttttttgagagaaaatatattttttttgagagaaaaaaccacgtctgactaacaaaaggttcctctccgacataactacatgatgtgatcgatgtgatcaatgatagagccatccacccgtaagtccatagtatgttaatgagtcacaatgtcatggcgatattacgtcagaggattatgatacatggcatgactggcaatctgttattagagtcactagtacagagggtatgttcggcaggccaactataactgctgtgtagggcggctgctgctgcggttatggtagaaattgtatgttgctactgtagctgttgattgccatctagtcacaccaaacacccagagtaattttactcatagttttgggtgctcaaaattagatagtagctaaaaaaatcaaagttttcctcgttaatagaaaagtaatattggtaggtggatatgtgtaagggttgatgagggttattagaggaataactcatcgatttgcggactgatagaggataaaaattaatttattttgacatatttagaaaataccacacgttattttgaaaaacacagaggttaccggaggagagttttctcaattttcattggccagggatgcgtcaaggcggcgtacgtacaaagcgtaagtcgttacactgaaaatttacgctagtgctgtagctgctagttgaggccaagttaatcttgcatatgcaagggtacgtagctagccgtgctggagaacgtgcgcgcgcgtacgatcgaattaacagcagcaaggggcctcgctctccggtgtcttttcttgccggacaaagtaggtcgccacacctctcgcgacgtgcgtgcattccatgcatacgcatgtcgtgagctagctagctccatctatatattgtccttgacgtgcatcgcggcatctagtacgtaccgttgccttgccttgcctggacgaacggaagcaacagcaacgcatatgagatctctccggccatgcatgaatgcggcccatccttgtgccaattgtcggccaatggtgtacctagaaacccaaacggcgtgtgggagaagcatcaccggatttaccattgttgtcagtctcctttaagcatctgctctctgatctcactgttaaaaaataataattctaatttttaagatgagtctgaacatatatgtcaggctctaaacacttcaagcagtagtagtacgagtttgtaagctagtactctctatgtctcattttaaatgtaaccatgattttccgtgtccaacttttaccgtccgtcttatttaaaaaaaattgaaaaaaatttgaaacataagtcacgtataaagtactattcatactttatcatcttataacaataaagatactaattataaaaaaaatcaaataaaacggacgatcaaagttaggcacgaaaactcatggttgcgcttaaaatgggacgaatggaatagttgtgttgtgcctgcgcatatgcacgttgattattactccctccatcccaaaatatagcaaacctttgagggagtaatgattataaaggattgatgactgatcttgaagataatatatatgcacacacatatatatggcgtgtttagctaggccctgtttggaagattagcccagggctaattttaagagctaatgtttagtcatgaattggtaggctaaacattagcatagggtggcatgtttggatccatgggctaattcaaggctaaaagatggagagagagagagagtagaaagagaggagagagaaggagagagagagctatttttttatggttcccacacaaaattagcctcattagcaccccttggaggggctaatgttttgaggagggctaattcatattagctcaaaattagcccacctgtttggattattgagggctaatttaaggctaaaaggtgagggctaaacattagcccatggaaccaaacagggccctgcatggtacaaccgctgtgtagcgcagcacagcgtatcggttattacagccacacaaatcactgttgaggttgttggttgcgttgtggaacatgcccatagccatttaattacgggtagtggttttgtataaagctatatacagctatattatcatgctaagaatggtttctttatgtggttttcgtaaatggcaaactattggcttacataatagttgtgaaaatgcagtaggtacagtggcaaagctaggtgtgatgcacttgatagggcagcaacaagagatgtatgattttaaccataagatctcatatttaatccgtaacacactcgtattttttttcttaaaatatgttggagggacgtctcttccttcaaatcttgaaaaatgccatagttagttataggctgttctcggctttcactggtttattcaaatgtcatagtccagattttaaaatacatgtggacagcaatggaggtagcatacacagtagtatttcgtttttttttttcagaatagtaagcactacgagcctgcaaatgactgaagctgtgtgtatactgtatagtgcatagctatgtgtaacctagctaaagcctgaatgtttcagctctttcatagtctgaaggtttatagaaaagcagagagtactgcacagatttgaaatttaatctcagccccgtcgtaaatagaactttgcatgcattggaaaatattgacgtagttcttcagatcaacagccagccttcagccacagctcaaagcaagtacagataaactgaacagtcaagctgtacgaaccatggattatatatgaattagtgcacgtacatggtcaaacattgagacggggtttaatgattaatctaataaatcaacactgcttaattcatgggacatcttttccgaatatcgaatcctgacagatcgggaaaatggcatatttcctctgctggtatagtaactcctctgtcagatgtcaatatgtcatagatcagcagcaacattgtgccattttgtgccatttattgtcgactcaattattcagtaattagattctgtattttgttggcacaatgttattactgaaagatgtaattcaaaaataggaattacatcccacgaaaattttggaatcgtccttgtgtcatcatgcagagagaatcaataactacaattatctgaattttttttatcgaaacacatacaactatctgatcgaaaatgcttccgctcgggcgtctgagaccaacaaatcgaacactgtaccgtagtcaattagactgcagggattaacccttgtgaagtacagtattttcagtcaccctagcctctagtgagcagaaaaggattcggattttacagtcccctaccgaaatagttacccttatttcacaaacctacccttaccatgtcacaattttacagtacaatctcttctactcaattttagtttacccctttcaccacaggatcacataattaatgattttttttgaggtgaaagtgaaaaaaagagagaaatactgtagttcgagtggaacaccggagaccggacgtcagaactccggcaagaactccgtcaactcctcctcctccggctccggcgaaggctcgtgaagcttgttgaaatactctaccacgctgaacccctcgcacgcggcaatgtcgtcggccggcggcgggatgtacggcggccgggagagctcgccgagcaagtcccacgcgactccggcgaagaacgggtgggcacggacctcgtcggcgccgccggcgaagccgagcctcttcgtgggctccttgtcgagcagcctcgcgatgaggtcggtgagctccggccaccgccgccgcgagtcggcggagaactccggctcccggaggagcacgttgcggaacgtctccttccggctccgcccccggaacggcgtcctcccgtacgccatctcgtagacgagcacgccgagcgcccaccagtcgacggcgaactcgtgcccctcgccccgcaccacctccggcgccacgtactcctccgtgcccacgaacgagaatgacctctcgcacgcggcggcggcgccgccgctcgcgctcgcggccgagcagaagctcgcctgcttcttgccgcggcttaccggcgacaccctcgccgacttcgccttcttgaggtggtcggcggcgccgccgccgccgtcgcttctcttgaggaaccaggccaggttgtgggtgtactgcccgggcgacgacgtcgatgtcgtcgcggccaccgacgactcacttctcgcgaagattcgcctcagctggctccggccatgtccctgcagctgcggcggcggcgacgacgtggccgagcacgacgacgacgaggtggaggtggacgcggagggggagacgggcgggagcagccgggagaggtcgaagtcggtcagcgtgacgtggccgtcggcgcggaggaggacgttctcgggcttgaggtcgcggtacgcaatcccggcggcgtggagctcggcgagcgcggagacgagctcggcgacgtagaacctgatggccgcgggggagaagacgcggtcgggctgcgcgtggcggagctcgttgaggtccccgccatggcagtacggcacggcccacgccacgaggtcgcccgtctcggcgcgcccgagcagcgacgggaggtgcgggtgcgcgagcccggacagcaccgacacctcccacctcgcccgccgcgccgcgtccccctgcctcgccgccgacgcgacgacggacctcttgtcgaagaccttgagcgcgtagtagcacgccccgccgccggcggcgtcgtccgccgccgcggcgacgaggaacacggtgcccatggcgccgcggccgagcacgcggacggcgcgcacggcgtcgaggtcaatgtccgccatgcgcggctgctgctgctgctgcatgggcgcgcgcgcgcgcgctctgtgtgtgtgcttgggagtgtgtcgcgttgtgagcgacgaggacgtggaggcgagatataataagctggtagtagggggccgggctaaacccgcgagacggttgcctaattaatttgttgtttttgtcttgtttaacctgcagagattaatgaaacaaagtggcaacgccacttcaagatttatactattgttatctccggcacagctttggcgttttctcaattctcatcggttctgtcaaagagacgatcttcggagcatatactggcctagggtttcaaaaccggctcagtcatcgaataccgcacggccttttttttctgtctatatatcatatgacataaaatctcacctcctatcatttgaattttgaaccattggatgtgctttaagattcgcgcagccccttaaaccctaactcctattcctccttccccggttccagatcatgctgccaccctcctcctcccgtcccacacgcgatccgccgccaccaccgccaccgccacccccaccgcgctgccgcccgcctcgccggctggccggaaaaagtcaacggccctgcaagccccctccccctccccttcccccctcactttgtcctcatggcgacgatgacgaggtgcccccgccccgccggatccgttacctctggccgccacctcctaatcccacgcttgctttgacccgccgccgacgccggctcaccgccctcctccatccccgcggctttggcgatgccgccgccacctcgccgctcgccggagtccaccgcccaccgccagttctccgccacccacggccatccctctaagccccaaggaaacccccctcttccccctcccccaacccccctcctaccctcaccccaaccccaaaccctaacccgccggagttggaggagagaagccgatgcacgaatcttggcatggatccaatggtccaaaatctgtaagatttcatcctcaaatttcattcgaatgccatatagcaatcccctttttttcgataaacgcgattactgtatagtgtccgacaaaatttgaacaaaggtaggagtatttgaaagttattcccagtgaaatatactatttttatatttccatcttttatatttccaaaggtgccatataagcaacgagtcatgtaattgatgattgaaaaacacatggttttatttttgttgtttcataggtaatacatgcaagaaactatatattataaacaatttggacatggttttatcctctgacctcttggcacgtcggaacaatttggacatggttttatttagatgaaactcatcgatctcatctctcactttattatatttcttaccacatcattaaaaaaatactaacataacaccctatttaaatagaatgaaactactatattaggatgggccttatcttaacctcggtcgtctccttcgatctaatggctagaaaattgtctccaagattcagccaaaaagagagcagggagatatggagaagaccgactccccggcaatgacagtgttgccgctagagccgcgaggtcggaggagggtagtggataagtcggcgatagaggaattagatcagagtggtaggggagctaatgggggcaccttgccgtctcccatattgggtaggaggagaggcggggagggaaggggaaggtcgattggcgggtcttgttggcatgctgagggcagggatcgatgtggtgacacgagtagggtcaaccaataagtcaccaacgagataaaggttggctggagctgaagggcaccctgaaagaccttccagggagaccagtgaccctataacgatataagtctaccctatgaagaccaaataacctgaatatgttgaagaaggggaaaaaaccctcgtaaatgtttctatcaaggggttatgcatgtaagagtttgtgtaagcaaatcctaaggttagttagcaaggctaaaaacctacaaataaatcctaaggatatgatgcaagggcatgttgtgaaaaattaataccgtacactttactgtttttgtctatatttttaagataagtgtttatcttttaacagccatatagttatttaatggtcccttcaacaaactatactgaacttttgaattctcttgaactataccagtttactgactcaatacttaattcctacgcgctcaataagactgatgataactacaataactgaagtactgaaaatttaccgtcgcattttcaaccatacctctggcttgggttttagcatttctaagatattgtatccgaggaaaaaatgtgtaattgtttctctctaactctagtcaagaaaatacattgtttgaagatatcttaaaataaatctgtcatgatttacatgaaaatcatatggtggatttaaataaaaagcagtttaatatagtactatcatgtagagctgtttatttgtggaagatttgaaaactagctttatcacttcagcatggagtaagtgggtggtggatgccgttggtccactcactaatacgtgtgcatgataagctaaattatgtcaattttgtgctgcttatgcctcctccaataaaggtgagtcagctagctaataaatctccatatcagcttttgtatgatgtggaagagagagaagataaggagagagaatgcactatctcttcttcaagagctaagcttctaaagaaaatatgagaggaattgtgaaacccaaagcattttaaataatatgctataaaataatttattggagagttaatttttttctcttgtataaggtgaacaagcatatccattaaaggaggcgttacaagagagatcatttggcgtggagctcaaggtgagaaaggtgagctttacacgtgtgcacagtatcagcaaccgaagattttttttttttttacagtgactctacaaacaggcacttcacatagtagtattcaaaacaaaatttaaactgctggtcatcaatcatatgatgcaacggaacgggcatattccaaatcggacatcgtacgggattatcgagagactttgtgttgcgattgtacatgacaaaagattatgataccgataggacgaaccgtaccattatattgtgcttgggatgctgctcatgagtcgtagcttgtgttaattttgcatatttgtacgatgtacctaacgaattttgaatgcaaatttacgagctaaattaactggccagagcagaacccgtccttcagcgacttctgcacgtcgccaatattgacttcgagtcaaaatttgatagtacgaattcggtttgattaatgagacaaaatagagtgcgattgatgcttccctcctaacatgataatattttgtttaatgctgaaatcaagaaagtgaaggtcaaaacatatcttttcgtgaatcagccttgtctgttggtgcttgtttagttcgcgaaaagaaaatttttaagcgtcatatcggatgtttaaccggaatttcggatacgaataaaaaaactaatttcataactcgcctgaaaaccgcgagacgaatcttttgagcctaattaatctgtcattagaacatataggttactgtagcacttatggctaatcatatgtactaattaggattaaaagattcgtctcgtgatttctcccataactgtgtaattagtttttttagtctatatttaatgctccatgtacatgttcaaagatcgaatgtgatgttttaggaaaattttttggtgaactaaaccaggccttgtttagttcatatggttagctttaccttttgaaagtgctactatctttttttggtgaagttcgctcccatggtgagctgcatgcatgtgacagaaaaatcagaattgaagttgacattgtgcttactgcttacgtgccaccaaattacagtgcttaaattcagaattgaagttgacattgtgcttactgcttacgtgccaccaaattacagtgcttaaattcggttataatttagaataatcagggatcatattggcttgcttcaaacatgtccaacagagaattgagcttgagtacttggactgtagtttttttttttttactttcatacagatatttatagatttcttcagttagttctttcaaatgtgcaatacgaggagcagtataccatcagtatgacagtcatcaactggtgagcttgtatggcagaaatgggtcctatataaattgaattactaattaattttagctgcagtagtgccagggtaccacctggtccaccagtctaccaggaacactgttcgtccgtaaacatgtgtgtgataaagaagatactcagagccgtatttatttcagtatggcacaggagccatccaaaatggcctaaaatccagcgtcaagttgcaaacaaaaagtatatatattcaactaagtttgctgacaaaaaccaacataaccatcagggaacataagtttatatatgttaaagggtgggtggttcgtactacaaagacggtgtacttctatgaagaaaatcttcatggagtcatgtttaagttgagtgtgttagctacttttgttctcttttgagaggaggtttgattgctaagtggcagcaatactaattgctccaattctgtcgtttctgaagatatataattcttcgtggagcccagagcctgaatttgagggttgccttacataagcacattagaataaccaagaaacctgtcccatggtcaacaatttgtatatcgacacttcaaccaacaaccataaactccaacagtgctaagttcaaaacgagataatgggtaaatggagaacagagttcctgaaacactacctgattacctgctataaaatggaatagtcactcctagttcctagtgttgcctaactctagaaaatcttcatccgccgtcgatcgagacagggacggatgaagcaatttcacaggaattaaactatctcctatgaaattcctccaaaatttctacgtttcaaaggaaccatgagtgtgtggacggaggacacccggcagtttctgttgtagatcatcccctgagtcgggatgtgagaaacatcacgtggcataggcaaaccatcctatccaacaccatctgtgcggcacatgtatgatgaaattatcaacagtgaatcagtgtgatggtttggatgatgctctgaacttgagccgtggagagggaccagttctggatgatcacttttcttgatcaggcgccggtccggtcaaggcctcgatcgctcgtttcgtttggtggttgtctaccactcattaccaaagctctgggacgagaccgaaaacttctttgttttctccttaaacaatgattacctgaaagcaagattagctataacaaacgtaacgtggctccctggctaatcaaagcatatggcgtcttgtgccgttgttgcttcatgccactgtgcacgcaaaggccattccttcctgccaagggatacccagctgggaatgtctctgacagaagagaaccaaaatggagacgtgaattcagacgtagtatctgaacatggagaagaattgtggattttggtgtctctgcagatgcagagaccgacagatacacatatatacgtatagggatatgctcagtgttcagtgttgttgccacctgccaatccgtcaggttaacgatccttttggaaattccacccgtgcattcttgtgtgactgtgtgcgcgaatcatgctctgctccattattggagctgagcttggcgtttggcatcttcctgtttatctggttaacttcgtcgtcacctactggctactcactccccctagtctttaacaagtcgtaaagctgaatagttgctaacatgttagcccacactgatgcagggggttaagagtattcaaatcggagcttgtcacccatttaacaataggtgtctaacttggtcggccattacacgggagtattctagatcaaagtgaggtaatcagcactaagtaatttcatcaacacaagaacagatgcatcaacacaagaacacatagggacataggataggaggcccttttttgcagctcctgggtgcgtgatgaaccgatgattagtgaagctcaattagtagctccttgacctttgccgccaacgaacgcagattcaggcatcgtttcagccataagagccactaaactgaacaataccacttttgttcatatgggaagttactaaagatcacccctgtgtgcgatcacatcagagaagtgaagtcacgtcacgttggattgtggcgcagattgctttatgcaaaagcgtctcactctcacacaaaaagggggtcaaggccgacgcttagctgttcaactcttggcgagggcgaggcttcagatcagatcagatcaaagatcaagatcagaactaccgcgatgaactgctctgcaacaaccgacaaccgcggttaatgtccacaagttgtgtgagcactgttcggcgacgaagcagaaacgaacaacgatccgtgcagagagacgagcgacgacaccaccggcgccgcgtgaattcgcggtagccgagccggggaagccgtgaggcgcgacgaatccgcgggggatgtgatcagccgaccgccaccgatgggccgtgcgaaacggcaaaaaaatgggcgaaacggccgaggccgcgcgggacgggccagcgctcggtggagttcgtggaattcacgggatttcacggggaatttggcccgcgtgcgtgtgggtttacgaggccagccagccagcccaccgtggaaagctactggctggctgggttgatgccttgatgggttacaagtttacaacggttgttgggtttggattctataatcaggaggacgtgtcactccgtgtccagttctactacttttttctctttggaagcgcaaggtgcaaagcatgtgtactctatcgttcatgtcgtgacgctatacaggtcaaacatggagaattggagataagagattatggtgttctgacagtacttttgtagtccatctgctccctgtttgttgatggtgattgttggtaaaggtgatctgggtatacagaaaatgattcagaaaaagaaacacacactaaaagttgctgctatgtttcttttttcccttcagttactaccaacaacagctaaaaacacttgctcaaaaaaaactgaaattgaatttggcatctagatgatatttaaaattaaaatgttcattttgaactatgtggataatctcaaggaaatactgatctaacggtggaacaattaacatttttttttgcaaggaacaatgaacatgattgcctgattgggagggagtaagaaaagataacattgaactttcctcaccaaagacctcgatgagaataccatgtgctcatccattttgcccgttctccgtactgccacatgaagcacgctaaactccatttcaacaacaaaaaagaattaagtaatgtaaacctcaagggatcagtttcggcacaaacaatagaaaagcccaactggcaaagccaaattaacgagaagagagaactatatcacgagaactcttgactattgattgcgcatcacatcgagcagcctaaggaatcctaatcatcatcatctacaagaacacaattcgcctaccatcacgtatactctattgctaacagttcgtgttagaccaaataaaaaaatataatcagaagtaatcaaagacgagtgaagaacaggtcagagtgagaccacaacacttgcgagaaagaagacgactggccatcacgagcagaggatgtggacgtggccatgtgaagagtcaggccgtgtggcctccacgacagtataacccgtgttcatgcacaaatcgcgccgtatcttttactactcgcacataatttctccgcacaaaatgacttatctttttgttgagaaaaatgaaaagtttattctacttgggtagtagtactatgttggctgatctttttttttctccctttttagcggttcatgagagacgcgcacgaattgatgattagttgcttggttggatgaataatttgcagtttacaaagtgtggagaaaggttccagtttgagatgaacacggaatgtgtcggaactggaattggatggattgtttatagggcagcaaccagctaccaagtgattgctaatcaagctactcaattccattcctttcatttcaatgattgagcaataaccatatgccgaataattttgtaaaaatggagcagaaagtgcgagacaaatacacacccaatccatttgttcttcgattctttttccctcaaccacctcacatcaccattattgttacactattccttttccaccacttatcctcccgtttgcaattaaaaagaataaaaagggaaaaacaattgcgagaagagaacagcataataataacatccacaccttcaattcccaatttttttctccatttcttgctaaaacagtagattttttttttaattttgtttgcctctcagaacctaacgatcttggccgcgcgcaccaccgggttgtccctggcgatggcgtccctcgccgccgacttgtagtcgtagctgcagccgtggcggtcggagtaccggtgctcgccgcagaacaggtggccgcaccggcaccggaacccggtgaggccgacacgcttccggcacctggagcaccggttcaccgccgacgtcttggcgaccggcgccggcgccgtcgcgagcgcggaggccatctcctccacaggcggtgggagaggagcctgaggctcaaccagcggcgccgccggcctcggcggctgcttgtcgagcaccggtgacgacaaagaagacggcgacgaggtggacgccgtggccgccaagaagcagttctggcagaggttctgcgtggccgggttgcccgggaatccgcagctgttggcgcacagcgtgatctccggcgccctgagctccgtcggctcctgatccttcttgtcgcgctgcgccatcgtcaataaccaaaaaagaatccccctcttggtctcaggctctctcagcaggctgaggattccgctcgcggtttgggtttgctgtgtgatgaggattgcaggagagatcgaggagaggatttgatcgggaatggcggcgaggcgggggggctttttatggacgcggaggcgcagcgtgtgtgggggtgggggcagcgacctgccccgcctgccgcgcgggcgcgtgttatttccggtattggcctcgttggcgtcgcgcgggaagggggggggggggggggggg

SEQ ID NO: 81780 - DNA, 20336 bp, Oryza sativa
tgacatgtgggcccacatttcttttcatgtgaataactaatgggtcccacgcgtatcccttctttctatatagttaagaccgaaagctgatttctggttgagccacgtcacctgttaaatcttagtcattcgatgtaatctggacgctcgcagctgccaccgccagatgcagtcgcttctcctcccttctccttcaccccggcccgcgctcgcttctccgccccgcacgcgctcgcggtcgcttctcctccgtcccctgcgagatgcgcggcgggcccgccgcggatgcggtcgattccccttccctttgcgctttcttaggatgttcgctgtcctccgcttccccccgcaccgatcctccccctagcccgtcttcgccccccatcgcatcgcctcccgcaccatcaagattccggggccggagtcatgcccccagcgcagcaggtggaccctccgccccatggccgcatcgcctccccccagcgctgcagtcgcccctcccgctctgccctgcgacgtcgcaccctagcgccgcaggtgcctcacacccccagcagccgcctcccagcctcttcgcctccttggcttgtatggagaaagggaaccatcgttgggcgcacgctgaaacggaaaccgttcgatccccgagtcccatctattcatcttcagttttttgaaacagtacgtcgccgcttgctttatactggccttctttcccgtcctatttatgtatgatgatacacacaacagctgaagaaaagtggtacacagcagctggatcaatctgctcggccagctagtagcttctcctccatacaagcacatccttggattgatctgctctaggttgtccactgcttgccgatctcacatgttccagcatagcttctttccccattcagctaaatttttttataatacatattgtttgatgctaattgtgtagtcacactaatttcttcgtgattcaattatcaatttccaaccgatttcagtatcccaaattggtcccttcttttttccctgtataacagtatttgcactaacagtttaattattcccttcaatttcttcacaggattaactacttcgatttcgtcttgggtttattactggattaagtaatccacaaccgttttacccaggttgttgaactattatggggaaatttctttgacggtaatacgtaacaatataatcctttttcccctaactatacaatttctattattatgctcctttgttttccatatttatttgtcatattgtgattattctggttaccttgcatctatcaagcacctttgtattttaaggttttagtattctattatgttacatggaaagtttagtagtacacttgctgcactgaatccctacagataattcctatcactgaacaatgtttagtgaatcaataattcctatcactgaatgacatttagtgattcaatgattttatatgtatcttgtatacttggagtactaaatgataagatgaaatataactgcagataattcccaacttatcaaaagtttggtgatcctttagtcagccctgtaagcatgattcagtgaagccatggctcagatggctttggcaattctttcagtaaccatcaataatgtaagtgccagctacagtttgtataggtcccagtcttctttgatttgtttaccaaatattacctgacctgagttcacaatttaagtcataatagtatgatctcaaaattctcaaattaacttaaaatatgttacagtttattttacctcaaacttacattgattcatataacatgtttatcttcctcatgtactgagaaactgcataatttatcaacttttcatgaattatatttcctcttctgaggtagcatcatgtcttttgtatctttcatgaatcatatttcctcttctgaggtagcatcatgtctttgtatcttaggtgaatcctgtttttttagatatgatgatgatcttcaaacttccatctgtagtgtgtgtgtgtgtgtctatatatatatatgtaagacaaggactgcattgagtattttcagtattgttcttcttgcccccatagatttggaagctagcgtttgatcaatatactcctattttctgtcaggcactattgtggtgttttacatgagggggtctcaatgcactcaaagtgaagcattgctatcagattattccttgcaaaagttgctccactatcatccagaatttcagactgcagttggtattgcgtcagtttcccttctttgcttatttttttttatctcacaaagtgtacttggatttttaaattctatttcaatacaaatatcccgccgcaacgcgcggggtatcaactagtttattttaattctaatgccacttaagcgccacgtcaacgccacgtataaagaagacccggtcaataccgccacgtcagcaaaaccgcccttcaaaaccgtcttaagagtcaaattgcaccggtttcaatagttcaggggtcgagatatcctccggttttatggtttagggtcatagattagattcgggtcactattaagggagtcaaagtgaacttattccttataaaaatgttgtaggttttacaggtgttttcttaaggaaaaggtttgtaaaagaatgattttcacgagcggttctattaaggaacagaccttaaatacaacggcaatatattttaaggataaaatgtcgtaactctttcatatgaagttaattgatgacaaaatttgcccaaaaaaaaagtatagctctcaatgagatcaacattatgttaaattatttttttacatttgaaattgtttatggcctaaatattcgttacaagctctaatatatatttttacaagtggttctttaggaagataaaactttgagaattcattttgagtccaattgaaatgaacggaagttatctgagatccttacaatatttgtttcaaacagaaaaccaggccattcgcatggatggttcatgggcctggtttttgcccataagaaaagagccgttccagcatcctcggatccgcaatggctgaaatggatcgatgaaacgtcggggaacacgttctactagtggaaactattttgatccctcgagaggatgccccctcgttgtttacatgtcactcaaatgatttttaaaaaaattaaacaaaattgagaagatgtattaacatatgatatatcacttcacaaatatacaagttcaaattcaacttttacatctcgcaacgaaaaaaaacaaatttgacttatatattcgccttgccgccctccccgagagtggcagggtctgtttctgtaaatatttttgccgataatatttctgtaaatattaaaaaaataaaaatttaaaaatgaaaaaaaatcagtagtcttcctatcctgtcctatgcactctgtccatcaatccatggaagacgagtccaacaattaattaaattgcatgaattagagctgatatcagttaattaagtagatggaccggatatgaactatcatgtgcgtccggcgctctaggagtgatcgaacaaagcgtctcctaggagttagcacgtgtgggcccccagctttacacacgagaaaccccatgtgtcttacagtagcacgtgtgggcccccggctttacacaccagaaaccccatgtgtcttacagtaccatttcctaaatcagtagatggtacacacatggcacgcttgaatatctcaagctgacatcattatacaggttgaactgtacattaataatagaagggtagcctaaataggacccaaatagaccgagcatggtcataaacaataccaaatatccaaagaagtagatgagctaacggaagcgaagcagcggcggtccaacatactccacaggcatcgactggtgcacctaggtcccggctccacggtcttcgacatctcttcatcagctagttcccgaatggtcgactccaacttctttctaaaagatttagttaagcaagggtgagtaccaaccgtactcagcaagccaccactacagaatgtatttagtgcacacagggggttaaaggatggcttggtttatttgcaaaaagttagatttcacaaatcagttcacaaacctaagacctagcagttttaaatgaaaaacaacgttaagttgaagttgtcattaatccgcgaggattcatccacattcccaaagcctcgcttggtccggtttaccctcacatccagttttccacattcccaacatcacaatgaccttccctgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaattttctcggatttttcggagctcaattcctaattttaatcttacaaagagcatttcagtaattacccacatattaaattaatcattaaatggtctaattataattttgttaagtactttgagtgtccaagtattttcaagatttttcttggaattatttgagcataggaagtatttttaacaattcaaagatcatttcagtgattaatttaattggaaaagtatttaaaatccccttctccttttcgggccgaaataggaaaagttcagcttctatcctcggcccattctcccttcctttcggctggccttatccctcctccaaagtctgctttgtgtccctttttcaatcgggccaagaagtagaagcccagcaaaaagtctagtttgcctccctgctacagtgtcatcttcaatctccagccggctggagacagagcccgagccagccgcacagtacctgtatagccgcggttttcccctccaaatctgaccttttcccttgtgtttttctaaaattagttgaggggaaatattcctcttatcctcctctatctttacccccaaaaatcggagcaaatcgttgagtattttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgcgccgccgcctccgtcgtcgccgccggtcgccgtcaccgccgtaaggtgcgccgaggtgtggagaagcccggccgctctctccccgctgtcgccggtcaccggagtcccgtcgccgccgtcgaccgaagccgtgccgccgctagacctcgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcctcatgatgtcatcatcgtttttctttttcctgttgttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtgtagcgtgattcattagagtgcgccagactgagaagtggcgagaagtccacgggggtcgctggggagtccatgccttgtttataagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttataactggtaacaatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaaacctcagttgaagataaaggatccagaaggagaagacgtttggcttataccccagttgagctgcctgtgggagtggagctgaagccgtcgctagatcgttattccgctgctgttttcttttctttgtaagtatgtaacgttattattaagatggatttgtatattaaattgtcagtttgtgtacctcggctgattcctggacgaggattttatgcacaaataagttcggaaattactagtgaatttccgggcgtgacattcccgcccatcgggcaaggtcacaacactttcctaatctaagcaatattaaaatctatgaggctagtcaagtgtagtacaagtcccggcgctcaataaccgcgagcacggctattcgagtagatttgatttactcacactgcagtggatgtacgcttttaatcccgcactccatgacttgcccaacacattagcctaatcccaacacatgagacttgtcacgccccggtttttcagtcattcttgcatttcggcactcgctccaaggactataaatccccattgcactcccggcacaacacaccacctcgagccggtagtgaggagagtcctggcgctcccgggatcacaagaggttacattacatataggtgaggtgtgttttaagttttgccgcggcattcaaacgatcgatccaatcgatccatcacacttcccacacaaacgtcaccacttcagaaccaccatggcagtggtgctgtcccacgagaatttcttagtccaccgggtctatacccactcgagaagtgtggtcgtactctgatcgtttcctgcataccttcttgactcggttcttaattgaccagggtcggcgactagccgtttccagaaccacccatattctatccatgccgcctcagtcgaaagcattttgtctaattaggtttttggttttcgcaaaggtttttgtgtcgcgggtggcgctcatgcctccacccgccttctggcaatcactctcgacgagtgaccaccgccaacacatccatatccaactattatggagtgtacaatcatctatatatataagccatactaagcaaatgtcaatatttgactacgtatgaataaaagactcaggcaacaaggatataataaaggtaacaatatcaatgatggttcacatacaactttaggtacgcattttataattagcatgcgactttatttataaacaaaacatttataaaatgggttcaatatgctcaaggaggggagcatactgacttgccttgcttttagaaatcgatatcttcaagaaatccacgcctgatgaatatccgcaatacccaatacgcggttagcacgagaaaaccatataacaacctccgaataaagtaccaaacagtagtgccattggatagatcccgattttagaaaaaaatccggaagttgaacggaatcaatcggagtcacggtttggaagatatggacttccgaagtttagatgatttataaaccgaggaaaaggatacccaaaataggattccttttattttggaggaaatattcctaaggtcattctctggaatggaggaggtatattggacttgggtggagatgaatactactgctgggctactgcccgaagcttggaggagggatataatacagacttttctgtgggattgattctctggcttaaccaaggaagtggggaatttttttcatttttcaatttaatttttttaatatttacagaaatattatatcggcggaaagatttacaaaaatagaccctgccgccctttatttgggcggcaagctgatgtggtacacgacgttatcacgacgccgtgtgcattttgcgtttaggcccttacagccctctgtaagggcggcaagaggttaaatgcaatttttgtcctaccaaaaaagcaattggctagttctttttgcatatgagccctttcccgcctttgggaatttggcgcggagaccccttgcaacccaaacatagggcggcaagggggccacgtgcaaaattcgcagtcccccaaaatgaccgtcctgtgtgccacgtcagcttgccgcccaaatggagggcggcagggtttattttttaaatcttttcgctaatataatatttctgtaagtattaaaaaataaatttaaaaatgaaaaaattcaggaagttggggaggtgatatagactttttgggtggccaaaggtttccaaggggtcaaacaggtgggtcccacggcccccttttcctttttcttttctttcgtattccttctctctctttcttatctactactccctccgtaagtttttgcttatagtgtttgaccactcgtcttattcaaaaaattttagaattattatttacttttttagaattattatttactttttattttttatatttgtataaattttttaaataagacgagtgttcaaacattacaagtaacaaaaaaaaaactcaaaattcatattatgggacggagggagtactctcggtttctcgtcacatctctctctcggtctctcctctgcctcttcacgcgtgcctgagaggaagacgccaacgacggcagtcggaacgggacggcgatggggggaagagagtggaataagggagcagcgccggtggggaaagggaggctggggcgctggctgctcgggctgggcggcgtggcaagaggcggcacgacggcgctcggcgcttggcgcggcggcacggccggcgtccgggagccagggacgacggcgacggcggaaaagaggaggtggcggcacgaggaggagactgcctcggcgctgtcggcggggctgtgcccggctgagctccggccggccagcgtggtggagggagggcggtggagatcagggagacggcaagaggaggccgtgtccgtggtcggcgacctggtgacggcgttcgtcccggcacggtgacgccgccacgcgcaagggcggaggcgtgcgggatgacttggccgcgcgcggggcggcgcttgcggcaggcggtactccactcggagcggcggtgacccagatcaaggtgacgatggcggcggaggttgcagtagcccctcggatgggcggtgatggaggcgttcgcgggagctgctcacgtggccgatgtggctgtgtgcggcggcaccggccccgagggtccttcggccgagcggaggtcgaggcggcgatgggaagtggaggagtgtggcggcaaagcgatggccgacgaggttgtggcgaagcggctgtggcccgtggcacacgggtccgagcggcgtggcgcccacaagctgctcgtccgtgcgccctagccgacgggtgatgatacgaaggtggcggcggggattggagtggcgacagtggaggatggtggagtgaggcggcttctctagccattgatttgcttggtgatgcggatggcttcgagggggaaggaaaggggaaggcagaggtgatgtggcgcgcgcccattgcttggacggcggcggcgtgggcccgggcgtcgacatcgacacagtggagcacgtgtcggcggtggatgggatggacggcgatgagatgccgacatccacagggtaaggcttactccgtccaagaaaaaaaaccctggatttcattatgtaacgtttaaccttcatttgaaaatttgaaaagaatatgaaaaaaattaaaaagacaagtcacgcataaagtattaatcatgtgttatcatttaacaacaatgaaaatactaattataaaaaaattcaagtaagacggacagctaaacgttggacatataaatctagggtttgtttttttttttacggaggaagtacagggtaagcttcgcctctgagattagagaactagctctccccttttcggtgtggactcggctcttctattcggcgtgaaccatcctcactgtgcttttggtgtttggggcagagattatgtggactgggtgcatggcgtaggaggggctgcgccagtgcggctccccggcggggattttggactttatgccatcttctccaacgcctcattcctaaatgccaccctcctgaacatcctcgctaatttgccactgggccccacaaaactgttgtttctatgccattttcctctaattttaacgccaccacaccggcagacgtggaattcggatggtgaaatgtccatcttgccccttggcgcgcgtggacagaaaaaggcgttgtttcttcgtcgtttcactccgcctcccctaaaaaacatgagcagccgcttacgaatccaccgagcagcgacggcggccaaaccgtgacagcaatcccaggtaggagatcgatagatccaccatcttcccctcttttggtttagtttggcatctgtttccctcacttttttctccggattcacttgtttttttttaagatctgatagtctagggtttgttgagaaggaggcatggttccgtctgagtggccatcgtggtaagatccaaaattcctgctttattctgtgttgctttcatgtgtccacacaccacaggggcaagacggccaattcaccatcgagattccacgtccgctgttgatgtggcgtcaaaatgggaagaaaatggcatagaatcaaccgttttgtggggtcaatggcaaattagcgaggatgttcaggaggatggcatttgggaatgaggcgttggggaagatggcataaagtacaaaatccctccccggcgtgcgtgcgttgaacgttagttcggggcggcgcacgacactgctcgtgctgccgcgtggtgcggcgcgacacggtgtgcggtgcgactcagcgcgggagcgcaatgcggcgcacgcaaggaggaggagcggtgcggcacgtcgcggtggctcggtgacctggtgcgccagccttgctcggctcggcattttgccgaccacgtggcgggcggcgtgtcggcctggccgactgaggcaaggaaggaggggaagaagactcggctacaatggggcaggggacgcagaacggacttatgctgtaatgagctgttgggttggctgagaacaggaaagcccaagcaataggagtatttgaatgactataacaaggaatttgtaactgggacttgaaattggaatttgtagattgcctgtaaacatgtaatggattgtatggttgtaaatggactgtataattggacaagtgactttgagccgagatttgggattgtgcacggactgtttaattttgggtatttggattggattcgaatcggcctctcagttgcccaagtatttaacttaggttttcttggcaaccgcttgaatgaaaggaccgctatatcgacggattttagaacgatgcttggcatacaaatccatcggacgcagtagagctccaaaggtagggatgatatcaatgataggattaggagcggcgtatggcacacaaacccatacgttgtggcaggattcaaaagttgatatagggtggaggatcaaagaattacgtacgacaattaaatatgccgaacgactttagggttttaagcgaaagccgcactcaaggacttttgagtagcatgaaactaggaaaggaggggatccgagggaggccaagttgaagagacgaagcaggtctcgattcaatcgcaaggttccaagggttggggaaaagaaatgatgttgcggcaaaagaacatgttccaggacttcgattagcttatcatcgaagcgcttagcaaaagggaaggacgtcgatcgaaggacatcctttaggaggaatgatttgactgcggtattccaacgattcaaggacaggacggatagagagttgagaggacataggagggatttcacaaggattgatggattaactgagatcttggtacaaacatatgaatgcacacaaataacacaagtcccattatgtgggtcggcttggcctttcaaggaggaaagctaagatttttccgtgagttcttttgaaataaaattcttttaagattttagttcgtaaattgagttttcctagtaaattccttcttgtctttcattgtaaaataatttccaaacacttataatttcaaaatagggttttcagaagttaactaatattagccctcatttgtaaaaatagttttctcgaggaaatatctctcaaagtatgttttctaaatatttagtatttatttttgtttatacatcaaatacatcaaataggttttatttcaccgaaaaggggtttcagaaagataaatagtattttttaaatattttcttaattaatatatttcataatcatggttctcttaacaaataatatttgaatctaaataaatttgtccctagatttctgtcctcgtggtccaagcgcaaccgaaaaatgggagataaaatccaataaaatccagcatgactgattttggagaagatttttgattatcccgaattttcaatttcgcaaatcaaaatagaaattttcagggtgtgacagaaactcatagaagtggggtcttgctggagagtcttgtgcatataaagattgagccataagttgatcaaccaccaaggtcctccaggattggtgatcggctgaccagtagctagcttagccgatacattgtgcaacaacgaatatactgagcctagcagatgcttgcccagagggatggagtggccagacacaagtgcttctgttatcgcctggggatttgtggtcgggccgacagtttttccacagtatatgaagcgttctagccacatgttgaggaatgcaacgtgatccctatcagtgacggtgcttgtcttcatgtggtgagccatgtaacctttccaacctccggcgtccttggttttcagttgataagtgggtttggtcatgaggtggaaaggattgtccagagccgatatgttaagtgatgttagcatgatgacatctatcaaggttggagtcatcgacccacgtccaaagagaaaggcgttcatggcgtcagaccagaagtgggcagcaactattaacattgattcatttttggccatgttgaagagggaaaagttaatgcactggtttatatcataaacttcccatatggtactcttagcttcagagacgcggaggtaccagttcctccatcaaggaatggggattggccaagatctgaaggcatttgaccactgtgatagatccaaatttgcatgtttgaagggcagacgacctatttttagattaatcggatctgtggggtatagatcgcccatcggtcttaaacatactaggacaggtctatcttccaaagcgatgataatcatatatctcagattttagatgaaaaaacagaaaagaggaaagaaaagcttgaaatcagaaaaatggcggaagatgagtaaagaagatgagaggatggaaaatggaatcggggattgtcctgatggaagccatgagagtcgactagagaagcttgctgcggtaaaaatcttgttcttgaggaggagttcttgaacttgggcagatgggatcttgagagcgggctctgtttggaaatggcgaaagtgaaggaagaagaaagggggcagtcgagtggggctttataggcttgcggtgggagataaggctcgattttcgaggcgtcgtttgtgcaagacacaagagaccaatcgctgtgtggcgcaagaattgaggaaagggtgcaatcatgacttgaaagaatttcggaacaaatccatattttattccgaaattggggggcatgtgctgacaccttttttacatcaaactggtcaaaatgtagtcaaagatggagcaagccgatgaagctgacatagccaataaaactgctgaggccgatgaagcatgcagccgatggagccgacgtagcgtgtagccagtaaaggactgaaggattagtcgacgtatggcattgtggggccacgaagagttcggcttgtattaggagagtctttattttaggaaattgtaattccttttcggtcaagttttgtaagtcgtagtcgacaaggagtctttagtttaaactataaataatagcctgatggctttgtaaaaagtctttacctaccaatcaaacaaacaagttcttacttttcattgcaatttattttcaaaccctagttttagtagttcatcaacgagttctttcaagttaagcagggctgcatcatcttgatctccggcttgcctgtaagttccgcttttatctggtgcatctagatttaaacttccgggtgtatcgctgtagtttgatctagtttctcctaagagttatcgtatatactagatttagggcttaaacgcatcgttttgtcttgatctagttgttacacaatttatcgaacgtgtctgtcctgccaatcaaagttgtcttataggctttctttgctctgttttatccatacgttcaccaagttatcgatatttgttaaatcttaatagattaattatttaaattttttaagctttagcttttatcacaatttatccagtccacttacgagcttctcatcggcttcaaagcttttaagcgcatagccgatctagacttggatttggactttaaactacgcatcggctgattctagccgatataattttcgaagacagttcggaatcatagccgatctgtgaattttacactctttatcccttgtcaattacaggtcaaattgactgttatgccccgaacctcaagatttgcaggctcatcattggagtgaagcaaacctctgaccccgaacctatgtcgcgtgatgcttacgtgaacaatcatcgcctgatttttgcgtcaataactcactgtttgatatgatgccacggtactgcgggcacgacgacgtacggtgcgcgttcgcacagggaggacatgcacaagctggcatttgtgtacatagcctgcctgccgcaatggtttccaagttggaaataaacggtgctctatcaattaaggccagtctcactgcacagtttcactacacggttacctagaccagaaactaggtaactgagccaaaggagtttcatggtgatgaaactcctctcacataccactacgtcaaaacccaataaagaagacacaatttagtgacgcgaatttgtcacacgtctcaaatatgacttcagtgacgtatcggtacaagacgcgtcactaattagttcaccccggtcatatgccagcccaggggaggcatatcacagatgtgtctccacaaaacgcatcactggagttgacatagtgacggctcttgttgagacgcgtctctgacatgtgggtcttccagagatgggtatagtatgagcatataccagagtcgcagttttacaatccgcgtcactattgtggataatattagtgacgcgttattacgatccgcgtctctacctcgggtaaccctatacaagtgatgcgtttggtagaaccgcatcactaacgtcagcttttggcgcgtgggcccattttcttcccgcgcgccgccggtgcatccatcccggccggcgctgtcctgtccttccatctcgtcgccgcccgtacgtccatccatttgccagcagcgatgcccaccaccatgcaccacccatccgagccaaggctgctccctccacgccaccaccgtcggtaggtgctagtttctccctccgcgccggcggcggtggcaggctgctcctctgcgccgcctcgtccatcaatccgccggccgaccagtacttcatctggtgctttgctgaaggaaattgatgatattcatattcaatgtataagttgccatgtgctgaatatgattgttgatgtaatgaaagattgcccttgttgactgatatactgattttgtattgctcttttgagttttgatgttggtagttttgtaaatgtagggattcagtagatagttggtcatagaatttagtatataccaagtggtaggtctgttgatgcatcatgcatgagatcatccaatacttgggtagcgagtagattacactagtacagatccttccatttgtgatggcccctaacaagacaggaatttgcgggaggaagtaatctcaatcgggccgaagtttcgcccgattgagatatggtcgcacagccatgatagatcggcataaaactaaaacccgtcacggatgacacttatctgtgacgggccataattgaggcccgattgagatgagggttccatatctcaattgggccctaaaagaagcccgtcacaaatgactgtcatctgtgacgggcaccaaccagaggcccgattgagataagtttaatgcccgtcatagatgacactcttctttgacggtcttttattaaggcccgatagagattacttgtatgtccgtcatggttgattgttttaggaccgttacagatatttgttgcacagtataaatacccccctccacctagtgtaactgtatcccactgttcactattttggtgggaggctgcagggggcgatttttttgtcttttttccaaggaaaacaaaaaattcccaaaagtgatcaaaatggagcaatcaagtgagtaatattaatcattaattgagcaatttcatcacgtcttacttttgcaatactgatcttataagatatgcctctgatttgttttttttattttgtagcaattgatcgaagttgggtgtatgcgaaaaatttgaaacgtcattctacggagtacagaaagggcgtaataaattttatgaacgccgtggaggaggatcggaaaagaagaaacagtgattacatgtgttgtccatgtgtagattgcaagaatgagaatatgtttgatagcggagaggatgtacatggtcatctgatacaacgaggattcatggacggctatacatgttgggtgaagcatggagagctagaattaggaagtggagcagcaacagacagaagtggtgcgcataatcaggaagatgaagatgagcatgacatgtttataccttctccattgggcggtgaaacggttgatgtggattacgatctactgcaagacatattacgtgaccttgaggacccagcccagaacgagagagattccatgaagttcagtaggttggtcagtgattccgagacgcctctgtatgctggatgcaaagcaaatcacactaagttgtcagttaccttggacctaatgaagctgaaggcaagtagtggattgacagacaaaagtttcacagatcttttaggaattttgaaggctatgcttcctgctgagaacacattgcccgagacgacatacgaagcaaagcaggttttgtgtccactggggttagaggtccgtagaattcacgcttgtccaaatgactgcatattgtaacacaagcaatatgcggacttggatgcttgtcctgtctgcaaggcttcttgatacaagtgaaagaaaagtgctgacgaaggaaagaagtcaaagaggggtggtccggcaaaggttgtgtggtatctacctatcattgatcgtttcaagagaatctttgccaacccgaacgaagcgaagttagtacattggcacgccacggagagaaggaatgacggtatgcttagacacccagtggattcgattgaatggaggaatatcgatcgaaaatacaaagactttgctgccgaccctagaaacatgaggatatgtctgtgtacggatggcatgaatcctttcggtgacatgagtagtactcacagcacttggccagttcttattgcgaactataacctcccgccatggttatgctttaaacggaaatatattatgttgtacttgttaatccaaggtccgaggcaacccggcaatgatatcgatgtattcctagaacctgttatcaatgatcttgagattctttggaaagaagatgtggaaacttgggatgcatatggtcaggagaacttcaagctaagagttctattgttctgcaccattaatgactaccctgcactcggtaatctttccggacaaactataaaaggaaagaaggcatgctccgattgcaaggaacatacacgaagccggtggctgaagaaatcacgaaagatggtatacatgggtcatcggaggtggctcctgctacgtcacacatttagaagaaagaagaaaatttttaatggtaagagagaacttcagcctgctcccaaagatttgtccggagatgaggtcaacaatatggttaaggacataagcaatgagtttgggaagaaaagaaaacgtggcaagacaaaggagaagggtatgtggaagaaaaaatccttattttggtggctaccttactggaaagatcttgatgtccgtcattgcattgatctcatgcacgtagaaaagaatgtgtgtgagagtttggttggcctgatgttgaatattcctgggaagataaaggacgggttgaacacgcaccttgatctacaggacatgaatattcgtagtgaactccaacccatatgagatgcagagacaggtagagtagatattctacataaaagggtgggatacgccgatgaaccatttgtacttgcaaaacaggtcgagtagatattctacataaaagacccttcaaacaagaagatgcacatcgtgagggatggcaagcgccgaattgtaggagttgacaacgtcgtcgatgaagaagaatacaaccagaatcttcatgtaagacctcacattgaccttgacgatgatccccaagagcctgcggcatatgctcgttcagatcatacggaaggtataaccttgtgaccgatgcatttgtacttatctattgtaatgaatgaagtattttgttttattacaaagacttgatatgtgtactcatttatatggctaattttgttttattacaaatgttgtttaaatatttcaaatattcaaattgaatttcatgctattgggaatatagttatacataaaagtaaccaaaataaaagttgtagatcttgaaaggctctacgactttgctgtttatggcttttccatttgaaatcatttaatatttacaaatgccgtttaaatttgtcatatattcaaattcaatttcaaactattgggaaaaaagttatatagaaaaatgaccaaaataaaagttgtagatcttgaaaggctctacaagtttgttgttgaccatatttatatttgaaatcatttactatcctaaaatgtgttatgactaataaaataaattattacacaccagctatatattttgcactcacaaatacaaatactttaaatggaaaaaatggaaaaatagtcatcggtgatgggccttagtttaagcctgatagagattaatctatctctatcgggcattaccgtagggcccgtcactgatgactcatcggtgacggggtgcatactaatgcccgattgagatgacaatcaggcccgtcactga

SEQ ID NO: 81781 - DNA, 3986 bp, Oryza sativa
tcaaattcaatttcaggctgttggaaacaaagttatagagacaaatgaccaaaataaaagttgtagatcttgatgagaggatcaacttttttgttatgcctttctcatttgaaatcatttactatttacaaaagctgttttaatttgtcatattttcaaaatcaattttaagctgttggaaacaaagttatatagacaaatgaccaaaataaaagttgtagctcttgaaaggctctacaattttgttgttgaccatatttcaatttcaaatcatttactatctgaaaatgtattatgactaataaattgaattattatatagcagctatatattttgcactcacaaatataaagaattgatgggaaaaatggaaaatagtcatcggtgacgggccttagtttaagcccgatagagattaatctatctttatcgtgcattgtcgagggcccgtcgaagatgagtcatccgtgacgggcctaaatgtcatctcaatcgggcattagtatggagcccgtcaccgatgagtcatctgtgatgggccctacggcaatgcccgattgagatgactcatcactatactataactagggtttctcagatcggatctaaaatttttctaagtcccgctacagttcccgcctccttagaaccctagcaccgccgtcgtcctccattgccgagcccgccgccgtcgccatcgagcccgcggtcaccgccatcgagcctcctccgccctccattcgaactgccgccgcctcctcaccgacaacccccaccgagcccggtgacatccttcctcatcgtcgtcgcctcctcctctccgacgaccgacgccacctccaccgagcacgccgccgcctccaccgaccccggcaacgccctctaccgagcccggcgccgccgccatcgagactatccgccgccgccaactcctccttcgccgactcctccctcgctgagcccgaggccgccgcctccaccgagcctccgacgcccgatgccgcctccaccgagcctggcgcagccaccaacgacctcggcgacgccctccaccgagcccgccgccgccaccgagcctgccgcctccaccgagcccggcgccgatgcccaggtgagtcctccatcgcgcatgaatgatgaatagatgaatgtggttcgattgatgaatgtgatgaataaatgattagatgaatgtgtttgaatacttgcatgtgtatggatagatgaatgtggatgaatagatgattagagaggaatgtggatgaatagatgaaatatttaatttatttatatgtgatattcaattcattttacatgtggatgaatagatgattagatgaatgtgtttgaatagatgaatgtttatggatagatgaatgtggatgaatagatgattagaaatggatgtggatgaatagatgaatagatgaaatgtttaatttatttatatgtgatattcaattcagtttattagatttgtgagacgtgcaatttagtttatttatgtgaataagtgattttagaactttggattctaagccattgaagcattgaattctgtattttcgttattttgaaaaaaaagtagacgatgtctcagcaaggcgaaccaatgtcgacgacaactagtgggtcctcaagggcacgtactcctaggacagggaacaaaatccctaaggaacggttccgcataacgacagtgaaccaagtagggttgccgacaggtccaaggaaaatattgagccgatttaggtctatctgcggggtcatagggaggcagaaattaagtattctgcaagatgacattaagcaagtgccggccgcagagaaggatagtgcttggctagcgttcaaggagagcttcgattatcctgtagagcacgagaaccttatcaggcaggctgcttttaaggtcatgggcaacgcttggaagaacttcaagagtaagctagtcggcgagttcgtcttcaacccggcgaatcctgatccaacagagaaatttccttggatcacggaacaggtctgggaggaattccatgtgaagaagtcgacccccgagtccatagctagaagcgaggcatatcgcttgcttcagagcaagaaccagcatccgcaccggcttggcaccgccggatatgccggtaaggaagaggaatggcagcatgaggatgaagaagcggaggaatcgaacacaccgctcgtgtttggcgatatcccacaccctcgggctaggaactgggccagggccaggtaccagaagaatgctgatggcacaatcttcatgccaaatgcagaagatcaacgagtgtacgaagctatagtaagtgtctagtcaaactagatgttcgcattgtttcccatcttgcagtttatttaaccccactaaattgtaatgcagaaggaattggttgtcgagcaacaagcctcgcaagaggccagctctcaaagacgtgaggatgacctcctcacgaaagcgttgggcaacaaggaacaccgtggacggacacggggagttgggtcctccgttccctggaagtatagatttccagactacgcgtggcagtacaagaaacgaacttccatcaaggcagagaaagatgcacgccttgaagccaagatccgggcgtcgatcagagcgaagctgacatctgaattcgacgaaaagctcaagtcgatgagggcaaatattaggcaagagatccgagaagagcaacagaacccgcaggccgccgctgctgctgcgcatgaagagttaggaagtcccacccaaaaacgcagcagttgcgcatcaactgagttggcggaaaatccaacatcggtcgacagcgccgtcgaccacacaatggtaaaagtttcgtacacaatgcatgaaagggttaaccaaatccatatgatatataataatctaaagaaattgatgaatctatcgcaggaaccaaccagctacacctgcacaggtagggtgattgcgaactttacggtttcaagaggccgaggaccttggttccagccgaccccagagacaagagtgcgtgactgtgcaaaagttcaagtagactcggttaagcccaaatacgagctgttcccactgaggtacccaccgaacgacgaggtcctctcactaggaaatgcccgtggtacctcatccaatggcccaaggacctcattgagataagggttacagcgagtccaaccactgcaccaggcggtcgtccgccaaagagacccgcctttgctccttcagcccctcctgctcaagatcgtcctgcacaatcttacgatgacattaatatagtacaagcccggtgacatcccacaccctcggtaagaacgcatatgattggaccccaattcaactagcgatagatgaagcgtagacccaatacgtgcaaagaggaggcctcaggaagacaggacatgacaccctcatccacaaaaaagacttcccggtgaagcaacaaataggtgaccagtgcggattccatgtgtgccacaacatgcgccttctgtacagagaaaaggtgaagactttggctgagtttgaggtcggtggtctcaattgtgatagactaactacattttagtacttatatatgatcgatcaactaatctggaattatgacaatgtagggcacaataaccaagtctctgcctaccagctttgaggagattcgcgaggagatagccagcttcatcctccgcgaaataattaaccccaaaggaatgtttaggcttaaactaaaatgatgagcaatgttgaacttttatgtctagagaatgatgaacacttattatgcaactgtgatgatgtaactgtgatgcttatatttatgtatatatttcatatgtttatgttaagacttgctaaataaatatttgatccaattaactcggttttgcaggtgaaatacgataaatatttgaatggatgtgaaatatgtgaatggatatgaaatatgagatggttgtgaatgtgtggttgtgt

SEQ ID NO: 81782 - DNA, 672 bp, Oryza sativa
ataggctgaggaggctgtgtattcaccgtggttgtttagcttccaagtgatctagtcttcttgatccgtaaattgcacacttcgaatggcgctccaaacggcaatgacttggtcgattagctccgttgtccacccttcggttgttggtagagcaaggtcaagcagccattggtccatctgagcggcctgttggagagtcctgctcttttttctggaggctacgtagactagtggtgcgacatcctttagtcttctcccctatagccaagccaagtcccagaaacttgcttttgctccgtcgccaacttgtattgttgttgcagcagcaaacaacagcatgtctgtttcatcgcaaggcgtttctaaccccacccaagccttttctggtgacttccattcgtgctagagccatttcagacggagggcccttgcaaatttcttgagatttaggatgccaagccctctcgaggcagtaggtaggcaggtacgcgtccaatttaccttgcacttcccccagtgacggtttcattcccaacccacagaaattgccttcgttgtttgtccagaatttcaagggattccttagatgctttcaagcccgtcagcaagaagattggttgggacgtaaggacgacttttaccaaggttgatcgacctgcgagaccaacatgc

SEQ ID NO: 81783 - DNA, 4685 bp, Oryza sativa
  unsure (1)..(4685): unsure at all n locations
atttcttggtactgcacgaagatcatcttatccagaacaaacaatattacctcttgctcctgccgagtgggactcgattgatttcaccatgagattctctaggaaacacgcatgtatagagaaaaggtgcctaaatcaaaccaaggtgaattaggaggtggggatttacaacgaatcttctaatgagggggcatctctcaaactcagagtgatatttgagagtggtttttgcaattttcccttaaaaataaaacacagtgttgcccatatgacaggcagcaagctagcagtaaccaaatgatatatacgtgtggcataagacttatgtgcaaaatttagctacttcaatataatacttctgcaatcactatgctcagtacatatactccatctgtttctaaatatttgacgtcgttggcttttttaaatatgtttgatcgttggtcttattcaaaaaatttaagtaattattaattcttttcatatcatttgattcattgttaaatatacttatatgtatacatatagttttacatatttcacaaaattttttcaataagacgaacgataaaatatgtgctaaaaagttaacggtatcaaatatttagaagcggagggagtaactaattattttgatcggcactaatttctggtagaaagatgaaacaatgtacgtacattcagtgcttcagtgagcagtgggctaatataaattgagtggttatcagggcaaatgaggcttgctacaggtgcttgactgagaatttatcaagtttctagggtgcacgggttgacagatcagtttatgctgctataaatttgaggagttagagctagcaaaaggaaataaggtatgtttgtacttagtttcctaattatgattgtgtatgcattgatgaatttgggaaacctatgcattgatgaatctggtgagcatagtggacttctctttttcttgacacaaattcatccatgtccatccattcggtttctcatctcagtggatttagagaacatcatcatagtttgtaaaaactccttacagataattctctatgaatgcttttagagttcaatttatacattggatttagcttgcatggtgtgtcgatgcattgtagagtgcttcgtaagttcttcgaatgattctttaccaatatgttatttgattgccccatagagttttcaaggttaactatgctccacatgatacacaaactcaattttccctctttcattgtatatcatttgttttgcgaacgcaattgtatatcttttatggcttttgaaaattttggcccaaccaatccaaatccaggtctttttcgtagactggctctatcttttctcgtcaaaaagaaagtatttatataataatatatatatatgttgcttgctctacctttattcttctttttttacgtagactgattctacctttttccgtcgaaaacaaagtatttatgtgacaacatgcagctagctagcttcacattgatagcactcccactccataacaaacacaatagttggctttggactgtttgctaagctactttattaattatagacaaaattacagagtgaactcttttatcaggtgccatgcatgtgaaagttccactccatccacctctttaaaatccaccctcttcattagtctttgcactccagaattgggcaataatagcttgcaatggcggctcatcatgtcatgagcatcgccgcagcagcagtagccatgcttctcctgatggcgtcgtcgccggcagtcgccggcacggcggtgctcggccggaagggcggcgccatgactgacgacgatgtcgtgggagggcaggcggcgacagggccggggaagtacgccgtgatattggacgccggcagcacggggacgagggtacacgtctttagnnnnnnnnnnnnnnnnnnnnnnntcaagatcggcgacgacatcgaggtcttcgccaaggtaattaactaatctactactactataattaatctacctctctattgattactccctgggtgatttttttttaagaaaaaaaacataatctctctataaaaaagtataaaacgtattaattttatttcgttagaataagacactaataaacaagtaccgtattctaataggatattattttgtggtaaaaattaatgtgagtatattcgaaaatacttaattttaattacacatttatgtgtagtatagtaacgactgtcggtggaagtttcatcctaaccaactaaaataagtcatatatttttatatttttttgatagagaaagtacttgtaaagataaataaaaaaagtttctttttgttgttacaggtggttcctggactgagctcgtacgctggacgaccgcgggaggcagccaactccatacagcctctgcttgataaggccatccacgttgtccctaactggcttatgaagaaaactccccttaaacttggggtactacttacctaacaaatttcaatattgttcttcatctaatttaacaaaacatgcaccactgccatacaattattataacaaaatttaagttttctaaaagaacaggattcaattaaatatttgatttggcccctcgttctgagatctgtgcaactagttcaaaacaaatcaatataatatatacacaagaaaaggcaatgatattttgggctctgtgatgaagtagttttcttggatcctttacccagaagttgaatactccatccgttcaattttataaggcatatttgatttttaaaaattcaaactttgaagattttgaccaaagattagtaagcgtacaaataaatttagtttataaaagttaagcctatagatttgtatttcaaagagctttcacatatataatattggtttcatgcccattaagaatatatattatgagaaattgatggtcaaagtttagtcccgaagagtttttttattcgaaatacaccttacggcttgtttggtaactcgatggaaggggattgggagtttatacaagggaattgatgatgagattaagataagaatttgatttttaatcccaatatcttgtttggtagaggagatggaaattgatagagagtttagttggagattaggtcattaataaaaacggatggctgagatttgcttagacaaagtaaaggataaatttcctcccaattacctgcccctacccaggtattgaaaaggagggagttccttcctcaattccccatccctatcccaccaaaattctcatgtctcccaaccaaacaaaacacttaatagcctcatcactctaaactcccaatccctcctactccctccaactaaacgggccgttatagaactgaacggagggagtatcgatcattcaagctcaaaccattttcctactaaaatattgtaaaatgtttctaacttgctaatcaaacatttaaacctacaggcaactgctggactcatacttattggagatgaaaaggcaaaccagattcttgaagcggtgcgtatactttaagaaaaaaatatactacataaatgaaatgccttcagaccacttacttaatttgattcatagtacaggtcagagatgttgtccacaccaagagcaaatttcagtacaatccaaactggatcaatgttcttacgggatctcaagaaggatcttacatgtgggttgctcttaactatcttcttgatagactgggtgaagattactcgaaaacagtaggcgtgattgatcttggaggtggatccgtacaaatggcctatgccgtctcatcaagcattgctgctaacgccccagaggtgcctaatgggcaggatccctatattacagaggagtatcttaaagggagagattacaacatttatgtgcacaggtaagtaatttccttctctgatagtattgttttagatgcatgtcagtccacaacaatttggtgaataactggtgatgatgaacacctgcagcttttttttatctgaatttactgtaaataatatatgggaagcaattattcatagtttttattagagaaattttatgatctttgagaaagtacctagagatatcaagatttttcactgaaaattttactacctcgaagtacctggtatctagagctaccaaatttcacactagaaaatatggtatctccttaaggatttacacttttactaagatcaatcagcaataacctgcagttacttgcattatggcgctcaggcttctcgcgtagagatactgaagagaaagaatgggccatttagcaactgcatgttgcgtggattcaaaggtgtcaagctagttttccttatttagttcaagatgcaaatatagacaaatcaaatgtttggccaatgcttaataattaatcaagtgatgtttattttatcatgggacaaataaaaggcaaattcacctacaacggggagcagtacgaagcaatggcagcaccacaaggtgcagactaccacaaatgcagacaagatgtggtgaaggcactgaacctagactcgccctgcgaaaccaaaaattgcagcttcaacggcgtgtggaacgcggcggcggcgttgggcaggacgagatctacgtcacatccagcttctactacatagcctccggtgtacgtctcattaactaaccggtttatactggagtaatcaatttatcag

SEQ ID NO: 81784 - DNA, 5257 bp, Oryza sativa
aatccgatcccccctttattttcttttccaagggaattaataattccttttcctttagacagaaaaccaaataatccttagaaaatccatatcttctcaaccgctcctccgattgactccgttccacttccaataattccgtaaaattgagatctatctaatggcactattaattagtctaaatagggtttttcttttggtatttttttaggttttcgattgtttgcgtatagtcgcggttaccggattttcgtcgatcatggttttcttgaagattcgtgaagctttgtgaagaccttgagcaaggcaagtcaccctttgacaaattgctcctataattggaaaatcattattattttgtttgcaacttgcattattagaatcacacacttaacttgcttggcctcggtttgcgtgccaaaccgacggacctacccagtagtcgcactatttcctgtaggttgtactaccctgattccttgtcgctctacccttgtggtacttcggtatccgtgctctctgagcgcgtataccaaatatcccacatacaccgttgattgtcgaaaacttgggaaatgggtttgagaagccttgaaacccgacatgtggtgtcggtgtgtttaaaaataaaatgaattgtgaaaactcgcgatgcggggattgtgcctacgtggcactgtcccgtattcgcatataaggaccgattcctgtgggaaactcatcgaacataatcaaagtgcaaccacaaggtggaatgggacaccctagctaagtaacttgtcggttcagggaaacctcgcatgccaatagttgggaacgccggggcggggtcggttggagccaaaccgggttcctggtaaggcaagaacgagaaacttgctaacttaccgatcgaggtggttggagtttgatttgtgaaaactaaaatggcctaaatttatgtgaggatttgatccttctatgtggcatgaggtatccctgggtcggcttgggaaaggctttgttgcgaacctccgacaccgacgggtgttcggaataagttcgtatcttgtgggtaaagtatacccctctgcagaggttaactaactgttcgaacagccgtgcccacggtcatgggcggatgtgaggtggttcccgttgcgtagatttttttgcctgtgctttgtgaaaagttattgtggtgtgggaatcgtaaccagaatcagcctatgtggcagatggatgacctgagtggtcagaaacgaatctgtgtgattcgggatgtctgcgggcatcatagactaggcttcccgagtgggagcggattgttgtgctgctgggcagcaggactctgggagtccgagaaaaaggaaaaaggctctgggagccgcttaatcaagtgaaatggctctgggagccgagaagtaatgatctgacctgggtgatcggtacattaccatttgagttgttgaaaagcatctcttaaagtcaaatcgagacgcaagtctcttttcggcccaaacttagaaagaaataaatcacttagtgatttcaaaagtggtttcaaacaaaggatttgcaaaacaaccttgcctctcttccaagcttgcatcagacacctaaattcccgtgacgtgctgagtacgaaagtactcacccttgctctatataaatatatatagttcctccgccctgaagttgaagatgaagtaaagtgaagattagggtttcgtcctggttcccagccgtcgcctgtggtgttgggtgttagttcgttggttccgccactgctgctgttgttggtgtttcctcgtccgcgtcgtcggttgcattctcgggctgttctgagctgcaacctaagttaaggtaattaagtcctctatttattttaaggattgcaatgattcatatttgtcaccgtgggtaccagcactatgtcctgggactggtactgagatcgcggtttcgttggaagcggttcacgccgtttttcctacgacacgctcctgtcaggtgccgttgtacggcggtgccggattggggtgtgacagatagctaatacttaattaattacgcgctaatatatcggtctgttttccgtgcgttactgttccggttgggatccggagatagcgaacacagccaggcaccgttttttcagcttatagaaagagttacttgatcagttttcatgtacaagctttctaaatcattaaactgtgcttttttgaatgaaaactatatatatttaataaaataaaataaaatatatttttagatctgaagcagacatgcagttgatttttaattaattatgtgctaatctactttcttgatttagtggctgcactaccttgggacatgataaatttatagcgtctttcatggcgatatatagcagttaaaaattgacctgtttacggcaaccaggagcctctttcgcacttgagcagcgtcaaatttgcaaaatattcagcttaaactaccaaagggaaacgagtgtcaagttggtgtaagaatcaggcaatatattctctgtacggacaaatcagagatatgatctggaggcagtcgaaacaaacacgtcccagatccagagggagatcgatgcgatgcgatgcccacgaactcgacaggctaagagggaatcacttttggctaggaaggaaaatcaccaagcttcaattatgcagatatggaatgttcctagttaggcagctaggacctcactctttagggcaagttctttaggtaagtactataagcctctatatattgcccctaaatttgccatataaaattaggtgatgagctagaggagagaagttaggagagagaatgagccacctctcatgtaagggacaacctccacacaatctccaagaaaaatataagatgatgtgagagtaaactaatattagggtttgtgtactagaggtggtatgttgtacttgttacctcttaattaataagaatatgacatgatttaaattagatgtggcacacacctccattataaaacttgcccttaccctcccgagcggccacagtgcaaaaggtgttgaaggttcccacattgcggctttgcaaacagtgtctgatcatcatctttctgcagggtttcaaaagcagaaatttgcagcttcaagaaccttcctggagacaaaatcaactcgtcgaccaacaatccaacatatccatatggttcttgttgccctggagagcccaacacaacaacttaaaagaataaaagcattgtttccatgatttccaggatatgttttattccaggatttgagatggccgcactttgtcatggatggggaaaaaaagaaaggaaagaagagaagagcatcatgaaagcaaagatgatagtagtcgccgctgctttagctcgtcacctttcaatagctacctaaaccaggcctagtaacttttttaattttgagtactactgcactcaacaagttaaattcagtaatccagtcaaatgtacatgcagatcgacgagacattatgtaagcagcatcgtcaagagagtctacagactacagtaatatactagtagtgaattagaggtaaagtgaagtttgtttaattacagcggatgcatctcctggtcggtgtcagagtcgtcgtcggcctcggccaggacgtggacgtagcccttggcctcgaactgggcgcggatgacatcctgcctctggcgtatggtgacagcagagttcttgatggagtcgacggattagagcaagtttaatataatagagccaactacgagcttatagcttatattaagagggagactagtgcacggcattccgtctgaatgggataattaaataacacctccacctccccgagcaagatatggataaggatcaaagatggactcggctagcctgacgtaccaatatgcatggctctcacaaaaatctgcatgtaggaattaatgattggccccacatgcatctagcgcttctccttgagtttgtaggtcagaacatgcatgtgtagtgcatcatcaactattttattaccacgatattctactagtactaaggataagacgatttctaataggtatcatatgatacttgggagatatcaccggtgatacttatcaggtatcagacgattccaatcagatttcacgcgattttcaccaggtatcagttaatacttgcgaggtaccacctgataggtatcacctgataccggttaggtatcaggacatgatacctgaaagatatcaagacctgatacatgtttctatccaaacggtgatacttatcaggtatcagacgattccaatcaggtatcacacgatttctaccaggtatcatataatacttgcgaggtatcacccgatacctgataggtatcacctgataccggttaggtatcaggacgtgatacatatttccgtccaaacggtgatacttatcaggtatcagaaactggtatcaggattacctgatacatatttctgtccaaacggtgatactcatcaggtatcggatgattccaatcagggaccacacgatttctaccaagtatcaagtaatacttaagaggtatcacctgataccgtttagatatcatgaaacctaaaagatatcaaaaactgatacatatttctgtccaaaaggatatggtcctgtacaattcccggaatgagaaaagcacaattaaagtccgatgtcttctcagtgtgaacatgcacccataaatacactgatttgcctagctttatcatattgtattgtcaccaactcagatattgatgtgacatatctgctcgtgtcacgtgcccacgagcactcatgagggttgcaggtctgcaacacactttggttagctgctcgtgtccgcgtgtcgctggagacatgtgtgcacgaaatcagaccgtatcaaggaagtcatagaatacttccttaaactattccatttggacggtatcccatacagtagtttttctcttatattaaagttaacatgtatagtaagtgagctacaaggttatctcttttttttctcctcctctctctatctcttacctatacatttaatgtatttatcttgaagtatgtgaatagctagctcttgtatgagagctaaccctctccaattttcaaattctctttcattcacataagcttatagttggcttatagcctacaagtatacttgctcttagagcaggatctcgttgtgccgtgcaggcaccacgtcgctgcccagcaccttcttgctcacagaagcagcctctccacct

SEQ ID NO: 81785 - DNA, 6145 bp, Oryza sativa
ggttttcgctcggggtgtatgggttaggtgagcacagtggggctcacctaaccacatttattgcggtttggctgagcgtgtcacgccgcatgtaacgcagtgcagtgcactcatttatccggtctgtgaccagtcacagaccggtcagatcgcgggttaggtggcgacaggcggtctgacgcacgcctcgccccatcccgtcaggacgagggcttctaggcgctcgtccccagctggagctagcgtgttacctcccagagatggcacgttagtcctgatcagatatatgccaggctttatcctaaccattacaagcaagatattgtgtgaagaagggcgaacatgtagattgctaagctgacatgtggtggacaagaatgaccgacgtgactggtctgactccggtcatgtcgtcagcaggcggccacgattccacgtcgcatctgctcccggcgaaagtggaggtagttgtgggccgtcccatcagaaggtgactcggacgacaacgatacaaatctccgtccatttatgaaaaggtgggggaagtccccacaaaaaagagggaaatggtgcatgtggtatccccttaagatataaaaggaggaccttgcccacttagatgggaggtttttttggactggacttttccagattaggaacccagaacaagggagaggctggctcatactttgtagctccttcacacacgaatccaccaaaacacaggagtagggtattacgcttctcagcggcccgaacctgtatacatcgccggcgtcttgtgtgcttcctgtctcgcgaaccttccacagattgggagcttagagtctcacccagggtccccggccgaaccggcaaaggggggccagcgcggtctcccgatgaggagccccacgctccgtcatctggcgcgccaggtaggggactctgcgagtgatcttctgagctctcgcactccttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggctgaaggatccgcgacttcgacatccacaggaggtggagaagggcggcgagatggggagcgtcgcctcctcgtctacggcgacggcagcacgccccagggcgcgctccaagctgcaggcgcgctcctacgtcacccgcctgtcgcccatgacccggagtctccagcccaacgttggctggacgatgtggccaaattggtcatgactgcaaggcagcgcctagatgctggtgggcggtcctccgccaccaaggcctctggtgctgctaccaccggctccgcgttgtcaagacgaagggcgcggcgagcggcagctgccgttcgccattcggccaccactccttcgtcgactccttcgacccgggaagatctgcgtggggggccggacgcccgcaccagcatcgagcggcggcgtaatgaccaacgtgctacccacgcaacggagggcgcttcctcgtccagagtgtcacctcaacacggacgcgggaatcagccctccgtgcccccggttggtggtgtcggctgtagagcctttgtggcgagtcttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgcggggttggctaatgaacttgccacccgcatctgtccactcttgggaggatttgtgccaacagttcaccatgaactttcaaggcacatatccgcgcccaggtgaggaagcggacttgcacgcagtacagcgaagggatgatgagtcacttcgctcgtacattcagcggttctgtcaagtccgtaacaccataccatgcatccctgcacacgcggtgatttacgcgtttagggggggtgtgcggcacaaccgcatgctcgaaaagatcgcctccaaagagccccaggctaccgcggagctttttcagctcgcggaccgagtggctcgtaaggaggaggcatggacctggaacccctccggttccggtgtggcagcttcggccgcccccggatccgccgctcagacagggcggcatgataggaggaggaagaagaggtcagcccataccgacgacgagggtcatgtcctcgccgtcgagggcgctccgcgggccacccgaaaggggaggcctgcgggagacaaaaagaaggaggccggcgctcccagcagggagcgcccaaccggcaagtggtgcaccgtccacaacacttcccttcacgacctcgcggactgccgtgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttatcgccggagcctcaaggccatgaagcgagagcttctggccgcggcccctactcatgaggcgacgcgccaggcgcggtggtcggaggttgccctcactttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccccggggatgatgctccggccgtcccagccgatcattggtgtgacgccggggcacacttggccgctaggtcatatcgacctcccggtcaccttcggtggacccgccaacttccgcacggagcgggtgaacttcgatgtggcggacctcagtctgccctacaacgcggtcctggggaggcccgcgttggtgaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccggtcaagaaggttgccctgggcgacggcccgtccaaggccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtacggccgggcgcgaggccggtccggcagaaagtgcggcgccaggcctcggaacgtcaagccttcatccgcgaggaggtggcacgacttctggaggccggattcatccgcgaggtcatccatctggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaacactgcgttcattacccccataggaacttattgttatacaacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatctagcgaaaacttttgagagcctccgctccgcccgcataaaactgaaccccgataagtgcgtgttcggtgtacctgcgggcaagcttctcgggttcttggtctctgcccgaggcatcgaagccaaccccgagaagatacgagctatagatcggatgcgcccccccagcaagcttagggatgtgcaatgtgtcgccggttgcatggctgccctaagtaggttcatatcgaggctgggggagaaggcgctacccttatttaagctcctcaaacgctccgggccgtttacttggacggaggaagctgagtgtgccctcactcagttgaaggcgtatctcagctctcccccggttctggtcgccccggagccaaatgaacccttactactctacttagcggcgaccccgcaagtggttagtgcggcgttggtcgtggagcgcgatgaggacaatcctcattccgcgcacccccaccttgtgcagacttggcccgggagagagcagggaggagaggcccccgagccgaacggtggcccaaggcccccgacgaccggagttggccctctgcccgcttgtcagacggtgctaggagcccccgacccccaggaaggccccgaggccactgtgggaaggccgcacctatcgccctttgaccccgaggctaaccctgtgctgattcgacccgggaaagagcagggagaagaggcccccgagccgaacggaggcctaaggcccctaacgaccggagttggccctttgcccgcttgtccgacgatgccaggagcccccgacccccaggacggccccgaagccactgtgggaaggccgcccctgttatcctccgaccccgaggtcatcagcacagaagacaagtgcgccccgggtggctgctcggacgaagagcgccccggagatgtggcccctggcgaagaggatcggccccgccgaaaggtgcagcggcccgtctacttcattagtgaggccctccgggacgccaagacccgataccctcaggcccagaagatgctttatgctattctgatggcctcaaggaaattgcgccattatttccaggcgcatcgggtcacggtggttacatcttaccccctcggccaaatcttgcataaccgagagggtactggacgggtggtgaaatgggcaatcgaactctctgagttcgatttgcactttgaaccacaccacgcgatcaagagccaggccctcgctgactttgtggcagagtggaccccagctcctgagcccgtctccgtccccgaggccagctcggacccctcgcagctgcctcacaccgcctactgggtgatgcagtccgacggctccctgtctcttcagggcgccggtgcgggggtcacgttgacctcgccgagcggagacgtcctcagatacatgatccgcctcgactttcgagcgaccaataatatggcagagtacgagggactccttgcgggactcagagtggcagctggactggggatccgccgcctcctgttgttaggcgactcccagctggtcgttaaccaagtctgtaaagagtaccggtgctctgacccgcaaatggacgcctacgtgcgccaagtacggcgtatggagcgccattttgacgggattgagcttcggcacgtgcccaggcgggataacatgatggccgacgaactctcacggctcgcgtcctcgcgagcccagaccccaccgggcgcctttgaagaaaggcttgcccagccgtcggcgcgacccgaccccttaggggagacggaagcgcctgaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacatgctggtagaagggatcctctatcggcgcgcggctaatggaatcctcctgaagtgcattcctcgggaacgaggcgttgtgcttcttgccgatatccatgaaggcgaatgcggagcccactccgcctcgcgcaccttggtt

SEQ ID NO: 81786 - DNA, 98190 bp, Oryza sativa
  unsure (1)..(98190): unsure at all n locations
agcctggcatatatctgatcaggactaacgtgccatctctgggaggtaacacgctagctccagctggggacgagcgcctagaagccctcgtcctgacgggatggggcgaggcgtgcgtcaaaccgcctgtcgccacctaacccgcgatctgaccggtctgtgactggtcacagaccggataaatgagtgcactgcactgcgttacatgcggcgtgacacgctcagccaaaccgcaataaatgtggttaggtgagccccagtgtgctcacctaacccatacacgcggagcgaaaacccacgaggggtcggggcgcctcggccctcggggccgaggcgggtgcggcccgaccccctcggggggactaagaggagggcgaacacatcaccctcgggcccgacgtcccccgagggtgccaggccacgtgggtgtttgtgtctgcctcaaacctctagtcatgatactcctgatcccatgtcaccgacaagatcctatttagttctaaaaacttttcataaaaacatcacatcgaatctttagacatatgtatggagcattaaatatagataaaaaagaaaaactaattgcacaatttgcatataaatcgcgagatgaatcttttgagtttaagtatttcataattagtcattagtgctacagtaacctacacgtgttaatgacagcttaattaggctcaaaagattcgtctcgcggtgtacaggcaagttatgaaattagtattttcattcgtgtccgaatacccctttcgacatccggtcaaacgtccgatgtgacacctaaaaatttttatttcaccaactaaacagatctttatatatatctctatctaaaatttattgtactcgaatatgtcacgttcaatcgtatattcgtttttttaatgaaacagaagaagtactaattaaagtagcagcagtataacggagtacttctatatcttcagaggatcatagcaaggtaggtcaaccatgacactgatagtcgtagcagtagccatcactccggattggaaagtgtagtactagtaaatcagcttttacctttctagccatctcgagaacaaaactgacgaaatcatggaataatcgaagtggtggaaattaagaacatatatccttttttaaaaaaaaaacaaaaggcaaatgtgtatcgctggcatcaaattacagcgtaaatttttattctctacgtgttagactatatttttgtggataaccattgaaattggttgttaaatagaacacaaatgctggagaagggtctggaaaaacactaggctttttagggagaaaatggtttcaatctgttcaaaacattacttaattgcttagctggtcaatgctacgatgctacgatggcattcccaattcacagttgtgagagttagtagccttttttctctaaaggaaaaggatgtagtcagtagccttttaggtgagcgtttgactcgatctaaaaagcttcggatataccactcctatagtaacaaaatccaatagggactcctctgtcctgagtcctcccgactccttagggcatgtacaatacaagccataagtaacagtggtcttaagataccacgtaggatagaaccacataaaggtcacacaacccacagtggtaatcactccaaaacatattttgcatttcagctcctatctatttatatgttagcccttgtgttgtatgttattatcaaacctattaaaactttatattttagaccctataacaaccaaaagaaatacatatgcaccccaaaaaaccataagaacccactgtcagcctcttccacccctcttccaccctatttcttttttactctcccccttctctctcccgttgcccttctcacacgcgaccgacccgctcctccaatccccttctccacctccaccgatgcctactccaccccgccggcgagatccctcccctctccggcggagctcgccagcttctcccctcccctctccggtgcgagacggcttctcccctcccctctctgccgcgagacggcttctcctctcccctctccgccgcgagctccccatcagcggcgctcgagctttggtggtggcagggagcggcagcggcggcggatctggaggtggcgttgagtagcggtggtggtggatctggcggcagcgttgagcagcggtggcggcggatggctcgacgccaccgtcctcctccccccacgacggcgcggacgagcttgccagatccgggcgcgggctcgccggatctggcagcaggggccataacggcagcggttcctctcctccttccttcttcgtgaccgtcggcggtgaagagtagcggtggcggcggatctggggattggtcgaggcgacgcacggggctccggctccgccaacgcgtggccttggaccgtggcttcgcccttcccgagcccaggcgcggcgcttcgggcggttcttctgcaagcgcgggatcggcttgcagagccacggtccccactgccatgggtgcgcgcatccgacgtagaggtttgagaccacaagctagggtcacgcgttgtacatggccttagcatcaggaactctgttcttaaaaaaaaggtttttttttacttgccacttataacaatcatcaaagaaaatatttaatatttactatatataattttaattataggtaacttttttacgtacgttgaaaaggatgggggtaatgtctttttcatataagaatagggagtagggaaggaggggagagaggtggatagcctagcgacagaatcagttcaaggtgaagttcatattaagagatgaagggagtgggagattaagaggccggagaggaaaagggccacgacggggtggacgtctatgagatgcgctactgtggattactatagctgaatatgaacttcaattttctcgttttctgttaacatgttttttaatttattaaatgatatgtttattataaaaattttctatagagaagctgttttaaaaaaccatataaatttattttttaaatttataataattaatacttaattaatcatatgctaataattttttctcgtttcccgtatttttttaattaaaacatgcgtggacattttacatacagtaaaactaaatcttcatcacatgaaaatgatattagaagatttatcattggaactattatttttagatcattgcatttttatgtttcattataacataattggaaaaggtatgtagcatattttttaaacaaattcatcaaaaagctttgctagaacatggcaccaaccaaacaagggggaaacaccagcggaaaaggtatatgtatagcaatcaaatacaaagcttaagtaaaaacatgagagagtatataggagtagctagtaactagttttgggggagcagcaaccagagtcgatgaaaatgcataatattcaagccaggcgattggtgtgtggaattgtggataggaaacgatcaaggggtggaaacagccaggctgggggtacagtactggtacagtacatggaaaaggcttgaaaggggcaaatgggatcagatccagcaatcagcatacatgtacgatcatatatatcagaccaaacatacaaactggagttgctagttgctacgaaacaaacgacttgatcacgagagtatccatatcggagggtatgcatatcaatgcatgcatatatgcttgacaagcaacaatatactccctccgtttcgaaatgttttgacaccgttggctttttaacacatgtttgaccgttcgtcttattcaaaaacttttgtgagatatgtaaaattatatgtctacataaaaatatatttaacaatgaatcaaatgataggaaaagaattaataattacttaaattttgtgaataagatgaacgatcaaatatatgataaaaggtcaacggcatcaaacattttaaaacggagggagtataatgcatcaagaattcaagattccatgcgaaatttgtgatacgaatgcgacgcttgcatacatcaacaaataatgctgctagcacatgcagatgtagcagacgtacaccagatcgatcgatgtgcggtgcggatatatatttaataattaattttgatcaattagcgaatagctaatactccatccgtaaaaaaaaaagaagacaaactctggattttcgtgtccaattttaattgtccgtcttatatgaaatttttttataatttatattttcattgttgttagagacacggaaataagggtttgtttattttttggacggagggagtatgcagcagctggccgggcatgcatgcatggaccttcgtcatctcctgcacgtttgcgacatgtgattaacaatatcccccatgcattttactttgttgtttagctctcgtaagtcgtaagttttgatgcatgcatgcaatacaagcagctagacttaactagccgtgtggttttaaccttaagcttccgtcttcaattcccaaaacactcataattttttattaaaagaagtgtcgggagggacatctgtccctccaaatctcgtcttttttttacttaactagcttagggtagggttaaaaatggttcagaaaatttctgatttcagacacatgtttttagaaatggaaaatatcggttagaatttttttttttggaaattttggaaacagaaataaattcagattttttctagaatggaaacgaatacggtaaggctactatccgatgaaaactagaatcgactgaaaactttctaaaaacaaattaaaaaatgaattcaaaacgttgtagtattgacaacgtttgcccgtgtagggagccttgcttgatcttccagctcgctactattttgcaaggcttatggtgaatagcgttggttgaacctggctttttctgtttttcgtagccttgtagtttagatttgtcattttctattaatttggtctagtagttgtggttttcttatagttttccttaattaactatgcactgtaaggtttggtcacgcgttttctcctcaaaataaaacaacttctttttttatataaaacgccggcaacggtctgaccgtttgaaaaaaaataaatatacgccgtttcttattactacaaaatttccacatatcattcatatctggatcgatatatatctatctactgcatgcttaggacaattaatggctaattgatcgattgagaatgatgcatatgtgctgctactatactggattgaataagtatatgatcgacagtgaagtttaattatagctgaatcgataagaggccgtggatcaacggacgttaattactggcagggtcgtgagaaaatgacatgaatatattatatatataatgtcgatctgaatagcgtgcaccgccctgcagggcgctggtcgtcgacagaatgccgattatttcgggcgacaagcagtaaaagttcaaactatatatggactatatatatgtatactacaacttaactatcacgtgcatgtacctgcgaccacactttgcatatccatcatttcgaattttcgatggatggatcgatcgatataatgtttcatttcttgaaggaaactaacatcgggagtgctgtttgctatagtgtaacttctggcgtttcatgcatgtcccgtgatacaccagtaacaattaagtacaacacaactcttcggcacgaatttagctaattttgctagcaatttgcttgttaattggagcaaattaacagctcatgagtcactctactgtgtacgtagtgcataaatcctgttccggcaggcgtgcataaatcctgactgtcgaaacacatgcaggtagtggtggataggcatgttggagttcatagtcataatccatatttttctttttggaaaatgaaaatcaattatttgacatttacttaaaaaaatataatcaattattacatagttcacaggataaataaatgtggaattactacacaattataacgaattaggtaggcgtgcatatagctaggtacgtagctaggcttatatatggacgtggcaatattctttgacatagccatctacacttgtacagtagtaacacacagacgtgcatgcgtgtgcctggcttcttacatcgatcagttatcgtactgtagactggccatcgtgcaatgaccaatgcatagtaaatatgcacccaatcgatcaaccggccggtcagaaccaagtccatccagagcgtgcagtggcagtcgcgcgacactgctactgtgcaagctgtgacacacgcacgcatatatacatactacaggtgtatcggtcattcacgccccaacagagcgtcacctcaaccctatagcttacatcctccagtcgtcctagccctggcctgactcgagattgatcattggcaccatcatgatcactttattatttattttggacaattataaatttaccactcgtttaaatcgttattacgaaaatatcatagaaaattaaaaaataccgctagaattgtcatccattcgagttaaattgttacaaaattaaaaataccaattataaattttcaaatgcccctatttatttcgacccatccctacctcttctgttcttaaaaaatattatctatctccacttagtgaaatactggaactagtaatctcgctgctacgaaaatagatatttatactccctccgtttctaaatatttgacgttgttgatttttttaaatatgtttaaccgttcatcttattcaaaaaaatttaagtaattattaattatttttctatcatttgattcattattaaatatacttttatatatacatatagttttacatatttcaccaaagtttttaaataagacgaacggttaaatatgtgctaaaaaaatcaacggtattaaatatttagaaacggagggagtaacttataatcacacctaaactgcacagtcggctaaaaagggtgagtggtgccacgtgcttgcccttatgacacatatcgactacccaggatagccaagctagatcgatatggtgcccatatattattaattgtatttgttgttcttgtataaacaattaaatatacaattcatccgatcttaagtacgtttgagatctcataataaacttattaggttttgtaaacttattctcaatagtataaaatagtaaccgagattatacttcaatgactttttcttttgaacgactcgcactaaacggtgcgaagttttattgatagagcaggaaaaaattacaagattacaatcctttataaggtcataaccaggaaaaaaaattataccaccacccacacagcgacagcgtcaacacacagatccaggagaaggctagcaccggaccggccgctgctaagcgtgatcgaccgccgctagaccaacaacagaacactgccgagatcacccaaaacccgacctatacaatcaacacaaaacccaactctatccaagacttcacgatttagggagagaaggtgagagagaagatgaaacacctctcccctagacactccgacgtggccaacttgtagaaactaggacgccgctacaagagggctagaatttagagcgtgcttgcaccaattgctcgggggtattggcacacaacacagtattaattaagtattaaacattacaaattaaatacatgtggtttcttatatataccatgtttaaccatgaacgcatatgcctgtgtgtatgttaatggatttactgtatatgagatggtcacgagagggttatgttgttgctggttaggcaggcaggcagcagtagatgggtagttaattctcgatccactgatctgatgtgagtcgcatgccagcgacgcttggcgtacatgcatcgtgttccccttgtccgttgctagtccacaccaccttggtatgagctctcctctgcagctttccccttgtatacttgctttgccctttggaataatatcgatcgtcttgcgctctgtgtaccatagtacttgtacctgcctgccaccatgtgacactgcgtgcttcatgtctccacccatgtaaactcttcctgccaagaacgatctagctagctagtagctactcttgtgcatcatagattaattgatcagttggggattggacaattaattagtcttaaatatgacttttaggacaactacctttccaatgtataaatattataatatttaggaattactagtactaattgttagtagctagcaatagctatacatatatgtatcctccatgtcattgtaaataatgttagtgcctgtttgggttagtgccctcgtaaaattttagtagtgcaaaatcttagatatgttatggcactactaaaattattattgacttggggcaaaggttgaccttaatccaaatatgtaccgtgctatattaaagttatcaaatgattcgtaggactaaatttggtatccaaccaagctatttcgcagtacataccaactagttaattagcactagctactatgagaggcttgtatacaacccgtctatttaaaaaatatataatgcatagtaaaatgttcttaataagtctatatatgcgtgtgtatattaattaatcgtaaccattagattaagctctgggcatagagtccagcaagaaatatatatgtaccaacccatgcaattaagctaaccatataattaaccttgtaagccacctgctatataaggttcagaaatttgttgtgatattttttgggtaccggtaatttataccccccataaaatcgatttttttttaaaaaaaaggaacacatgcatttgctgcttcttcttttcgatctggaacctgccgtcgatcgatcgatgaagcatcatatctcatgatatccagtcacgaatataaaggttgccacacctgactggttcctttcattcgcatgtatagcaaagtacaagctggtgatgatgctggtctgattagtggaccgaccgacctggaatgaatatatacgacctctcagattttccttcaaaaagacaaacgtgtcgctctagtacttagagatgatattcttgagatgcatgctcctctcattgtctgattgttagcttatttcgaaactccttttcaagtttatatttttattttccgtgggtggccaaacaactgtttttaccagttatgctttcgaaacctcaggagcggcatccgatggtggggacggcagtggggagctttgggtggttgccaccggttggggggagcagcatgtcggggatagaggaagggcggcgggggcaagcggagagcgggtgtggcagggagcgaagacggcggcatccgatggtggccgccatggattgggtaaggtggggggacctccctgacaacgtcctcctcagtgtcaccgcccgcatctcctaccgcgcgccacgtccgcattgggtggagccgcgcctcccaccgcccttcttctacagctggatcagcggttgtcgccgccatggtgtgcaggctggctgcgtgctccccctatgccctcgcgccgatacaccgccgcctcctccccctcagctgcgtgcacggcgccgctcgctcgagtggacactcgctctacctccgctccatccccgtgtgctcccccctcaaggcatgtcgcagccacgactctgcccacgtcgtccgtgtggcggccgcagaggcaagctctctcttcccccacccgcggcggctgccgtccccaccaccattgccaccgccgcctcctccccctcagctgcgtgcatggcgccgctcgctcgagtggacactcgctctacctccgctccatccccgtgtgctcccccctcaaggcatgtcgcagccacgactctgcccacgtcgtccgtgtggcggccgcagaggcaagctctctcttcccccacccgcggcggctgccgtccccaccaccattgccgccacaactcaccgccatccccaccgccgctctggccaggtgaagagaaaggccgggggagagagagataagagagagggggaggaggaagaagggaatgagagaagatgacatgtgggccctacatgtcagtgggtaccacaatattatttttgtgaatggcaaataagtcatgcacattcttttttgattttaatgccacataagcgtcacatcaacgccacgtggaatgaagacccggtcaataccgtcaagtaggtgccacgtcagcgaaaccgctctctaaaaccaccaagggagataaaatgcaccggttttaatagttgggggcccggtatatgcgaaacagattcagccattagtgaagggagtaaaagtaaacttattctgaagaatttgagttaagcccagtgcgtatctggacccatatctgccactgttcctttttgttttgaactccaattttattgggcctgaaattagtaggcctacgatatgctgtgcataccattatacacgtgaaatgtcattttcgtactactgtagtactttacaaatatttttgaaagtgaaactgatcctgagtttcttctgatatttccaaacctccctgcgttgttctcatcctcaggccctctaaataacaaaatgttgcaccgcagtgatgactgcttgattaacaacatgctagtatatggttatttagctttatttttccaagaactatgtttaagctttgcactatgtataaattttataccataatatgcaattatccacaccatattatcagctattcctacatctatctcaacggtcaccaattctagaaagaaaaattctccgatgatcgatgatcatacacccggtcgtgcccatggcctacgcccactggctgtcctctccgccatcgccacgctgtcgccgccaaaatccaccgacatggctcccgctccagctcccaccactgccaccggcctcccgtacgcctgcagcaccagcaccgacgccgtcgtctggaagtccttggacgccagcaggtcgccgatcggccccagctccggcgactcgctccactccgccatccccgccgtcagcccggaccccccgggcaccttcccgacgacgaacaggtccttgttccccatggcctccacgctctgtatctcccccaccatctcgctcgcgttgaacacgccgcgctccctgtactccaccgtcgcgccgccgccctcgttcgccctctctaggaagtcacgcaggcacccctcgtcggccttccgctctttcagcgcgtcgaactcgcttgcagtgaagcttcctcccttctggacgaaccggagcaatgtcaggtcgatggtcgggttcctcaccatgcgcgtcgcaagcgccgccacctcccggtcgtcgctcccgccgaagaagagcgccaccacgcggtacccgccacccggcaccgcggcgaggccacggtccacgaggatgcccaccgtgcacggcgagaagctctgcacgttgcagttgagcggctgtatcgccgggtgggacacctccaggccgccgtccaccgaccggtacttgtggaacgggagcaggatgagcgccgagtgctggttctccgcggcggaggtgatgtcctcgtgcatggactcgtacggcgagacggcggccatggtgcgcgccgacacgcccaccgactgctcctcgtacgccatgaaggcgtgggagatgtgcttgaactgcatctccgtgtggctgcgcccgtggacggaggcgtcgtaggaggacgacgacggcgcagaggcattgatgaggaggagcgccgaggagcggccgacgaactcgatgaggtggagggcgaggacgcccacgggcgaccggctcgacggcgtcaccacatcgaggagcgtcagtagcgcgggcacgtcgcgcggcacgtggacgcaggccagcacgcggagctctgattccgggtgagcccacgcgaccgtgcgccgcttgtagaacacgaggcgccgcgccggcttcaccaccatccccaggaaagggctcaccatcgccgtgatcagcgccgacacgaacaccagcaccgtgaacgactggtcactcatgatctacacaacacaagaagctacctacccttaattaatcacgacatgcaatgcactgcatggcgatcgattaattaaaatggattacccctttgttccttgcaatgttgaggatgacgagctcgatgatccccttggtgttgagcagcagcccgatggacgtgccgtcactgagtggcatgccaaacacaccggcgacgccgattgcggcggcgaccttcaagaccgcagcgaccatggcagcgaccatgagcagcacggcagaatgcatgttggtgatcttggcggtgtcggtgcggaggccgctgagggcgaagaagagcgggagcagagcacccaccacgaagtcctccaccttctccaccagcgccaccccgaccggcccgttgggcacggcgaggccgaacacgaaggcgccgaatatggcgtgcgtgccccctgcgtccgccaccagcgccgcaaccatgacgccgatcagaatccagcactcgcggtcctcgccgaccgcctccccctcggcggcgcgcctcgccagccgcaggagcatggggcggagcaggaggtagctggcgccgaagatgacgacgcccgacgtgagcgtccacgtggtctgcgtgatggtgcagcgcgagtggccgagcaccgtggcgacggtgaggccggtccaggcgaaggtgtcgttgatgagtgatgcggagagcgtgagctggccgacgtcggtgccggcgagcttgagctcggcgatgttgcgggcgaggacggagaaggcggtggaggagaaggtggagccgaggaagatggggaaggagagcttgttcaggaaagtgtcacccttgcgtttgtcgtcagtgctgagcgcgacgtagccggtgagggcgccgacgaggaagggcgggagcgcgcagccgacagcgaagccgaagctatggatgccggcacgggtgatggcggagacctcgatctcgacgccgacgatgaaggtgtagtagacgaggccgaggagggccatggactcaaggacgaagaggctacggacagggaagacgaggttggagaagtgagggaggtggccaaggatggaggggccaaggaggaagctagcgaggatctgggagatgtaggtggggaggcggagaggggagaggaggagggtggcggcgcgggtggtggaggtgatgaggaggatctggaagaggaggagaggtatggagaagtcgagcgggttgtcgcccgtccagacgccacccatggtgatcttgctcgggtagaagcacatcaggtgcgtcttgtccatcgacattgtgtgattccatagctcctctagtggatccgtcaccgtatgcgttgccattgatgaattccttgtttggtatcaactccggcaatgggtggtgttctcaggtaaggtgaggtgaggggaggagtgataagatacaccatcgatcactcgttcgatgtgagggaagggaaagaggagtgtgctatttttggatttctgcatgtagaggtttagatgggttgcatgcctatcaaaggaccacaatgggaggtacaaggtaccactaaaaatcaaagtgtttacgttgttgcttcacaaaaaataatcttaacgaaagataatctcacatagagaaaatggaggggaacaagtaatgttgtttattttttactccaacatcttttttttactgtcatgttgcatgttttgcttggcgatgtatcctttgcctttaatatccctctccccgcaacgcaaaaaatattttgggtaattggctacggttgtgttctttcccgtaagtttcttactcacatccctcattttccacgtgcacgtttttcaaaatattaaacaatacaattttttgcaaaaactttctatatgaaagttgctttaaaaattcatattaatacattttcaagttctttatagttaatacttaattaatcatgtgttaatctatcactccgttttatgtatggaggttaccaaccccttcaaaagaacacaacctaaggggagtgcctagggccacaaaataatgattttatttggaactagtgcgctatgttggtcaatctgacgttgtcgtaacgataatttttaaccataagaaattatctaccattatgtaggttatctttatgtgttccaatcgacttcactcttggtgtatgatgctttcacaggaacaacatgatgctatgcgtactggtgttgcactcttggaattggtagccacggagcttttattccagtttggatggtgtagtacctacgaaattttatgctagaatctatgtgattttgaaaacgttatttcagttgatacttttattagtggaagttgggggtttgtcccatcacatcttttttaattctttttttttaacttctgaaacttgttggatgtgttttctttctttctactgaaactagctgggtggcccgcgtaattgcgcgactagcacccaaacaaaatcatatattttttcgtatgattttacttaaaattatttaaatagctatcttattgtcttaagactttgaaagaacaaatcttctcatccccgaatttctaattaaatagtttttgaaaagtcacaccagttactacccttacttatgtcatatccttttttatttgcttgctcgatctactattatcatttattctccttggaaccttttaaaaattggatcttatagtttttagagtttattgtctcattgggtttcgtttttataattcctaaaagtctcatcaaacgccgccattatactcctctacggcccgtccactgtcttttctctttattgtcattgaaattttaaaaatcgaacataattatcattcgggttcattttttactttctagaagtcccgccaaaccgtcagcggctttaccattgtactcttttatggctcgcccgctgtctcccttctttattgtcattaagattttaaaatcgaatattattatcattggattttttttttactttttagaagtttcgaacctttaaaaattggaccttatagtttttatagttcactgtcttgtagggtttcattttttataatttttagaagtcccatcaaacgatgccactatactcctctacggcccatccgccacctagtctttattatcattaggattctaaaaatcgaacataactatcgttggaattcatttttttttattttctagaagtcccgccaaccgtcggcggctgctgcttctcctttttattgtcattaagattttaaaaatcgaatatgattatcattggggtttattttttttttattttctagaagtcccggcaaccgccttgcctgtttgcttcatggcctgcccatcgtccctccttttaatcgtcattaggattctatttggtgttttattaacagtttttatatgtcgtatcaaccgccaacactctactcctttgtagacatgttacttaatttatctcgtcatgtgttttagatggtattttctttcaatagttttttgtcactaaatttagttatttataaattgtattcataactgaaatctttttttctttttctaattttagaatttatttttttttcaaattttaattaattaataccgtataatgttctttaaatattcttatttttttatttttgaattttagttgtttcaaaattgtattcctacttaaactctcttttagtttttctaattttgaatattattttattttttattctgaattttaattaatctcgtattgggtttttatatggattcttctttcaatattttttatttttaattccaaattgtagttaattttaaattgtattcctacttgaacttttcttttctctttgctaattttggattttatttttattttattccgaatattaattaatctcgtattgggttcttatatggacttttttctcaatattccttgtttttatttctgaattccagttatttctaaattgtattcctatttggactctccttttcttttctaattttggattttattttaattttattctgaattttgaataatctcgtattgggctcttatatggactcttctttcaatattgcttattttttaatttcgaatttcagttatttttaaattgtgtttctacttggactctttttttttctccgattaatgtggaaatttctagcctccacagcgaacgtggtgccttctttcaaggctgttttaataatataatagatagatagatagatagatagatagatagatttgttggctgtgtatccatgagtagaaggccagagatgtaatatattttcattatattatatatatataaaatagttctaatgggtctctcttacaagaaggcccacaaaggcctactcctcctcggaaattttgggccgtttgatttgtctggtggcatcaccatcgttgccggcagtgtcacggaccggaagcagtttgcctctttcagggttgagttccacttccacaaacggcggtgagcttccgggggcggtgcagggtgcggccgcacggctcggcgtcgtcaatgcgggcgatggtagcctggtaggtaaggttggtatgctccgctcaggcctgggggtaaggagtttttcttccccttcttttcccaatattcttaaggtcggggagagatgctgctgctgcatttgctgttcgtttgttcgcataccaagtgagcctacgcgtttcttttcaggtttgcactcgtctggggggatttgagagtccttgagcaagtggatccgtagctttcgttggtatgtaatgtggagaattgaattttctaaagcatacatgtacgtttctgttctttcgtagctgtaccgtacacggtgatggttctgaccagatttcgctaagaccttttcttctatgctattagcctattattagccatgtaggagttggaattttactccatttggcatcaattcaatcctttcaagaaaaataactcatggagcaagactacttctttgtttgccttttagttgtatgtgaagtttatcaagctgcagttcacccccccactttggtaaaaagacaccaacagcatcttgtatcatcccatcatcatttgttaagacgaataatggcagatcaactacttgtcctaaaaagagaagcgcattatttacaaaattgtcttaagagcttaatttgtttcaagtaagaaaaatgatgggatgagtattaggttcagacttcagtctcagagaggtgcaggctgttgtcacaacaagctttgtagagtacattcaactaaccacatgaacgtggagcccagggatttgccaagatatgcaaggcacacctaatccaacataacctactacagttctctgtcatcagaaagttgaaagtgtttcttgtgttgtatttatacccctcttttggcagtagaatagtcacagtcaaagtaatttgcttgaaatttattcaacaaaatatatacaaatttcacatagtgaatttgatattttatcttgactgatacctcctccctttcatctgcggtagtctttagtgtacaacacatgcttttaagaccttagtgtttttaggaagcaagttgataattacaattgtttatacttgtaacaacaaggcttgattttagcattgaaagtatctttccagaaataaaaacctattgaacaaaaagtggtcacacataggcaaactgtcaaacatggagcaagtatctcaagacagtgatctcattgaaactgtccttatttctttttcgtaagcgcacaggtccacttttatcttccttcacatgcttaaaggcttaaagctatccctgctgtttcttcctacaattctcaacgaatctgactctaacctccatttcctttactttcccctcgactcctcttggtctttcaccctactggaacgaccatacagatttagccattaatcatccacctcttccttcctaacataggccatcatcatctgacagtaagaatccagaggtgggtgtgacaagaagatgctgaagaaactgctatcaaagcctaagagcaagaagaaggaggctgcctcctctgcgctccccactttggatcgtctccatgaggttgttcatcccttttcttttattccttttctattctcgattactttgtattctgtgttgtctccgcagaaatttatcagctgtgggactattatcaagctatctaatgttagcatgacggggttgggagtttatggctgcacagtttgaagagatagctaattagttttagtatccccgaagaaaagctttagtaaaaaagaagggtttattttaacaactgaccaccttggaaatatatggaagcaaaacctcatgaccatgcattgcccaagtaaataggcaaaccaatctcatgaagctaccctgaccatcttatgttgaaggcagcaatgaatgtgattgactgtgtttctgtgtgttcttaaaatggatctctagaagacaatactgaatgaaaaagcaatatcttaagttcagttttgacatggccaaacttgctagccagttgtatatcttgactgttagttgcgctgcatctagaagaatatacttggttgaatctgggattcctctagtcaattttataaagcactttcctgttaaaacttacaaggaaataataagcttataagctacattgttgatggtgacacttctgatgtactcttgttcttagtctttatcactatgaagttcagtctacctctcagtagacatataataactttaaaaaaaatagtaaagtatgtttgaggaaaaaaatcattgccttatgaaaaggaaaaacaaacttcatattagggtgatcgctattgttccagcctagtccctgctgaagtggtatcaatatttatgccttcggtttgctattgctgcatatagtatcacaacaaaaatgatgtataatgttgaagagagccttagtttagctaaagaagatggaaatctcttatattctaaggagctttcagctgatactaacgagataattgctccagttataaatagaactgattttttttatcttatatgtaccattcactgcggcctaattttaatacaatttgcatgtgcagactctagaaatgctggagaagaaagagtgctttcttcagaagaaggcttctgcagaagttgaaaaggctaaggattatacaaaagctaagaacaaaagcggtaagcatttctttcaagaaatttttttgtttgttaagaaacatttacacttatatcacattttttatgtaaatgtatataatacataaacttgttgaagatgtttgtttgttatgcattaatacttgaagaactttgcaactaggagattaagaagcctgtaaagaacaatagcagttaccctgttttgttatggccaaatacaagcttcctggtcatgtcttacattacccatcaactcatgtatgataaagagtagaaaatatgtgggtcagtaatcttgcacatcaactcatgtatgatacagagtagaaaaactgtgggtcagtaatcttgcatgtgtacctatggtaatggttccttaatgatgagaaaaatatttctcaagcttgtgacacttctataaactatatgagagagtacctgtttgttgcagctgcaattcagtgtctaaagaaaaagaagctgtatgaaacacaaattgagcagctagcaaatttccaattgcgagttcatgatcaggtgatgagatatatgggcgcatattcaatcttgacttttgaagcattctgatattccagaaggttgttataaattcaaattgacaggaaattgtttgttttggtagataataatgcttgagagcgcaaaggcaaccacagataccgttgatgctttgcgctctggatcatctgctgtcaaagctattcatcagtcagtgtaagtctctgattgccctccattcatggtttctgaaattgaatcgttaatacaatgaattcagaagcataagatgctctaaatgccaaatgtgtgtacatttctactgtattgttgttccttttgtctttcacattatgaacttaaatatagatacaaacttatagcaagtagttaaaatcagcaagagtgtcagttaatccatacaggaggcaacagtctagttagcatcaggcatgtgcttggatcaactgataacaacatttctttcacaggagtattgatgacattgaaaatgccattgaagaggcaaatgaacacacagaaaatatgaggcagatacaggaggcacttgcaacaccaattggcgcttctgctgatttcgacgaggtactgttcatctatctctttcccctctggcgtcaattaaaacgtgtgcaagatggtattatctaactcgaaataggcatgccaccaagacacaaaatacataattgcacacgatgccaattttccgaagatgtttgactctcatattttctattttgaaggatgaactagaagcagagctggaagatctggaggaggaagagctcgaccatgagctgcctgaaccacctcagagtacacgcatggaaccatcagcgagagttacaacttcatctcaaccagccaatgatttggctgaactgaccaaacttcaagcagagatggcgctttaatcacagtttggagggatttgtttgtattttgctgacatcctgtttgtgtagtgtactcggaaataacatgttgtaaattcagtttgttgtagaaaaaaacccttccttttataatttgttcttttctgttaccttgcttcctaaacgcacgattttttttttgcctggtaccccataaatgagttgaaatcgaaaccctatgcctgtgaatgagggaagaggaagaagcagaggttcagtaacaaccacacaaaatgccccgattggactggcttccaaagtcttattaattttgtgttgaaaaattagtttccagtttcattcgtagttttctgtatagttgagatatttttgctattattctttgaccacttgctggaattggtgtcagcgtcacactgtcactcatacttgtcccgggtaacaaggaaaaaaagaagaagaggaaaaccttagtcattgtgctgagtgctgactatgttacttgtttcattgggtcattcagatcaagtttccttttgcatacaccaccatcacgaaggcaagaaatgctagtactccgtattcaatatcaacaatagacagtagtagtatctttaggcctctctgtttaggcttataagctaacttataagtcgaaaagtctaagcctaaacaaacaagcagcttttccgtttagcttttttgaaaccataagccactctaatactattaagccaaaagctaggttggagaagcttttttggcttatgtgaggtagatgtatgactcaactactaaacttaggacattaaatccaccggcttataaatcatataaaccaataagctgacttaaaagtctaggccaataaacctaagcctaaataaagagggccttaagctagaaacagaaccaaacacgtaccaaaaatgtcattttcagcttcatcttcacatttgaggtgctccacctgagtgtatggggctcgcatctgatgctggctgcaactgaagcagcatatgggcagcatatccaacgtcctaatcaatcaacaaaagttccatccgatgatcttagctacacagcacattggttagaatttcctgccatcgagttaattaatcatccttcaacacgaaaaagcacaacatcatttggtcggtcgggcggttagctgaaccaatccataaacccccatcctcatgctaatgtcgtgttagtgtgttgttattgtcgtttttattttcgacgccatacgtggattagtacagagtacagacaacagctccctccctgacgcgtgggccaaacctggcaacttcttcttctgctatgccacgtcacaccgccatgtgggaccacgctgattgactcattggtcccacgtggcagcgaatccccctcatctctctcgcggagctcggagagacaagagagagaaccagaggcttctcttctcccgcatctcccaccctgatctcctcgcgtcgcgccctcccctcacctcgaatggcgatacctcctccacccacgcgccccaatccctaaccctagatccctcctcccacgccctctcgcgcacgaccaatctccctcttccttcctgttgtgtctctctcgcactgtccaatctcccaattcattatggaggcgggggcggggagcagcagcgccaagctggtggcggcgtgcgtcatcggcgggatcgtgctgggggcatccgtggtcgcgctccacctcgccggccccgtcgccattcccgccctgccgcccgtcgacgcgctccgccgccggttccgccgcggacgacggcgccccgtgcgcgtctacatggatggctgcttcgacatgatgcactacggccactgcaacgcgctgcgccaggcgcgcgccctcggggacgagctcatcgtcggcgttgtcagcgaccacgagatcaccgccaacaagggcccgccggtcacgcccctccacgagaggttcactccaaaccctttgtcattctctttttaaaaaaaattcttgaatgatgcacgatgtaatcctaccaaactgttacctgatactggttgtgtgctttaataatgatttaggcaaatcagcctataggtagtgaattttcctctacatatcttgcagtgttctgtgggcatttcaagttcttaggggtaactgttgtgggttgttccttatgggcgatcttttacttgggttaatggtttagtcgagaagctgttgcatcaaacttcctatcttctgtttcaatttcagctgcacactgattctgtcctaatcatggggaatatgttactgcttttactatttcataacttaatttgtatcgcacactgatttgtttcagtttcgactctttagttgcgttcaatgtactgttgcacaatacaagttactagtggagcacttttataaggatatccttagattagtttttgaagctgcgacgttttccccccacacatcatatatgtgtctgtcggtcttaattcgagcactagtccagtaattctatctggaaacttgaaattgctaagggaaatgttgtgacatgtgggttgtagttagtcgtcggaccaagtttctgataactttggtggtggatgagctgcttatgtttctctaattcatttgagtacggattcaatatctgagcagtaacgaaaaagattagctctatttcttttgggtgcctgaaggagaaactcagaaaaaaaaaggtttgctctgctgaaagtactaaacaatgaatttttggtctgtacattcaaacaaatccaaaaaacttattaattcctaacgataaaccatactagacttgcaggtttggttctgctcagtttgccttaagtacctgctaagtgattccttgctttcctttgtcttgttgataatcacaagctgctcacatatgacatggtatgtgtggcattttagatgttaggtgctgcaacctttttttcctcatttaatcatcatcatggtggtttagcaacactataaatttgttatttttgctggttttcttttgttgtttactgactttcattgtgtctggttttccagtttaggagttactgcacatattgttttttttttctttctatttttagttgtgttaccaattttacgtgtgaccccatgtcatatggaattttaggcatttttgttcttttagacttgcagttttgtttctttgattgtattatgtattatcatatacccatattttccacttcaaaaaaaaccattttgtcttgaatgatttttttatgtttctttttctgatatacaggttgataatggtccgtgctgtaaaatgggtacacgatgttattccagatgcaccttacgccataactgaggatttcatgaataaattattcaatgagtataatatagattatatcatccatggcgatgatccttgtctgctcccagatggtactgatgcatatgctcttgccaaaaaggttggtcgatttaaacagattaaaagaaccgaaggagtgtcaacgacagacattgttggtactgattctgttcttttctgttttaatcattaaagtttttactcatagtgaaatttaacctaaaacttccatcgcaagggaatatatggttcttgttatgtactacaactttacaagttatttctttggctcaataccatagcaatttccaacattacaattatttctaggtcaaccaaataattgtttgtagacaagatcagtgcccacctgatttgtcctgaagtggtactttaggaaaacattcaaactattgctttattattatatgatgaactgataagctattaagctctccagacaattaactacataattcccttctgtatcaataaattgcttatggtcatgaataggttttattttcatgctaactgcccagctcatctttctagtaaataaactacaggaagaatgcttctttgtgttagagagagatcagcttctgatagtcacaaccactcttcactacaaaggcagttcagtcacgggcatggccagaaaattgatgatagtggatctggaagtggaactaggatatctcattttcttcctacatctcggagaatagttcagttctcaaatagcagggtacagctctttacattctttcacagaggatcattttctgaactgctcatgtaaaactttgaatgtcattttttttgagatatcatattttttgaaggcatgaattaaacattgacagcataaaaatgcctcatagatgttttttttttttgcctttaaacagtagagcgcgagttatttggctttcaggatcctgttaccattttactaatacttttgccatttgaaagacatttgttgtttggttgcattctttatctagtaaacattgagttgaatgacctgacgacaaatggattatttcacaacttagatttgttctgaggttatattagtaaagaatataagttatatccttgaacttccaacaagaactaacatgctgctaagctcaactattaattaatcattgcattagtcgtttatcatttatttcaagctgtttacatttgatactattcactagataaaactacttgctgagtacggccacttattctttctgttgactgtcagctttacctatgcagggtccaggtccagattctcggatagtgtacatagatggtgcatttgatctattccatgctggacatgttgaggtaaacgcaatgtcaaatgtctgtctcagcatgtagagcaacttggctatgcatttgttggttgtatggttttacctgtggttttccttttccttttctttttcttattgcaagggtgcaaactgaaatgatctctctaagacatagtgatttggacttcctgtgtatttatagtttcttctacttagatattgcgcctcgctcgagagcttggagatttcctgcttgtgggtattcacacagaccagactataaggtaataatgatggttttttttttccactgtctcaatttttccaagttacaatgcttggtactgtttttcagttttgcatcttagtttatagtcaggttgtatttgtattgaagcatagcatctctactcaattccgtcgtcataacattctgtttttgggggcacttggtgtttaccgtatttgccagttcaacaagaggaccacatcgcccaatcatgaacctccatgagagaagtttgagtgttttggcttgccgttatgttgatgaagtgatcattggtgctccatgggatgtttcgaaagatatggttagttttctgttctactttatcatgatgctctcttactgtagtaggaattgcttgatgcaactgctagtaatagttcattgaacatggcacaactatgcatgcacagttcaaagattgaacatgatatttatgctacgccagcaaaagccttgctcacagctattattgattttagatacagattaacagatatggtcggatttgtgcttatccatgattttctgcagatgcacgattgcacgtagcattaattttatgtcacagtcaaataaactaaaagtttaggagctggcttggttccaaaagtttaatttgatgtagtctaagtttccgttagatatgttgttaagaaccagattatgtatttgtatgcaatattatcattgaaattgaccatctgaaattcataccctttaactgttacttatgattatcagggtatgtgtctttgcagtgtggctggaggtagctaatttcctttttctgtgcagattaccacatttaatatttcgttggttgttcatgggacaattgctgagaatatggactttatgaaggttacttactcaatacattttcttagaatataaagatgtatagcattgatcattaacaactgttacttgtgcacctatcaggatgatttaaatccatatgctgttccaagggctatgggcatctaccgtagactggagagccctttagacatcactactagtactatcataaggaggatagttgctaaccatgaagcctaccaggtatgttatgtaacatggtatattggtgctacgtcaaattggcaggtgggagtctggtttttctgtttggtgcatgcagcatgtagtaaaatacataatcccagtcaaataaatgcgatttgcctgttgtctacttcatattaatgatgtgtgtacatgatttattataaaccgatgtttgtgataatgtgttagtgttttcttgaagccctttgcatatgcgcattaaatatttgtctgtttctctgggaccaattttttcatgctataactacgctcagcaacatgttgtttggtgtggggacttggtgtagtttgcatttatttattctggtccattgatgtgctgtggttttgttcatttttagtctgtggttttgcttttgcagaaacggaacgagaagaaagaagccagtgagaagaagtactacgacagtaaaagctttgtcaatggagagtaacttaggaacaggtcttgcattaatgctattgcccagaagtttagttcacaaccttctggcacaaatgcagcggttagatgatccacaattttacagtcttgtggtaactattctcatgttgctgatatagctcaggaaacttcagatgcaaccctgatgatggtgctgacttgggtgatgctggagaccctattttcctgtatatggggctttgtggctgccaataccagctgtgttattttgagatgggtagtttttttttttttgtttttttgttcaggattgttgtagagtatgaatgttaagcttgattaactattcctgatgctttatttcggagttgccaggtatatgtggcatcatcttatgagagtccttttctcatatattttggtacacttctgttatgatctggaactgagcaactgatatttgtgtgggtcggtgacagcaactgtgtctggaatctggatgttttttcaaggctgggttggtgacacgttgggatctttattatgatacacattgatgtgtgaatcactggaccttgacaaaatggttgcaagcagtggctggctgccaaatggtcgcaatctgctggttcagtgtggtatacgttaatcgccatggaaagggatgtgctacctgtgatctccaaacagtagcacactgatgagcagccggggcacgaggctctggggcagcctgtgcctgctctcctgtaagcaacttacactgtttctggccgctgattacttgatttgcctgccaatatatgttggcttggtttggcttggctttgattttggactgtgacacatgtctagtagcttttgtgtgtttatcactctatcttgctcacatgtgaatggacctgcagagctatggtaaatagaacagtactacgtgttatgaacacgcgtgacttgatggactcgagtgtctgttctgtttggtacaccatttcatttttttttcttggaggagacatgcactttctagctccagttgtacagagtttaggttttatcctttgctagagatgagatccaatctgttttcatatgaatttttctactatgttccaagctgagtagctgagaatgtagcttgcccctgtgatgaattggaattttggaatactgaactgtatatggagtggagttgaaacttgaacttgaggtagagcgtgacatgaaaagagaaaatgaagaaatgtgcaagtgttttgatggtgtcgccatgcgaatgcgatcctgtggggcaaggtgaagagatcgagctgctgcataatccaacgaccgcatctgacgactgtcgcagagcccatggtcacttattatttcagaaatgtcatctcgtctcatctcacacctggaatcctgtactactgtttggtttggtttcatttcatggggccggacctggactggaatgcaaatggaatcctcaatcactcactttgctgttttttcccttccggtcccatgcttaattagcatgtagaaatagacaggatgatgctgctggggccaagttgtcattgaggaaaccgttgagaatcaggttggcatggctacctcatccatggatcattgtctgtctagtgtgtaggttaaatgggggcctttaccacatcagaaatgatcatacactatgatatcaattcatggaccagcttcacacccgtgagcttctgaatgggtatggtcacattcgatatgttttggaagaagattattttttctaatgttattactatctgtaaaatttgtaagattgaatacagttgatttgattttttagaagtacaagaacatcagtgctgaaaagagttgaagcactatctcatgtagcatttatcttttcacatcttggatttttattttgattttttcagatgtagaacatataatccctatgagttgatttttagaaatgttcagaaaattctgtaatttttcaccacggcactgtcaagctccactagtgtaccaactcatggaatctatctgtgtcatttctatattactaaccatgtttataaacaattttacagttgatcaggccatcaaaggatccctctttgcatgcatgcacaactgaactgaactgaacaaaaataaaataaaatgcaggtcagctttagttaggctaagagcaagtttaatagtatgctataagccaattataagtttatgtggaggacagagaatttgaaaaatagagagagttggcctcatgtaagagctagcactcacatacttcaagataaatacatttaatgtataggtgagagatagagagaaggagaaaaatagagataaccttataactaatctactgtatatgttaactctaatataagttataaactcatagttggctctattattaaacttgctctaaacatgcacctcataactcacaaaattggagggcctaaaagcctccagcgaagagctttttggcgtggatcgatcagattagttaattatgatatcacatcagttaattacttcactaataattaacgtatcccaagaactctcaaaacttgcaaccatgtgcggacacgcacttgcaggcctaattaattccttaatcgcgtacttgtcgctactaatccatcacaaggaggtacgtagccgctaccgtccaatcgcttcacacgtatcatgacccttctcattacatgttgacatgtagctaactagctatgcatgcatctagggatgatttatctacaataatcgctgacaatctgtctgatcggcttgagagatggattcccacatgtttaatcatgaggtaactactagttccttttttatataggagtagaaagcttaaaatcactcccttcaatcacaagtgacgcttttacattgataaggtttctaaaatgcaacttgatttgcatacaattgtattgtagaaaattttacgaaaaaatagcatatctaaatgttgaagcagatatatgtgtttcttataggtggtgacaactacaacatgctatggctgcactgccgatcgactgccgcctatggtccgtgagctgtaaaaagtggctaaccaccggaaaatggtactccattagttgaacgttcaaactcgataatgccggccgttggctgcactactaggttcaataacgataggcatttctttactcggtcatctttttatttcttttatctcgcatggccagcttaaccttttgctctggatcatactctggattactactgtattttaagcctgacagttaaaggccatgagctactaaaagtagtgacagttttggtgctaaagtttattcatagtgtgatcttgtgccaagtgccatgaccagggttgaaaatttcggaccgaaatttcggtcatttcggtcccctccgatacgatattacttcggccgaaatttttcattttttcatttttttatgaattttgataatatttgttcaaattcaactaaattttgttcaaaattttcgaaatttcagaatttcggtgaggtccgatcaaattggccaaaagaaagagaagaaatgaagatgatatatactgcagcctgcaaccacttggcttagcttgatcagtccccagttgctgctgcctgctgctggtgtttggtggtaggctcggcctgcagctacacacccgtgtgatatggttgtgtgcacatgctgctggacatgcattgcatatttgcatggacagatattagccgatgcccaccatcttatctttttctgtctgtggtccttcctcttataatgctccttctacaagctagcatgaagcacatttcctcaatctcccattttcatgccaacttgttctttttttattgttattttgataagatttttgtgtgtgcaaagataggcagcatgctcttatggcacattttagaacataggattctcaaaacagggaataaaaaaaatgcatagtatagcgcttcaaatcttatgaatggcaaaatacaggaaaaggaaaattacatgaatagtcgtttagatggagcgcatgagatcaatagagataggcacaaaggaagattttcatgaggttgaatctcatgttaggaatcctctaaaattccaatgatcttgcctatttctaaggaattttatagtatctgtgggagctagtaattcttttgttccaaaggaccatattagaaaatttttcgtagaattaatttcttaaacaactcctttaaaaaaatcctttaatccaaaggagccttattttatattctctattttgtgtaaaattagacaatctactttgttggtagtagaagtagagttttagttttgttcaagtgtgtatttgcaaaaaacacacactggcatgagagatttgcttaactctagtactggacctaaatcttgcttttgggtttaagggcgtgccagttagtttgatcctgcaatcaacaagaaacaagaaaacgaagttaaatcctcaaacgatagccgatcggctaatggccgatgacgtctcgtttataacctagccgatggtacgtaaggtagatcggcaatgaaatataaagcaaaagaaagttagatctatccgatcggctgtagatattaacaatatataatatgtatatcgaaatatgtttaaactaagtgattgggatagatcggacagcttgccgagacagtataaatcacttatgtctaaaagtacttcaatataaagattatatatgtttatagcatagccgatgttgtagatctaacatgtatcggctaatactccgatacaactttatactacgatatcaatgcaagtgaaatatattaaacagatatcaatcgattgctaagataacttaacagattaacaacaagctcaatatattttactatagtgagatcttaatataaagagcagatttagcatatcaaatacataaaataatgaataagataactaaatcaggtaagataggctgaaactccgatgctatctctaatagcaatcataaaacaagttagatattataattctaaatattacttaataggtcggacccaaccgatgcagcattaagcataaggagatgtataagatctatacaagtcgatgaaagcctttcaagatggtagataaactatataatctaattcaacgttggtatctaaccctatcggctaccttctagaaagagatgttagctgatttgaggctagataacaatattagtctagattatatagaatatatgataaatcaacaacttatataaacaagactagagtatcatagagatggaagcactaatcccgagaacacaagccatcataacaagttttaccttgtcgtcggagatcgaaccgatgcagcctaacttgaaagcaagaactcgtcgaaagtaaactaaaacgaaagggtggcgatgcgccgagattgttattaaactgattgttaattaattacatgggtttgggctacttttatacccaaagtacataatatgtccctgtcggacacgacacctatctctattacaactcaaaatgcaaacaagtccctaaggtggactcttaccgacttgaaacataaggaatttacataaaataatctaattaatagatacaattgccttctttggactcaatccatgcatggctatcctcatgaggcatatcaacccaatccaacaatgactccaatatcatattgtcggaatcggcttcatcggctaccctgtccgactcgactctgccgatgtagatcgtagctgattcggactttagtcgatgtgcactctgtttccgaaacattcaatttcttttgattttgcttcggttttatctctatctccaatgcttgatttaccaaatttgatcgttaacatatgccccccaagtccgcgatatttggtaatgttgcggatttgcccaaatcttatctccaagaaaatctagggctttccgttttttgaccgttatggccccgctataagtactaactgtcacccccgagaaatttcacaccgttacttttcgtttcaccgcttacatcacacctgtcttctctctctccggcaactccctcgaacccctttggcgatccggaggcgacttccctgcagtggcgacctcacccgcgacgatgtcaacttccgctggtccttttgctgcaccatcggctgaattccccgaggtaagtccccatcggctagatcccttgttcttgcagtagattagttctttcttcgctcaatctgcctttttcctcttttcttctatagaacctttctcatcagatcgcaatcccaagtttagttcatcccaatcagtactttcttggtccgatcgacaatttggatccaactgagttcattaatgccgaaaccaataggatcccctttagactagccaatccaaacttaagtctttgaaaaaatacctttaagtcatggccatcaacttagaagagttagccggcttggtataaaagggtatcggctagcaagggttctcactgggaggaaattgggatagcccaagccctagctctgactgcagccaatatggctaaggatgaacctctgatgtcggcagcttcttatttctggtccaatgccatgaatggctttctgtttaaacagggaccaatgaccccaactttgctagacataaccatgataactggtttagacatcacttcatcggttaatccagtcggcttgaataccaaaaacaagtttgacttcaaaaccaggagcataggtggttggtcagggtttgtctcatcaaacatggggaatggagctgttactccaagagaacacacagcattccttctgatgtggctagaaaagtacttgttctgtggtccaagctgtggcccaactgtaaactggcaacacatagccgagtccctagtagaaaaaaaaggatttccattaggaaaatatctattaggttatttataccaaacactgaactcaacatcggctagaattgcttctggatcagcaatcgacataggtggcccttggtggcttcttcaaatctggttgaatttgcatactatgaaagttgtcgatagaccagccctgacagaagcagatttcccaagattcgaaccaatcaccgatgaagatagggaagaaataaccacatgccgatgcatgtcttttggagaggcagcatcaactaatgctggatccaaactgtcagccgatcctttcagagattggtttgcaagcttctacaatgggttccccagggattcaatagtttggtttgcatatgccgattctgatagctttgaacttccctcggacttcagatttgatgacattaattctgagaagtttgataagtctagagaagttttcactactgctatcagcccttgcatactctcagttggcatacatcagggtagaaacatccaagtttcttacgaattctatcaccccatgagtgctgccagacaacttggattgggacagctgccaattggtttgtattttgccgacaagatccagcatagaggggaaattacattggcattaatgatggatcggctgctaagcatccaaggacctccccttggaagtattgataatattgagctagctttgctcaggagcacaacatttgaccgatggtgggttgaatggaagaaacatttatttcatcaatcggtttccatgtatctcactaacatattccctgatgttatccctcaagtaagaatttctacttttatcaatttccttaactatctgctgatataaaaatttatccaatttatttctttgattgcagaccacagaatcttcacctcctcatcatagtgaaagtggtttggagatcaattatgctgcaggccttcttcctaatggtggtggactggctcctcctgtcatcggcttccatgccccccaagacaacaagtttgcttcaaggacagatgagagagcctatcccaatggataccggaaagaagaaaagaaccaagccatcggttgtagatccatcggctaccaagaagaagaaaacaaataagcaaaaaactttagcaaccgatgatctaccaactgttgatccagatgtcgacaaatttctggatgatgaagccatggaagaagacattgatgcagctgctgccgaagtcagtgacactagagaacaaacacctcctgccgataccccagctccacaaagaattcctccggcaccacctcaactagctcggcatcccagggtaagtattctaatcaaaacttgatgcttgcaagaatttcatatcccaatttcatcataacacttgtctctgcagaagaagaaatcggctgccagaaagaaaccaatactgcctccatcggtaacttatattttctcatttcctttttattcatataagccgattcctaataacacttttctttttagcctcctcattctccaactcctgttcagcctgaatcaagtgaacacaccccatcggctgtaggaagtcatcatgtagaagatgcagcagctccaactcctgctgtccctgtaagtacttatcttgatcttatatcggctgtttaaacattcgaacactttaaccgaatctgcatttttctttcttgcaggttttagccgatatgttctcttttgacataagacaattctgggatgaagaagaagaagacacctcaagcaaagccttagctcctctagccgatgatgttaagagaactcttatggaaatatcaaatcggctagagaattccttggatgtcttggtagtcgattgtggatcaatcagggcctggttccacgaaattcaaaatatgatcccagaagacttagccactacgctaactccagctttttatcttgaacaacatcaattcaagttggagaaagcaagacaaaggatagccaataggcgagaaagaaaagatatagaggcaaccatccaagtcaatcggcaatctgtcaatgaggagaaagccaacctagatcagctatcttttggcccttgtcgggaccccaattacgatccctctgtgtgtaatgtgctagtcccagatcaacgctagcacacacagtaacaaaagataatatcacaatcacatcacgattatattaataaataggaaacaaatataatttttacattggtcttatgaccagattttataatttctttgccacgcagggtcaaacagagataaacagaggaaaaagaggcgagaggcaccaacgacacaccacaggcaatcgactggggcacgcaacctattcgacgttcttagcaacagaacttctagaaacaactgaccttctctgaaatttggtgagacaacaagggtgagcacataaagtactcgcaagtgtacgggaatatgcaatatatgatacaaggcttcaaaggacggttagggttcatttgcataaaggcatttgcaaatttaaatataataaatagatataaatttaatttaagcaacatttgcaatcacaacatttttaaccaaccaaccaacccaaaaaggatactgtgtccacacaagaccaaaaggttctttgtccacacaggacaacacatctatattcattaattcctgcacacaactctttcccaaaattaaaactttcacaaatctacccctcatgtgaagtcaccgagcatgtccataaccgaggacgcggctattcgaatagattgacactctgcagaggttgtacaactttacccacaagatacagttcggtgccgctaaacaccaaagtgtaacaaagcgtttcccctacctcgccctaacaccggcttcccccatgggcggtcctccctacaccacacaggtgaaagttcccatggtacaaaccaaaaacctatcatctagccacctgggccgccggtgccaaagctaagcagtgtactaagctaggtccttcccatgaaaacatgtggttgcatggtaaggctcagatcaatggcgcacgaagtgaagtccttaactgaccagggcgacttgcttaaactaaggacctcaagcacacaacaaaaatggagcacacagctctggagcacaccgctcaatcgaccacacaggtcaatgataagcacgcacacagatggcttacctcccaggttcacacagatccaccatcgccccggtctaaaacattttccaccagttcattactacacacggtgcaacacatgccaccaagaagatagcacacagccacacaatttatataaaaacagtgataagtagatcattagtcaatattatattttgcttgtaaactagtgtgagtagggctaagcaaatctaagtacctgagtccatacccatatatgactcacatgaaaactagggtgacatggcatgaaaggtaatcaacaataattcaaaggcatggaataattaacaagtaggttataactacccacacaataatttgtgaaacaaatcatgcatataatttaaaacaatataattttgcaagttaggatcaacatgttcaagggtacacttgcctttacccacaggatcttcagacgaaatcttcacctgcagcagcaacctcttcggcaacggcgtctacacgattgcaaaaaggagaaaacaaataaacaaaagaaaaaggcagaaaaataacatcaaatgaagtaactaaataaatcaggaagtagagctcaatttcagaataacataggagaaagaatgggttgaatctgaatttggacggaggagataggaccaacgaaagattgaatttagagaacattttcatggagaagtaaatgaatgtttctggaaagtttatttgggatttctggaataaaggaattagttttggtggactaacgggtgtggcccatcctgttgagattatgggcatataaggatttaatttattccataaataaatcatgacattacagatgaaaactagcatgaacgcatcattagatctacacatgtaaactacgcagaataacatgaacagatcaaatatgcgcaacatattaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacatcgtgcacgcgcgccgcctgccctgccctgccaggccaggccaggccaggccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttccttcaagaatgctctgcaggacaacatctttgctaattaaagccaacagaactcattaaggcatagccaacctgccttgcagctcacaagagtatatgcatcttcacttggatagggtatatatatttgtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagttctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagtcccaattccacagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagagtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatagcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattggaaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccctccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattaacacgtaccgaggtgacgaaaagaccggctgcttggtcgaaacttttcgcaggtgtctacgaaggcacgaaacacgcgagcaaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacacatccatcagtgggatgatcaacggagaatttgttatagggagtagagtggtggactgattacgtagatggccgagatttatttgtagggagggatgacttggattgatttgggtattaggaggtttggtctaaccatgaggtgtgcaacatggtgccgtggagcgagcacataataggcgtggtgatgataaagcactggatggtggacggatagctagaggggcttcaggagtcggtttggagtcagggacatcgaggtggagctcaccgggatgctcgatggtcgctcgtggtaggttggcgcggggggaggaaacaacagattttgtcacagcggtgcagctgctcaccaaccacgatggtgacatggctgtgcacgagaaggaaagagaggtggcaacaatggctcaaactcctagggacagtggcagcgaagcgagggaggatagtgcttgggcatcagcgtctcagcatacgtgaataaaaagaaaaagggccagcactagtaggaataagaagagagacaaggcgcgtggcggaggaagattatagaggcagtacagggaacaagatagtagaaacggttgcaacaacgacgggtagttgacgatgtggtgttggcgaggatgacagaagtggtaactccagtccttcgcttgtttggaacaatgatgatgcagccaaccgcttggtcggcgtgggaagaaacagagttgtgttccatatcgatagtggtatcggaagatagaaatttggtggaaaagctgaacggattttcaagaacatttttctgaaatattcggaattccaacgatgtataattttgtggattaacaagtagggtccatgagtcattctcagagggaagttatagttatgggcacactgcaggcacagcgaccacgggccatccactagtagtttggtggcgccgagaacaagaggagacaccgggctcatggcggaggacggtgatgatgcagcattgtgatggaaccgcgatgaccatggaaaaggggacagcaacaacgctttggcaaccgtccataaggagaagatagcagcagcggcatgagcccctagaaataggcgctgccaacaggacagggaggatttggccaaagtcgacctcgcggcaacatgtgtttttcccgactttaggaggcagcgaagcaaggaagaggagtagcagcacaacggcgtcttggcgttggtgaagcaacggtgttgcattatggagtgttctgactgacaacgatggcacaactacgagtgggcgatggcatggaagaaagcagcggcgctgatgttcattcacccgaggcggcattggtggatgtgatggtatagcatcacatatagatgaccaaaaggcccgcccggcacggcccggcccatgcacagccaggcacggcccaccagccatcgggccggcacggcccgatcggcacttcatgccgggctgtgccgggccggcccgaaggcacggatggtccatcgtgcctttttttaaataagtctattttccgtccctcctctttgggctgtgacatatatatagtgaaaataagtctatttccgtccctcctctttgggctgacatatatatatagctaaaataagtctatttgacgtccctattcttttgaccgtggtatataatatgtctatttttactccctattgtttatgtgtcgggcctggactgcggcccatcatgccgtgctagcctggtcgtgctgggccagcccaacgtgccggtggaggggcccaggcacggcccggtggttgggccgggccagcacgggcccaacccctgacgggccgtgccgtgcttgggccgggccaaaacaccgtgccgtgggccgggccgtcgggcctcgggccttttggccatctatagcatcacaacagcaagatgaagagtcccagtgtgcacgaataaaataaaataaaaattggaggggcagcgctgctgtatagggaagccagagcagagagcatctcagcatgcgcgagcaaaagaaaaggattgcagaggtgttgttaaatatatatagaggagaaaaggggaaaagtacgagcagccataagatggagagatggtgaaaacagagctaaccgatcgacggtgatagtgatttagtttttgataaataaaggaggaaatgattataaaaagtggaggcagtgcaggtccttaccaaccacgatagtggagacatggcagcaacaatatgtgctagacgacgaggcagtggcgtctttatgtgcacacgacagcaacccgacatggaagaacagaagagcagcagagtgatggcctctcaacctgtgcaaacaccggatgatgaataggaaggaggaaacgaccaatggacttggatgcggtgcaagtgcttaccatgacagagaagtggcagcatgatgctcgtatgatgacggcacaaactctagagatggtggtgtgatggaatgggaacgacaatgatgaggtgaagacgacagcgcagaggagcatagcagcggcgcatcggcggttgaggaagctcccgacgaggtggtcatgtcctcgatcatgctttcacatggatagcacatggtgtggctgtttgcaagcgctaccgtggctgaactcaaccgggctgcgatgacagagcctgcaaaatctcccaaggcgatggcagtgaagcggtttggcagggcgctgacctatccatgtaaaagaaatagaagagggcatggcactggcaattatacaggacacgggaggtggacggtaaaaagtggaggagccatatgtgctggaaaaatggatctagctcatcatggtgattcaatttttgtcattgatggaaaaaaatgatttaggagaggaaggaattagtgagtagattggaagaagaagaaaagaaacggctaatcatcctcagtggtatctgtggaggaggaaggtaaactagctgggagatgagaggtcaccggaaatttgggaaacggattcagatcatcaaggtagtttcattttttggcattaaacagtaagattgatgagggagatgatagatctgtgatgggaattggaggatacgttgctgctttcatggagaaaaaaacgtcagattgaagacgaagcagaaacggcgtggccgtgcgtgggcagtggggaggatggcggcttgggttgggctgggtttggcctgctcatctgattggggtttttctaggctcctgcccatgcacaccgagaggaattgattggatcgacagaaacagaaccacaggagaagaagaaaggaagggaggaaaaaggaaaagaaaaaatagaaaggaaggaaaaaaaataaagatgggaattttctggaaaattcaaacattggaggattttgggatgtttggaatttttttttctggattggacactttggaaaattccaggaattgagctccacttccaagacccaaagataaccaaataactccaattaacaaacgataaaataaatggcggcgttattaatttatttagtcaaattaaaccctttttcatttatgaaattttcattaagctattttaggcgaataaacacaaatgctaaatttcaaaattaagaaaattagaagacacgaaaaacgggacgtgacagccctggtccaattcaatccaacatagatcagctggaatctcgaaggattgagctcttggctcaacttgaggaatgtaatgctgagcttgccttagagaagcagaagctagccgatttgcccaaggttgttgaagaacagaagtccaagctgaaagcttccattaagcatctagctgaaatgactaagtccttgaaggtgatccctgaaaccgatgctcaagacgcccaagcaattgaagaagtgatgcagattaggcaaagggctatatcggctatccagagatatattgctgagtaatcggcttgtaataggactgaaacacttttgtaatcggctttgaacttctggtgatgcctatgtaatatatcttctcctatgaacttgtgccgattaatataattttttgcttctaaagtccatatttttgatttgaagtccatattttttatatgcatatgcccccttaattttacaatgttgaacaaacattgagaaaattaaaaattttaactaagggcgatataacaaatatcggccatcacacatcggcacaatccaaccgattatgataagaaaaaaaaaacttagagcgatacaacacatattggctatcacacatcggctacacataacagattatgataaaaataaaaagtctaagggcgatattaatcatatcggccatctaaaggcgatgtcacaacatcggctgtcatgcatcggcacaacttaaccgaatcatgaattgatccaaacacttggataatatttcttcaaatacttcccattgagagctcgactgaaaacttctccatcaagtccttgcaacatgtaagctcctttacaaacagacttatagatttgaaacggtccttcccaattcggcaaccacttgctgaatttgttgtcacgggtcctaatcggcaagatcaacttccaaactaactcgccttctaaaaaagattttggcacaaccttcttgttataatgatgagcaatcctttccttatctcttgttaccttttccaaagcacgcaatcttgattgtactaattcttccgactcatccaccataagattatgataatcatcggctgacagctcatcttgtaattcaatccttcttgagccgattttaatttcccatggcatgtccataaaccagcttataaggaggaacttgaatcgaaccatgacaagccatctgataagcccataatgcctcagccaatcggttatgccattgctttggataatcggcaatctttctttttatcaacttaatcaaacttttattagatgcttctgcttgcccattagcttgcgcataatatggggaagaatttaacaacttaattcccatgctttctgcaaattggacaaactcatctgacacaaagatagatccttgattggttgtgatagtctgaggaacgccaaatcgatatatgatatgcactttgacaaactgaattgcatccctagaatcaactttcttcaaaggaattgcctgaacccactttgtgaaataatcggttgctaccaatatatatttatgtcatttgctagatggtggattaatctagccgatcatatcaattccccaacctctgaaagggccatggcttgatgataggattcatagccgatgctggtgttgtttgaattgttccaaacttctaacaatcttgacaacccttgtaatatctaaaacaatcctccaacattgtcggccaaaaatacccaactcgccgaagtaaccacttcatcttgtgagccgattgatgagtaccacagatgccctcatgcatttctcccatgacaacttttgcttgatcaatactcaaacacttgagcaacaccccatcaatcgtccgataatataattcatcctccagcaaaacatatcttaaagctttgtacctcaatttccttgaagccgattgagaaggaatttttaagtaattataaacatcatacctccaatcatcgactgtaattgtggcaacctctatatcaacatccttgaccatcggcttataacccgatgctccttgagccaaatcattagcctcaatattttgttctcgagaaacatgtttcaatgtcaccagccgaaaaccacccatcaactctcggcatttctcattgtagatcatcaatgtatcactcttgcactcatattctccagctaattgactaatgactagcaaagaatcttccatgatttcaatagcattggcttcaacttccttcaaaagttgcaatcccttgagcactgcctcatactcaacttgattattggtagcataaggtttaatcgtgtaagcaaactcaaaacatgccccccttggttatataataaccaagccgataccacaaccatgagtgcaaatagatccatcaaagaataatgtccaacgcactatatcaaccaagccgattgaatcatctcgatgttcaacaataaaatcggctatagcctgcccctttactgccttgggcgactcatacctgaggtcaaactctgtcaaagcataaattcactttctaactctcccttttaatactggagccgatagcatatatttgactacatcggccttgcagacaatagtgcactcgttggataacaaataatgccttaacttagtacatgaaaaatataggcataagcacaacttctccagtggtgaataccttgtctctgcatctagaagccttctactaagataaaagattgctctctctttgccttcaaattcctggatcaaaaccgagccgattgacttctcatcggctgacaagtataacttgaaaggcacccctttctatggaggaatcaataatggaggggaactcaattaatttttgatattatccaaggccttctgttgctctgcccccaagtaaattcttgatcagcttttaacctgagtaaaggtgtaaagggctccatcctcccagacaaattagaaataaatctcctaatgaaatttatcttgccgacccatgactgtaacttgttcttgtcctctggaggttcaatgttcttgattgcattaatacttctttgtgtaacttcaattcccctctcatgaacaagaaagcccaaaaattgtccagccgatacaccgaaagcacactttgtgggattcatctttagaccatttttccttgttctttcaaaaacttttcgtaaattggctatatgatcatcaagttccctagatttaaccaccacatcatcaatgtagatttcaaccaacaagtcgatcaagtcatgaaagatataattcatagccctctgatatgtagctccagcactcttcaaaccaaaagtcattacaacccactcatacaagccgatttcaccaggacacctgaaagcagtcttgtggatgtcctcttctgccataaaaatctgattatatcctgcattgccatccataaaacatataatcttatgtcctgaagcagcatcaaccaattgatcggcaatcggcattgggtattcatccttaggtgtagctttattcaaatatctaaaatcaatgcacaccatgagtttaccatttttcttaataactggaactatattagaaactcactcagcatatcgacatggccgaataaaaccagcatcatacaaatgagtaatttcggcctttatagcatcatacatatcggctttacatctcctaggtggttgtttatatggccgataccctggtttaataggtagccaatgttcaacaatcgatcggctaagtcctggcatctcaaaatattcccaagcaaaacaatctctgtattcttttaatagctctatcaacttggttctaaattcagatgacaaattcttacttatatatgtcggccttggtctatcttctggaccaatatcaacttcttccaaatcatcggccgagatgaaaccttatccgagcttgccatcgagatcatctactgtatccttggtatagaaatttgaaccctccacgacgccctcaaagcaacaattggggctctccatctccaattggctatatatcacaatcggataccttagaaaatctcctttccaaacctttccagacaaacaatcggtactatctatctcccaaacagacaaatcggcattagcaatgctaactgacctgtcggctggtacaacttctatcttgtcaccttgccattggatcaaactctggtgcatggttgagggaatacaacaatttgcatgaatccaatctcttccaagcaacagactataggagcccttcccatcgatgacaaaaaatgttgtaggaacagttttgttctacatttaaaactcccttggtctctgaaggattaccaccaaaatctttgagaaccatgttagtcttaatgagatcatccgaattcttgcccaatttcgtaaatgtagcatatggcattagattcacagcagccccaccatcaaccaacatcttggacatcggcttgccattaacaaatcccttgagatacaatggcttaagttgccgattttctgtcccctctggcttctcaaagatagcctgttctggtgacaaaaccaacagagccaaagattcttcaactacatctgcatcggcatgggcttgactaattccaaattcagctggtaacacaaaaaccatattaaccgatgtagatgcaacagattttcctttagccaacctctttactttgtcagcctcaatctcatcggctgataccaccttgctcttcacacaccactcttgctttggcttagccttcttcaaccgatgattaatttcctcttgtacctcttggaattgctccctattcctcatcctttgaactcttctcttctggttcttggtgaaaataccagaaggacaccattgcttcttggttccatcttcatcttcagaatcttgaaaataatcttgatgaattggacctaatctctgatgaacaggcaacttcttctgaagcaatcaattttccctaggataggatcggcttgaacttgcagcatgtcccctgttagaattgctgcatcctggggatcaaaattgttatcatcccttcgttctagcaaaatctgaaaaattcgcaactccaatggggatcaaaactgttatcatcttcatagtacctttcttcctgccgatcatgctttctttgatacttgttgataatcctaacataattgagctgtttagaccgataattcttgctatcggctgttttcccacttgtacgaaccatgttcataggaaaaggattaccatcaaccttcatcggcttctaggaatcatcaaatttgatcttgccgttttcaatggccgactgaatctgctgtctaaataccttgcattcattggtactatgagacccagtattatgccacttgcaatatttcttcttccccaattcctcaaccgatggtaacacattattggctggaagttgaattttttctcccgaagtagcaaatcaaagatcttatcagctttggtgatatcaaatcatatttctcctcctttgcagaatttttcacccattgacaagtaataaccttcttacttctagcccactcggccgctgctacttcagaatcatctacagaatcagattcggaagcaaaataatggacattgttcaccttcttgaaagccacaaccttctttgcttcctgaaatctttgctcatgtactcctaccttctaggccagatgagccaaactttcaaagtcctgagccagaaacttttctctaattggagccagcaaatcctggaaagctagatcggctaactgagaatctaacaaaaccaagctgtaacacctgttcctcatatctctaaatctttgaatataatcctgaacagattcatcatgcttctgcctgattgatgtcacatcagttaacttcatctcatgaaccccactgtagaagtaactgtgaaattgtttctccaaatcggccaaactattgataaaattgtatggcaaattagagaaccatgtgaaagccgatccagacaaagacaaaggaaacaacctaaccctcagagcatcattagccgatgcctcaccacattgagccaaaaatcggctgacatgttcataagtcgacacattatcttgtcctgagaacttggagaaatctgggaccttgtatcgatgtggcagtggaattcaagtccagtacgataatatcatgcaagtctaggttgcacaggcaaaaatgtacgataatatcatagccacactacgtggagctggtgcagctgaaggcacacatgccactgtctccgacgtgcaagcaactggcccatccacgacaagcggtgcaaactaggccgtgacggcagctaccgattccatcgaggcatgcaggtcaccaaggaggctgcaacgctcactgctgccacttaccgcatgtagccctcgaaggaggtaatccctttactgcaccataattttatacgcaactatcacaaagctctctgatgacacagcaaatgcattaccacgtgcattatcacattgtttaattaccttacatgcatttgttttttcagcacatgcatctatgtttatcttgtcaacattgcaattagtgggggtactctatatttataattattcctacatttattacatactaccagggacaccgaaagacaggcgacaccactaaggcggtcccccaggacagctacagcatcaccacctacaacaaagtcacttgttaccagccccaagagcactgatgaacacaaggataggagtacgtcgccaccaaaagctatgagaaggtcaccaaggtcctcgccggctagcaatgtgcacccatcatccccacagcaggcggacacgcaacaatcggggttggcattggaaaagggcacgcttgaatggcaaagccgacctgccatcagcgcaatgcaaggcatgcagaccgacggaggaacactgccataggaccaaggcggatgctcgattgatgcgactgcaggcattatacatgcaagtagcagccccgagcggtcgagccatgatccatcggcggcagccaatcctgccctgtcagcatctgcacaagaatacactgaagagggagcgcaaccgctcacaggtatggccatgttgcatgcatgttattcctgccatatatattcaccgagatgacctcacattccatcgcatgcaggctgccatgcaggcacagtaggccaaggcaatgatgaccagcaaaccattgatcctgctggagtgctggagaacacaaccccacagcctacccaggttacaagccctacttgtttctacacctgaatttgccctagtaatccatttactctaccctgatcccagcaaccatcacagcctgaacaaactactcagtaattgcattacccagacatgtttgctttcttgcaataatacatccgtagtactattagtaattgaattaccttgcacaattccagtgaccattttctctaccctgatgtacttgccctagttatccatttactctactttaatcccagcaacatcacagcctgaacaaactacttagtaattgcattattcagtcatgtttgcttgccagcaacaatacatctgtagtaatattagtaattgaattaccatgcactattccagtgaccgctgtagtccaaataaatattttggtaattgcactactctgactagaattacctgcttggcttgaagcaggtagtggtgtttcaagatacaggtgacattgggcagcacatcccctcgtcagaacctatacgctgtcctcgcaggtcggccaggtttgtttcaccgctcaagattggacacacacgccccctcccggatagcgcgaaagttgttgctcttcgcgaacgcattttgagtgacccggccaggtttgggaggtaaattttcctgttactagtgtacaattccacaactcttattttttaattgcgttatacattgggtcacgtgatacaattgtgtacaatgtagcgccaacatcattgaagttggcatatctgctgctaccgccagcgatattgcgtccttgttcactgatggttcaatgacaaaaggcctcttcatcgatgctttcataaatttgattctgcatgatgagcaggagtttagcccgatgtcagctggggaccgaatcttcctgccaaccagtgtatctgtaagttgtgatttgtattagcgtacatcaacacctaaattcgcacgtatgcatgcattttgttttccctttacactcatacacaccatgtgctcaatgcagaacctgcttaactgtgattacctggacccaccactcaaggcagactttaatgagcagtgtctggcagaacacttgcgtgaagtcctcccaccagccaaagacctccaatcctggaagatggtatgttctacgtgtaggttatagtacctgttatacaccacagccactggactctgtactgcgtcaaccggaaccatgggcgcatagatgtctttgactccaacaattaccctgctttgaatacggagtacaaggatcaccatggtgacctagggagtcgtgttgtgaaacggctcagcgataggctctatgcagcagccaggactgccttcaagaggtttgggaaccagaagctggtcaggaacaaatgcccagtcatgctaaagcccaatgattgcgcattttttgtcatgaggtacatggagctatatgaaggcgatgactcccccctgatacaagtcgctgaatcggtaaaactgctacaaccatttacgttgccggggaaaacctttagccaccttatttaccctgctgaatctgttctcattttgtgcaggaggagtacaacgacttgcgttcgcagatgctgtacaacatggtcttccactccaacaatgttgctgcgcctctgccaccggaactagaagagctatgacccagcagcccctgcgcagactcaagtgaatgatcaatgcgtgtccctgtgatgttgccttgtggtcttctgttttttgaacaacaatgctattcatgtgatcccaagtacttgtaatggaacaacatactgttgctcaactagttgcattttgctttgtgtggtagccttagttccttcaaacttgctgttatgcattactgacatttacagtggaaggcccagtaatcgatttacttcatgcacctcatcatatcatttgtgattttaccctgtaaatcaattacttgagacacaatccatcattctgtcaacaacaagtttaaacagctaacgatgataataattgctttactatagattttagacgcatcataacaactcatgtaacctaattacaacaatctctctgccgagcacttcagttcttttttaatgcgtggaaattgaccagtaattcgttaactgtgttatgccattcagtgtgcatgtctcattaccatccttggcacacgtagtaaatggattaccatccttggtgcacgtagtaaatggattaccacactactgtcatcactttcatcacccctatcggttctttgcaaccaaacacgataataattcaattaccagaagatctcccccacacccaataacctggagtaatccaattacaacagccccacatgcgctttcatttgttttgcatgtgtccactgatatgcaaacccacaaagtgtataattccacaagccacacccacacattacacacagcacccaaaacgtattcaacgtcctgttttcaacaactgtgaaaccatctacacggcacacatttatattctgaaacctgctattatcaagctggcacttaaactaacatgtactacataacaaacatttgatgttaggttggtggcttaacaatgctatttgcacgttacacaaattatggcacatacgtcaatatggacagtgtggagcgtacacatcataggtcggcgccacctccagaatcatcctcgccatcaatcatctcttcatcctcgtcaaccccataatccatttcctcttcaagcctcctcctaacattggctgaaacccccgctatacgcttaccgctgccccttggtcggcccctcttccctttacccctattcaacaccttctgtagcttgtcgaagttgttgggggttctttgggcaggtagtgctgtaatgaccatcctttttatgacaccacccacagaccctgttgcaaaccttcttgccctttgtgccgaggaccatcccctgtcctggttcggcggccataccctttgttcgcgacttaggaggtgcagttcggcttatctggctagcgaggtcatttctttccccctctccttgcattgttgtttgatcaacagcaatggatgatccagaactggacgggatgctttcgacatgtattctcaaactcttcaggcctttcagcgcctcatcatatgcgtcctatgatttgctcccagcttttgcaacagccatagcctcggtcatcagtacttttgttctgtaactctcttgcacaccgtccgaaccaattgtcttttggtcccttctatcgaagggcatgtcgcttttcgcttgcatagtgtacctacggagaatgtacttggccgggatggtctcaacctgcacgtggacaaatgccctaagcaagtgagggcagaaaattcttgttacaaaaacatgagcaagccaaaattagtgcgctcaaataaatagtctatctccactcgataactaaacataggacagatgtacagttccaccaaacctgtatgctcccaaagcatgcactcgcactcatactgcccatcatcaacatttgcaattactcggaactcccgctggcaccagttatattttagcgatctctttgtgtgcgagatgatccatgtgtcactggatgcttcacttgacctaattttgaatgacttgctatcgcccaacaccccctcaaatttcttgaatactgccctagtatatagtctcgccaactgcacctcgaacggccaacaatttgcaaagctgatttcggcctacatgaatcacatttaacactgttaatcactgcattttctatagttagtgacacgctgatagtttatgcgcacatatattgtttctttccatgcaagccgactcctctgctgcctccttctccttcctttatgtgaatacatcgagcattctacgcgcgaaccagtgtagcgctgtctggtggtcaacaaacttacgctttaccaatctgtttgtgctctcgctctgctgcgtcgatgtcatccgaccacaatagtcttccgaaagtaagctgggatccatttctcctggatttcgtacagccgctccattgttcccacaccatgtagttcatatttatcaataaattctgcccaggccccttcaaactccatcggggtatatgtttggtcaatacaaatctccatgtcaccctctaaatcttcatgacgggcgaatataatcgcgagggcatctgcatatttgtgaagtatgtgccacctgcacagtctatgtatgatgttcttgaaaacaagaggtatggcagctgccattgctacatcctggtctgcaaaaatattttactcatttaccacacaagttcaccatcatagtaaagtgcaaatatcattgcatactagtaaccacacaacattgcactttttgcttaatacattacctgttagtatgcatcatagttccggccaatccgccatgcaagtcttgaaagtattgaacaaccactcgaatgactccttcttctcatccctaagcaacgcacacccaaacaacgtgttttggagatggtggtttgaacctacaaacattgccaatggcatttcatatatgtttgttttgtatgttgtatcgaatgtgacaacatccccaaaatctgcatacgccgcctagcaacttgcatggctccaaaataaattcttcagaatgccatcttcgtcaagctgggcatcccaataaaactgagggttatctttcttgcactccttaaagaattccagtagcttgtttatgtcgtctgcattctcagctctcacattagcggctttcctgtttagtaaccaaattacaaaggacaatttatttcaacacggtgccacgatgtatggatgtttaatgcaattcaatcggcaaatgacatatgcaggatacaaatctattctcaagattgcgtgaagtgaatgggatgttctcttgtccaccatgcatgtcagcaagcactccaattaggctgttctgcgccaccctgttttcttgcatggtgttcacaaactccattatcgtgtcatccgtgtgcttatgggatctcatgtgctttaccgctgctagagagggcgtgagcgggtggttatgctcaagcacaacaacatcgtacacaacagacgacacctcaccatcaaccatcacatttttcaccttcatgtatgccttgcaaccagttttctttgtcctatggtttcgctcacgttcaaattcatcgcctttataaaatttatggtgcccctccctggagcaacatatttctcttatagtcttcttagttctactcttccttatgtcaaacccagcatggtaagcatatttctcatagaaatcatatacactgtcatagtctttgaacaccatattttgtttcggcaccatgtcatcatccagcccactaaactgcatttagtaaaactattactacccacccgtactgcatgcataaatgccatagagcatagatctgttcatccacaaaaatttgtccttacaaacaacatattaactactacttacatgggtgtacactgctggccgtgttggagtagaaatctcatgctcacgcagagatggtggcatacagttcgcatcccggccagtacagacgactgcccctcctcacactagctcattgtggtgactacctaacacacgctgtggcgatgcagatgttggcggcaattcaccaaaacgagcaccgctggagttcatcgttggaggtgtcactatgacgcttcaattggtcttcccaccgcatggaaccgcacccctccaaaattgtgaagttgccaaagaataaacccacccacacgcagtggcaacaaccgaccagatcgccaacacgaaacaatcttgtcataacttccgtagtaaatcaccataatacgataattcatttaccgacgaaaacgcctacttacaatgtggcagtaacccaattactgcattatgcgaaccacctcatcccgaaacaacagtaacacatttacaacaaactcggtcactaactatggcaaacaatttaactaccccgataaatcgattaccatatgcctagctgtgaaaaggagcccaattaacctaccaacgtaataagtaatccatttaccaccagaagggaatgggacacgtgtcggtaattgagttaggttagaaccccgtttttcagagtaaatcgattactatcgattttttacacgcagcggtaaatcaattacaacaaactccttcacacaatttatctatacagtaaatcaattaccacaagactggttgctagaaggtgtccctatatccgacactaattgatttacacgcagaggcgtatctttaacaactacccggattcaaatagatctaatctacatggcacgaacgtgggcaaccgaacacggtttttgcggacactgggcttgacatgcggtgctcgaaacaatgttccgtgcgcaagtgcgctgaatagcgctaccgcataatatattgaatttcaataaggaaatttacagaattattgtttacatcttgtaacaaagaaattcataggcatatcttttaaaaagaaaaaagtacacattttcagcagcaagctctgctagataattgtgcaatatatctattcctatatcatcttcgcaaattccttcgctacttccttagatcttgaagtgggattcaagtgtcagaattcagccactgataatttgaatctacataagaaatttattattacacttcacaattgcaatgaaataatattgaccatatattacttcagcatataaaatgctactatgaacatacatgaaacaacatagccatattgtccattgtcttgcagtacttcacacgggtcttaccggttatcgttttgcttgaaacaatgatttgtaaccactttactaaactagttcaaagacaaacaaaagttgctcacagatctagcattaaagtgaggccaattgccacctgaaaaatagattaggagtactaatgttcatcaagattatcaatgatcctgttaagaatataattatctgatagtttcatcctctatatatccgaaactggagaattctaattggtttttggacagatcattttattactaagcttcatgttctttctcctctgttctgtcaaccaaaaacagagtagcactaacctttgataccattggaaacccagtgtggtagtgtcccagtcatcttaaatatattcttgcaaacctgcttgagaggggaagaaagacgatgtagcaccaaagaatcaaataatgtattgaagcaagaagcattagtatttaagtccatctaaagtaaactatctaacgccatgtttgtggagtgttgactgtacacatcatgctttcatgattcctccaaacgtgcctacacaccacaataatttcctccatactacagtagaacatctatagtattttattttactgtatcagcaatagtgtaatacaagattttggaaaaacacagtgctcaggactacccaagtgcaatttatcacagtttgctgttgaaaatggaggaaaatagttcgaatggcacatttcttaacattgaaagctacagttgactgagatatacaaatcggatatcagtatccgccaccaccatatagaagaataaatgattactactcctacaatggaacgaatacattgggtaacatatcaaactttggagccacacaccatagaacaaaaacataatatgctatatatgcactggatatgtcaacagttaaacatcaaatatttttgcaacaggaacttcccaatatgcatgtgagcatgcacttctaaaagatcttactactcttgccaatgacagtacaacttctatcaatcatctgtgaaggaaaataaaaagtaattatgaccttttcctatatagcatttctccaataaattggaaaatacctatagaataattatgactaaccagagaaggctgcagccataattaccttgcaccaaatgatgtgctctgtgagttcttctcctgtgggtccatctttacaatcttgtgagcagtcacatatagtgatatagagttgctttgcctcattctctacacttaaagctgcagtgttagtttcttgtctcagaacatcattagaaaataatatgtctgttttacttaacaagtcatggaagaaaatagatgacatgcagaatagtagcttaagatttcgttcccagaatttaaagatatagctcatgttattttgaactttcatgcacaaaccacaacatgctgatccaaaatattcttcaaagctagtgttttatcaaacaagtcaacattttttttgcaataagaaatcaactcgtattatattggttttgctcttttggccctctgttgtgacctttaagtaatgatcagacataactctggattttatcgaacaaatcggtccatatatactgcctgcttgtcggagtcaacaacttaatccccttgaaaaaactggctagctgcataaaaagctgttctgttgatggtgatcacccaatgcgtgcatgaagctgaaagcaataagcactactaattcacagatttagggttttttttttgtggatgatcatgttggcaataagaattttgcaatttcacgtgatcagataaagtatgagaggtgtgaagaaaacatcaataatctgtctaaggacaaaattttccttttacggagctggcatgcaactgtacacagtgaagcttctcaaacacatgatgtgcatatctgtgacagagaacaagccatccactcttactgaagaagaatttagtcaaacagtacataaaccacaaaaagggttcctttgggttcttgtgatgtgctcaccatgcgtacacaagaaggatgcaacaatcatacgtgtctcgaccaggggcggatccaggattttcagtcaccggtgtcattaggtaaaacatattttattatagcctagcttgatatagttctagatccttaatcgatgactggatttgaagtgtatatgttaaactataatggtttaaatttttatagtatttcataaaagattgggaacaaaataattcatcccaatattatcaacataatcataaatctaaatcatatatttatgaagcttagttatctataatgttctacacgtgttctaacattagtgaattactagtacaacatagaaatagatatcactgattgataacaattcgagcaacttaccatgtcttctaagtattaaaaaacatttttgcaaaatttaatgcatacatgtaagctttttatctgttgcgcactatttctataccttattattctacattgttatctattaaacctaaaaagaagtaatgacacatttcaccgggttaaattactaattgtttaacatatcagaacaaagtaaagtaaccaagcaagttagttctaacaatcacttagcaaaactatgagaagttgattaattaactaaaggaaaatagggtgtttgcacgtgtaatgctaacaatagcataactgttttgctttcataaaacaacgcatgtttttattacctgctaattgcatgagctgtagtgaattggtcaatctaccggtgtcagtgaactttcatcgatggtgtcattggctaaaaacaaatagcatcgtgtaggatttgcaaaagggcgtcggtgtcagctgacactggtaggaacaccgtagatccgcccctggtctcgactctccagcaatcagatgtgtctcgatcttgcatcctgcaaataccatgaagaaagggatgggtgagacaggctagatagatggccagttctggggagagccagcgtgtgcggctgagcactttactccttctcccccttcctccgttgccgccggcgtctatagtccctcgacatcgctcacggttcacctgacgagatcgatgtcgctccaccgatgaaaactcccctttctcccctgccacctgccaccatgggggctgcgacgagccgtcccctttctcatcaccgagatctgagtagttgagaataccagattgcagtagatgggaagcataaacctcggttgctcgggtgatgactgatgaattgtgggttcctcctggagttaaggaggtgatggggtagttggtgttggggcttattattaggggtgaaaacggagcggatattatccgatccgatccgctccgaatccgtccgatgtgaggatatggtaaggatttttagatattcggccggatgcagatgcggatgtggatatggtatcaacgatatccgacggatgcggattatccgatattttaatcggattatccgatgtactgtttggcggataatccgcaactttcaggccacacaacaactctatttagcccattttacatcggacggcccatctagcccatctagtgtaacctaatccaatcctcccctaaatctctctctctgtgactcatctcttagtcccttctcctgctcccacacgcgctgccgcatggcaccattaccataggtgcgccgcgccgccgttgcagcatgttggcgccaccgccgccgctcctccttctagtccgccgacagtgtgttgtgtgttgtgtgctgtaagcagtgtgctgtatggaactagtgtattgtgtgctgtatgcagtgtgctactgtgttgtgtggctgtgtgctgtatgcctagatagctgtatgcctcattgcctcatgcgtgtcgtattgatgagtgaactactgatctactgaactgaacactatatttttaaattttaagcaacacagtgaactgctgaactgaacacttatattatgtttttgatggatgtgttatattaagcaaaattatattattgatgtgttttggttggtttttcctagagagctgaaatcatgttcatatgttgttttgccatcgtattgcggctaattgtattgccgccctcttgttgtacggattgaatacaaacttaacatccgacaactttttgtccgtttccgaaccgagtccgcaccgactccgcaccgaatccgacgtccgaaataatccgctccgcatccgcatccgcacgtcatccgcacccgctccgcatccgcttaaaaaaaggtttaggatatggtatagctattatctgtccgaatccgctccgttttcacccctacttattatatcgtgagctgaaaatgtggagataaattagccggttcgttagatgtgaaattttggcggcagtctctagacggaaaatcgagattggcgggaagtattttcatgtaaattgctcataaaaaatagtacggtatttctttttcaaaaaactacgagagcccataagttaaaaaaattggtccacatgtaagtattaaattaaggtaattttgattttgtttatatatataacatgagatttaattctacattcttgtttttgagatggaagtttgatcacaattcttttataaaatataaatttatagaaatataataagtttatgagattaagaaattactttcaaaacaaaaatgtacatgtatcatttgttatgtgtgcaaactatcattttcatttatatttaaagttataataatttagttggaacttgtctaaaacattatatattttcttgatcaaacgtattaaatggtaaacacatccattaatttaattctatgttatttgactttaccatgctctactgtctcaattggttcctcgtctattggtctatttgagtctggctatcttcggttcctcgtctattggtctatttgagtctggctatcttcataaatagcttgaagtgcgagtacaaacatctcatcactacttacttcctatgcttttcacaatcaaacatagctgtctctattagacactagccatccaagtcagccttatgtcttcagcgtcctacgtgtaagctagggaaaccacgtggctacaaacatagcatttaatggaagatgatttttacaggttaaatgaagcttgtttgtggttcgcatattttggcttaaatttcattatcaaagtgccctctaaattctttagaaaattaataaaattgctgctgatacgaagttaattgtccatcccatatacaagcttgtttatttttctggttatttatgtacaagtagcctctatatgtttgtgcctagatagcgtcgtcagccgctgccattgctgtaaggaataactagatattctcactatgtgcctacttccattctccttcgtcatattacataaaaaaacgatatgtatactttttcgtaaaatttcattttccacacattataaatagcactgtatatgaaaatgtaataggctattatttgatatagaggggaagattttgtttcattaacatggattaaactaatttactgataaggtgcgtacaaaattgttaaaactttatagcattccaaataaaactactagtaataaaaaaagttatttctaattattctattccattatctaaaaaaaaataaaactactactaatttatttctttataggtccaccctgtcagatttccatcaatctagctctcttgtgcctgaaaaacagaaacgaactgattttgccgcgggtttgctccaaaattttgtgttcgtacgcttcctccctcaatttgccgggttttcttctccactctcggaagcagttatggtcctaacagagaacaaaacccatctcatctccttgactccttccctgtacataccgacccaatctctccagccttcgcagcttctccacagcggatggcggggcccgccgcggccgacggcacaatcccttgcagcccaggcgacgtcgccggtgcggcagtgcctcagccctggtcgctcgtccccagggcaagatcacccgcctcaacgcgcttctccacgccgtcatcgaggtcaactccgacgcgctccagcagccggcgcgcgccgacaccgcgagcgcgcctctagccaccgctactgcgggccgctccatggcgtccccatcctcaaggacaacatcgtgacgcgggaccggctgaaaacgacggccgggtcgttcgcgctgctcggcttcgtcgtctgtcgtgacgccagcgtgacggccggcctccgcgccgccgctgccaccatcctcggcaaggcaaactcctccaagtggtccaacttccgccccgtcccgaacggctggagccaagacgctggtaacacctatcaccaccctaagctgtcgtttttttctccagcatctcgtcttgtatgcaatgtgtttgtgaaattgtccataaagagccccatgttgtcaactgacgtgatccggtccagccgcgcggcgctggcatgagtgcatcatccgtgttgaacgggtggtccctggcggctttgcccgcgcgcatcccctatgttttcagtttcagcaccagcagcaaccacctcaccgtgatggattcactggctgaatttgttcctgccaatcaacgaccgcttatcatagtaagaacttgctgaatttgtttctgccaatcgatggcaggttacaatagttagcactctatttctttatgcacaccacgagttcgatactttgggccagtgcaaaatcgttggtcttattgtttcatattcttgtgaactgactcaccgctgtatacttttgtggatttaggcagctccagttagctactcacacgaaggtcatttgcatctactagaagctgcagcatggacgtgatatatatatttgcaagatctggtgagaacactatttaataatcccaaacaccatattagtgctggcagtgattgtcatactatgtgcacacgatctattagaatttgttgaacccaagctttggctatcttgctcatgccataattgtttggaatgtcagattacattaggaggtgatgaagtaagtgttccaaacgtgcaaatccatgtcatcatccaccagcactgccccctcactattaccattctctaccatatgtactagtaattattatagttatacagatgaagtaagatttcatgctggaactttcttaggaataatatgcaacttgtgacctgtttttgctagcattattgttgttttgaatgaagaattgatggttgcaattggccgatttctgctaaccagtgaatcagtaaggtatgaatggatgcaaattctgctaaacacatagctatttttattcaggatagagctgcgaactacgacatgaataatactcatatgtacatgaatgtacatgttaatacatacattaggataaatataataaataactagatgaatgggtagtgtgaactaacctagcaagttctgttttttaaatcgtttggtggaaaatctggcagtttttttatcaaaagatatgtgaaatgatgtagacactcccagtcttatatacagtcctcatcaaggttgttcatgttgcttaggattctattcattcgtccttatcttttttttttgttagtaacaacatctttgtaccatgatctaagctttcaggctggtataagtataatcagccatctgtggcctttcaattattctaattatgcatgtgtacaagattgtccttttttattcaattcagtgatctccaaggttgcatgtaagctttgtccactagatcatggatccaacacaagcctccaggtgctgttaacctcatctccacatatttagcgacaaactttgtgtgagatgaagatcaaattgtatagtcaaatatattcacttgtggttattaaatttataacacacctacattacctttactttctatttcaacacagcaaactatggatttaaatgctagtaaacagacattgcttttctacagaccatttatgagcatttttggtagaataaaggagttttcatatgtggaaaaaaatatcttgaaactaagatctgatccaatggccatttaacaattgtgtgaattagtgattattacagcagaagtgtgtgatcattgagtatgtttattaaaattctttgaagtggtggaatttttttacactgccaccacatgtttgtcactgttgttggtatagaaagtacaaattttcatctatgtgatatcaactgtttattttcaagcccattctttggtttgtcaaggtgggaaattcaagtaaaggcttgttttgataacctcttttgcaggatttattttcaatttgttcaaggctgttggtattgcacggaggaaattcattacctactttttttttaaccttgcaatgtcatattgataacccatgtatccccgcaaaaaaaatattgataacccatgtaatcatgtcatcaactcatgtgatatttggagtgccttggagtgtattggctttgaaagctttgctatcctgtatttcccatggttattcatcaacagagattgcacattgttgctttctactctgctagtggagggtatgttaattaagtccattgttggtggatgattatttgatttttgaccatgttaatggattaaactaagatcaacatgctatctgtaatatatatatctgacttcatatggaaattcgattgtatattaaacaatgttatgaactccaaaataatttgcatattgagaactgcacaagctcaagggaactttagtctggtctattatagaaaaatggcaaaaactgaggtgattaaaatgagaggtatgagagaaaatagaagagtaatacaatttttaagtaaacaatgcaacggaaagtaaacggttgatgtaaatctccgaacaaacgaatacagtagacatgtgagttcgaatagtttgctctatggttagcagtttccttttttttatatatatatttggagacatgtcgcaaatcagagtaaaaaaacagatttgctaaaaatatgtcgccagtttttgtcaaaaaatagtcgattttgtgacagtacgatttacatcgagattcgtgctagtgcaaagtgtcgtgacggagggttgaacccagaacttcgaagtcggcagacagagctcctaacaaccgagcacggtattggcattcactttattgccaaaacaaattaatattgaattttgaagtacttatacactaattaccccccacattcacttacacggcacttacgctataattacatatgtatttattcacttacacagcacttgcatatcacttacactataattacatatgtaatttagggacttacaatgtaaatacatgctgactattttttaatgaaaaatatggttccataaatatagctactcccgttaaaaaacacacaaagtaaaattatcacaacataatccaaacacagccatgcgctttcaggtgccactggatcgcaatgcttgcgatatacatgtttgagcctagatattattattattctttctaaaaaaaacttggacaacagttgatagtgtgatggcgcaaaaaagaaagtaaaatcatttacatgcacctagcaacaccaaggtatacttgcccacttggttggttgagaattgcgtatgccaaaggtctagagtttaactccctccataataagcaacacttttttaccatatatttgttcactgtttcagcattcataacattgtgttacttttgttcactgtttcagcattcataacattgtgttactacaggcgacagcaacatatatgtaggtgttactatacagttcaagtataacataactcgtatgttttataacacacagcttgtgttgctattgaactatcttgtaacatatgtcttaaagtgttacaaatttatattgaactatcttgtaacatatgtcttaaagtgttacaaattatgttacaatatgtaagttctgtaaaatgggtgcacgatgtcattccagaaacaccttatgccataactgaaaatttcatgaacaaattattcaatgagtataataaagattacattacccatggtgagtttgaattattcaatgagtataataaagattacattacccatggtaagtttaatatagattacattatcatggtgatgatccttgtctgctctcagatggtactgatacatatgcccttgttaactaatatatagtcatatttcctccaaaagtatatatagtccgatcataaatggtatggacattatcatgccgaaaaccaccctttaacaacaaaaatgacaaaagataacaattttaagacatattattgatttggttataaataattaactctgataattaaatctaccagtagaaacttacgccgtacttaggacgtctgcatgcaatccatattccaaatataaaggatgaaataaactgaggtattgcagcatacactcatttcatgagaaaaataaaaaatatgaagaaaaagttaaacaattgatcacaatatatcttgttttcaaaaagaaaacagtgacaaaaaaataactgattataattaaaaagatcaatgaattaattaattacactcatttagtttttaaacttcataacacttgcaaatttcactcgtaaactagtagcagttaattgtgtgtacttgtatgatggctactcggaggacatcaccacggatgccaacggcggcggatcctatggccatggcagtgggcccgattatgaactttagaaaaaggcccagaagtgcaagtcttcttgctggcccatgaataatccttaggaaaaatgaaagaaaagaataagctggtttagtacttttaatgtaaatgtgcatttttttcttggcatactgtggacagagatatattataacccttacatacatatagactaaatgacataccactatatgtttagaagtgcatgtgtgcaaacctacccatattgaacatagccagccccagccctgatcttgacattattagcaccgacccctccaaagctggtggcaaagtgaggtgcgacctgcaaaaatattaggcacagttgtatatattagtacatatagattaattatattaatgagcatgtacttatggggatacttattactcatttacctattggagatgcaagcctaggagatgccgattacactagcatatagactaggattacaggctaacttacgtgccaccgacttgaagagcggtaacctggcaccattcaccactgccactgacactgcctcctcccccctgagatcttggttcgtggcatctgaaaccccctcttcgaggctttgcatatcttcgctggtacccgagctaccgacgaccgtatcatcatctatgaaggatccttcttcataactgttagactcgtcatgagcgtcggagacgaaagctttccttacttccaggaccaccacgagtgaggtgagccacactattgcctggaagattgatagttgtaccacaatttgccctgcccagttgccatacatggccctcgccatgggcatgcccacaaccaaagaattggtgagtgacgcaagagaaaagccgcttatacaccagtcggtgacagcggcgcataatccctctttccggaatttcaacataacaccaatgctgattgcggcgactataattaactttgctatgctatcagccgctataaggctgcacctcacattgtagggatcaaggtggagggtaaattcaaaggtgaaaaatggaaaagcaaaccaaacgaccattctatttattgcttcggaatcttctgccgtgaagatttgccaccatcgcctggaagagcagtaccccaatgcaagggcgaaataaagcagtgttatcgcggacaatatttttccaatgtccacccaccctatcatcttgaaattggtgaaaaaaaagatgaacaacactaatacttcctgagaatgtttaggtcgacgagtgaacactgatatctcatgacgactcgatatcatatatatagtgaagactgatatctcatggagatattgttgagatcatgccgttatgagtttgttaagcatgcgcgagccaaatgcggtgagctgatgatggcgaccgcgaaaaaccaaattgtgggattcgttttcttcctaatcacccaaacttaaggatctaaccaaattgtgggattcgctttcttcctaatcaccccaacttaaggatctaattgttgagatcatgccattacgaatttattaagcatgcgcaagccacatgcaacaagctgatgatggcgaccgcggaagcgactgtgaaaaccaaatcaaaccaaatcgtgtttctcttgcagaatgtagcgtgtagtttaggaaaaactgtatttgggatggcagcttagagcatcatcaaaagcatcctaaaattctatccccaacatttcagttatggtaattctaaacaagatttgaggtgttaaaatttttattcctgcaacagattagctataattgatttcctaaaaacaaaaagactgagcccttagaaaacttccaacagaaattagtttccactcgtcgctctcacgagatcacgctctcgcacgtgccccttcgtcgcccctctccacgcagtaccatgccggcagatcaacctgactggtacacgtgcacccccagttttctacatgtacaccagcaattctagcaggcaacaaagcaccaactagcagcaagcaatttttgatcaaaatccccggaataccacacagggaatgatatcaagatgctgttggtgatgctcttaggtatcacattctagtttttttttctctttttatttttagctgtgttaccaaccttacgtgtgacccccaggcagtatggaagttcaggcatttttgttcttttaggcttgcagttttttttctttcccatattttccacacaaaaaaaaaatctcattttatttagaatgattttttaatgttttcttttctggtatgtaggttgataattgtccgtgctgtaaaatgggtgcacgatatcattcaagatgcaccttatgccatgactgaagatttcatgaacaaactattcaatgagtataatatagattacattatccatggtgataatccttgtctgctcctagatgataccgatgcatatgtccttgtcaactagatatataatcatatttcctccaaaagtatatgaccttatcaaccaaatatataatcacatttcctccaaaagtatatgtccttgtcaaccagatatataatcatatttcctccaaaagtatatatagtcccaccatgaatggtagggacattatcatgcccaaaaacaccctttaacaacaaagacaacgacaaaagataacagttttaagatatattattaatatggtcatatataattaactctgataattaagtctaatagtagaaacttacgctgtactcaggacgtctgcatgcaatccatattccttggcaaatatgaaggatgaaatagactgaggtattgcagcctgcactcatttcatgagaaaaattaaaaaatatgaagaaaaagttaaacaattgatcacaatatatcttgttttcaaaaagaaaacagtgacaaaaaataactgattataataaaaaagatcaatgaatgaattgattacactcatttagtttttagacttcagaacacttgcaaatttcactcataaactgtcataatccacaagtttggatgtatggaaaacttggaaatggtcacattgctgccatggatggcaatgaggtgcatatttatacatgaataatgcctactttgatgcccatatactaagtactagcttgctgaaaaaaaattatttgaaagcaaatctgatttgaaagcgttttatgcaaataaaacttgccttatgctaaaaagaaccatatatgccttccttggatatatgccatgcatgtagtgtgttaggattgccttgtgcttgctagtacattatttttgtaatgtactgactcttgcatttgttgttgtattgttgttatttagagatggttgcaggtgaagtcactccggaggaggatgacttctttggtgatgattcgttcttccaggatggttcttgctaaggtctaccctagtcagttgcataaaagatcttttaggtagaaaatgcttccgcaaacttaagtatttggccggtcggccataagtatcttagtactaagcccttgtttagattccaacttttttctttaaactttcaacttttctgtcacattgaactttcttacacacacaaactttcaacttttttctttaaacttccaatttttttcaaacttccaattttggcgtggaactaaacacagcctaagttgtgagaatttatctaagtcccagaaccctctatatttggatatcaagtgcttggatgaaaatgtttaatatgttccttatgttaggaaaatattaaacatgactatcagttaaagatatttgacaagtcgtatatctttagccatttatcaagtctcctgaatgtgtaacatatcttgtcgctaccttcgtatggtttgacgggcacatctcagactgaagttgactgacaggctaaaggaccagcaatatctctaatatccttctctcgaagcgtcggatgtcttattatgcttgatgggtgaattgaaccattctattcaactatcaaacataataagaggtccggagtgcttttgacataaactagtactccagtagttaattgtgtgtacttgtatgatggctactcggagggcatcatcatggatggcaacgacggcggatcctatggccatggcagcgggcccgattatgaacttcagaaaaaggcccagaagtgtaagtcttggtccacactacataatcctttcttgctggcccatgaataatccttaggaaaaatgaaagaaaagaataagctggtttagtacttttaatgtaaacgtgcattttttttcttgacatactgtggacagagatatattatagcccttacatacatatagactaaatgacatactgctatatgtttagaagtgcatgtgtgcaaacctacccatactgaacatagccagccccagccctgatcttgacattatttgcaccgacccctccaaagctggtggcaaagtgaggtgcgacctgctataatattaggcacagatgtatatattagtacatatagattaattatatttatgagcatgtacgtacggggatacttattactcgtttacctattggagatgcaagcccaggagatgccgattacactggcgtgtagattgggattacaggctaacttgcgtgccaccgacttgaagagcggtaacctagcaccattcacccctgccactgtcactgcctcctcccccttgagatcttggttcgtggcatctgaaaccccctcttcgaggctttgcatatcttcgctggtacccgagccaccgacaaccgtatcatcatctatgtaggacccttcttcatgtctattagactcgtcatgagcgtcggagacgaaagctttccttacttccaggaccaccatgagtgaggtgagccacactattgcctggaagattgatagttgtaccacgacttgccctgcccagttgccatacatggccctcgccatgggcacgcccacaaccagagaattggtgagtgacgcaagagaaaagccgcttatacaccagtcgatgacagcggtgcataatccctctttccggaatattaacccaacaccaatgccgattacgatgactataattaacttcgatatgctatcagctgctataaggctgtacctcacattgtagggatcaaggtggagcgtaaattcaaaggtgaaaaagggaagagcaaaccaagcgaccattattgcttcggaatcttctgccgtgaagattcgccaccaccgcttggaagagcagtaccccaatacaagggcgaaatagagcggtgctatcgcggacaagatttttccaatgtccacccaccctatcatcttgaaattggcgaaaaaaagatgaacaggattaatagatcctgagaatatccagatcgatctaaaaggtactgtattaatgatatacttactacatagagtcgatagatgaacaccgatatctcatggagataatcccctcaaaataaaaagtcacacctcacacctcatacctttctcctcctccaaataagaactcccacctcatgcctttcttattctcctaaacttatgggatctaattgtggagatcatgccgttacgagtttgttaagcatgtgcgagccacatgcgacgagctgatgatggcgactgcgaaaaatcagatcgtgggattcgttttctgttacggaatgtgtagcatggagtctaggaaaaaccggatcttgggatgacagtgtaggtatggcattctagtttttttttctctttctatttttagctatgttaccaaccttacgtgtgaccctaggccgtatggaatttcagccatttttgtcctttttaggcttgcagttttgtttctttcaatgtattatataatattatcatatatccatattttccactccaaaacaaaatcccattttctttagaatgatttttttaagaccaactcatggaatctatctctgtcatttctatattattaaccatgtttataaacaattttacagttgatcaggccatcaaaggatccctctttgcatgcatgcacaactgaactgaactgaacaaaaataagataaaatgcaggtcagctttagtttgtcctgtggctaagcatgcacctcataactcacaaaattggagggcctaaaagcctccagcgaagagctttttggcgtgggatcgatcagactagttaattagctatgttgacatgtagctaacttgctatgcatgcatctagggatgatttatctacaataatcgctgacaatctgtctgatcggcttgagagatggattcccacatgtttaatcacgaggtaactactggttccttttttttttataggagtagaaaagcttaaaatcactcccttcaataacaagtgacgcttttatattgatacggtttctaaaatgcaacttgatttgcatacaactaactaggtgagccgcgcaattgcgcagctagcatccatacaaaattattttttttacatatgattttgcttaaaattagttaaatagctatataattgtcttaggactttgaaaaaccgaaccttatcatctgcattttctaattttatagtttttgaaagtcacactaggcgctacctcgtacttatttgttacccttttatttatttgctcgatctactacggtttctattcatcctccttgcaacttttaaaattggatcttataaattctagagtttattgctcgatctactacggtttctattcatcctccgtcaaacgccgtcactcgactcccctaagccgtccatcgcctactctttttattttcattgggatttttaaaatcgaacataattatcatctgtgtacattttaactttctagaagtcccggcaaaccatccgtagctttgttattgtactcctctatgacccatccgttgccttctctcttaattattagtgagattttaaaaatcgaacatgattatcattttggtttaatttttactttccaaaagtcttgccaaacaccgtgattgtgctgcttaacagcttgcctgtcatcccttctcttaatcatcactgggattctatttgattttttttaaatttaaccactataattttgacatgctatcatctaacaattattttttagtaatatttaaattcaataatatgataaatagatactacttgaacactttggaagtcatatcaaaatccaatttggggatgtattttatttttaattttatttttaataaatatttttaataagtagatggactctgcttctaatattctttatttttaattctgaattttagtaatttctaaattgcattcctacctgaactctttcgaattcgtagaattcatattgaaatcaaaatttgggatttattttattcataattctaaaatttaattaatcctatgttgtgttctaaatgcactctcttccaatattttttaatttagaattttagtaaattctaaattgttttcctacttgaactctttgaaaatcgtattgaaatctaaatttgggatttattttttaaattttaaattttaattattttgtctttgtttctagatgaactcttttttcaatactacttatttttaattctgaattttattaatatttaaattgtattcttactttaacttttatttttatttttctcaaacttattttttaatttcgtttgataatatactcagtaaggggcaggtgtggactgcatggatgtcatgtgcggttgattgcgcattagacatactccaatcaaacagttgatatttttttttatttttctctaattaacgtggtaatttcttaaaggtttagacatcatagcaaaactgataagctcctatgcggtatacaggagccgggtttgatattttttaggtgcatgtatgttagttttttttacgatctagattatatttccaatttgccgtgctagtcatcaatctatcaaaaaaatgtatgacatttaattttctccaggagtgctaggctagctatttacgaatgcatatggcagtgtatagacatggaggcatgcactatttatttttcttagtactctacttttcctttttttttcttcgatggttaatcggatctactctacagttcaatcactcattctttcattgctcagggaacggaaattgtgtcgtgtattcgtatttctcgtcaagtgagtcgagactgcggctgcatcctggagactgggacggaaatcagcaacagctagcagcacgagccacgctcacgtgtggaggcagcagtagcttagttgggagcttttctcgatgaaagaaagaaatgaaacaagaaatagaggaataagatcccaattttctagcatccatccaggaacaagaccccaattttctagcatccatctatcactgttaaataaaacataggtagtttgctaaatttcatgtatttgatggactatgagatattaaagttggatgcagaatcatatagcgtgcaactctttttcgatatcatattattactttgtagttttttcgctatatattccatgtttgtaacatgaacattgatctattatatataactttgatctattataagtgcaatctcgaatgacaaggattttagccctcgcagcctcgcaatgcctcattttttgtccgtcctctgccactgtccttgcccaaatcggcgccaccgcccctgccaccggaagccttttcatctctaggtcgctgccgacgccttccacgccgagctgctcctcgccgccaccgatccctgccgccgacaccttccacgccgagctgctcctcgccgccatcgatccctgccgccgacaccttccacgccgagctgctcctcgccgccaccgatcccgccaccggaatcccttttgttgctaggtcaccaccgccgccttccgcgccgatctgctccccgccgccaccgatccccattgccgccatcacgctctcaccatgcctctactttacgctccacatctcatagcacaggtaatgtggctcttcttgaagcagtggcattgttctgttcttttgtttttttgaccgttttgggtatattacatctaatttgtccactgggttcagtaaaagtgtaaaacacaaagcagaaggattctctatatccagttcataattgggaagaatgtcatctgatagtatataagtgaataattttccatgtaatacctagattggcttatcatctgttgattccctggagagctaatcaacccattgaattgttttgccacttaccaactatacctgattaaatcagtagtcaaaccttttacttgttttcaaattcaaactttttacattttgatttgatatttctctattaaatctgaattgcactggttctcattgcttgtttctctcagtcatgatccatgtttcatgtgtagttaccaacacttcttgcttccatgctatcactaggagaaagaatgataatgtggttatgcacagttctcatttagcaaaatcacaccaagatagagaatggtactgtggttattaacacatttgaagatccatctgttatagcttgtttgtgaatgttggggcttttttttttctcgatgttctgttctcttttctgccagaaaatatgcaaaccaatatgttaattcatttgcctgtttgcgtttaaatgttgtgtcttgattctgatgtttaatccaatgtcgtaaaatcactgccaaattaataatcaaaatatagctatgcattgtggtgaagtcatgctcacgatgagatagagctcagctgctaattttagtcactaattttggtaaaataaactatgccggggatatctttgaatgtgaggctactaaaatttcatgatgatatactccacttaaaatatgtttatttgggttggaaaatcaggacttgacaacaatttcttctgttccttttactggtcattttactgggctgaatatataagatggaattgcttagtggttattggtatttaacctgaaatggatgccttgagatgatcacagatggcggtcttgtaggttatccattgccctgtgatatgcatagatgtcaccgtgaaaggaatggagcaattcttagattaattatatggagtcttagcttcagtcatacatggtagatgcattcctgtcttaaatacattagaattggcatatagagcatcaacaggcatcaaagaggcctatgaaagttctttcaattcaagtacgaataaatagtatattataaagactaaaacttatttggaaccagcacagaatactattgtttgtaactttcctttggaataaagtatggctcatacagatcaataattcatctttccatcagtggcgcttgtcctttggaaagaattgctgataattcgatggaacgtattgatcttaagacaatcaggggtcataatattgtttctaactttatgtcaattgagaaaatgaatgcatcgggcagcacaagtgctgatatataatagatatgtgcatacacatgcttttacacattaattttcatgttgttgctaaatatacattgatgtgtgcattcctgataggttgatgggaacattataaggaggtgctaaaagtcatggactgcaagttatcttctaccctatagttcaacaaatggttttactcattcatcgtgtgacacatccaacggtctaaaattatctaatgaatctggatccaacgtcccagatccgcgtgtgtcccgcgcctccctgtcgaccgcaatcgccacaccacctcccccgcatctgcgcctctcccgcatcatccttctctcacgcaccttcctttctcccgcaaccgccgcacccccaccacacatcgcctccaccaccctcatcagctccacaaatcatgccgccgtcgccgtcccgctcatcgcgccgaaccgcgctggagtcaccgtcggcgtccccgttcccgcccctccgcccatctcatcgatccacgccgccagagtcgctgtctccgcccccgatccacgcctgtgcgcccctcagatcaccgtcggccggagtcgccgggctcgtcgtcgcaagctgatcccctccgccattgataggaggtccagaaaacctccttccttaccagattgaatttaatctctttttgagttaagcaagagcattggttttttcctccatcagtttgattcttgcaagttctggagactgatacaattatgtaaaaattgaggtggcatggaattcaaagccatgtgtagaagttagaaataatacttctgctcatacacaccaatcctttgctctactggagactcaagtgcaatattgaatccatcaagagcataacaaaatcaaataatagagaggattgtaacagattaccccatcaagttggtgaaataaaggagcaattaggataaccaatagatcagctaatggaacacataatgaacagaaattccttagacctttgttgtcgaagtgacaactgcatacgtcgaaggatgtggttgctcaagggttcttggaaacaacgaagtgtactaatttaaggatttttcttttgaatgcccctttacatggccctaggggtctatttatagttctattacagatccccctattagggtttaggttttacaggggaatttacatggttgccctcatgagagggacacttgtatgggcatacaatgtaattgaaatatatgggcctccaatgggccggttggcgaatgttggcccactggccaatgggatagagcggctgggatggccccttgggcctccttggagctgggcttgataccgcgaagtcatcctccttcggcaagcacccttcaccatttagccttcgcctaggacgcatttggacttgcagggtcccaacgcgactcttcacccttcgccgcctttgcccccatagtcttcgccatggggcttcgccccgacgaaccttgacgccttgagtctgaatcctcgctggttgcatggtttcggcaggtctggtcgaagggtctcatgacataccgccaacaagcccctcacaggcaagggtgagataggagcttcggccgagaccatgcaaaccatgtggtatggtatgaggcgccccctttcgaccgacgctcctgccgaaacctattttgggttcctgcaaagaatgtgtgcattgcgtgtacatgtattcttgcggttagtaatgttttgcagcttttgccttctgcgaacggcgaagctgtccttattctttcactggaccgaaatgaacagtgatgggctttccttcgtgggcttgtccctatgcggctcggttaatgggaatttaccgtttcgcctacccttatgacgcgtggcggctcatgattgggtgggaaggcgaaccgttgcctgggtgggctatatattcccccttcccctttttcaccgccgcaccctcgtcattttcaccgcgagcgctctctctttctctgtacttccctttcacggcgccttttgagtcattaggtctttcgcccgttctcccttttcaccaccgcgcacacttttcgccatggctcctcgcaagccgaacccaacctccgcgacgggccccgatcccggccggatcgacgatgacaccaccgcctttttaggagcttagctcgtggacgatgacgagctggtgaagttggtcagctccggcgcagtggtggaggggcaggccttcgctccgggaaaggccgtggtgccgaaacccggcgaaaaccggacggtggtattcgtcatcttctttgaggaggggcttcgatttccgttcaacatgttgtttccggagatccttcgccttttccaggtggagctcccccagctaagcccatcggcactcgtccgtatcgccatcttcgactgggcgtgccggatcgccgggtttgatccgagcgccgatcttttcggcaccatgttctacgccacagtgaactcgaagacggtggtcactccggccgggacgaagaaaacgacgttcgggagtgtgaactttaatgttcgccccgagcgctccgatatctggccggtgaatgccgccatgtcaaagtaggatcgcaattgggtggcgaagtggttctacctctccatccccttcgaggctgggtccgatgcggcgaaagccctccggaggcggcgtagggtgattgcaccgaacaggaagcccaaggtcgccgtcgatggcgccatggaagcccggttcgccttgctgcacaaggtctgctcccgccttagctgtcgcgacttggtggaggagttctgcatgcttcgcatttccccctctcccagtcgtggcaagtcgaggtcgatggcttgccgaagctcgtcatgcctgcgggggcgaacggtgagtctatgcttttcctatgtgcatctatgtttcgctctttttccccgttcgacgcctgatgtggtgacacttcttgttttcgtagtgttgactcttgctcaggccgacaccgaagcccgaaagttgatcggcgacgtgtcggtcgctgagttcagccagctgctatcgcggcaggcggcaagacgggcaaaccggtgtaggatcgagatgtcaactagaaggggggtgaataggcgatataaaactaaatgacacctaatcaaaactaacctaagttgctaggcacgtgaggatcaactctaagcaactaagttatgttttgcaaacgtagggtgatagtggctcaaatatatctctaggaaagtaaatcacactcctatgtcaatgtttagcaatcatagggtgatatgatctcaagtatctctctagaaatgtaaattgtacaaatgtaaatgcgacaatcaaatgagacaaggagacaagagatttttcaccgaggttcggaaactcgccggtttcctactccccgttgaggcgagcccaactccaccgctcaaccacaaagccaccgcacgcccccttcgtcaaggggtgggcaaggcgggagccggcccacggagaggactacccaagcctcgatcactcggggtagttcttccttcactccgaaggtggtgaactccaaaccactcacaaaacggcgccgggcctcctccacaatcttctcggagaggtcaccgggcaacccctccacaagccgtctaggaggcggcaacctccaagagtaacaagcaatgacccggcgtggagataatcaatcaagtgccgcactagctctacaaatggaagcaatgcacttgactcttggctaatcaaccctctaacacactagatggatgaacacaaagctcaagtgagtgtgagagaggtgcaaggggtgtatgcaattgaattgggtgccaagagagcccccttgctgctggtgggggagtatttatactcccaccctccaaaactagccgttgggggcgaaatcccccaactctgtgctctgtcggtctgaccggaggtatgtggccggtcagactgtgctactctgcaacggctagaaaactagccgttgtagtgctgtcagagggccccatcggcccggccggtaagaccggcgttgagtgggcggtcagaccggcctcggctcggtctgaccgaatacggctccgtcggctctgtatcggccaccctgagcagcaccatcccggcctctagggggccggtctgaccgcgcatgtgccgccgatcagaccggccatatgggccggtcagaccgcccgcttggagccggtcagaccgccactatgtggccggtctgaccgcccctggtcaggccgaacccagtgaaaggcaaagtgtgtgtgtgaagaaaatgtgagcacaagtctaaatgcataatgacctaatgtggcaattaaaatcatctctttgctaggtcactacccctcttaataatacggcgaaactaaaaataaacttgcaaatttgatcgccctacacctcgatcaattctaaattaaagcgctagttttaccgtcttctttccctttgctttgcgccgtcaattttaatccatcgataatcatccatgcacacatatgacgtggacctaacttaaaatatatagctcaaagacaatggttagtccacaattagcgcttgtcattaattaccaaaattaacaccgggggcctagatgcttcaatctccctctttttggtaattgatgacaaacaccacaaatatatatataatcaaacatagagcacatggacatatattgcattgacaagcaaaagctccccctaaacatatgcataacaatcacaaatagcaaatatggagccaatgcacatttcaatttcacatttcaacatatcacaaacacaagagcaatatctcaatgtgaacttcaagaaatattcattcatgagcataagatggtcacaaatatatcaatatcacatacaccatctatcatcgcacaagttcacatctcttaaccattcaaatcacataagtcacaaatcattctaaaagggctcacaaataaatataggctattacaagactacgaagggtccaaatgacatagagatcaacaaaatgaaaaggaacatacaatatagagtaatagcccatacccatacataatatagcccaaacctccttaacctattagatatgaggtgactaacctcactaccactagtcccaacccacaagacaaaaagcacacctaatgacatttttctcccccttttggcatcaactaccaaaaaggtcttcattcttgtggaggagaaggaggacgcgccgaagtggaaggatgatgagcatcacgacgacgatgatacacaaatgcttgggagctctccaacatttggactcgagaatccaatgtacccactcgagtgtgcaatctccccatggaagcattcaagtctccaacatcggtgcgcaagccacgaacatcctcatgcaaagcttcatgcccggtagacaagtgttgaatgcttttacttagggtattaatagccccaagtaccgggttgaagtattcgatgggttgcattccaaaataagcatactgtggatggaagaaagcatttggatcgtacccatggggaggaggaggtgctgagcttgagctagctccaggatgagaggagggcgccgccctaggagcacggggagctccaagctgaaggcggggcttgtactgcttgtgcttcttcaaatttggctcggcagccccaagcttatcttgaatcaacctcatgatgtaaggggcataatagattccctgagagaaagtccccttggagatggcaatctcttgcatcataagagacacaatgtcgaactgacgaccctgaatgattgcatccatgacgtgccaagccactcccctaatgtcatcattgtttccaaggcgagggaggatagtggctctcataatcctgttgaccacactggggatagtcctcaagccgacaaccttcccatgagtgtaccgtgctccatcttcataaaactgagagagatagtctatggagagcgaattatgggtgtgctcctcatgcaagtcatctccaaagtccaagcgaatattgaggagccgccggaattgcctcctagagatagaacactggagggtgtcggacatccacttcatctcactatagtctccagccacccacactgtagcataaaactgccggatcaaatcttcattgtagtcttgctttagggtcacaatccggtcaatgccaatagtcttgaagagatcctgtaagctctcaaactctggagtctcattgatgtctctccaagaaatccacttatgctatgcaaaagccttcccagcataaacctgctcatacacactttttaggaaagcggtgtgaaaacggggatccggggtgtcccgaggcctcaaaactgatcatgatgcctcaagatggtatactgcgatggattccttatgtttacaacaaattggatgaagggatcaatgtgcatatcatcacttccttcattctcatcctctccacttccactgtcatcatcaccacacgaagccaatacacgccatttagccttcgcccaggacgcatttggacttgcggggtcccaacacgactcttcacccttcgccgccttcgcccccatagtcttcgccatggggcttcgccccgacgaaccttgacgccttgagtctgaatcctcgctggttgcatggtttcggcaggtctggtcgaagggtctcatgacataccgccaacaaccttattagaactactatctttgactggaacacctgaacacatgtgtcattagtttcaaccagcgaagtaagctttagttggaaaccttggagcttgtgatatcaatctaaaagaccattgagctaaatatacacagatctagatttgatttggcaccaactggtataaaaccttatccttagagtccatgtatgaagaaaccacacttcatttttggtgaagccacaaataaaccctgaagacacaatattatggtattagtacaatgcccatttacaaaaattgaacgaacgaatgatgcattacaagcaaaattcatcctctatttccaattgttattattatttttgggctttgattcactcttagtagagaaataagagatgcaatagcaccgcctggtcattatttgagaagaatgagagacatgtaaattgtccatcctttttttgtacttatagtaacaaatcaatatacaggtttcatgtcattgaccaatggcaaaaaaaaaaagatcctataagacagatgtttgaataatccaattatatgtttagcaagcatgctaaggaaccattaacctagcttatatggccggaatgcaactctatacatatggatctacccactgagtcaaatgtggtcaaggaataaaaatgtaggaagaactcggaagagatgtcgctgctgtgttgatagtaaacatatgggtctgcccactgagtcaattcttctgttatgtgatttaggtaaaggtaagtgaggaaattatgctaagacatctctcccctgtatggctgtatggttgatttgtttttaaaggcagtctgacagtaattgtacatttgtactgtcataaactcataacccatatttgtttcattttgatgtgccattgcaaaaaaaattgtgtattacaagagagaggatatgcatgtaacgagaaaccacgaaatgttgtatcttcttgctatcaaccaattgtcagtacttttttttttttgaagatgggtggacaaaactaccaaactatatgggctcgacatgaaagttcttcgttttctccctgtttttttcctttctttctaagggttctggcttctgggatgatgaccatctagagtggtcaaatggtcagttaattgtcagtgcatatttcttcgtttcgctttactgttatcttattcttcttgtcaatgtcacaagaactaacagatcaaagctaagaaggaacagattaagggtcccatgcaatggtctcactctgtttttcttataaaccttgaaagttggattttgtgttctctaggtggtgtaaacctgtatatgctatgaaacttggatcattttatttttatgactttggaagccacatgctccatcgaaaatctgcacagcagcaggtattctcttgggcttttgaatgtattggtctcagagctatttgaatttaaattttatctttcttagctcatttgatattggaaatgttaatctcccatggaaattttctacagtgcacctttgtaatagcataaaggaatcttttgttatttaagtataattaagtcctaataagaatcttgtaaaattatattttttgtgaatcatgaccgttccatgtaattgggcagttgattttggtctttacaacagccgtagagtatgaattatacaggagacgatctgtttccgctctctgctaagttgaaatataaacttttacacctttgtaagtctgattttttgtcttatttctgtataggttcagttttgttactaagaattatagacctgtactaggccgtatggaatggttttgcattcatcataatatccttgatgtgcagttgtctagattctattgataaatggccttcaaatggcgtattgaccttgaattgtcgctttcatcataatatccatgcaatggagtattggctgagtaatctctctactcttaatagattttttttttctctttgctcttcacagctttttgcatccttgtattacctgtatgactctttttaaattaaaattcattatggctttattgtttcagtcctgtggttgaagatcaataatgttagcctactctttatttccatccccagtagtatcagtgcttgaagtgtgtccatctccgtatatattttcttgtcagtagaattaccgaattacatcaaacattatatattgttaagaattatgtgcaccattattcataaccatcatatcattctatgcttaaaaatatatcttcttttggttatttgatttttattatcaaatattgccatagcgtttagcacgggtatattactagtaccaattagtacaacaacatggctctgtgtccgtactccaagcaattatatgtagctatttatggtaactctccactgttaaaatcagatcctccatgtaatcaatgtatattttacacatataattattgttagtttttatatatggttataattataggaaactattcgtaaaaaataatatggtagacggtataaaacctataaaccttatattttacgatttaagtatagaattaacactaaattatacttgccaaataatctaggtatatggatagggcgaatatatatagggcaaataatctaaattatatatatatatatatatatatatatatagtaaatttgtttggtgctccatggtgcccgggcaccattgttgaaattgagtatatacctaattcatgaaactttttcaattacttagatattaacattagctactttactaactagttcaaagcaagtttgaactgaatttgaacttgtttttggtagattttgattctaggtatatagcatctatacatataattagttaggtatgtaatcatggattgtgaaataaagttaaatttgagttgttttgttgataggtataggtatgaatcgagttattataactaggtatatactcacaatttgaaaattttgaaaaatttgtgtgattttgtatatttgataccatggtgcccgggcaccatggtgccccatatgagtgtcctatatatatatatatatatatatatatatatatatatatataccgcacncagggtgcgtaataactaaaatatcccctcacaacctaccccaccatcgcacccaccttccctcacaacttacttccaccatcgcacccaccttcggtaaccaacacccccacgtttcctttttttttcccacagtcggtaacctccgtctcccttttctttttcaccagctcttctgttttttttttctttcctcgtgtagccatgagtaaataaattactaatgggtaatttcgcaccaaacattctgttagtaaatgaattatttttttttgaccatgctgaagcctcggtcggtaaatcaattactcgtgcatatattgtttgattagttccatatattgttagtaaattttgtattgccatgtatccagccattagaatttttccacggacacttattattgcatagtaaatgttttcctgtaaggcaatacgagaatagtaattcttttacaaacaagcctacacggcatgatggtgtgagtaaacaatttactcgatgacaatattacatagaactagggtttggggcttgatggtgtgagtaaacaatttactcgatgacaatattacatagaactagggtttggggcggtggttggtggcgaagatggccggccatggttgcggacatcgatggcagtgcgtcatacaggtggccaccgatgctcatcagatagatatagcgtgtatcggctaatactccgataccactctatattaagatattaaagaaagtaaaatatatcaaacatagagcttaatacacctaaatgcaataggatcttaacataaaaggcagatttagcataacaattgagcatataagacataaagctaaatcaggtaagatcggctgaaaccccgatgctactctaatcagcaaccaagaagcaggctagagactatagttctaaacacgacttatgaggtcaaactcaactgatgcagccataagtatgaaaaaaaagacaatatctagacaatcaaactattggaagcttcatagagtggtagatatcctatataatataagccaacatcgatatttaacctaatcggctgcttcctaatgatagatattagccgattggaggttagataacgatattgccggagattatataagatacatgataactcgacaacttacataaacaagattagagtatcataaagatggaagcactaatcctgagaacgcaagccgccataacaagttttacctctacttgaagatcgaaaccgatgcagctcaacctgaaagcaagaactcgtcgaaacaaaacgaaagtaaaagggtggcgatgcgccgagattgttgttgaacgtctgttgttgtattacatggggctcggggtctatttatacccgagattacacaatatgtccttgtcggacatgactcttatctctaataaactctaacataccataagtcattgcggcagacttttgcccacacttatctctaaggaaattacataaaatatcctaattaatagatacaattgcctattcaggactcagtccaagtgtggcaatccatgcgaagcacattaattctatccgatgacgtagagttgtattgtcgggatcggctcaatcggctaaccctgtctgactcgaactctgccgatcctggtcgtagccgatttggactccagccgattcttgctctgtttctgaaacaatcttgatcttggattccgcttcaatctaatctttatctccgatacttagattaccaaatttggtcgttaacacatgccccccaagtccggaatatttggtaatgtttcggatttgccatatccgtctccgagagaaactcgcacttgccgttttccgaccgttacacagtgctttaaatattaaccgctacccccgagaaatttcacaccgtcacttccgttttcaccgcttaagcaaacctcgtcttctctttctccggcgatcccctcggtgcacacggcgatttcaaggcgatcttctcctggccaagcttccgctcgcggcgatgtcgacttccgccagcccgtctgccgcgccatcggccgagtacgcagaggtacgtgctcactggctagatcctcttttttcgcaatagattgtttcttccttgcctcaccttgttttcttcttctctatccttgtttacatctgtagcacttgtccaatctagtcgcgattccaagtttgtctcatgagcatcactatttccttggtccgattggcaaccctgaccctactgagtttatcatagctgaaaccaataggattccttttagattggccaacccgaatctaggtcattggaagaataccttcaagtcttggcctgctcttgagaaaacttctcccgagaaaaactggtctgtgtggtaatagtgggtatcggctagcaaacaagcccactgggatgaaattggaatcggccaagcactagcccttaccatagcaaattcgactaaggatgagcccttgatagccgctgcaacatatttttggtcgaatgcccttaatgctttcctcttcaaccaagggccaatgacaccaactttgctaaatatcacaatgattactggcttggatgtgacttcatcggctaataccatgagcttgaacaccaaaaatacctttgaattcaagaccaagagtattggaggctggttagggtatattgtagcatatatgggcaaaggacatgtcactccccgagagcatgtagcctttctgctgatgtggctggagaaatttctcttttgtggatcaagctgcggccctacaactaactggcaatttctagccgaagccctagaaataaagagacaattccccttgggcaaaatcctcctcggctatctgtaccaaatgttgaacaatgcatcagccaagatagctgtcggctcagtggttggagcaggtggtccatggtggctgctacaaacttggctgaatttagtagccatgaaagctgttaattggccatctgtggcagaagctgagttccccagattagagtcgattacagatgatgatggggtagagcgaacccaccgtaggtgcatgtcttatggagaatatgcattcacaccagctgatgcaggagcaaagctatcaactgaatttctgaaggactggttcttcagcttctacgatggatttcaaaaagatgcccgagtctggttcccttatgctgactcgatggattttgagctgccatcggactttagattttaggaaatcaattctgagaaatatgatcaatctagggaaatttttactactgccgtcagcccatgcatccttctagtcgtcatccaccagggcagaaacattcaaacctcatacgaattttatcacccaatgagttctgctaggcaatttggaatgggacaaatgccgatcggcttgtactttgtagacaaaatccagtgccgaggtgatataacttcagccttaatgatggatcggctgcttaacatcccaggacctccactaggcagcatcgaaaatatagagctggcaaggttcaggagcaaggcatttgacagatggtggggtgaatggaagctgcatctgttccaccaattggcttccatgtacatgacagacctctttccagatgtcatccctcaggtaaaatccttactttgtcaatcctgtaaaataattgtcaaccgatctatattttggctaatctcttcttctgtcttgcagacaacagaatcttcccctcctcgcaaaagcaacagcggtaaggacatcgagtatgcttctggccttattccaaacagaggtggaccatctcccatggtcatcggctatcatgcccccaggacctcaagtctgcttcaagggcaactaagagaaccagctgatgctagtaaaaagagacagactaaagcatcggctgttgatacatcggctttggctccgaagaaaaaggccaagaagaagaaatccaagccaaccgatgatttgcctgccttagatccatccatagaacaagccttggatgaggaagagatcgaggaagatgtcgaccaagcggcagccgaactgagtgacttaggagaaaaaacaccatcggcttcacccaaacagactcctccgactcctactactccagctcacttttcaagggtaaataactcatcttgatcacttcttgaaaataacttacatagccgattgcttattggtcttgtgtttgcagaaaaagaaaactatcatgaagaagaaatcaacaccagcaacatctaaaccagctcatccggtaaggtgttatctgtaaaatcctttaagtttgattataaccgatgttaattaacacttgtctttttcagcctcctcctccttcacctcatgtgcagccgacaccaagtaatcgtactccatcagctgcaggcagccataacattgaagaggaagaacaaccagctgctcctgccatcccagtaagtctttcattgtcataaatcttagatcggctacataacttatttcgatatttaactgtctcaagttttctctcttgcaggtcttagccgatctattctcttttgacatcaaaaattattttgatgaagaggcag

SEQ ID NO: 81787 - DNA, 86320 bp, Oryza sativa
ggggggggttggcgcggcggcaacgcggccctcggtttcacgggtggattccgcagccaaaaaagcggtaaacggcgtgcacggccgttgggtcggtcgcctcgcctctcccacgggcgtagtactacggtagaatcgtcacggcggaacgtgacatgccgccactcatggctcgctgccggccacagttcggcgctgggagtggaggagctggatccagatgggtagccgtggctcactggctcctgtgaccgtgtactggatgagtagtacagtggagctatcgttccgcttatttcatgaataaacgaaatgacatatttacaaacgaaaaataatttataaataaaatttttatatatgtattcttaacgatctaaaaataaaagatgaaagataaattttaataaaaagacttaaaatcagttttaaatttaatattaaaaatttaaattttaagtataagtataaacgaaaaggtgaggccctaagcgtgtggagacgtgtgggtggaacggtctttttccccgtaagatatgttgtgtttttaggacacgggacccgggcaagtagccaagtagcccaccccgcggggaggagatatgctcgaccgaaagaggaggggagggggtggaaaacgggaaagcgaagaaccggggcaaagcggtaaaccaaaccatcggcaagccgcatcgccgtctcgggtcggctaagcaagctctcgttctagctgggaattggaagttggaacccgtcgtcgtcctcggcctctcgacccgtcgcgtggcgtggcgcggcgtgcccccgttcaccgcacgttctcgttctgccgatctgcctgacgccgcgatgagaaaaattaaggaaaagatcccccctttctgctgttgctgccgtggagctctcctcgcgtcgctttccgcccgctgagctgtctggattagcatggccattcctttccttccggccggccttcccccccccccccccccttcttcttttctccccctccctccctacgtagaccgtgcccatgtcactgtcacacatacgtacgtacacactcaaaagccaaattgcaatccgagaattgagaatactaaatcacggcctctctctctgtatatgatatatgcatcggctgtacgcatgtcgacatggagaaggacgattcgtggaccggttttggtccagctacgtacgcaatacattgccccgtacatacgcgccgcgcagccacgcgctgatggcgttttcatgtgaaatcacggcgtagtttgttgcccgattttacagggaaacttcacggcctcgctgagcttaactcgtcctgaattaacaaagtacaaggcggccaaccacgaggagacacgcgaaccggagcgcacgaagagaatccccggataagcggattccctttgccccagagaggacggaaaagacgccggaacagcacgcgcgacgccacgcgagagacggagcgaaccgaaactttccccacatgagtacattgacaattcggcaaccgatcgattgatcgatcacctcacccgatcgaatcgaattggggtaaaggagagcgaggaaaatatgccggaatgcgcgaaatatctctctgcccttggataggtagcagcaaaagcaggaatggatggatggatgatccgtcgggtactttggatagagcattggagctaacttgcagaggttggaagatgcatggtcgtgatcatatgatcaattgatcattcaggggaagcttaattgcgcacgctgccgacaacgggtcgaccggcagccggccggccggccgcccaatcgatcgaccggcaaccaactcgaccaatgatttgtcctgccgatatatatacacgtaattgttcggctaatcatgagctacgaacgaaccgggctgttgacgaacacatgttatatatacctacatcataattcgatgttaattgagcttaattcggtccctcaaaaataacctaagatgcttaatgcttaatccttcatggtttccattgaattagctgttccctggaaaattgaagtcggcgtggaataatatccatgatataaaggcatcgaaaggctggaccattgctcaaaaggatgaggtcgagtaccgctcaagtgactgacaggacaatgagctagtaccagaaaactagctgcaggtataacttttgaaagccgccttggctggctgtaccaatcctttaccggaagcacgacaaccaggaaaaccacatccaaccgaagatatcaacaggactgtatattactgccgcaacacgtcaccgtccgtcttgcgggcaacagagagcgtcagcgtcggtgtgtccgttccagtttgcggaccgacttgatatttcgattggctttggattgctatcccttgaccctagaatcacctttgccaagtgctcctttttcgctcataaagttccagttcaggatgatgctactagtggctttgcacttcaggagtttactacataattgtttgtggagtttagacgtggcgattgtgggtggatggccggcagctggtgtgatatcctccgtcgaacggcggcggctgtgatcgaacccggcggcgacgctgcgcttcacacgtgtgtgacgctcgccaccgcgtgtctcccggccactgagcacgagcgccagcccagcacgggacagttcagggtcgcacacgcgtcgagccgtcaaccttcgtttactcgctcccggggccgatgtccgcttccggacgacgccggtttgaccgcaccttccggcttccaggagagtcgtcgtgatgcccgcgtgcgcgttttgcagattgggccgcgtaggggacacgctgaaaactgggctgccttttttggtccaacgtgaaaggaaaaagtacatcgaaggtccctcaacttgtcaccgagataaaaaaacgtcctcgaaccataaaaccagatatcgaaggtcccttaacttaccaaaaccggtcacaagtagtcccagggcagtatttcacacggttttatcctacgtggcactggttttgtccaccgtggtgctttaaccttggtcttcgtcgctgagtcaccagcgccacgcgaagctggcgcctggcgggacggagtggggcggcggtgagcagacgcgcgggcggagtgacggcacccgaagccgacggggtggcggagccaagcggaggacgccagcctcgttgtcgtcatcttccgacatagggaggaggcgtgggagctggagccggaggaggggctccgctagaagccgctactgtagaaccaggagcacatgatcttgagctccagctccgacgccgcctcagccgcgtcagttttgccgcgcccccacgctgtcgtcgacgccacctcgtcgtccatcatatcgaacattgatgcggccgcgataatcgccttggcgctccccgacagcgactcttccggggcggccctcctcttgccccctcatgtagccacaccgccccctgcggcggcctcgactcttgcgccgccgcttcatgactcactgcatgacgccagcagggagcctgacggtgacgaggagcaggatcgctgctcccttcctcctcctctctccctcttgtctggggagggcggccagtagcggtcgacttcgtcctcgaactcgccggcggcggcgagctgttctccctgccggcggagaaggatggagaaggcagtggagcggcaccgcccgggctgctgcttcccctgccgccgccgcccgcccgcgcgccgctccgctgcacgccgcctacacgctgctcctcccccgccgcttgcgctcgccggccgtcccccgtgcagctgcttccccgcccccgcgcgcgcccgcaaccacctccgccttcgccactaaagccgccatcgtcgtcgtctacttgtcttcatccaccccaaaatgtcgtcgcacctagacgggcaccgccgagtagccaccccttttccctcaggcgccgaccgccgcgccgcggcgatgcgccggtgttgatgaaaaacacgaggcctgggtcgttaatagccggccatcacccaatcggagccgatgccgccgctggcgccccctccaattggcgccccgtccttctcctcccggcgccactcccttccctccctcctccgcctggcgccacctcgattcctcccctctgcgccgtctcccggccgcgctgccaagccgccgcgcctcgcagcctctctcctcctgcgtgcaaccgcgccgccaccaggctccctctccttgccgccaagctctcccccttccacgctgccggcccctcttccccaccgccgccgcccatcacctgcgtcgctggcgcccttcctctgctgcgcgcgtgtgacgcgtgaggaggaaaaaaaaaggcagagagagagaacggcgaagtgaagaaacagagagaaagagacaaaataaaacaagaaagaacagaaaaaggaagtggaaccccccttgactcctccccgtgaaggaaaaagtacaccaaggaagagatgtgacgtggcagtctgacacgtggggtacatgctgactcagctgccacgtaggataaaaacgggctcaaaaccaccgaatgagttattgtaaccggttttggtaagttaaggaaccttgatatctggttttgcggttcgaggacgttttttatctcggtagcaagttgagggaccttcggtgtacttttccgaacgtgaaatgggtggtatcatgatgggctgttcaatctgtcgatatttatgggctgaattaggcttacaggcttagggcaagccgaatttcgtgggctattatggcagcttttctcgtgcacaaatatggatctttatttggcccaccgcgaccccacggcataacgaaacaggcagagcccctggaaagatttcagcaatacctgttcagacgacgacgtctgctctgttgttcgatttccgtccgcatattcgtcgtgtgatcgtgtccacgcctggagttttctggcacaggccgcgctcttctcacctcagcctcaggactcaggtgatcgtgtcaacgtccggagctctcaggcgatcgtgtctcacttcacaggttgacaggtcggcgcattcgatgccgttccaaacgcagaaaatttagagaaacatctcgggacagagcggcgctcccacgcgtggaatcccgcagatgtaaaacttcgttacaatttacagtgttcgcaacatcaagaaacgacattttttcattcgaaaatgctgcaaatctgcaactggcaatctctagacaaatcctttccctttcgatgccgaagcagaattgaagtttgagaatgttcttcgtctagaccgagcagtcagtgatctgcaagcgcgaggcgttcacagatcgtctcgacgacctccctcccctgggacgcgttctgcctgaacctctccgcgcaccgccgctccaccatctcggccgcccaggccgccacggcagcgagcggcgcgcaccgaatgctcgtctcctgccggaacagcgtccactcgtcgggccgctccgggtgcgggcggtagctgcaggtctcctcgacgtgcaccagcgcccggaggttggcgttgcgggagatcacccgcatggcccgtgcgggcccgtccacggtggtgtgctcgacgcagagcaccacgtcggcggcggcgacgaggccgcggaggaggagcgggagcggcggcgcccgccccgcgatggcgcgcacggcgtcgatgcgccccgatccagcgtcgacgcggcgggacagcgtgtgcacctcgaggatgtgcgacagcggcgccgcccgcgcgtccgcgtccgtgaacttgcgccacgccgccgcggtcacccggtgccacgggtggcggtacacgtgctcctgcgtgtacgagaccaccatgccggccggccggccgccgcttgcctgtgcgcgcgcgcgtcgcgtcgcgccgagatcgagcgaggctagcgagagcgatttcgacagcaactgcagcgaaataatgggaatatgagtgtgtgtggactccggactccggaggaagagaggaatattcgagttccacggggaattaaacccattattttgggctcaatttgcttggactgcaaagctaccagacctgcagcccagcgcatctacagatgggccaaattttgacatacttcttagtgggcctaagaattcatgaattggggccggcctaaggccagcagcccagtgagtcatcacctcgcgacctaatgtctcgatccaacggcgaagatcaaaaccctaacctgcgccatcgtcgactatattaaaagcccactcctccccgcgccgccgcccttctctcgagcaagcacccaaaccctcccctctaccccgccgccgccgccgaggaaggggcaagaggaagccggcgaagatgaagaccatcctggcgtccgagacgatggagatcccggagggggtgacggtgcaggtcgccgcgaaggtggtgacggtggagggcccccgcgggaagctgacccgcaacttcaagcacctcaacctcgacttccagctgctggagggcggccgcaagctgcaggtggacgcgtggttcggcacccgccgcaccatggccgccatccgcaccgccatctcccacgtccagaacctcatcaccggcgtcaccaagggctaccgctacaagatgcgcttcgtctacgctcacttccccatcaacgcctccatcaccaactccaacaccgccatcgagatcaggaacttcttgggcgagaagaaggtaagaaacccacctttggatcacttccatttgcccgctgttcgtggatcatcctagatctcccccacagatctctcaaatctgatgcgtctttctgtatgctttgtgtttcaggtgaggaaggttgacatgctcgagggggtgaccatcttgcggtcggagaaggtgaaggacgagctcgtcctcgacggcaacgacatcgagctcgtctctcgctcagcagccctcatcaaccaggtgaatgatacgatcccgtttcttctccctatagattggagatttcctggtcttctaatactgatatgatgcaatataacctaattagtcctgatctttgcatgtgttatgtactcatgttgccatggttgtaggaattagttctctttgctccaatgatatatctaggtttgtaattgtttaacaagtcatgcctgcctgcttgtttctgttgtttgctgcttaaggttatatgttgaaactgctaaggcggcatgatgttctatgtccttagtttgatcattggcagttgtgaatgtcattatttacagtgctctacttaggttttaataaccatttcaccatctgtctgttatgtcagtactgaagttacgttaacacatttgtgacgaacaaatccatttcttgaacaaccaagatcccttttgtagttgggctaattggcattgctaagttcttggtttggaaaccatgagtggtgtcggtgctcagggtacagtttgttatccactgtctgatccctatttgaatttggcgtctgcacaacaccatgattatacatcaaacctttttgccaatgtgatttatcttctatttttcggttcgtcgagcactcttttttccatgctttcagtgaaacaagatattttatcaattatcgtgtgttttgctcttgttgatttgtttgtgcccttgttgtgttgttgatcaaaattccctttgcttgtaaacagaaatgccacgtgaagaacaaggatatcaggaagttcttggatggtatctacgtgagcgacaagggtaccatcacagaggatgcgtaaactcctatcttcacctagtatcatgaagtgctgtttcttgtctcccgtgtctgatcatcctctgagttgcaattttctgagagactgaattttgtaatggtgggttatttaggatgtaatggagcatggtatcttatcctacatattgtttctgtttgcgattatgaagtctatttatcatcccctaaagacagtttactggaagcattcgtggttagataaacagcataatgctacttaaaagtgtgagctggtatgttttcccctgcgtatgatggattgcaaactggaggagtgtttttcccctgcccttccactgttactggaagcagcggttagtttcgagacattggcttatctggacatagaggattccattgttagcatcatggatgcatgtgtgatttagagctgcaattcatttgattaccacactccgcactactgatctgacactgacgtacagaatcaacattgcgaatgctttttggggacttcctctcacattctcgctgtagagagtgcgtctagtagagggtgaaaccgtcgctgtacttaagagagagtgcgtctagtagagggtgaaaccgtcgtcgtaggagacgtggcgtccgcggcggcagggcggcgcgccctcgtcgcgctcctggcagcagctccacctccccttccagttgtctctcccggtgtttgggcgactccccctgtcgttccacctgtacacgatcaccccgctcttgtcgctccattcgccgtcgatcccctggtgcggcggcgacagcgagaacaaccccttctcccctgcaaacccgtcaaaagatagattcaagtcttatttaacagtaactagctgggtggtccgtgcaattgcgcggctagcacccaaacaaaatcatatatttttttaagtatgattttacttaaaatttattaaatagctatctcattgtcttaagattttgaaagatcaaactttatcatctccgtgtttctaattatataatttttaaaagtcacactagttgctacttcttatgtcatctccttctttatttgcttgtccgatctaccacaatttctattcattctccttggaacctttaaaaattggatcttatatttttttagagtttattgtcattttgggtttcgtttttataatttctagatgtcccgtcaaacgttgccattatactcctctacggcccgtccactgtcttctctttattgccattgagattttaaaaatcgaacataattatcgtttgggttcatttttactttctagaagtcccgccaaaccatcagcggctttgctattttactcctctaccactcggccgctgcctccctttttttttgtcattgagattttaaaatcaaacatgattatcattggtttttttttactttttaagaagttccgaacctttaaaaattggaccttatagtttttagagtttattatctggttgggtttcattttttataatttttagaagtcccatcaaacgatgtcactatgctcctctacggcccgtccgccgcctactatttattgtcattgtgattctaaaattcgaacataactatcgttggaattcattttttattttctagaagtcttgtcaaccgtcggtggctctacaactatactcctatacaccccgcccgctgcttctcctttttattgtcattgagattttaaaaatcgaatattattatcaatggggtttattttttttactttctagaagtcccggcaatcgccttgctcgtttgcttcacggcctacatgtcgtccctccttttaatcatcattaggattatatttggtgttttattaacagtttttatatgtcgtatcaatcgtcaccactctactcttttataggtctgttacttaatttatcttgtcatgtgttttagatggttttttctttcaatagtctttattttatcccaaattttagttatttataaactgtattcataattgaaatcttatttttctttttctaatttgagaatttattttttccaaattttaattaataccatattgtgttattttaatattcttattttttattttcaattttagttgtttcaaaattgtattccgaactctctgttagtttttctaattttggatattattttattttttattctgaattttaattaatgtcgtattgggttcttatatcatccttctttcaatattgcttatttttaattccgaatttcagctaattttaaattgtatttctacttgaactctttttttttctaatttcagattttatttttattttaattccgaattttaattaatctcgttttgagttcttatatgaactcttcttttaatattccttatttttaattccgtattttagctatttttaaattgcattcctacttggattatccttttcttttctaatttttgtttttattttgaattttgactaatctcgtattgggttcttatatggaaacttctttcaatattgcttatttttaattccgaatttcagctatttctaaattgtatttctacttggactcttcttttcttttctaattttagattttattttatttttattttgattttttattaatctcatattgggttcttatttggaaacttctttcaatattgcttatttttaattccgaatttcagatatttttaaattgtatttctacttggactctacttttcgttttcttcttttttctccgattaatgtggaaatttctaacccccacggcaaacgtggtgcctcctttcaaaactgttttaataatataatagatacttatatttacagctaattattatttcagtgctatataatgtatatttatataaggtcatttcgttaatttcaaaatacgtcgatctaatcatttgaagatgcttataagtgttaaaatgttgtgggcgtctatccaaaatgtcgacacacttcacactacactagcccaagatagccacgaaccggagaaagaagaagatatttatcgcgaggttggctacctgtgacgtggccgtggaaggcgcagtcggtgggggagttgtcctcgtcgagatacaggctcccgcaccgcaggcatcgcttcctatccttctcctcgctccgactgccctgctccaccgcagccgctgctgccgcggccgcgccgtcgcctggagacgcgccgatccgcgccgtcgcaggccgacacggcggtgccgcggcgttccggtggcgagacggcccgcgcggcggcagtaccggcaccgtgcgggttggtgcgagagctgggctcgccgccatggcgtgatgaggcgacgggattggcatcttgtgctaatggagctcgcactccacacgcacacacagacattcccgctgagaattgctgcctcttttcaggttgtggcttgggggtaatgggccaaatacaaacggcccaaactacactggacgacgtagtagtgatgcaggggaagagatctggcccaaattgaaactagcgatgtgagtagtgccgtacccgtactgccatgtctctctccacgccaaggacggcaggacgccaggaccaggagagtacaagcaacttccttgtgatttttgaaccaaccctaataatctccacgttttttctagtagtacagtacataggtagtacttacagtcagtcgttgacgtgctaataacggtggctgtcacgcagtgtcatcatggtcctcatcacgcagtggaggtggtccaaacatgtatcataagcatcattcagaaaactctgaagaaactgcgattagttacagctcgccgacgacgacgggcgagcttccgtcggtccgaccggccgcggtcgcagagcagagcagggagggaagctgctgacttcgccgcgctgcgtcgcgttcggttcttgccagccttcccaagtgggttcctgtcagctttttcctcgcggcctctgagcctctctctcggtcatcatccttcagctcctgcggctttgctgactggagttgctccaactgtttgtttacagttttgactcttggtctccacatttacatcggcggctagaacacgcacatttcactctctcaaagaacttttcaccctatcacattaaatgtttatacacatacatggagtattaaatatagataaaaaactactccctctggtcctatattaattgacgttttggacaaggttgaggttaaacttttataactttaaccatcaataactttaaaaatatttagtttagaaaaacatatatagatttgtctttcaaaacactataataaaagtaaacatgtatttatttattgtatatattataatagaaaaataaggtcaaaggtatattttgtagagcgtgtaattgtccaaagcgtcaattaaaatgaaactggagtgagtaattacacagattacgtgtaaatgcgagacgaatcttttaagcctaattgctccatgatttaacaatgtggtgctacagtaaacatttgctaatgacggtttaagtaggtttaataaattcgtctcgcagtttataggcagaatctgtaatttgtttggtattagtctacgtttaatacttcaaatgtgtgtccgtatatccgatgtgacacaccaaaacatttcgtctcgcgaactaaggccctatttacttccaggggtgaaaagttttggcgtgccatagtgattaaagaaccaaactctgaactcgtagcacctgacatctttgtggcctcaaaatagaagaacagaactgtggcgaatgcactataccaaaacatttgggtcagggatctgaacacactaggctgcgtttgataggatgggttgggaatccatcccctccgcacgaaaaacggagcagtccattagtgcgtgattaattaagtattagctaattttttttaaaaaaatggattaatttgatttttttaaagcaactttcgtaatttttttttgtaaaaacacaccgtttaacagtttgaaaaccgtgcgcgcgaaagaaagtgagagaggttgggaaccttgaggttcgaaagcagcctaaagataaccacggaggaccatctgtgacaattcatcaatctttggacgaaaattcagaatatagaccctcatcgtttgggtgctattatgcgagcagaacactagaatctttcgacacatcgccatccccaacctccgtgattgcaaaatcaaataggaggctggggcttgggtcaaagtaggagcgtccaagttctaagagtttctatttggggggagattacgtactttgacctttttaagtcgggcgaggactttcacacgtcgatgtacatactttaattttgtttactccctcactatggggtgtttggaagagaggggctaaactttagcccctctctcaaaaatataagtctctaggagatggacttatatttttgagagagttagatttatttgttcaaagaaaagacgcctaaaaatcattcagggctcttggtatcctttaccacattcactttccatattccctttctttagttcagacgctatcatacctcagggaaaaaaattttctatcaacgattcccacccaactctaaaatgactctcccctctctcccttaacatatcgaaggcctcttatacgtcaactagaccttaatagctcagacttccgagccttgctggatgatgcagaagggccaacataagaggatcaaatagagcgacagtccagattcagggttacttgtccacaccaactaatcaggtatcggaaaatagggcatatttgtttcagccgggagaccccctgggggtctagttttaaggcgattaggcctattgagatgcacatactaccttctttcatcttatcaccccgcctagcgactttgcaagcattacaggctaggcaccgccgaaggtagtccagtccgcttgttagattgaattgaatcttatataacctacgtagctaaagagaaaatcataatagtctaagtggacctctcaaaggtataaataagtatacattagtcttactggttcgatctttttctttttttgttatgatgcccacatttcatacttctcaattcttatttattcaagggttcgtatgtactgagtttagggtttagcccctctcttccaaacaccccctatatatacaagatgtagcttttgccttcttaaaaaaatttagatcaggaagaaggtgaaagagaggagaaaactaatgaagtgacatgtcggactcgccctcaccttttattttctcaaaagatcctcttttttaatgattggagtcatataggccaaattaggccggttcgagcaagggatataacttaaacagtttgaaaagttaaagaggcacaatatatgatttgcatatttaagattgatgttagtgttccatggaattttagggtgccgttttacacatgcagttgattttgcttattttgttcctacaaaaatattttctacctgtgaattttgcatagcgtagctggttagatttcatttcgtgaaacatataaactatggttgaaatcttagatttagcatgggtacccgcatttatggctaatttttccaggtgtaggtgatgtatatgtcaacagcaaggtgctcgtgatgatttcatcaatcgcaaggtacatatcgattgtggagtgcttgtagtgtcttcgtaagccttaaggtatatgtcgacagcgaaacgttggtggtgacttcatcaatcccaagatatattggttgctcatagagaaaagatgtgtatgtattcacaaggtcaactgtgtgcgcgtgtttataagcatttgtgtatgtaatgtgtttcaaaaatatatattcccttattcccaaaacaagcacaactatgagtttctgtgtcccaactttaattgttcgtcttatttattttttttaaaaaaaactaaaaaatataagtcacgcataaagtaatattcgtgttttataatctaataactataaaaatactaaacatgaaaaaatttcaaacaagatggacgattaaggttggacaccgaaatttatggttgcgcttattttgcaatagatcgagtataaaatagccagctctacgttttttctttaaaaaaaaagaaagatgttttttgtgttgaaggaaaattactgggcgcgggagggccggcctggtcagccagccaggccagcggtagcggtaggttgtactttggggcaccggcatatccaacttttcaggacaaagactgaagctgctgctggtgttgattagactttgcatagcagggcaataatttccatatctcccaaagttcctccccacgaattattcaggcagctaccgatacacattttggcagggcgcgaaaaagacaccaatgtacttcagtacttgcagccaacgcagtactccgtctgtggccagtggccagcgcgcgtgtgtgtgcatgcgcaacgcaagagagcgtcgcattgattgtgtgtttctgcgtggcagatggtactacaaggggtacgtggagtccgggtcacgttgctggcctgcccggtccggccggtctcccccacctgcaaaattctcacacacgcgtgcccgttgaggtgacccgtcctccagcagctaccgcgcgccgcgccgatcgactgctccccctctcgtctcgtcctgctttcgcacgccggatcaaacgcaagctagcttcccatggtattcggtgttgttttgcccgaaaagcaatctatttacacctgcaaactgcatatatgaaacgcatgagtttgtggtaacgagggccgggtaagattgacaaaaaaaaaaaaaaaggggaggatatgcatgcagtgcccgtgaagtgcacgttacaccaaccctccatctatcgatccgtcgtctagatgaagctaaggccctgttttgggttgaaagttttgagaagtactacctccgtttcaaaataagtgtagccgtggatatccgtacccaacgtttgaccgtctgtcttatttgaaaaaaatatgaaaaaattaaaaatatttagttacacataaagtattatttatgttttatcatctaatagcaataaaaatacgaatcataaaaatttttcaaataagacgaatggtcaaacgttgaacgtgaataatgtaaaactacacttattttaagacggagggagtaagtcaaaatcaattggcaaggggccgacgattatgagaattaagaaagttggttttttagcaccgggcctagcaaaagagaaatcgccatatactagccattatttagatatgggtggagcccaagaatatcggagagggtctaacaccctactattcagtttataattacctaattagttagatggtcctattataaaaaaagaaattatttgagggagctttgactccatccattccccccttgtctccgccatcgcttggtgagtcatcagctagtgggagtatgtcaaaactagatttcccaacttcttgctgctagctgggttcattctgaatcctatagctattgattcacatagtctagatgagtatatggaccacttccctcggttccaaaatgtaaaaatttttaggtttaaacaaatgagcaattttattgtacttgagagataccatggggtaccaaagatttagtgtaaaatttggtatatcatagtacttaggtatcacgaggtatcaaatttacaattgaaaaggcagtacctcatggtatcttctcaagtaccgtaaaattgttcttacacaaatactaaggttaggtcaaaagattccatgtaaataacttcagttgtcaattttgaattgcttagtttttatttcaagcatttcattgtcttaggaatcatcaatagaatgatatgaatcttgggaataagtgcatgaatccttataatattatgatgtaaaatttgaatcatagaaatacttactctctccatcccaaaataaatcaacttttatacgagaatatacatagactatatccagattaatgtataaaattttatattttatagggcagagggtttatattttaaattggatggagcatttagaagaggtggtgattctataagaagctgtaaccattggaagctagaattaagggcatggtcgtttcaacaactcaggtgagatttttcatggcatgaaaaagaaaatcattaacgagtaattaattgactattaattatataaacttagaaattgattgatctttttaagaaacttttacatataaagttttattttacgaaatgtaccttaaaatagtttgataagtatatccacaaagaattaacgagggagttgcttgcccgagttgcagaaacgaacggaaccccaggcagcacaactcgtaagataggcaatcgcatacagtgtgtcgtcccggcctgctctggcagaagagcaacttcctccatgcctgactagcggcaataataatattccaggtccccccattgattccctctcatgtatctttccctttcaatccaagagatgcatgagaaaagctcatcatttgacatgaacatctcatggtatttgtgtgtgcagcagcagcagcaggtagcaagcatgtacatctgatgttccatccatccatcaaccttgcctagacatacttttgtcggccattccgtggtgagccttcaagtgcgcccaaaaagttgatctccatctacacacatatcctctcctcgtgaaaagaagatccccaagctatttgttctctctcacttacacacagtgacacacacatactactcatctctgtgctttgtttccctctctctctctctcttgtttcttttacagtacatgcaatgcacaggtaggtcacagctccatccaattgtaggataggagtatataaatgtttgggcaaggaaacatctttgtttttggaagtatctccagctacaataccccattgctcccttttttcccttttctagggcaaacaaacaactggacatgtctctcacagcctttctgcaggggaggttcggatgcttgcacaggaaagaacacatagcaacagtagaagcttgaccgatacagggttgggaggttattgttttccagatgtagacgaagagatggtgataaaattggccccatcccaaacgcatagcgttagctctagcaaaacctggcgttgtttgaaccgacaggttcagttgaaattaaaaaagagagctatatggcaaaattatccactcctagcttgaatttgctgccacgagttaattaatactagtactagctggtatctaaaatctcaaaaatcttgggggaggatccatttattaattcttttttttcctagaaacccctttaggactcatttgcaatgtaaacattttctagggttttgataggatgctagctcaatttcctctagctagtacaaatccattagtattccttcattttcaaaagaaggccatgagtttttaattaatgggcgaagataacaaaattccaaatcttacaacacaatgctaaaattgaaaaaaaaaacaattccatagagaggacctagcaagaaaaactaaccccactcattaccatgcgcaacttttttccctccactcacccgaatcctcattttcccttctctcccttcgtttgccctgtctccccttgtgatacttcacaattgttgcctgcaagtaattaacatcctccctcatgacgcaccatatctcctaggcaaaatttgccacaggacatgcaaaaaaaacgtgtaattggctaagagacaccgtgaaaacatgacacggctgatggacagtaaaaaaacatgtaattggctgtaggacaccggtcacattttttttattatttccaggtcaaaagaggtgagatatttttctaaatgcctgacttgccccttctctttccttctttaaacaccggtgggtcccatgtgtcatggacagtgtatgtttaatctaatttttaataggtttttaaccatcaggccccacgcgtcatggactaatttgttcctaattagtagggtgattactatttactaaccataagtggggcccacatctctctcctatcctccttcttcctcacgcacgcggcggagcagaggaacagcagcctgagctgggacggctcggtacgcggcggaaaaagcggcggcgctccgccggggtatcactgccggcgacggcgaggaccaacgccgggatctcctcattcagcgaggaccaacgccatggcgacgagcagcgccgggatctcctcgttcagtgaggaccaacatcgacggtgacgaccaacggccagcctcacctccatcctcatggtgcagtagctgtccacggacatccagggtctggacggcctcatcgccagctctgaccccatcggcttccaggtcggctccttcgccaagagctacctcatgcaggagctgggcgtgcctgagtcccgcctccgggagctcgccatcaccgactactcctccagcctgcagagcggcgtcgtggcggccatcgtcgacgagctgccatacgtggagctcttcctctccatcaactgccagttcaggacagtggggcaggagttcacaaagagcggatggggattcgtgagttcttttccttgttggcttcttttcttcttctttttatcctacactacaaccaagtactacatatgcaggctttccagcgcgactcccctctggccgtggacctttcgacggctgccgaggaggaggaggctagagagcgaggtaggtgcggaggcaatccgatccgatgaattggcggcggcggtgctccatggcagggacaatctcgccatttgaaaaatattatcacctcttttgatctggaaaatataaaatattgtctccggtgtcctatagccaattacacaatttttagagtgtcaatcagccgtgtcacgtttttacggtgcctcttagccaattacacgttttttacatgtcctgtagaaaattttgcctatctcctatttgaccgatgtcatccgccactcctcgactgctcttatgacgtttgctttggtaccttttcatctactctagtttgatatctatgacggtttgtgcgctttcgacctgtgttaccgctcattagtttccatctcaagcacatcatcaagggccactttccatgcatgtccaggtgatggtacattcttggtggttgcttttgtccagacataaaatgccaatgagaacactgttttggcaaacacatggaacccacataaacacacatgccacatgtatacacattagctagtgacatgagccatgtccccttaaggccttaactaacaccctcaaggtctcaacagacaatgtccatgaacaaatccactaatctcataaaatttctcaattgtactatatcacatatttataaacgtgagcacccaggacctgcccgtatataccaaatacgtgttttgcttatggtagtatatggaaacaacatgcaaatgaaaaacagtatgtacaagcttgagccaaactctgtacaaacatttcgtctgaatgtgtatagtatatatgatggacaaacaagaataaaaacgccattattttcaatttgcgttagtcaatttgcgtcagtcaattttccatgtgtatagtaagcaaattgactgacgcacacatcgcgtccttgtaacgcagcatctcatattctagatgaacgaaagtacataccactgtacgaggtgatcgaaacaaatcgatcgagaatatcagacccgctggcaaatacgtacacacattgcattcacaggcaatatatgcagcttacagaccactccacgctacagcacccaaccaattaaacaagaaagatgataataacaaaacaaaacagaaaatctagacacgatcgatcgatcgattccttgatcgcgacaaagctacgggcgcgatcaatttgagatatcgccctagcaaaattaaagctagcctcctactataccagatcacggagttgcactaataatcaacaagagaacaaggcgtgtacgtcccaccagatggcgacaccaccaccatcatcaacagtgtgtacgccgtactacgtaccacgaagaagaagaagaagaagacaatcaccaacagcgagcgaaaccgatgagcaaactcgtatacatccacggtagaacgtagtagactagtagttcatagtagtagtgttgttacaatgaagagattcactctggtccaataaaaaaatacctcgaggttaccgatacattatggtaccaaattgtttccaatcgctggatccaataatacatatcttatccagctaaatccaacgatcagaaacgatttagtaatgtgaggtactagtacttcgagatactttttgctggaccgaagcaggtctttgcgattagagggatcgggcggcgggggcggtggaggaggagtcgtggtcgaggtcggagacggcgccgtcgtcgtcgtcgtcgagggcggcggcgccgccgagcgcgccgtggccgtggccgaaggcgcgggcgtggtccttgagggaccgcttgtgcttgaactcggagccgcagaggcagtaccagagcttgccgcagttcttctcgtgggtgcgccagtcgcccttgacggcgaacgccttgccgcacttgcggcacaggaacggcttcagcccgtgcttccgcttgtagtgcgtctgcagcgtcctgaagtccttgagcggcttcgcccgcgggtggtcgatgttgttccggcagcccgccgcgcagcagtagcacggcagccgcagcatcgccgtcggctgtatcccccgcagcgactccggccccttcctgtactgcgacccatgcccccacatatgcatctgcatattatcatattgaactcatcatattactgtattacgtatatactctatcaaataaacattgtacaatactactatatacgccctaagttagaaaaacacaacacacaactcctgaaaactactccgtgtatatgtacgtacaccgctagtaactcagaacgcagatgtcaggttgttgtctgtatgatcgtatgctggatttgcaggctgggttcaggcaatggtggtttccatgtgaacatgcagacttgtactgttactgctgctgttcatttcagtgtggtactaggacaccgtatactggctttctttttaatgcgtttgcttatcttgagatatttgcagacatctagtacggataatcagaagggagtcgatctggctggacctggccggctcatgcatcaatctctccttgctctttctcacacaaactttccggctttccccatgcatgcagctgtgataaaccggagaagccgcatgagcgcagaagaaacgccggccttttgaaagtgagggcgctatatatgtagctcttcagatcagacaaggctatggcttagctagtagtaggagtagaccattgcttgtgtgtttgtgactgttgcttgtgagatgagagagtgtgtggcgtgcttgtgcctgaggagcacagtgtgtgcgtcagggacagtggagctaagctacagcaagaacactgcacatctcttgcagttcttgggagaggtaaacggcagctgtagcaaaaccactagctcttgacaagtgagaaacgaaggaagaaaaggttaatgtggcttgatcaaacatccaacctaagctagcttggcaaaaaagcttcatcatctgaaagctagagagatcagtgtcatatggtagtggactgcatgctggctgctgtgagatactaccacacacacttcacaccattggagtagaagaaagtagctagcaccaggaacacctggcccctgccctgcctgtctgtgcatgcagctgagctgagcaaagctaagctttttcatcagagatatcatcagacacacacactatagctagctgctgcatgcatgctaatgagatctctttccatccatcaatagatacaccaggactcatctaatctacttagtacaaatcttattcatgcagatcatgcaaaggtgaagtctctggagaagagatcttcactgggatctctgctagctctgacgaaccaccactctaataatgcgcgcatttctaaagagagccccctgtaaaaagcaagagcgcccccagaaaagcataaaagtcgcatgcatgtatgactgcatttgcatttgcatggcatggctgccccggcctggccatatctgtcttgttcaatcacacgaaaaggcggccactgtgcgtgcacaactccaaccctctcctcctcatctcagctcagctcaatctccggtgatctcagagaccagaccagacaccagcacgtgtagcttgtatccactacttctcttatgagatttgctctaactcaaggtagcggtaactcacggtattaaatcatttccgatcgtcggatatagctgggtagtatgggtattgttagatctaacgatccgaaacgatttggtaccacagggtaccagtaccttgaggtaacttttttttttttttggaccggagcaaatctccttctcttatagcttgcttgctagcagttgctagtactcgtcgtatttcaacgataagctaaacaaaaaggtacgagctagcactagcagccatggaatcgaaggagaactgaactgaactgctctctagctttcatgttccctccgtttcaaactagatggctttgaaaataggtcgccagtttcaaaatatagctatctcattgaatggattttttttttcgaatggaaaaaaaatagctatctctgtagttcaaattatatggctttggaaataggaccttcatactttgtcgttcattaaaaatatggtgtgcgtgtatgtgttcatatggatgaatgtacacgtgttatgagcgattacgtttatactgtgtttctaaaaaaaattgactttggaataggagcttcatgcttcatcgttcattggtctgacagatcgagcaaaagaacaaattaatgttcagagaaagaaaagacgggattcatgttcttaagctagctagcccggctatggagtggcaagacacacttgataatcgagatttactagtgtacgataattccaagatcagctgcatgttgtgtgggacgttttttgtcaagaatttctcagataatatgtaggtttagcagctagcagagtatctataatgcaaagagaggttggtgaatatatggatatttttacatagatacatatgtatatcacttaattaatcactgtaaacagataactcttaagtaattaattaggttcaggctttcttcttaccaatcctaataaaattcggtcggcctaattctttcagtcaacccggcaaaaataaaattcagttttttgtttttatataaaggtagtgcaggttttcgttcgcatgctgatcgaggctgagtaactagctaagtataagaagcatacgttaatgggatcaagaggtatatatagaacgagtgagacgcattgtcaaacattattccgacaaaagaactagcaagtaattacacccagctagatatgcagcgttcgttcaagagccataaagctttcctgaactactactgtagaaatttttcatagccagatcttagaaagaaaaggtaaaaattgcgtcgcctactgtcggtatcatttatttgttaggtgattgcaattaggatatgcttgaaagaaaaaaaaattagttctagctagatcggatttattctagcctaagaaaagggatttatcaatctactgaagaagacatatgctttgtcataccatgacgacaaaaacgggggaagacgaacaagaggaccactagtggtacagtttggggatcacgcatgatgctatgtctaattctaagtaaattaatcacttattagtcttgaattgcgacaaaactgaacagcaataacccacaaagaatcgcaaaaaagaataaaattaaatggagcagcgataatctagagcaagcaagaacagtagcagctagcagaattaagctgtgaagagaaatgaagaaattgctggctgacctgcatgttgttgtatcggttgaaggttttgaagcagacggggcaggagaactgcgtggggccgatgaggatctgcgacggcgtcgggatccagtactggcccttgttcagacgcccgatcggcgtcgacgcgaaccctagcggcgccgcggcgtcggcggcgtcgccgccgtcgccgtcgtccctgctcgcgccgccggcttcctccgcctcgtcctcttcctcgtcacgacgcgcggtggaggatcttctcccggctgctgacgagagccccgagatgaggtcggcggcggcggtcgggctcggcaggccgatgtgcagcgcgaccgtgacgtccgcgtcgtcgtcccccgccgcggcggcttcggcggcgcagcagccggagccggagccctccacgtccatcgggtctcccgccgcagccttggtgttcaggtcggcgaagagccgccccgcgcggcgacgacggagctggtggtgtctatcgccgcctccaccgccgccgccgccgggcgtcgagcccggcacgtcctcctcgtccgccccctcctcctccgcgccgtcgtcgtcgtcggtgcagtcctcctccccccgctgccgcgcacgctcttgcgccgccgtcgtgccgccgcgcgaggcgggggtgagggacagtagcggcaaggcctcccggagcggaggcgacggcggggcagtcgtcgtcggcggcgtcgcggccgtcgtcgacgtcacccccgccgtcggaaagaacgggaaggaggaggaggagtaagcgccagccggcgacggcgacggcgacggcggggtggagaagcagtagcggcggtggtgattcttgaggaagctcgcgtagtaggggttctccatggctggcaaggtagcttgcgcctcttgctatggagagatcgacacagctcgtgtgcgtgtgtggtggcgtgggcgtggtagttggcgaggggttattatagggcgtgtgagtgtgagagggaaggcccccgaaggggattgggaatgagtatatttactatttactgtggaggttaattagctaatgtgtgcatggaggacgtggtacgtacgtacgatgtaccgggagataactcttgttttttcggattactaagatggacgcacgcgcgcgcacaccattatacactctccaagagtcggaaaccaacagcgcatctctgatctcagtaaaaacttgttggaagcccaactgcatgtgcatagttttcttggacatcacgatttaaaccctggtgggtgaaatcatgtgcatacgacttcaacaccagattttctacttcagcaccgcaccagtggtgcttcccctcttggtttttttttctttctcgtaaggagggacatgttctttctgcagagtaaggcttcacaagctcgatgaattttgatcggatttcgggaatttggatcatctcgagttatcatgtttggagtttatggaaattcattcgaaatgtgtcgatttttctagattggcgaaaaatcgatgtctcactgggctcgaatttcactggccaatcaataccttgtgactttatcacttaaattttgtattttatatattcattaaaaggttcatgaatagaatcaaaatatagataagaaatatatgccctctttagggggcttctagcagccatagatactccgagaatctcggctagctccccaaacaatccaaatgtttactcaagattgtgacacttagtaaagctaaaaatccaggaattaattagtgctataagctaggggattatatatacttctctatattctcaccagctcgccagatatattataagaaatgttctttttatgggaaaaaaagatttgtagtcaaatttccattgatcgattcatttttccatatgtccttatttgaaattaacgaaaacccatttattgtgtgtgcccatagttacaagctagtgatggtacatgtactattattatgtgtttggtttataaaattttgatggagaaatcttgtccagatgggttttctttctttcggcccggtactgttgttccttatatatacacattattagcattttgttataggtcaatttgttttgtccggggccacaattcacggattattgatgctgctatttaaagatgagcaatagcttgtgtcaaaagacaactaagaacatcatcaccggtcttgaccaaactacaaacgtgcaactttacgagttcttacattaatttccgaaatattgtaataatggaaaaaagatgttttctgaatcggttaaaaaatgaataaaattaactaaattcaggatgtatgaagcacctagaatatgaatatatatggaatgagggatcctaaaggacaaatataggaatcgagacgagagatccgaggatgatatgggagcctagagaacaaatatatatataggacccaagaggataaatatatatggcactttagaagaaaactaagaggacaaatatgggactttaaagggaaggctcaagggatgaataagaaaatccggaggaagattctaagggcgcaaggccttgttagtagggaaaaatttttgggtttggttgtcacatcgaacatacggacacacatttgaagtattaaacgcagtctaataacaaaacaaattacatattccgccaggaaactacgagacaaatttattaagcctaattaattcgtcattagcaaatgtttactgtagcaccacattatcaaatcatggcgcaattaggcttaaaagattcgtctcgcaatttacacgcaaactgtgtaattgtttttttttgtccacgtataatactccatgcatgtgtccaaacattcgatgtaatgggtgaaaaattttgttttgggaactaaacaaccccctatatgaatgtggctacaaaataacacggatattaattcttacaaattttttttcgatatgcatctttggagcaaaacttttattacatatgtacacttgtcatataaattgaatatatagcaaaattataatctataaaatatttttgtagaggaagattcgcatatactgttcttgaatgactaatctaaacatttaaaatatcccatagtaaaaatgtcaccacatcacattttctgtacattagctatgttttagtgtggaatttgcgcttgtcgttccgaaatgatcacaactttgccctttcgagggaaggtgttgggttcctgtccatcgattcagctagtatcttcttaatggcaacatattcaattttgcttgcttgaaattatgaaatgttatatagcatataattataattaccgtttcaagtaccaaatgttgagaggctgatttaaatattctttccgaacttcaaaactttggatattacaatgcgaaactgccctatataaacacatagtatattgtaagaatatgaaaagggtgtaaaatgtgacatcaatatagtatttgtattttttggagaatccattttgctattgttaattagagtctagacgtcataacactcggtgagaaaaaaaccgaagtatatattgatgccttagacctcttcttgatggcattttccaagtaattgatttcatttactatataaacataatgtaaattctccttttatttttaacatggctcttgatgcagttactagtacttatgttcttaagaggatgatttggttggacattgacacagtctccaatacattttatcattactatatcaaactatataattataaaagataaattatgaaagagtttttcatgacacaagtatgtcaacatttttcatattttgaatcatgatacctttgaattaatctattaataacttaagattttgaggtttgactgcacatattttaggacgtttctaagaacaggacatatataagtaataaacagggaaatatatatatacaaataatgtaaattctccttttgtttttaacatcgcggtgggagatacctgctaattgagggagctgagagtaacctgatcccgcttataaaaagagctagctagactaaaaacaaattaacaattgttagcatgattaaccggcagaatttaaaacattattctcgatggaaatttatttaccttaattaatttggctacggtacgtagagatgtagagagaacatgtagcaagattttagctacggagaatgaatcagcaagggaccaacactgaattaatgtgggtttccgtcttttcgccatctgaaagcaaacggcgtacgtggttcttataccgggaccatttgtgaattgtgatcgtagtaaatatatggtcgacgcgaatgtttcgcactttcgctggccgcaccacagaaatcattggattataaggcacatgcagggatagtgttttttgcttacaaattgagaaaaaataatggaaattaatctttttggccatcaagttgtacaattccaacctgatcgtagacattctttggtacctaagtaggagtaagatatatttacaaaaaaaaactatattccttacgattacacaaccaacactcttaattccaacatgcattgagggcaggtcattactccattttattaagataatgaaaatggactataatgctatgacagattactacatatacatcgcttaaacaaattatagactaacaattcacctattaaagttattcggtggtggtctttattaataggttttctttctctcatccttagcttggagagaggtatatatttccttatatttgatatttacctctttgtgaaaggaggtatcataattaatcttatagattggagttaggataagattgaaacctcatatttatatactcactccgtttcaaaatgaagctatttctaccactcgatctttgattaagctatttcttcacctatctccttctctcaaccgatcacaatcattctctattcaattttttctactttctcttatcatctaatcttaacattccccaaattatttccacctactttcttaataatcgtatctagaattgcttaattgttttagacaaaggcagtatgtttttaatgttttcttctgtttttgagaggtatactacgagtatttgtgttattcatgagaaatataccttcggggtaaagttatataacactgactaggctgtgttcttttggagggattgggaacccttcccctccacacgcaaaacggaacgatagatcaacacatgattaattaagtattaactaataaaaacttgaaaatggattaatatgatttttttaaacaactttcctataaaaactttttgcaaaacacgcaccgtttagtaatttaaaaagcgttcgcgtggaaaacaagggagatgagttgggaactcaagggaatgaactcagcctaagagcaggtgcaatagcagactataagcctgctataaacacatttcgaggaaataagggaggagagataagggctacagatttgtagccagctgcagcacggactctaagatacatgtgtgtattggtgggacaaactataaatcatgtaatatatgtttataggtaactattatattaatcggctattaaattgactatagataatttggagctagtagttggctatactattaaacttgctctaacactggtttatctatacctctttatacctctcggaacaataattaaagtctcgtcattgtcaattgtagacttgtcttataattagttcaaccagtttatattttttttaccctcttaaacaataagatggttgcaccgttgcactacagatttcatttatatatagcctaattacctctgcccaattgtctgtaagatccagaatcatatatgattggccttttctggccacaactatgcatacatttaacacctgaaaagaagaataaatttaaaggccattattaattacacgtggaataggatatattcaaaccagcattcaaggagcgaacagtattactatagatataggcggccttaccagcaagttactgttcaattagctagtggcccgtgcaattcctgtagatgatcgatgtgagattgcgagtgagtgctaatcccaagccagtcaataaatcggggagcatggacagatccagtaccattcatgttcaataattatacatgcattgattggaaattagaggaattaatcttaattattgttcaggctaacctgaactcaattaattagcatagctaactattgagcagtacaataatactaataacaaaagatgctcacttggaaacttgccagtatatagaacaaacagaaacttgatagaactaatatagttaattaatgaaataatttcaaattaatcgggaaaaatcattagctcaagagtcaaaacctagttgttgctgaggaccaccactgattatattgactagtcaacccattccgtgttagtcttcctctagaaatagctccattaatatattacacttgccatacaatgttattattattgttacatttcaaatatacaaatatgttccatcctaaatataaggcacaacaattattaattatttatctagatcactctagtaaatacaatccaggtacccaatgggcttagagattttaagggtgccgaatttaaaaaataaaataaaaggagggagatgttctagctaattgcatgcatgcaatgcgccccttgtaatgaaaatggttacactttttattttaggatggagtagtattgtgtaagcgtacatagtattacctccctcccgaaataattgtattataaaaaaatagatatattagtacatataaataaccacagtaaccctacatgcatataataaaaaaaaaggtcgaggcagatgcgaatggaaagatgagaaggtagaaggcgggatacctccatctaaccaattggacgtgtttcaacttattataaatatatatttttagacagaattaatttgatagttaattacagatctactgtattaggatggacataattgcgccttgtatgactcgtccagttaattcgaatagctgtatataaacagctcacaaagacttaaatacattgtccacgcgattagctatctgtcatatagtatagtggtttctcatattctgccataatgaagtaacttattgcatgcatgtactttatagccaccctgcttgaacatttgatcatcgagatcacaagcaaataattggttaagagattattattgcattgggctatataattaagaagctatagacagatcgaattgtcggggaaggagcattgaaacccggtgcccacacacagtgtgtgcataggtggcctagctcgacggctagccgtctactgttccaattaattaggcagctggtgcgatctctgtacatagccggtggggatttaagaggtaattgatctgatccatgcagctagcctgaggaaacacatgcgtcttaatacatttgtgtgccgggtccactggaccaaaacgagatgccgccgtgtgttatcaattgggtttgggcattcattcatacgctatgcacacattgcaccacctgcgactgcgacctcttcgaattttgccggtatatatgttttttcttcaatttttgagaaggaaaaagtccaggagaaggtggttatattgctctgagtaattttcttgagcttttatcaacctaaaattgtagtgctccctctataggttctggacaacatcagctgtattttctttgttagcctagcgacggctagttcagtgctaaccttctcctaggtatttgcgttggtgttgtttgtgtttttttttggggggggggggggggtgggtgggttattttttcttcgtttttctggttgcgaccttctaaggttgtaatcgtgtaattttttttcctgctctatcaatataaactttacaatgtctggtttgagtcgttcaaaaaaaattgtagcgctccctgtagccaaatatttttgatatggagagaactaaattctattctcccaacgttaaataaattagcccagaagtagctagaactgctgtatggccaacaagataagttttagtagtaattagagcccaccgatgggcgatggtctgtatcgcagtgacttaaaaacgatatggagccactaaatttctgacagacaacatgtttgtaaagaaggaattgttgtgggttgataggtcgccaaacagttatagtgatatatagtttgtcagtataatagattttctctgaccaatgacatatggtaattcttggtcatggtgtagtgtttgaactctgtatttgtacggtcttacataatttgtattagcaatagggttattatcacttttcttatgtagtactattatggagtacgtcctattccacaaacataattattagctaccctcttcttcaaaaagttgaaatgagacagtctgccttaagtatatatatttattttgatttaagcatggcatccaatgggcatgctccatgcaatgcattaggtttgagaggtagaagatcccagcagacagagtgggttcaaggtataagcaataaaggacccaacagtggtggcattgaattggaaatagtggccagagaacaaggggtgtggtggtgtgatgcgtacaatagtaatgtggttgcacggtagggcaaatgggtgtgtgcatttaatcaaaggacatggaaaaggagaggggagaccatcgatcacaatccccttccccggccgtcgcgatccaggcaaatttcttctccgtttctctccggccttttctccctttttttctgcatggtagctaccaatacctgcctgcaaatcggtttctcatgtgaattgaatcaattggattatcatcggttgccctagccttgagggttatctggaggtttgtgctttgcactagccaggcatgccgatatatacaaatcttgtcggtgttgagacagcttcatatatggtctaactgtagaattcgctggcatgcatgcagggagatgatatttttagggttaatttggtgatggccgactagatagaaatcgacgtatttgacgtgacatgtagtctaaggcttcattcgcgtgtgtggtttggttgaaatttttggtgacacgcaaaatgagaaaggacattgttgtatgattaattaagtgttcactgttataaacttgaaaatagatttattttttaaaaaacagtttttacataaaagttttttttacccaaaatatgttatttaatagtttaggaattagctagcgcactcacaataaacaagaaaaaaaatgagaaagtaatccagccaggaagtttagaatccggccttagctagctagaatgaacatatcacgaacgagttcaggggcaaaacgccacatcaagcacgtaaaacatgcttccttgcaagttgcaacattccaagaggataaaaaaactcgtttaatttactgcatgtgccagaattggaggatgggaaattgaccccttttaagctagtagccgccatgatctattcacggtttttactttcttccaggaccattcaattcccttttctacgtttgctggagatcgttgatatctgaatttttaaggtgaggggcaattaatttacagttcgcaatacctatttagatgtgactaaaactttaagaaactatcacatcggatgtttggacactaattataaatattaaacgtagactattaataaaacacatccataatcttggactaatacgcgagacgaatctattgagcctaattaatctatgattagcctatgtgatgctacagtaaacattttttaattatggattagttaggcttaaaaaatttatctcgcgaattagcttttatttatgtaattagttttgtaagtagtttatatttaatactctaaattagtgtctaaatatagggactaaagttaaaattagtgtctaaatatagggactaaagttaagtccatatatctagacacccctgtgcatttgatactttgactgatgagtagatgagtctgccggcagaagggcacatcagaggaacatgctctccaggagcattccggaaagagaaaggattactcctattactgtactgtggcaaaagtatacttcagtgctttaatagttagccgccaccatctattcacggttttcccccttattccaggagtatttccttcgaagtttttagtagttagagtatcatattcatcgtgaagtgtggatgatacagatgcagaactatgtattctttcagtattaaaagatatcaacctgaacttgctaaccaatgataatcaaagcatggtcctcgctttgatgtaatccaatttgattgtaaatgctcctctttgttcccatgccatgttaaatttatttatttttactctggatctctatttttacatggacttaaaaataattatattcattcatcagtagtaacttccgaataataaaaataattgttcccttaacatgttaaatttatttaaaggtggattttgttttataaaggattgtgaattatgtcctctattacttaatagcacacttgttttgtcctcccctcacatgcagcgtgcactcgcataacaaaagaaaattcctagataaaaaacggttgtttactatttaaaagtggagtcgttggttccttcctcccctatttcccctcgtgcgcaacacactctctcgcataataaaagaaaattcccagataaaaaaggttggttaacaacaaaaaatgtgatttaggttcgatccgcacctagatcattcctaatggtataggtcagttgcaatgtatgaacatattactagtatatgtaaaaatgtatctccgctatttttcttcttttttcttatgatggttctctagttctttcagcacttgtttttacaattaaatatcaattgctagctaacttaagatacataattaagattcaaaaatatctaataaattcgatatctagagttagaatagctgctctacatctaacagaatgatgaaaaaaaataaataatctaggcaataatcttcaagccgcaagttctgtataattctgatactaacaccaaacttgcccaatacatatatgtagtcagcaataatcatgcctcttccccttttcttttacttttaagtaaacaagtgtattcatggatggcacgatgcacagtcactccgtccggacgcagcgaacagtaggaggagcacaatccgatcgaaatgaacaaacataccccctcgataaacaacaatcctattccattattgcccatgccattgcccataacggcttcggcttccatccagcagcgagctagcacggcatgtgatgcatgcctgcacatgctcctctcgatctgctctatatgcctcctctatcacatctgtcagttactcgccatagtctgcatcaccgatcgagtctgcagctgcatgcttctactcgtgacaccccccccccccccaacccccaaagaaaacgggtaataattagctcgttcttcctctgttacaaaataaaacaactttttttatataaattttaacataggtgaaggagcagtacttcgaccacgatagctgaaacaccttagcacgtcgaggaaatcaagcgtacacaccggccggtacacagatccaccgatggatggatcggtgaggaaatgaagcatgcagcagcagcagcatctgctgactgcaatggccatggccgatggctctgcatgtcctgtgccctacaacaccctgcatctgcatgctagctagctgcacgcgcgtcgttgcgtgcacacacacgctatgaatgcgttggtgcatggcgtgttaattttatccggagtccccacagacgacagacacatcaattatataggatctacagtgtatcaatcgatcgatcagcagacaaaaggaacaaattaagtacgcgggggagagagtaggtggctagagaggggcttcgccttcgctcctccccttcgcatgtagtatacgtacacacatgccgtctcgcctcctcaattatgagctgaggcgtgtacgtgcgtactctgctgtttgctgtggactctgtacgtggtggaaggcccacagacaagctcggcaaccaattaacgtttacatgtacgtatctatagttgatcagtccagatctccatgtcgatctggaagatataattagccctggttttgttcctaaattttttttccaaaaaaatcacatcgaatctttaaacacatatatataacattaaatatagattaaaaaactaattacacagtttgtatggaaatcgcgagacaaatcttttaagcctaattagttcattattagctataagtgttacaataacccacatgtgctaatgacggcttaattaggctcaaaagattcgtcaagcggtttcaaagcgagttatgaaattagtttttccattcgtatccgaaaaccccttccgatatccgatcaaacatccgatgtgacacccaaaaattttcttttcgcgaactaaacagggccttagttgagtagtttgcataggtgttcagcgatgtggagattatgggtaccccatatccacacgacatggttatcctactaattttaggggataacttatatctatgaaatatgtaacggatcatgacttgagtattacgttttcttgtatattacggaacggcctaaagttttggtttggtaatagatttaggaaaccgataccatattggttacattttttatcttgtaatcctaccccccattctatataagacgggcaggaggccctctagggcaagatgattcacaactgatcatcagatcaatactacacctggcggattcaaatccctaaacaggagtagggtattacctctcattgagagggcctgaacctgtctaaatccttatctccgcatccatccacttttaggtctcatgcactacccctttatattgtcgaaatcttgttttgacaagcgagacgaagaaggagaagacacaattatctgagcaagtattaaaaagttgccgcaagttttttgattatataaaatatttttaaatataactatagtataattaaagtgtagttatattctaactgtattgtaactacttttttttatactagaagaacatgagttccccgtatccattgaaagaaatgcagagtttacaattgtattataactatagtataaatgcattgaaactacgctctaactacattgtaactacgatctatactcaactatgtgtcgaaacatgaattcggcaataataaaagggggtagcgtacgagacttaaaagtggatggatgcagagacaaaggatttagacaggttcaggccctctcaatgagaggtaataccctacttctatttggggatttgaatccgctgggtgaattatagatctgacgatctagttgtctcatgccccctagagggcctcctgctcaccttatataggatggggggcaggattacaagatagaaaccttatccaatacggtatcggtttcctaaatctactttacaatcttatcaaaccaggactttaggccgttccgtaatatacaaggaaacgtaatacccaagtcataatctgttacatattccatatatataagttatcccctataactagtcggataaccatgccgtgtgggtatggggtacccataatctccacagtagcccctgagaccttcacaatcgaaaagataatcttctctcgaactagattactccaaagccgagtgcttcaatcatctttgccatggtctcccgagtacttttaccaaatctgaagactgttaagggctgaaaaataaagtcaggtgcatcgactagatgcacctaataggtgtagccctcgactatgtggttaattgaacaaaccaagcatatagtcaagtaataaataatccaaccaaccgagtggcttcgataattatagtcaaccaagcgacttgatattaatatgtagcatatgcggtgtgaatccctgaataacatgatccgagtgatataccgactgttttgtaaaatatgatgagtgtaacctaaagttggctacatcattgaaaattcacatagcaaaacagctataaagaagcttatatgttgtgaataaagaaatttccaaagtattgggcatacgccatgtgcacactgctttaacagatgtgcttaagtccctagaagacacatggttccaccacacctggaaatatatggcatatgtggtataaaatccgagtaaataaactcataaaggatttaccaaccgcctggaaaatgaccaaaatatataatcagcctaagccataatattggtcaataaaagtgcacacttacgtggcaaaaagcaatgatattgtatccaatcaattgctttatgaacccaaacaacaccttgacttatataaaaaagtcagtggggagctatataaagcattactgtttggcaccttttaaaatgcattgtaccaactcctaaaaaattgagtaactgcggtataaaaggattttaaggtattgggcacataatcacgcgcacttttgcctaagcaaaaagatgcctaagtccctaaaagaacgtgacaggccacacctgaaaatatgggctgcagacatattaggtctaggccaaaaaatatgccttcgacaccctttaaaggatgacgcatgtaacatgctcctgagtaataaatctttcgggtgatatagaccaagtgtaactcatatgaatagcttctgatctgagtgattatcctttatgggatactccaaaatagatataacaattgaattccgactagcgcaagtattcggttgataacccttacggggaataataaatagtccagtctttgagcatagaaaatagacccatgatcatcaaattcatgttgcatgtatccggaacaagtccaaattgaaggtatgatacttgtgtttgaggtagtaagcccctgagtatatagcttgtccttctgtcgtagtcacaattgtccattgatggtagctgacgcggttggcatagagacaagacgaccaatatagagataatattgcccaccagaggtggcaaaaatattggtagtagtgaagatagtgataccaatcaaaagtgatgaagttgcatagccgtggaggcgaagaaaccagtcggcaacagtcaggtcagccagcaatgaatatgaaggcgcccagcgataaagttgtgtagccatggcagcgaaataatcagtcggtgacagacgatgcagctggtgaagaagatgaagatgcccattagtggcgacataataagccatccatgaaggcgaggataccggtcggtggtgacgaaagcaagccgatggtgaagatgtagacacgcatcaaaggcgatgacgaaatccaccaatcatgaagatgaagaaaatagtcggcgacgacaaatgcaaccgatagtaatgatgataagtagcaatcatagatgatcaaatataatgacgaagttgcccatcaatagcagtagagtgggctatgttgaagaggcttgacaggatgttgatgaagataacgatgtcggtgatccagtcgatagcaaccgtgaaagtgaaataataagtcggcgaagacatagttatccattagcaacagagttgatgtcagggccgatgaagcagaggtgttggtgatgatgtcagtgacaataatccatcaaattgatgttatagctgttgcagatgcttcacttgaaggaaagtagatgatgttgtccaactcgtcgaaactgagctgattggttgataactctgctctaaagcaaagacgaagataatgactcctggaattgacttgttggctgattaattgattgcttcagcttgtcgaattttgagagtcttgtatttgtgtagcccccgactctttggttagttgggaaacaactgaacatagagtcgagaactgtaacttcttgtcgtcgagtagtcattgcttgagtgaagataaatattgaagattggaacaccacttgttgtaataaaataacacggcatcatatttggtgacgtatgccaaggtgttgaaactcttgtagtcgtcatggttggtgaagtagcaaagcttgcgaagtagaggcaatagagtttgccgatgccgaagataataaaaatgaagttgctccaccatagtgacaaagttgcatagccgtgatgaagtgaacatgagttggcggcaacagaagcaaaccggtagtgaagacgcgcaattgtgaagataaaagcaccagtcggcggcgacataaccagtcgacgacggaagacgatgatgtccatcagtagtggtagctgtataaaccagacgtagaagcgagggcactagtcagcagcagacgagacgaccggcgatgaagacgataaggccaatcaacactagcagaatcatgcagccatggaagtgaagaaaccagtcggcagcagacgtaggcagcttgtgttgaagatgctgatgcctattagcggtgacggcgatgtagccagccgtgaagaagatagcatcagttagcgtcataacaggccagccgtgcaggcggtgacaccagtcggcgacggatgaggcagccggtcggtgaagcggccggtcggtgaagacgtagatgcccaacaaaggcggcataataggccagccgtgcaggcggaaacaccagtcggcggcggacgaggcgaccggtcggtgaagacgtagacgcccaacaacggcggtaataagccagccgtgtaggcgaaaacaccagtcggcggcggacgacgcggccgatcggtgaagacgtagacgcccaatagcggcggcataataggccagccgtgcaggcggaaacaccagttggtggtgcacggcggaaacaccagtcggcggcggacgaggcggccggtcggtgaagacgtagacgcccaacaacgatgacataataggctagccgtgcaagcggaaacaccagtcggcggtggacgaggcggccggtcggtgaagacgtagacgcccaacaacggtggcataaaaggccagccgtgcaggcgaaaacaccagtcggcggcgaaggaggcggccggtcggtaaagacgtagacgcccaacaacagcggcataataagccagccatgcaggcggaaacaccagtcggcggtggacgaggcggccggtcggtgaagacgtagacgcgcaacaacggtgacataataggcctgccgtgcaggcggaaacaccagctggcggcggatgaggcggccgatcggtgaagacgtagacgcccaacaacggtgacataataggccagccgtgcaggcggaaacaccagttggcacaagccggtggtgatgttctgactgatccattcctggagcgtaagagataagcttaaagccatgaatcccttttatacatatctggatctggatcctgcagaacaaacatataggatgagtagtatctgatataaatataatactcgagaaaaattcaagtattttaaaatatttataaatatgtatttcttctcttgtcaattttgatttccccgagcaaatgactcattacgtttaaacactctgcccgactagtcatagccaccaagcaccgggagtcggcctaagcacttcccaaacatgcatatgagtgacatgagttcgtcattaatggaacaaagtttcacgggtcggagtttactactcgggtacttttgcaattattaagagcagaaaataaattatcttatctctatacttttgatttattccgaataatacttagcaccttgcattattcggtccatccaacaagcccccgggtgctaggaatcggcccaaaggcaactatccattggcaaaccaaacggaaagcataggaagatggaactccataactcgataggcacttttgtactcagaatatgtcgcaagcaatcaagataaatattatgaaaattgtttaaaaaatatgatataacatctgtagcccccgactcactagtcaacggcgaaccagttgatgtagtgaggcaaaggaaaaggcaaaatatcatataaagaataaaaataaatgatgacttagctttgtcgtatttcctcggtgacagcaaaagtagccgatgtgggaacgaagcagtccatcaatggtgacaaaaacaccagtcggcgccagtggaaccaagccagtggtgtagatgatggagcccattaatggcggcgaagtccgccaaccgtataggcgaaaacaccagtaagtggcggcagaggcaggccggcggtataataggctagctgtgcaggcggaaacactagtcggcagcggtgaaggccagccggtcggtgaagacgtagacgcccatgtacggtggtgtgaccaaccaaccgtataggcgaggacaccagtcgacggacacccaacaacggcagcatataataggccagccgtgcaggcggaaacaccagtcagcggcgacgaaggcaagccggttggtgaagatgtggatgcccaacaacggcggcatagtaggccaaccgtgtaggcggagacaccagtcggcggcggcgaaggcaggccggcggtgaagtcgtagatgcccaacagcggcggcataataggccagccgtgcaggcggagacactagtcggcggcgacgaaggcaagccggtcggtgaagacgtggatgcccaacaacggcggcataataggccagccgtgtaggcggagacaccagtcagcggcggcgaaggcaggccggcggtgaagtcgtagatgcccaacagcggcggcataataggccagccgtgcaggcggtgacaccagtcggcggcaacgaaggcaagccggtcggtgaagacgtagacgcccaacaacgacggcgtgaccaaccaaccgtataggcgaggctgatttgcatgtagattcgtctctctgattttgttgacattatgggcttggtgcagctaaccggccttagaggttgcgtgtggcatgagcaaacgctacatcggtagtcgagccacgcactatgtcctggtgtacccctctcggcaacatggtagcagtgggaagcattgcaccgacggccgtacatgcaataaaaaatcatgagaagattagtatacgttagtaattaatctaaatatataaattacaaggaggttaggaaccggcagcacagccaaatcccatcactcattaaggaacgattttttgatctcgattgccatcctgtgcatgcgaccaaccatcgctccagtatacatgcaaaacaaacagatatagtttgattagccttaaaatattacacgcttaattgtgtaatgcatatatcaagctagggtttgatattaacccgtgcatatcagttgatcaacacatgcacgtgaagcactcagtcgctgttgatcccatggacatgaattgtccccgtgtcgtatgaaggttacgccggcacctgtacagatcgtaccaggcgacgagcagacacaccgggacttcgtctcgatctcagccggtgcgtgaaaacaagaaaaagaaaagtaatagaagattagtctgcagttagagaatgatctaactagtgaaaacgacaaagccaatgatattaattggagatcgaatcgatgaaattgccgagattgatcccttcgactggattgaatccgagacgaaaaagacatgcttgatgaatccggcgatgtcggagattggttccatcacacttgtgataggaaactcgacgaacccctacctggcgcgccaactgtcgaaacatgaattcggcaataataaaagggggtagcgcacgagacctaaaagtggatggatgcagagacaaaggatttagacaggttcaggccctctcaatgagaggtaataccctactcctgtttggggatttgaatccgccaggtgaattatagatctgacgatctagttgtctcatgccccctagagggcctcctgcccaccttatataggatgggtggcaggattacaagatagaaaccttattcaatacggtattggtttcctaaatctactttacaatcttatcaaaccagggctttaggccgttccgtaatatacaaggaaacgtaatacccaagtcataatctgttacatattccatatatataagttatccactataactagtcggataaccatgccgtgtgggtatggggtacccataatctccacactatggtttggttgtctagcacagagattgatgtgatattcacaaggggtttttttttacatatatatatatatatatatgccttgggctaggtatttttgaaggctcaatatttttgtagtcaatagaaagaggcagtcctcacgccctcttattgggaggggaaaaaagtactaattccatgtctgcgcgtttgggctcgcatcgcaggcatgcaggaatcagccggtcgtccgtcgtctcggcgagaagagcggatcgctgctctgcatgccgttgctcttatgatctgctcgatcaccagagggcagaagccatgcatgatactgtacaacgcctgctagcttagctgccggcctgccgcatgcagcattgccgccccaagaaacaccggaaaacacatagccagaccaccaaaaacgttcgtgacattccgccgcgggcatcgcggcggtgcgcggcaggcatatgcagccggggcatcatggggcatggggccgcgcgggccggcatatctcctcgccccgaaccatccgcgccgcgcgggcaattactcggttcatttttgccacgatccgcgcgcgcatcggtcggcatgggccgcgcgcgcggcgcgcgcaagcggcaacacggcaacgccgcccaccatgtcaagttggccgctcgcccgctcgacctcacgcgtatgcttcggcgcaacatgtccaattgtccgtgtacccgtcgtgtctgcttcctgatcgttacggcgtgcagcgggcgccggtcgatcaagtcgagattcgcggttgagtccgtgccgttgatctgtgttttcggtagagcacggtggtatccatgggaagaggaggaatcacgttgtacttgagtggccagattgcttgacatggtttgggccttttaagctggttgtgcttaggtaggacctctgggctgaaagggaggtgtaactaaacgggcttgcccgtggcaccaaccccacgtttttggagtcttggacttttgtttggcttgggctgagtggacgcgggatgcacgtgggctgcctctcgcaattgacctccgccagctgcgacgccacctacggaggcgcttccaccttgcagcgaagagtgtaagtggatcgatccacgaaaccattaaataaggctcggtttgattcagcttaagattattataatctaaattattaggagtaagctggaacaaacaagtagattattatgctagattattataatatataagtcagattactataatccaataatctcctttagaggagctttttccagattattgagtggctaaagacccattacccttagatgcctctaataatccaaataaacaaacaactcgtagcttatttttatgtcagcttattataatacagcttagagtaatctgatttaataatctagattacaataatcttaagctgaaacagacaggacctaagtggataaatcattaagtggattcgtggatcagctcgtttgcttgtggcattccatgtagactgagaatagagaggcagtggcggagccactttacgggcaggttgggtgaccgctcggactctatcgtcatcgtcttcattgtcaatagctgccaaaacatataaaaattaatcgatcacgggaaacactaacagtcgcctgaacttgacgacgctacatataaaaattaatcaatcacggaaacactaatagtcacctgaacttgacgacgccgctgactccgtcactgggcccatcgatgcttgtcaatgacctgtgactccaacctccgactcacaaccacaagttccccgatcagaaccgggacaagagggggacaagaggcataggggatggacttagacagcagcgcgagtaacaggagcaacgaccagaaaagcccgtgcttgattattttgagcacatgcttcttcagtaaagaggaatcagacgattcaagtggaatttttttgtaacgtatcaataagatagagctatgctgcgggttgtctcaggtcctaaataaacgcggacacttaaaaaatctgttgggtaggcggattcgcatctcttacaacccacacaatcttcggttcttggtgcggaagcaatttgcttggctttacatccatcccaaggtatcatttgtaatacatttattggacaagctcgtgcacattgagtgcatcctatacatgtatcataaatttttacggaatgtgacattagatctataattttttcctttcaacataaagattttcgacctggtcataatgaaattagttttcgttttttttataaggagtgtgggggtagtcatggccatctaggcgtgtaggatagcgttgttgtgggtgatgggctgattggggcaagggctcacgggtagagtttacaaaaccgtacgtgcggttatcatttgcgataaccttttcagtttttaaaaccacggaataactcgtggtacctgcgcggttcagctggctcgctagcttgtggactagcctgagttagcttatcttaataacgagctaaaatgctatcttggctcattacaagatggaaatgagtcgacttgagtcgagcaaactaaccaaacacgaatttttgcccggccatatgtgcaggtcatattttatccaggcacttagcattgtctagatcctcttggagattctgcagctaagagatgaaggttcgtctccactacgacacaatgacacataacttatgactctgaagtctggagcatgattcttgtgggagatgataaatcacttattcatgcgttcaaaatgacatcctcaatagcgtgatgacaaagaagtacctttttttttctttataatgggcagagaagtacttgatcctagaaaggcaaaagcacatgtaggtgggtaaagtacaaatattctaacaattgagaatttgtaagtagaggctctaatatactgtcctacttggaatatgatacagagaaaatatcacaaattttttataggagtagctagctggatgataaggtccattgcatcattccaattgtggcaatgttgaaatgactaggcaactggtcaattataaagggatagtttaggactttctgcaacttgcccctcattatgcagttgtttatagaatgagcaattatactgtctgctaagctctatcccaatttccctgttctgctctcctacttttgtaaccgaaaccaattttcccttgttatttaagttattcttcagacgactcacgtgtagatcaaaatgtcaacatggggctacgatgtcgaaagatatattaacatggaacaactcaatacaaatacaacctatattgactcaaagaatatgaccccatgtttttcatgaggcaagacaatgggattgactacacgctgtacaacaatacaacctatgcaacttactactatattatccacgtaataacctacagcctacaaattgaaatattcaaaaaacatccaattgaactttgactaaagtttctatagcttctgatccatgccaaaaacgacggatcctgcatgacatcaagaaaacaaatcagtaagttttttccttcgcgaaaacgcaaaaggattgtacgtcaatcagtaagttaaaagtatgatacggcaagtattttcactgtctgaattctcggttgtgtagagactagagagttgtcacttgtcagttaatttacctaacgttggcagtaggatggtgagagctgcaaccccgacaattttcaggggcgttccggcgatcaccatgtccttgatgctgatgtagcccgtgctgaagccgacgacgttgcccggcgagccggtgggcagcaggtaggacagctgcgcgccgacggcgccggggaccatgaggaggagcgggtgcacgccgatggacttgcccagctcggcgagcagcgggagcaccagcgtggcggtcgcgtcgtcggaggtgaactcggtgatggcgccgctgaagacgcacgccacgggcgcgatggccagcgccggcgcgccgcggaggaagccgagcccctcggagaggatgtcggtcaggccgctcgccctgaagccgtcggcgatggcgaagccggcgccgaggaggaggatgatgttccactgcagcctccggcacttgccccagtccatgagcttctcgccgtcgttcttgccgctcgggattatgaacagcagcgtcgccatcatgatctgcattgcgagccaagttgttgtcccgtgagatcatgtgacaaatcgtctctgagaaaacaaatcagaatttgttcgatccttggtgcgcttacagtgacagttccatccccaacttcgccgtggaagagtgatccccacccaggaatatcatctgtcaggctcctcgtcatccataggacaatcaaaccctgcaagaatcaattatggatacattaaaattttgtcacactataacgaacccctccatgatcgcgtcataataacgaacctgcacaaaattagttgagaagggcccaccagtgatgatgtggcaaattttaaaattttgggaactaaaatttcaggcatctcttggagaagggggtgttttataggccaaattagtttttggctgtccccaatataggatttttggggctttaattttagccctttgttggagatgctctaaccgaacactgtttccaggttgagataattgctataaccccagaaatggaaacggaacttaccccaaaaacggctagaaccatcttctctgcaaaagccataggacctgtcacaaatcaagatggacaaccgaatcagaatccattatggcaataattatcatggcactgatatttcaatgagtgccactgttatggagaaaaagaccaaaacgaggtccatttcagagttacccaggtttcaggaaatattggccgagaagctgtcagagtttcagagataaccccagaataacattgaccacgccattgatgagcactggccattgccgtgaagtaacaaacaaacagagcaagaacgagaacctaccaagcaagctgagctccctcctgagatggctcctgtccaggtaagctgagagcgccctcccggtgttcttggagcagtacaggacgcagagcgtggcccagagcgcgacgaagaggacgagcgccaatgggagcccgaacgacatccacgagctgaaggtgatgggcggctgctccgggaagtaggtggaccacatccccaccaggatgatgttcacgccggtgcccgtcagcgtcgccatcccgccgatcgccgacgcgtacacgacgccgagcaccaccgccttggagaaccgctgcacctcccgcgcgtccgcggcgctgctcgccgaggacgacgccccgtcgacgcgcgggaaccgctgcaggatccccgtcgccaccggcatcatcatcacggtgcacggtgtgttgtggatccacatgctgatgaacatggtggtgccgcagattcccagcagcagcagcggcggcttcaccgggtcgccgcagaacagcgacgtgatctgcaacaaagttcgcgggttttccttggattgttagttgcacggttcggacgaacgggcttggtaaagacgggctcgcggcgcggatcacgtacgttgagagcgaggcggcggtggatgttgtagtgctcgatggcgagcgcgaggatgaagctgccgaggacgagggagatgacgtcgtccatgtaggccttggcgacggcgtcggaggaggagatgccgaacacggggaagaggaacagcggcgccatggacgcgacggcgagcggcacggcgtcggtaatccaccacaggaacacccaggcgagcaccccgagcatgttgcgcgcggcgcggtggccgccgaggtcgacgaggccgcagatcagcgcgcacgccacggggcccgacgcgaccgccaggtacttgttggcgagcagcgacctcagcgcggcgcaggagcgccggcccgccgcgccgtcgtcgtcgtgcagcgggagcagcggcctcgtcacgtcctccgacgagctctcccagtggctgcgcctcggatccatggccggttacaaatttaacaaaaatcgttacgcgattcgcctcttccgcccgccgcgttcgacgacgactgattggttttgcgttctcgtcttctccagctgcagcgtcccaaaaagcttggcgcttttatagccggcgcgggaacagaaacagagaaactgtttgtaaaactgaaaagtacttgttgcgaacttgcggttatcaggttgtgatcaaatgatcatcgatcattcgtggcgcgtcgaatcaaggcgccacgtcagatattatttaaccaggaaaagccaaattagtaacatggaaatttttcatggctatccaacgaccagtagggagcattaatgaccttttttaattaacaagtcagcatccagataagcacggtcagcagtacaaacccgcggataagactccagccatcgactgctgatgtgtcctccgccatgctcgtgcccccatcttgaaccagcccttgagtggacgaagagctggccgaccgcggttggttggtcggacggagacggggcgacccgccgacgcacgcacggccgtctcacggcgtcgagcagctgcaattgatcacgtactactacggcgcccgggtcttatccggacatgtcgacacgatccatcggctcagacgacacggacgcttccttgcactcgctctcgcggaatcatctctagctgctgctatccacgcacgtcttgacgtgggcacacggccgcccacgccgcgcggtggcgcgcgggcgatctgcatcggcggcaccgagtgtacgagcgcgagcaacggaacagcgttggtttggttggcagcggcatgtgcacgcgtcgcggtcgcggtcgcgagggggtggcgcctccctgagatgcacccgcgcgcgcttgcggcggcgtttaatcgttttgtgtttctcgcgtgctcgcgcggcggttacaaataatttccacggttcggggggctcgaaagcgatcgatcgatctcctccgctactacgatcgatcgagcattatttgttgggcggctggtggatgcattcgcggcaagatgcacctgcacatgaggagggaggggggatcgcggcgtgtcgtggcccggaagcccaccgaagcagcaggggacgtatctctttcccgatcggtgcaggctgtctcgctataatttgttttgggtccattgcttcgttccgttacttcccctggtcgtagtagatggataatgtcatcaggtacgtacgtgtctgccatcgaacaacttactctggctggggatgagatacggatcctgttgttgcgtgagggatctcgagttacgctcctacaagcgagaggcaaatggtcactgcttactggctaaagcagtttaagcgaaaaaaaaggtctaattactggctgagagggagaaccgggaatattgactcctgctgattcatatcgtcatatcgagctcgagtcatgtagctagccgtacacgttataagcttgacttgttcagtactactctattcgcacacataaattcaggcacatgcatgcacacggctagctcacattcttctgtcgcattcctagctgcttccgtagcgcatgacgtcaaacctatagcagccgggtccggcgccgtctattgcttctctctgttcgcaatttcgcaggcgattcgatccaaaagttggttccaaccgagtcgaaacagggacagaaggtaccaaatcttccttttaacaacacgacctgtctgctaaatgaatattcggcctcaatgattgaatgtcgatctgcctctggcttgcaatcgtgtcgaaaccaacacttcgaaaataacgtctcgtggccgcgtagccgctagcttagcttgggatcgatgacgacacagagtggaacacgcgaagatttacacgaaaggcgcgcctgcctcgcattacacgtaagtagacgggacgccacacgtagacacaatcatcgttagtccgattacgcgaggacaggacacgagtaccgagtatacgtatataggagtacgacgtacgtaggtctcgattgatcggtcggcggcgacaatcatcatccagggcagccgcgatcggtggacgacgagtccgaatcgcatttctgtgcgcgcgccccggatgcggcctgcccggggtcgcgccgcgcgccgtgcacacgcgcgcgtaaaccgtttgatgatcgctgcctgcgagcaatcgagcaggagatgagcaggtttgctacgggagcgatagctcgagattccaaccaaatttcgggcgaaatcgcggctgccacgtgacgtgactagctaaggcgaggtttgcgataggatgagcacgagatcagccgatcgaccgtttcacggtaacgggtttattaaccggtgactagtcttttctcgtacgtgtgtgtggtcttcagattccgtgttagaaatcacatactatgttgcttatgtttggtgacggcctgactgaccaatgatcacaaccacacgttttttatttctgtattttcaatgtctgtcatgatcaaaccccttccgtgtggaaattctgtgtcttgtactcttgtttgttctagagaaaaagaaaaaaaaaactttgtgagctagaaccgagagagagagagagaggaagatcagaagttcagaacatcttatcggagcgtcttcatttcattggattgtgttaggccgaatcagtaaaggcccaatccgtcaccaggttggatttgtgaggttttccatacctgaagccgaaaaggaccaattagactcagttcaaaggaaaaagtttactttaagtctctcaatttgtcacacaagtttgaaatttggacagtgattttggctgacgtggcgcctatgtgaatggtttaacttgttcattgtcccacttgacgttgacgtggcactacaattgagattaaaaaattaaaataaaatatatgggcccaaaagccagtcaaataaaacaaaatttataatgggacccagatgtcggtgggtcccacttcctccaccttgcccctctctcctctccatcccctcctcctccctttgcttccaaattccaagtgagtgtgcggcgacggcggccggcatgcaaggcagcagcggcaaatgaggtgagtcccgtcaaacatcctttacatggaccaaaataaacaacccatataaggcccatattacacgtcgatgatgtattctgtttctcaggcccaacaaaggacagtcttggacgtcgtaattttttttttccaaacgaaccgcatagggaagtttcgggcgttataataattttccaaacgagccgcataagagagtacgatattttatatatattgatagagtaagaaaaaattataaaaccatagcccaaacgaactacactctacgcgcctacatcgcaaactgtcggagcaaggaactcctctagtgggaaggctagacacccttccttgagagttcggccagagtgcaagcatccgtgctcatgcttaggtcgtgcgagagtacatggacacatgatttatacaggttcggatcgctgggaagcataatactctactcctatggttctaggactatatgatggagtttacaatgagttattggtgttgttttaagtgggagagtatcaacccttcttcactataatgtggctagaatctaacttaatcagaatgaatcaaactgattgaaccggaattagaaaaaaaaattctcaatggcatggatcctcctttcatacatcaaggggattttacatcgtccatgcatacaataaaaaacggaccccaactccgcaggagatggtaagcttagtcttgtcgctgtccctccaagcaagctaaccggatgtaacatgttcacctatcatctatgtaacatcctggtccaattagaatttatcttgtgtgacccatgagagctgtgtgcgcatgtttagtaccaccttactggtttagcaagggtggaaccaacttataaggcttcttccctccaaccatacaactctcgggttaacccttttacacgaatcgagtatgaaagtgtaagtgggcccacacgtcagatgggctggttacgcggttctagagagagtgttgttacaacctaacaagtggagcagggtagatgaagtcttcgtcccaactgccaatgggccctctcgttagccactaaggctgataaagggtgggccacatcgggtgagcaaggagcatgcgtcgcgtcgcccaccttttctccagggcaacgtgggcaagcgaggggatgcaattatgatagggcaaggctacacacatgaccgaatcaaatctccttgatgatgtagattcatctagagagacatcaggcctcgatgccaacctcgggtccctatcctacttgcagtggtttcgtgaacggaagctagcttggccccgagctaatgttgacatcgagtcaccttctttggcacttgggtccctacattagtccttgccttgaccatcgtgtgccccgtagtgccccaagcagctgatggagtgggaagccttgtttccacttatccgacacaagcacacaaacaataatcaggagcatgacatcccaacacactcaactcaagcacacattgttaaacaataatcaggagcatgacatcccaatacactcaacttcatctatgcctttgggtttatcgggaagaggacgagacagaagaatgaatctgctatctctcgcgaggcgtgcaaaaatgtggtcatcttgtgatggcaagggcgttgcgacaagaggagaatccatctaaggtggctaatggaccttcaaaaaaacacctctagggaggttgcaccgccggaaaacatgggttatttttccccatcttgcgcgcctggcgatgtttttttttctaattatcttgtataatctaggttatagtagaaaaacatacagtataaattttgaaagttatgttgcaaaatttactatgtaattacaatattactgtacgtaatctataatgtaaaaaatgtacaatttttctttttataaaatatgacgttgtaaacataaaaaaatgtgacatcataaatatagtcccatacggcaaacaagcaaaataccatgatatgccaactttcaagataaatttcactggtgtgaagtgaatggttccaaatcaaatcatatatttgcctgcttttaaaaatgctacatatacaaactatctaaaactaaggttaatactaagaaattattgcagtacttataaatcagacacattgaaaaatttcatggggctcggtgggacatgctacgtagaaagggttgcttgtttctggtttagaaaagataaagtttgtgtttctccatatccggataccaacaaaaagaacagggtagggtactgcacctctggttggccatcttcttgatcgttgtgcgcaactaaccccctgatcaaatcttattttttggaaggggtctgcacttccccgctaccggagaatcgccactccgacggccaactttgaagataaatttcacaggtgtcaagtgaatggttccaaatcaaatcatatctttgtctgcttttaaaaataccacgatatgccaacttcttgacactttgaccgttaatactaaaaaattattaccagtactacttctaaaatggacacatttaaaaatttcgtcaacataacatgataaaaattttaatcgaagtcgtgcattagagttctataaaaacaaatcttgcattagacacagtgaaagtccaaaaggacttgtttatgaacttgtggagtaagtacatgatttttagtcattgggccgaagatttgaagcacctgcctaattgaaaagcaagcagcaaccttatgccggatatgtacacaaagtgatcgctatttgtttggaagagaaaaaaaacaaataaataaaacaacctcgtatcatgagagaaagaactattccattttttttcccttcgttcagagcatatgtcgacatgtcgtgtcgtcccatggttgcaccctactactctaagcccagcgccaccagcgcctgagacttccagtgcttggccttctcgaagccattgatgctgaactcgaagtcgttgatggtcatgtcgatctcctcctcggtgttcatgacgaagggccccagctgcgccacgggctcgccgatgggctcgccggcgatgagcaggaaccggagcggcttgtccgacctgttccacacctcgacgccgtcgccctggccgagcagcagcaggtggtgcgccccggccttgtcgccgccgccgccgccgaacacgccctccccctccagcacgtacgcgaacgcgttccacgtcgcgcacaccggctgccgcgccgccgcgtgggggcggaccgtgaagtccaggtacatggtcggcgtccgcgtgcgcaccggcgaccgggcgcccatcgactgcccggcgatcacccgcaccgtcacgccgtccgacgtcgtgctcgcgatgtccttgctctgtatctcctggtaccccggctcgatcctgcacgcaccacacgcgtgtcaaaccaccatgccaatgcagcgacacgacatccgagagtggggaaaaaaaacgaaggagatgacaaggacgggtcgtgacgcacatcttgttgtgggaggagaggttgacccagagctggaggcccctggaggtgccgggccccgccggcatctccgagtgcacgatgccgcgtccggccgtcatccactgcacgtcgccggccttgatcgtgccacggtggccctcgaagtcctcgtgcgtcacggctccctgaaaaacacccaccattcacgtcagttccaataagaacacggtcaatgcactggcctaagtagcacgtagattctgagtttaaatttttataggagtgaatttcagattaagttgtttaggctaagttcccaatttaaatggtttcatattttctgttggatgtaaagaccggattaaaaatactcctctctttttttttaaaaaaaaaagaacacggtcaatgcaaaaccaaactatcaaggccatcgtacgtcttcctgtagaaattgtttctttctatttcattttacacggcttggcttgactgatgttgggtttaggcgaagatatatattactaatcgatctgccaatgatgagttcaaggtgtgaagcagagttttgagcgcggaaaagtatatgcgacgcgaggtggttgacgtaggaaggctaccaaccaaaggcagagcaaggcaacagggcccgtttggatgggttagattcttcaatttgacggaaagaaacgttctgaatttgctaaaaactactactccgtatcagcctatcaggtttgcgttgttgacaaatgaaacgcgtttaattcgtttctgctgatccgtgtgatgtggttgtcaaaagacgctgctgtctgtacgtatcactggggattaagcaaggaattttcatggccgctctatatgcagttggatgttctactaccgacgaacagaatgtgaactgtggtaaaagactctgcctacctcgagcatgtaagtgacggtctcgaaacctctgtgtggatggtcagggaacccagccggagcagacactgcacaggattcgatcaagaagacgatcaaaaaatgcaaatctctatcactctaaaccagatgatcaaaaccgagccagaagcaattcactcacctgagaactcgtccaggacgaggaacggatcgaagtacctcagctcaaacctcccgatgctccggcgaacgacggcgccgacgccctcgtgctgcggccgcgccaggaacttccgcaccacctgccggggcttctccatcgacgtcgtcatatatagtactaccagttaccacctttgccgtcgccggcgaacgatcgacttgatcagaaattcagaattcaagaacacctcgacgaccctttcttcttcctccgacctcccttgccggcgatgcctatggtttgtagtagggtatggtggtttggtttggggcctattttcttcctctttatatagcggcaacacacctcgattccgttacgccccgatacgccgccgccgctgctgctgctgctgcttcccggggtcaaaagcgacagatggtttcttggcgttttttcctctctccgctacggggaaatatatataaaagctcgccgcatagctcgcgctctcaacagaaaaagtgtttcctttcgaaacgctgtgccagctgctgcagctgttgcggccggcggcggtcacgctgacgccatgcgcacgcaagccgctagccctagcgcccccgtcgcgctcgggctctgcatacgtgtgccttgtgacagcgtcgcatcagcacgcgggggtggacgggtggtgacaggtgagtgaatggaagaccgaatggtgattgggtgatcagcgaactaacgcctcgctatcaaaacgccacgtttactggcttactgccgtgatggttcagctgcttttcatcttatttaccgaattattaaaacagatataactcattattgaaacaaattgtttttctgttgcattatttagactgtttgatttaagttatttatactaaattaattttataatattcaatttgtatctacaaccaagtcaatcatccgccgtaataatcctaatccgcccagtaatttaagtcaaaggagtcttttatttagtagtaactctatcgtggtgtttgagatatattaaaatgaagatgaagtcagcataagacgagaaagtcattttgatattttaaagtagaaagttttgtaagaaatatcatttagcagtttaaaaaacgtgctaaaaattgagaaaaaatgggtgaaaatggagcggattcggacggatggccttcataccatatcctaaaccatattttttaagcggattcggagcgggtgcggatagtgtacggatgcggatgcgaatgcggagcggattgtttcggatgtcggaaatggtgcggagctggtgtggaatcggttcggaaacggattaaatttatcgggtgttacatgtatatgcaatcaatacaacatcgagttagcaatacaaggaacaataatacaatagttaataaatgacccattgtaataattatgtacttaagtgctgaacaacataaatacattatgtctataatataaaaatatagctacgcaagtgtgacacgagacaatgaaagccttaggctaataaatctaggttaattgataaattaggtcattggatgaaccaacttatattatatgcaatatatagagtggttacatttgttgataattttggattatctgacaaacggcctatcggataatccgatagaaatgtcggataatccacattcgctggatttctaaaagtgcataccatatcctcgtttcggactgattcgcccctagatcataaaatctactatcttaataaaggaatagggactataaattaccacatggtaaaaattaagggcccctttgaatcaaaggaattatgaagaattttcataggattgaaatcctataagaaattttcctatgtagctctttgatttaaagaattgaagtttcccaaatcctacaaaattcctatggaatggcttattgcatataggttttagaagaaacttagcaagaggtccaacctcttggtaaaaatcctttgagtatatctctcttatccgattcatgtgtttttcatgtgatccaatcaaacaaacattgttgtgtttttcctatgttttgcaatcctctattttatacttgcatttctatcataattctatgttttttctattcctccgttttttcattcttacgattcaaatgggccaaaaaggagttttcattttgcgggcgtgaggttaattaatttttagtatttgggaggaaacggggcagagaagacaagatcatggccctgaggtatttttaccttccaagcgacggctccatgatcctcaattcagttcatggctctgacgtcgaaaggtaagatttttcacttggctgcaggctggtgataacatgacgtcaatgtgagctcactccctctccctctgacctctcacctctcttcgccttcgtggtgctttcgcctaatcaccatgtgcctatgatacgtatcatccacaaagccaagcgttgacctcgtggataccgtcctgatcaaatcattaaaaatcccattaatgagcaggttctaaacgccaagttctgtagtactaatgcgcaggccggccggtgaaatatctaactgaattgtgcagggtccattacatctttttttttataaagcttatgacctaattgagccttaaagtggggaacagaaactataattagtagccggtagaacccttcttttctggccaccaaacggccccgcccacagattaattagtcatgtctacttcctttacaacatcctggtgaacttaatctacgggcagagaaaaaagcagccatgaaaagacaccgattaggagatatctcggaggattttgattggaacgtgtaaaaatatcgccacaccgtcaagaggcaagagcccacaatcttgtgctgtacacaaaatcaatattttgactgcagattgccccattttttgaactcaaaataaaaaaacagcttggaaggtgatcgcaaacatgcctcgatgtgacgccatctgccggaccatgacgaaatggagtggacaattggcaaattggcaaagaaactagctttcctggagacgaaaatgaaatgtaattcggtgggcaaagttgatcaaagtatatagtacgtgttcttatcagcttacccgataggcaaagagtcttgacgtatccatgagtcatgcctacgttctcagcttcttatgcttggatgcaagaccaaatagaagaaattaaattggtacttgcagagaaaaataatgcgaaaggagagaggagaatcgtaaccacccaacaagtcactttcattcagggagtcccacatactcctcatatcttgttttggatcaataagcaccctgcaagtagtttccttgtgttatcttgtctcctctggcaattttatcatttcacctttttttatcctatcatttgtggccattttattttccaacctgacacatgactctgtttgtactttgtgtaagtgctggtagcctggcatggctggattccagcccctacctctgttggaacagttaaccaaaagcccatgtaatagggaataatttatacgaaaacatcaagatatctataatacgaaagggttatatgtaaattttagtaccaccttactagttttagaagagagtaacaccactttaaaaaagattatctcttcttactacttgagctatgtgtgtgagagagaactagagaaacacacgagctcatttgtttgcctcgccttctgggatgcaggtgcaagtatatagaacctgcatgaatggttcatcaaaattggttttagttgcttgtatggacgtaagttccttttgcaattttatttactacattggagtagtgaaaaatctggatcagttacatgtgacttgattacatttcctgatttctctttaaataccgagtcatggtctccacataaatttacggtaaaaaaactagggtttgccttcatatgtactacaccatcacacgtcgtctgctccattatgctaacaagtgtgtactagcgatcgggagagcaggtctttggaatcatcgtattcgtgatactgcaacgggagagcgcaaataaggttttttgagagcatgggacgcaattggtcactgatggctgctcatccaccgcgatttgtctacatcatcacaagagcgtcgctcatcgacgtctacgtctagtactacaagtcattatcacggtacctgatatgccggttgctacgaacttcccgaactgaatcctcggcatgccgctttgactatatcgagtatatttgatttgttcgtatgtactattttatacatatgtacaatatactcatactccctccgtatcaaataagtttaattttggaatgaatggaggctatgttcatattcatgtatataagtgaacttatgagacaaaggaagtattctagttaatctatacgatgtcatcttttatttatagaacaacctatatatgcttatactatcaacggccttatcctcgagcaccatctgtatcaaggctgcatattcacaaacttcactattgatcgatcacctccacactatctgcttgggagcatgcgatcaaaaaattgtcaaaaccggaatttttagcaatgccaaacaaatttgatttccactagtttaattggtgtcgagttttttttgtcacattctatttagattggctctctacttcattttgtggataaaccttacatgtctgctctttgacaacatgtttctaatttgtttggtatccatgtgtaactataaccctacaccttattgttgctaggcgtgccaacattaattgttaggtgcaccgatgcttgctaatatctgatgctggtgtacgtaggatgagtatgaaaaccaccatggatgaatgcaggcttgcaagtgtggaaatgtaggaaaatggaggtagtggcaagacccaaggtcccaagaaagagtaattttatggttcttgagaaggtaccataaggtaccaaaaatttaatgtaaaatttagtacatcatatttcctagctactaaattacaatagaaaaaatggtaccttattatacctcctaaatacctccttaaggaatgtaaaattactctccaagaaaaccacctataggatatagttgaaccaaatatacactagagggacgtcgaatgaacaatataatctctagaggtttttagattttctcctatcatgaaaatgatgaggtgaaacatcaatatctactaatcatatgtctttcttctgccaaaacatggcgatatagtgactaattagcttacttaaaagggtaacagctagcagtgttatttttttagagacaaagacattatgtatgccacttttgccactttatgattggagttaagcttgatccgtaatactccctccttcccacgccgttgacatttttaaacatgtttgactgttcgtcttattcaaaaacatttgtgaaatgtgtaaaactatatgtatacataaaaagtatatttaacaataaatcaaatgatagaaaaagaattaataattacttaatttttttaaataagacgaacagtcaaacatttttaaaaaagtcaatggcgtcaaacattttaggatggagggagtatacacatggcggttccggacatagctatttcgagttgttggttttgagtgatgcgggattgaaagcgttggtgagggcatgagcatcactgcatcagcacgtcatgcatatgtgaggatattaggcagccaacaaagttttttttttgtcatttgtcagagaccccctataatcttgtggattgtggattttgaagcacgaaacgcacagcaaatcctacgattagaagttttcaaggttttagccccaatttcccatcgaataccatttagcaattcctttttttatgccatttcctgaaagcactctggacaaatttattactccactcataaaaagaaccactacctccgttcaattagaacattggttagtttaatttgaactaactaatttttaactaataaagtatgaactaacaagcgtcaaacaaaaagaaaaggaggaaatattattttaggttaaagatttatctcaaaaaaactatgtttttagaacgggttcagtagacctctatagtacaaccttaatttccttctcgttttagacattgaaccaatagtatctactcctcctcatttttttttcatgtcccccttttatctctttaatagcatctccaacagcatctctaaattcaactctacaaatgcctatttagccagtttgctaaagagttggagagtcaaatttgtatttcactccaacagtctctcggttaccttctccaattttaatactgggttccacatgccaatctctgtcattcttcatctctcttcacgtcattccatttccccactcttttcctttccccacccacccgctggtggatgcgcaggtgatggcgtggcggctgctgctgctgctcgaggcaagggggctcacagcgatgattggcggcagcggcagcggtgatgtagatggcgccgcaccgctctaggaggcccccggcccacgcagtgtccgcgtggaacccctcagccgcgccgactacggcctccatgtcacgggcaacgtccggcgggagcttctggaggtccgcgaacaaagggtcatcctcctcgccatcaccaccgccgtcagcatgggaggaatcgattgggacttgcgattcgtcttcctcattgtgtgcgtcacgatttcgccttttgcggtggcaacggcttgtgcgtgaaccgtgacacagcgatgacaacgatgactgccgcggcggacgatggctagacgacgacagccgcggcgggtggtggcccagacattggtggcgcgctcgtggccgacgtgctctccaattcgcccccggccgatgcgctcaagttgctgccttgctggtgggtggacgacagagagaggaaggattagactaggagtggtggtgggacccacctttggccagtggaggaagctggctacatttggtcagctggaggagcaatttggcatccgaatctggatggagagtctgttggagcttgttttttctctatattggttaaattttaacttggagagccaaatagacattctattggagatgctctaataagggcatggtaatctcttttagccccttgcttaattagtctttgactaggtaatagcggagcaagatcaaatgagtataacacagataacaatattatggttgttggtcgtgtactcctgttggtagattagactgtctgtttaactaaagaaccgacaagaagattaaacatgataacagaggaagaaaaccttgataaatcgtaattcagaaactgaatcgtgaattagtagttaggatataagaggttgctcataattgttttttgtgacttgtgagcccatccatcaatcacccaggagagaaactaatttcctgcctgtgacgaaacatggaatggaaagccacgaacattgtggcttttaggataaacacgcatgacgcccaaacacctcatgtttagccgtctttgccgccttgacgccgacggccgatatctttgtgtggagccggatcggagtgacggcgagcgtcatgcatcaatgcgcacattccattcctggttacactttcatcaaatcaaatcctctccttgatcaccgccggcatgtacgtacgtgtcggccttacctcacgcctgcgatcgattctgcgatgccttaataccttctcgtgtcctttgctgctgcaagctagcctggcatactaccgcgctggaaagccgtcgggatcggccggaccacacccgatcggtttcggcgacggcgacgattcggcaccgtatatccgcgcagatcgatcgatggaatcgacgctgggaatgggcaaagcgcgagggtgaacgaaaggtaagacgtactcgagctcgagttacggttggttggttggtttggtactttggtttccgcccgcccgcccgccgcccgcacgcacccgcagcgtcacgttgcgtcgccgtcgcgcgggcagcgtctgtgcggcgcccacgcagacgcggcttcgtggacggacgcgaggtgcgcgcgagcggctactgccgcggtaaaacggtgggttgcccctgggtgccgtctcgggccgcgtgaggagaaggttgggctgcggtttgtggttttggggcctttgacgaggggagacgagctcgcgggctgcagctcgaaggagattttttgtgcgggaatgctaggggtacgccggatggaccggagaaggcaaagtcgcagactgcacgtactacgtggggatggtggggaggtgaaaccgctagaaatgtggagatcgcgggccgttaatgggctgggtcgattgtcctcaatttgtgggtgggctccttgttgcggaatgctaaagtttcaggcgaaagtgtcgttaaaatcttgggctcagggcctgttcactttgaaaccattttcaaccttatcaaattttggtaaagttaaaaaaaaagtggctacatttagtttgctgtcaaattttggtaactatataagaaatcctaccaaaattttggcaagttgccaaaagttttttatttggcatcaaaatgaacaggcccttggtttggtttttatttggttccagagttttcccttttagaaaattttatatttagttactcaattatagtgttggtctgatcgttgtctctcaactatgaaatcgttcactttttgattcattaacgctcaaaatcttctacatatcatccttgtgtctatacctggatggttttttgatgactcctgctttttgaatccacatggattagtaacgaggacatcaacatagtgataaataattaaaaaaagaaatagtaagaaaaaaattgaaggaaatactacaatctacatttcaaccctgtcccaattccttcttttccccatatcttattttaaattgctaggatgccccgtggcaccacgttacgggaaaaaccacgtttgcttaggatctacggtaaaatatgaatggttttgagtgttaagagatgacttcgtatttaagtgaaaaaaaatcaaggctatagttgaacgagtactaaatgtggacttttctctctatttttgcttttatgtattagaacaaaaactttatctttgacctttttttcggctgaaaagctactggcctgtaaaccacgatggtaaaaggctagctaaaaatattaagttgaaatgttaaatttgtagctttcgatatgaagcatttacgcattaatttatttgttgcttaaggatgtaaagcctttcgcaatactataaatatatgatgtagccctattttatctagtagcaagttagaagttaattagggactcgtacaaatatatgttttcgtttcgtccattcaacaaaaatgttgttacgagatcacattttattcttgtgaaattacctacaatcttggtctaaacacattttttaagtagattagaagctctaaaactttttaaaagaaaaacttatttagtaaaatcagacgactaaacaacatcataatataggggacccctttcacactgtatataacataaatacagctctatggcgtatgacgtaagcggataagttagacgacttattaggtagaaccttcactatggggaaccaactgttttttttaatgaacgagtttgactgtcctacacgagacgaaaactaaaaacatattcttagccatcgataaggcatcacatcgaggtatctccttacctaccgccgtgaacgatgaagggagacactacccaaatcgcactaacctgcgttcttttcacatatgaaatgatctctctcattccgggtaaaacatataaacgcgtagcacaccaccccctttctctcttaaacggcgagaagatggcaacggggtttcagttaatggacccgtcctttcaggaattcgtcacttgctcaatcgtacaaatgtggtccgtttaggttgatgccttgagacaaaatgtacttgattagcgattgatgtgaggcaagcaagcgaaaaatgctcactggaatatatcgtagagaaatctcctaacagcatctccagcagaaacactaaatataacccctaaacagattttgggtgttgagactaaaaaaactcaatccagcagagcccctatcaaggatcctaaattaggtaggcacccaaataacctttcctagcccccagtctcaggggctctactgcacagcccctatccacggttggaaaagcgcgggagccgcccgacgtggtcttggtccgccggcacctctcctacccagtgctcatccccggccggtgcggctcctccctgcctaccgtgtcatccctcaggtgcattcctctacccgacgctccttcccggccgacgcgtctgctgtacctggagtctcctctagcctgcaccctctgcctgaactcgatgaaaaacatggcccagtggccgagtcatgcgatggcgtcgaggcactggatgattcaagtgttgttgcaggctgcgaaattgagaaagtagtagcagggtagcactagcagctgcgattgtgggacttagaagaatgggtaaagtgatacatgcgatgtgctatgcagttttttttgttgctttgcttggttgttgcttcgtgagagaagtagctggtctattggtggatgagaagacgggaaaaatcaacacatgtgagaaaatgcatggaagcgccacaacagcagaagctcgtttcacccgagctatgaatacgtgctactaggatttgtatttccattttatttttttaaaagaatcgaatttgaattgtgaatttaaatatggttggattattatggttttatactaggagtagcgtagagtatagaactatagatttgtactttaaagtatatgttaaaatagaagatgaaatgaaataaagggcgagaaaagggattgctgctggagttaaaggtattttttaggtatttagaaaataggggaagcccccattaaatttttaggggctgtaaaataggagctattgctggagatgctctaagatccttcctcgaaaaaaaagtaatctcctaagatcgatttaggatcaatttaatgccgttatgttgataaactttgagatatcatttccatcatttcattttctttggattgcatctcattaaactactctctctgtttcatattataaaccgttttacctttttcttagtcaaacattttaaaatttgattaagtttgtagaaaaatataccaatatttctaatacaaaacaaacataatattaaaatatatccaatattaaatttaatgaaactactttggtatcgtggatgttgctaattttttttataaacttggtcaaacttgtaaaactttgactaagattaagaaaaaaatcaaatgacttataatataaaatagagggagtaacatggtatgagataccacaccatattagagaaagaaaacaataatatccaaaattgagagatgccactcattccatttcaaattataaacatttccgataaaattatactaaattattacttttgtcactaacaatctctcatttaattttgctcagtaccataatctcaacaatatttttattttttaaccatctatcatttaatatatggtattataatttttttaataactactcccccatatcataatataacaacctatccgattatatgttgctatgttatgggatcaatgaaatataatacttaaacaaaaaagtatgaattacctcccgaactatcgcggtcgtccgaattaccccctgaaccataaaccggatattcttcacccccaactatgcaaaccggacgaattacccccctcgactcaatccgcggtggttttggtctacgtggcatacacgtggcatcctagtcagcgtttttctaataaaaaattagtgaaacccgcctatcatactctcccacctgtctctcttccccactttcctctcaatctctctctcttcccctattcctctcaatctctctctgtctcatatgtacgacgagttggtggccggcgctagatgcggcggcggggaaggaggggggggcgaagagcgccgtcgccctcgcgcaccaccgggagcagctccagctccacgcgcgccacgggcacgtccgccgcccgcgcccgcagctgcctccgcagtcacctccgttccgccgcctgcccctgtgcgtcgcgcccgtagtcgcctctgctcggctatcgccgcgataccgccgcccgccccagtgctccgcgcccgccgccgccgtccaccgtccgccgcctgccctcgtgctccgcgcccgcagccgccgtccgccgtccgtcgccgccccgtgcgccgcgccggccaccaactcgctggccacatctgatacagagagagattgagaggaagagggaaagattgagagattaagaggaaagtggggaagagagaggtgggagagtatgacaggcaggtcccaccatttttttattagaaaaatgctgactgggatgccacgtgtatgccacgtagaccaaaactaccgcggattgggtcgagggaggggggtaattcatctggtttgtatagttgggggtgaagaatgtccgattttgtggtttagggggtaattcggacgaccgtgatagttcgggagggtaattcgtactttttccatacttaaaacctataaatagttatatttaggaacagggagtatatggtatatgccagcacagattagattacagaaggataataataataatctctatgctgtgaggggccaacggattaaaaagcacgacgaatccagcgggcaacgagccgatgactggttcgcgcgcgcgcggcggtgagccggtgacgacacacggcgccgctggacgcgacgcgatgcggggcaaaccaacccacgcggcggtaaagcgtgcagaaaacgccccagagaaaaaaaaaaggtagaaaaaaacaaaacggcaaaagcaatcgaaggagagaatggcaaggtgagctccttggttgtttcacactcccaacctcctcgtcccccttcccctcgttttcccccaaattccgctcctaaaccctccctctcctctcactccggccgcgattctcccgccgccccggcgatggtcccgatctaagcatgtccgacgccgacggcttcggttgcgagcaccgccgaccctccaagcgccgccgcgacgggcccgatcatgccctcctcccggtgtcccgagaggtgctgatgggccaccccgatgaccccgccgccgccgccgccgccgtgggggcggaatcctcctcggcctcgtcatacctcggggttgtggcggccgccgcgtccgcctccgcctccgcggcggggggtttctcctgcggggcccacttcttcgtgcgggccaccgactcgaggaccgtgtcgatgcacgcggcgtggggggacaccgtgggcgccgtgctcgcgcacctcgccgaccgggggtacggccgcgacctccgcctcgtctacgccgggaggcagctcgcgccggagaccgccctcgccgacctccgcctcccgccggactccacgctgcacctcctctcccgcctccgctccaccccctacccggacgcgtggcagctcgcttcctacatcgcctccaccgccgccgccgccaagtccgaccccgcccacaccagctccgccgccaacatcaacgagctcgtcaaggagttcatcctctgcgcgcaccgagccaacatgcggcagcgccatgatcgcgactcccccctcttcgatgcccaacccacgggggaccacgcggcgcagtacctcgagattttccgccaggcgggcgcccccttcgcgctggttcgcctctacgccgctaatccctcctccgcctcccaccatcacgcggagaacgccatcaaatgcttcctcaccatggatccttcggccttgccacccgacgtgctgccggtcatggcgccggtgctgcttgaattttgcgggttgctctctttttctgtgggcaagagggatgaactctatatatcatcccgttctatgcttgcaacagtgctcagcttgccttctgggcttcccccttgcatcaagtcaccttccaagctgatcgagcaggtccttccgtttgctgaagaaatagtgggagtggttatggacgaacttgcatcactggatatgactgtgtcatccaaaaaccttgaagacctctcaaatttctttaaagtgctgcgccagcaggcactccgttgggttcccaatggggggccattgcccaagaatctgtataacagtgagcgtgggcataatgacacgtgggtgtggaagttgcacgaaatgtcaatgaacttattgaacagggtggatgagtgcttgaagaggttggaaatggatctgtccttgtcatcggagaacagaggggtcaatataagtcaatctcgatgggttgcccggtcacatatgctggtcatgctgacacaactagattttatatcgatgatttatgaggatttggcacataacctacggcttgtgttgctggcacacagagatcctctcaatgccctcgtgcgctgttccaagaggaatgagcatctccactggcttgtgaagcataaagacctcctttgctttgaatcaagaaggaatttagtcttgatgatgctacctgagggaaaggatgaatacggggagcttcatgagatgttgattgatcggcaacacttattggacgagtcctttgaatacattatacaggccagacccagtgagcttcgcagtgggctatttatggagtttaagaatgaggaagcgacaggccctggagttctgagggaatggttctgcatggtgtgtcaagctcttttcagcccgcagcaagttctcttctcgccttgtcctagtgatcgacagaggttcttcttgaacggaagtaagtttcctcatccccagtattaaattatcacttaagaccctgttcttatgttatggcactatgatcatacatcttgaaagaaaaatcctgaatcgaataagctaatgatgacttgagggtggatccagtaattggcatgcatggtataatagaaaacaaaatatcttggctagtatttctttttgaacttaagttggcctagtattagtaaaggcttacctttgcttgtctacttggttcagcacctctttttgttttttcttttgataaaacttggttcaatactgcactaatgagatgctgccactttttatttgcgaatttatactacgatgctatgacaagctgttttccacttgtatgttctggcacttagtaatctggaatgcaatgtgtcattggcaccgcacattatacacacaaattttggtggactggagaaattttgtttgagcaaccattgctaatctccagttatataagtagccaaccacacaccagagcagttcctgccagggcatcgagaaccacccattctggtggtgtgaattgtcatggctgtttctctgtagactgttggtgcccagacctatgtggaagttggtactcaccatacctgtggaaaactttgctttgtagatttccttccattgcaagtctgtagtgaagtttaacgtgcatggaatgagaaatagtgaatcattagttggtcagctgcaatatatgctcattcctcattgagactttccaaacagtccaacatatcaaggctatgctaacagttttgtggatatcatccttgccaactggatcagaaagttccgatgaacaaccttcaagatgaaaagtatcaccgcagttgttggaaattgtgtcacactgttaaaggagctctgggaaatgcagtgagcctgtgacacagctgcacaaccatagacttccccaatgtgtctcttatgtgcacaagggacaaatggaataggtacatagatattaagatgagtttctattttatgctgctaacgaaaatgctaatttccaacttttggtctacaagctgataaataaaagctggcttatttgataagcctaagcttggccagagaggtaacgtgacactgttaggttgaaagtgaggcatgcttcatgcaaaaaggaggataagtccttgctggcacaatatgcaattagtatgttatcttgaaaagttctatgagaataccataatttttagcttggcagtttattctagctgtagctgtttgagccattttcacttttcttaattatatttaattgattcttatatattcattattcatgatacagctgatgtctacaagtatgttcactgaatgtctgaatctcttctaatttttttatgcttattgtatgttgcagcatctgctgtggatccactgcacctgaaatacttcatattttcaggacgaataattggattagcattgatgcatagagttcaagtagggatcacattggaccgcacattattcttgcatcttgctgggagaagtattaaattggaagatatttctgctgcagaccctgtcatgtatgcaagctgtaaaagaattttagagatggatgctgctgttgttgatggtcttgaactaacattttcccgagatgttcatgaattagggtctcgaaggactattgagctttgctcaggagggaaggatctccatgtaaatatcaggaacagagagctttatattgaccttcttattaagagtaccttcgtggattccatatcagttcagttaacccatttcgtgcgcggatttagtgacattctagttgatccggaactccagaaagtattttttgagtttttggatctagaagacttcgacggaatgctagggggaagcaacaaaactataaatctggaagattggaaattacatactcaatataacggctacaaagaaaaagatcgccagattatctggttctggaaggtatgccatgtaacattgtacaaatgcattcaaccatgattttttcttcatcagttttatatcatgatattatttgattactttgctcattgtaagaaatgagggctttgaatgcatgttagacttatgggggaaaatgctgctattatcattgaagaccaataaggagtttgaatgtgggccatatcattttcatgtttttctgttcacaatctcaacagattctgaaaccttaacctgtaagatttcaaacggcgccaaaaatattaagccactttgtcctgtagtcttgttcaggttatattgtgggatcatgtggagtcttattatggtcttttttgttcacaaatgccatatcttgaaatttgaacctgtaggcatcaaatggaataaaaaatgttattactttctgaaaagtaaatgaaactaaggttaaatcttgtttgtctctttggtgttttaacattgaagctgtttcaacgtgatccttgtatttgtcactgttttgatgacaactgtttgtgttttttttttctttcactttactggtccggcgctgttgtatacctataagttgaggtcaatcgatgatatcctatgctgggttttctgtcaagtctcagttaaccatagacgtgggtttttctctaccttacagcaccaatattattttatcttctaggagctgtacaacaaccactctttccaatttcatggaacttctgttacttgatacaattgttgttgctcctttgtgtgaaatgctgagaacaatgaaacaattttcttaacttagttccgcatcaatctggggttccataacccagagcttgtgctgctgccaatattagctatggagtagcatattaaatacagtggaatgagtaggtaataaagtatagtggcaactattgcactttgtcatcgtttttacactgaggcctggtttagttcccaactttttcttcaaacttccaacttccatcacatcaaaactttcctacaaacataaacttccaacttttccgtcacatcattccaatttcaatcaaacttccaattttggtgtgaactaaacacaccctgacataaaatcaaatacgctccttaaatcttgcatgcacttttctagaatttcaatagaaacttactttgtagacttatctagcataaccatacacttatctagcataaccattgtgtgtttccgattgatttggtgtatgcttgataagaattaagaaaacttgtttattcacactgcaggctgttgagagcttgtcaattgagcaacagaggcagctgctgttcttttggacttcagttaaatatttaccctcagatggttttggtgggctggcctcaaaactgtacatatataaggtatctgagtcagctgaccgtctcccatcgtcacatacctgcttttaccggctctgcctgcctgcttatccatccttgaaagtgacgagaaaccagctgcagaagatcacacaagagcatgtgagctgtagctttggcacatggtagatgccgcccttatggtaatccaatatggtaaattctgtacatacccaagttagtgtcgatttacctgcctcaattgaagctagaaattaaaagcaataggctatcttttgtttgttttgtacatatttaaagtgttctgggccatttaatctagttaggcataatcagaagagagcaggttcctttcattctccctcttttgaaccaggcttccatttttcatatactttctggagaagtgtggtgggagcatttgcatcgtgctatgctcacaagctctggaagccagttaaggcttaaaccatgtcataaaggtaattgcaacgtgtagtagccatgtggcttggtgttcctggtggagctgaaattctgcatagagtcgagtagagttaaagtgatcatctgtttgtgaatctggacaaaatcggtcactgaaactttgaaggtatgcgactctgctaatgtgaagttaaaactcggatatgctttgctgtttagtaccagcaggcagcagaaattttctgggaatcagccagaaaccggtgtctcagcagctgacaagtgatatggaccatactctgcctgaacatatggattccaacgatgtctttggtatatgaatcacaattatatgttgacaactacacccggtggaatcggatgcctagttgatgtgtattcacacctttcaaatgttttgcatctgtgagagaaattccataccaaatcccgctgaaactctggcaaatttccacgggatgcttgtgcacggttgcacctacagtttctccacctttgcgagccgccgatggagagatcattgctgcactctaatcatctatcctctgattcattttgatttcactcatcttcctcccctcttcaacattttgtacaaccaatgaaatgcagttacttggcagcgctgaaacacaaatgccgaatagttttgatatgacgcaattgcctcataattctgacatgacacttgcattgatccccctgtgatttcttctgtggaacctttgagaggtgaatctgaatcatttctatcctcaatgaaattggcagagctcctgcatttccccctaaaaaaaaaacacttgcattgatcaccttagcttatcacagagcaagagctgattgcatgggattaatgtacaaacatcatgatgccatccttaaataggtactccaccgtactaaagtaaatcaactcctaactataggtatgcccaaagctagaatttaattccttttggacggaaggagtagggttcacgatcaagggcccctttgattcatgaacccggaaatgagctattcttgtgaaaacccaataaaattcccatatttcaaataaggcccatttttatatgtggagaaaatcataggattttttggatttcaatcctatataaaaaaagtaggaagtcgtttatttcccaatcattttcattgaaattcgtaggatatcctaagactttggagaaaagtttaaagaagcttcaacatgtctcttatccgattaatgcatttttcatgttgtctactcaaacaatcattcttgtatgttttgagcttatccttcctatttctctatttttttcaatcccgtgtttaaaaagagacctaaacatgaagtatttatggagctcgatttatcttaagatatcatacgcatacactgccaccattgctggtcgcttcgctttcgacatttcggtaggttcaccgacggcgagaaatgattgacacatgcacatcaacggatgagatcgggcacacaaagcacagtgataatgtactctcagaacgtgacacacccatatatacacgacgaaccgatcaaaacaacaacacacaagacggtaggttcaccgacggcgagaaatggttggcacacggccatgaacggctgagatcgcacacacatagagacagacaatgtactctcagaaacgcacccattacacgatgaaaaccaatcaaacacgaaaaaaaaaaagcacaaaagaccgacaaacaacgcctgcgacgacggaggcatgtgggggccagagaggggcaccgcgtcactgacgctgggccccaccgccctcgatgacaaactcttttatttagccccacgtcacgcgtacccacacacacctacggagtcgagtactaccactccagctcactcaactcatcactcgctacacgcacacgtacgtacaactccggcgagtcgccggcggcggcggcgcgcgcgggccatgcatgtactccacggtgtacgacgacggcgagccagccttccccggcatgcactcactcgctggccttctcggcctccggctccgcgaccggcgccgcctcctccaccttcacctcctcggcggccggcgccggcgccgcctcctcctccttcacctcctcggccacctgcgccgccggctcggcctccttggcctccgcctcggcggcggcggcgggctctggcgccacctcctccttggcaggctcggcctccggctcggccggctcgggctcggcctccttcacctcctccgccgccggctcggccgcagctggctccgcctccttggtctccgccacctcggcctcggcgggcgccgcctcctcggccacagcctcggccggcgccgccggcgtctcctccttcggcgcctccacctcggcggcggcggccgccggcgtcgcctccactggcgcctcctcggccagcacggtggtcggggtctcaacctacacatcgatccgcgcgacgagatcagcacaacacgatgatcaatcaacaagatcacataattttcacatattttcctagcctaatcaataattaaccattttcaatgatgattaacaagcagatcaacgagctaattaattacctctacggtggccattgatgtcgatgaggtgtgcttactaatacaccaagaaaaaagtatatatgtgtgtgtatagtagagtggtcagctagaggagcaagagagctaaactgatcaagtgtccagctcagtttgtgtgtgtggagctttgcactgaggtggagggctatatatagtgccctcacaagggtcagaatgggaaaaacacaccatgcccaaaggattaaaataattcaggattaagctcaacttgtaactcccatccatctcatgcaaattcgtgatcaggaatctttggtacatgtactacatgtcatgcaagaatgcaaccaaaagttggccatgagtcatggcacatggaaagtgtccaaaagggtgcaacagtgcagggagtgctgtttgtttatttatttcactatattttcactaacatttgtgtgatggatcagagggatcatatcatcacagatccatataaatggcatgcatacacacacagtcactcggtacagagttgtcacagatggatcgatcagtgtgcccaagaaaagggccaagtgagagctggccaaccagctagcctggccacagtggcagcaagttggagatatagcttttgagttgtacccaggtttatctttccgacggacggtcggatcccgactctatgaatttgacaaattttgactaaattttgctcgaaagtagcagttcagttttgaatttattaaaaaaacatttggaaattgcatcaaaatatgcttttatcctgcgttgaaaccttaaaattccacggttttcagcttgtttatgtcgaaactatgaatcctagttgtactcccctgctcctaaatataagtatttcttgctatatagttgtgcataggtagaaatgcttttgtttatggacggagagggtactaactaagctgtttgtgctcagtgcatgcagggcttttaggtgtacatctcagtgttcctgcacgttctgcctgcgccccaaatcagtctgagattcgatcgagatctttaaaaattttgatcgtgtaaaaattttgatcggggagacgattgaattgattagggtttgttttgtacgagattaattagtggtggcatgaacagagacggtattgtcgggttagcgtgaggacaatgcaattggaaccagtgaatgtgcccctgaacagtggctgatgtgatttggggaattcagcttagctcacaaggtggccacctataggttgatggatatactttttagtgggttagataagatctttaattctgtttgttctgagatatggttgttattctactcaatgccttgtttgggacatgcctgataattttacaagaatcatatattgtttcatgtggcatcaaagtcttccttttcttttcattttcaagataatggaaataacttgtgcgtgatgttttgctgaagtaaatgttattaaaacgagaccaagaatgacgcgagaagtattaaaaccgatcaactatacttatttactcagagggttcattatttcttttgagtacatttttttaaacgaatcagcgagccaccaatttcattgaatagagaaggagtaaactctacagtcttctaagtacattttgaaattccccatttgatcaacactattacaactagcatcctgtgcctggttaagtggttgcatgtgtgatgcttgagagttcatcagccacaataattacagcaaatggagacctctataaactttggagttcgtcctctttgctttagacgcctttattgaaaagctagcatagaaatatgcaaagacgattgtacaacacctcaggagtagttgtccgtagatcaactttgtcttgcaaaaataaagagaaaggcaagagggatatcatcagcaagacagcgagatcagagccgtctgcagtagcactacattgccgtgggggcacaatgccacagcattgtcaccggcaaacaagcatatctagtaatgcataatggtgatgcataatgttagctgctcaaggtgtttcatctactatgccttttttctttctctcaatcgatcggcacagctcctgccataagtgttcaagaaggaaaaatgatgtttcacaaaaaaaaaaggggaggctaaataccctttgatttcatacataccaaaatccagatcacgatttcgcttaacttatctaagatgatgcgcggttctcttgcgtaatctctgaaaaaagaaaaaaaagaagaaagagataaatctttgtacacggtgatttcaaatgttcaacaggaactcctcttccactgtactagtaaaatttttcaaattgattcgttcagaagtcctagctagtggttgcagagaatactgaagctgggggcagctttcttctccctgaaaaaaaaaagaagaagaaaaaccctgctgtctctgtgtcgttttcgttgctttaaaccgtccatttgagatgttgatcgagttgatgaatgaagtgtacaatgatgagcagctttcgggggtagagtccacaccgatcgtccaacattgcccagtaggatggcctgtttggtgccaaatcactcgaggaaaatgaaaatatcgacttggccggctgtcggtgtgggcccccacgtgccacatccagccggatcccccgtggcatcgcctctctttcggccgccttttctgctaggatgagctaatttgtgagaccctcattgattgctaggctagattgagagcgaatttccgctaaaaataatatttgtgtttgatcatgaggagactaaactgcactttgcgtgttgtgttgcgattcatgttttagtttgcaccaggtttaaatggtactttcactttgcaccaatgaccaacctaggacgatataggatataattttcatcagttcaaggtcaatcatgatttatcaaaccgtttgaaataggactaactctgtaactcatagtttaacggttaccacgataatagcacggttactgtaggatatactgtggtttgaaaaactaaaaaggttagcacacattataactgtgtgataaccgtacgattttgtaaaccctgagctcgatcaattcgaggataattggtgatagctctgccacctccaatttaattctcttgagcaaccttgatgctacgcatggattacttccgttttttttaacaaaaaaaatggttttgttgtgtgctactttagagacattagttattgattacctagagtaaaagcatcaccaaccgttattctatttcatttccaaaactgattttgagggtttttagtataaaagtcatatccaacatatttccaaaagccttgcactagttttggagttcccatctctatatatttcgttacgtggatttaagggtgagagagtgactcccaatccctcgttcgccttttctctctcctttccgcatgagggctgaaatttctgttgggagcatgtgggttactgtgatctctttctgtgcgcgtggaaggaaaataacagaaaagaaggtccacttttttaaatttttagaggaatgagttttttcactttctatttttagtttaggaaatccaaaattaaatttcgggaatagattattgctaatctgttggtgatgctaagagttaaatgaaaaggtttacaaaccatgaagtgtagatgaaagattacattcaaaccgtttgattttttgaagaacatatactactatatgacaatgccttgttttcatccttttgctgccgcgccacattggtggccatgaaattgcttgccacaaagaacagtgaggcataattggagcccatgacccggaagcagatactgacgtggcggcatagctagggtcggtggaaagggccccacttcacagtgctcctgaattgatttgctcgggtgttgcccttgtgaatgacgtgtaatgctgccaatatacgtgcgtccaggtcatcctgcctctacctccaattactatagcggccctaccagtaatttgtaatttgttcatctgcagaagcgacgaggaaaattttatggtagagttacaagcctcacagtatattcaccaacagtattttaatatcattccctatcctgtaatttttgattttttttaatcaaaaatcggttttacatgattccctaatctcattcccaatattttttattccctgtcctacaattatagtctagggacaaacttcagctccaatcggagtaatttcctaggagtctcaccttttagttattaaaaagctaattttagccaatctcctgagagataaaaaatttaatccctcaaattctgtttaggttctaaaattttatggatggaattttgggacacggttggtgatgctctaatataaaatatatatattccttaattcctatatgtaaagttagaaatgaatcacatacaaatagaaagatttatggtagattggttattgatactgccaactaaccatttatgtaaggcagcgtagtcacttcccctctatggttgtggcggtgacaccatgcctcactgctccacctccttgctgtttattgctaagtgctaacccgcccttctaatcttagaatctcatgaaaatcattgtcgacaggttatatccgtaaacggtatttgtatagtatgagaataattgaaaccaaggtatacgcgagatcaaaataaaagagataggacaagttcatgccccttaactgacaggtactccctccattaaatatgtatgacgtcgttgactttttaccaatattttaccattcgtcttatttaattttttttaaatataaaaatgtttacatcattcttaaagaacatttgataataaatcaagttataataaaataaatgataattacataattttttttaacaagacgaatgatcaaacgtatatcaaaaagtcgacaacgtcatacaataaaatatagagggagtaatagccatactcctgttggctaaagccggtgttacttttatatatcagtatcacacgaatacaatatttgggatgacctaatctagtttctatcggcctggtggcatcgagcttttgcacatactcaacggctggtgtagtcttctttctctgacataaacttggcgagattggatgtagttctagatccctcatgtcggtctctgtggcttctacattgggtttgtctagatctgtattggcttgtcttctgtcggtgtgttccctctcatcctagtgggtcttgtattaatagtgaaaatcatctttctatccaagtagaattcgtagaaatagaacatgatacaggttaaggaaaccttttctttcccgataaggactctaacactttcacaacttctattccgggaagataattttcttttctatccgctttatttccttaattaaaggatattttcttgtatactactgtatatggtatttctatttaccgcgaacctgtatataggaggtatgctttatcctcgacactaccgtattgcactactcttaactcttctcatctactagctagcataataaattcaatcaagagttgagatgtattttcctatgtttgccttttctctagacatcgggtgaagtcaacacaactatatatacgacgtacttgctcggatgcaattaagggcctgtttggcacagcttcagctc

SEQ ID NO: 81788 - DNA, 10753 bp, Oryza sativa
tgttattaatgcaaatcctatgataagcctgtacttattcttaggtttatagatgtttctactacaaaaggtattattgttgttaaaactgaactacaagcttgaatggcaaatatatatttaaaatgttagactccttattcatattgtgtgataatgtatatgttaggaggactcaaagccaggacagagccgcagaggctcctgagctcatgatgcttaattttcggacaactaatatctcaaaaaaaaaattcctgtgagaagctgacatctcaattgatgttctttctactgtgaatacaagttaatagtttcatgatttaaaaatgagcatatatatggttgaggaaagaaaaaactaactacatttagcaaggtatgtggttcacactttatagatgaatactttttattgcgtgatgggaaataagtactcatgctttataccttattcagaaccgagagaaatcaagcctgaatgccactgacttggtttgttaccaaatctagaagaacaactttgattaaagaccaggttggcgtaatctcaggtgaactgaccatggagggctgaaagcagtgatcaatagtttaaacacattttctgcaatggtaaagcaaacattaagaggaagaatgctgaaagggaaggaagacagtgataacttgaaaggcactatctccaactggtccagttccttatattaattcatactactccaggttatggactgaatctgaatcttccaaggaaaaatcatcaatggagacatagtattactgcatttcttcttggacttggccaggagcattcttttcagcatgttcttcttggacttggccaggagcattcttttcagcatgttgttcccctaaattctgaagaagtacgttattctcatgctgcatattattcttttcagcatgttgttcccctaaattcaagaagtacattattctcatgctgcatatttggtatctccatatgcaaatcctcaatttgctaccacaaaatgggtaaatcctcatccataggaagaacatcagtgaactcccaattaagcacagaagtgtgcagagtccatgactctccattacctcccatattaacaggattttccataacaattcttctaggcacttcactagggtctgtataaagacattttgccagaactctgccaagaatactatctctttgatgccaatggattaacttcccagaactctgccaagaacactattttgtgatgccaatgtataaacttcccaaaagcgtttacaatcctatgaatgtgagtctcatttatgtaatccgaaggaatccctaaaatcattatccaactctcctgattgaagggacagtttctccgataggctaaattatcaggtcttataaagtgtgcttggaaagcccctttatttagcatcaaatgctggccggctatcaaagtatccctgtgcaattcagaaggaacttagatcagacataaaaagtggaaacctgagggcgcagaggacatgcatgttgaactgattgttgatggcgtgcaccacttgatggatcagttgcaacattttatatatgtaacaagatccacctcaaccgtaattctgaatagacttaatgtttgttatacaatgtataatttccaactaaacaatttaaataccattattgtgagtaactaaacatcaattttacaccaggtgggactagggccccagtcaattttataccgagcgggatagggggtcttagcgcccagttacatcgagcgggtacaagatcatagaatattcaagttgctactgatgtagtctatgtcctattaaagaaagttatactctctaatagaatttttttgtgtatcttaactttggtcttgagagtagtataatatgtcgatagtttacagggataagtaaaaaatatagctgttttctcccacctatcgacccactcaaacttggtatagaggctagatcttgaaaacaaatatgaaaaaaacggttcaacttagatgagcattgggccaaaccataattatagctatattttgttagcttctcttcttgtgtggcaaatcttcaagataactttgttactttctttgacacattagtagcgataagtgtttctttgacacattagtagcgataagtgacataacattcttgtttagtaaccagttataaatgtcataaaactagttcacaagtatagataatatgttcattgcatgtaggatactaaattgaatattttcactaaaaattgcaattctaagactacaaaagttgtaataaaaaaattcaaatacttctcagatgactggaaacaatattagacaataacaatataagactggatacaaatataatataagacatgtttcctcgactggatacactaacaatacacaaatacaaatacaaatacaaatgtaaatagtttttcgtcataaataaaatatttttcaacagacagtgaagtgagggaaataatgtattcatttgttgtttcatagaatgctaatggtaaaggattacaactgaccatgtttatgtagaaaaaatatctcaacactaatatgacttgtttcttgaaattaggtgtgtaagccgtgtaaacagtttatgtgtcatctagacaaatgctttctatagtagctttgcaaatacactactttttagaagtacaataataaattttgtctagcaaacatgttccagtatagtctctaaacatatcaagtgaatcaggacattcgtaaaaaataatgtgatatttgttactgcggcatgacaaccatgagggccacgacatggtaacgcgatgcacctacagatgaatgtgctgcaatcctgtggctgtgacaacagctgcatgcagtaatcaagattatgtttttgtatcgtgaatagagatggcaacggtgaattcaccgtcgggggtcatgcccgcgtccccgccaccgcggtgaaaatatttcaccgtccccgtccccgtcaaccacgacggggctataatttctccagccccgatcaccacgcggtgaatttttccccgtggtgaacccgtccccggttaaacaatatattcacagtcacagattgtagtatactcaccttgcatcgtcgctattgtagctttaggggggaggtggctgaaggccgaagccatggtcggcagatggcggcggcgacggcagttcccattggcgcggcgacggcgactcccggcggcacggcgacgacggctcccattgaagatggctgcaggctggcggcgcatcgacggagcctgccggccgctcctggtgaagatggcttcaggcgtcgcgcggcccggcggcgcgtcgacgaaggcggccggcgacggcagcttcagtctcccggcgagaaggcagcgagtggcggtgcgcgtggtggctggcgaacggcgccggaggtggctggcgaacggcggcgcgcgcggctcccggcggactggcgaccggcgacgcacgtgactcggtcgggtggctggtgtggatctggatctggatgggtggaaaatttggagtttgacctgttgacttagggttagattatatatgtgtctgttaaatgggcttcaatattatgggccaatacatctaaaaagtctataattcctcccttgtacagtacagtcgggtcaccgtccccgcccccgtcatcccgatggtgagaggtttttaaccattttattccccatggtgagtagatattaaccatccccgtcacgtaataggtgaattcactgcggggaaacggtgaacgggccccattttcatctctaatcgtgaatggactaacaccaccatcatgtgcatgatttcctctgcaacaagccccagttttgccgtcactttccatcacgacgtgttgttttcaaccattagatagcttaattaagctctaattaacaatccactagtagtttcatattaaaaaaaaaacaatctatataagtcctccctccgtcctaaaaagactcaattcctggggtttttatgtctaacgtttgaccgtccgtcttatatgaaatttttttatgattaatattttcatattgttagatgataaaacatgaataatacttatgcatgatttatctttttatttttgtcataactttttcaaataaaacgaacggttaaacattagacacggaagcctaaaaattgatttttttttttacggagagagttgcacctttttcgtgagtccaatgaaccgtcagcatgcagagatccgtatccaaacgacccctagctactcaatttttaattatttcgagaattctgcccatggtttgctggcaaatcaaatcgcctcgaaagaaaaaaaaagtcatgctgaaaggatcataaggattagaaaaattaccatggaaaaccgagagtacatgtacatacagacggccccggtaaagaaagcggcggatgagtcgaccgacgacgccaggcggaaaaccagcggatcgtctgctgtttgtttctcgtcaaaccagcggcaacgtcccacaacatctgcgcgcgtggaacctggttctgctggcccttttgcaccatgcgccttcgcctttctgtatatcgcgtggtcccgtttctcgtggtctttcttctctatttttttcttaactccactacacttagtactaacagaacagagagtagtatatattcagtccttttcacttagggcttatttagggagcttaaaattctgagaaacatttgttgagaagctagctgatgagaatttagagaagctgggagcttattttccagattctataactacagattctcaaaatctgggtaaaaagctagattgtttggaaagcttctggcaactgaagattttagaagaagctgcagctgctataagctcccccaaacagactcttaataagttgtattacctcctcttcttttatattattcattttataaatcattttattctttaagtcaaaatttttactaaatttatataaaaaatataacaatatttttaacatcagaaaaaaatatcataactacatttttcttttctaaataaaaattttagtaaatttataaaaaatataacaatatttttaacaccagacaaaaaaactatcaaaacatgtttaatgttagaagtaataaaactaatttagtgatataagtattgctatttgtttataaacttgataaaactttaaaaaagtttgaaaaaaagatttgtagtatgaaatggaggaagtatatggtacattggatatgtgtatgacgtcgatattacggataattgttgtacgattgtgtgaataccttaatctgaccaaaatttgttctgagctcatattctcagcgcatcctatttatacttgtatactcccattccggtatatgagattctactaaaatttagtccctttggttccatatacttgtcattggttacttttgtttttttaactttgacaactcgtttttttctgacaaaatgagaaaaacatattgtaccacacaaacaaaagaaatataactttcactaatcatacattaatcgtttaaacgctagtactgatcaaagctgaaacagtagtgacaagtaaatgaggatggaagtagcctaaaatcggatcagggatgatcggataccacatttcccacatttcccatatctgaactcatttttattgcggaatcaccaaattaggtcagggcatagatactatcaaaaatggatagaaatataaatattatcggcaacaaacatgaaagtttcatactcaagatagatatggataatatctattacaaatacttaattgggtatcaagtcaaagcaataacattatataccacatttgtaatagccatttatccattccatatatccaaaaatacaaccatattaagatggaagtatagtggcaatggttgttggagggtccgttgcttggcaatggaaatctcgccctcgctgagcccaaatatcgattgacaaagagacaaatcattttataaggacaaagtgcaacattactcgtgttatggtgtacaacctataataacaccttaatcgagggatcgaaacgtaattacgtaaagcaaacccctccgcggcgccgcgcctcgtttgtttatataaacagcagcatattaacctgcgaaaccagtcagccgtctgtctcatcgatcgattgattcctcgtgtctccgtatattcgatcaccgcgattcatccttcttgcaggtaaagattctacgaggttttgacgaagttgattgtttcttttgattctcgcaagaaaagatgcgcccttttttttcccttttcctgttcttttctggccattcctcggtcagtcgttctgtccccgagagctgctttcttgggggcattcagttgttgctggggccgggatgggcgcacggggtgggtgggggcaatggccgtcggcgtgccgagcggaggagcggcgggagcgacgtcggcgtttcgtcgaacacttggcgggcgtccaggactccgggtggcgtatggcctggttggtggtagccagggcccaggggtttaggtcggtttcacagcaaactgcaggttgggttaggatggtgagattttcagaatcttttcgaggagaggagttgacagagtctgaaagttcagaactgaaacctgaagagaaaatcgggtcctgactcctgacaggagtgcaaaatgggcgtgtaggtgcaggctattctatttcttcctgttttgttcttttgctcacttcttcacatcgaggtcgaatcaacaacaattttaagcttttgtttcttttagtttctgacatggtccttgttttctcttcagaagaaagaatcatggcatgtgctgcttcgagtgtaaaaggttctctcaacgttggaggagctaaggcattcagcaataatttgtttcgtgattacttgaaatcttcggtgtcttatcccgtttcagagatttcttctcccatcagagcgcaacatgtagcatatggttcgaatctcattgttaggggttctaagagcagggactttagctcgaagctcgcatcgacaaacggcagctcgaagatttctggtatgatactcctggagaaatttaatttcatattcgtgtatgctatcacttttcaaacacttttcttgcattttaaaatttgctagatatggtttatgaggaaatttcaaatttacctgatgccctgatgcattcagagggttgacaaattacttaagcaaaagttcttttttttttcaaattgtcatttaaattttatatgttcgtttgtcacatttttaaatgctagatatggtttatgaggaaatttcaaattaacctgatgccctgatggctgatgcactctgagggttgacaaattacttgagcaaaagcacttcttttcagacaaattaacaacagaaaagcctgttaattaaattatatatattgctttgttacagaagagagggtaactgtattggtcattggtggaggaggaagggagcatgctctttgttatgccttggagcgctctccatcctgtgatgcagtcttctgtgcccctggtaactctggcattgctcaatctggagatgctacatgtataccggacctggacatatcgaacagcgacgcggtcatctcgttctgtcgcaactggggagtcgggttggttgtagttgggcctgaagcaccccttgttgctggccttgcaaatgagcttgtcaaagctgggatacctacttttggtccttcatcagaggctgcagcgttagaagggtcaaaagacttcatgaagaagttgtgtgataagtaccacattcccaccgcaaaggtactttctctttaattttgtggatttctataacatattttctcacttggatgaacttgtttgagagatgatttattcatttgctttgaaatataacacaagtataatctgaataagaaacacatattcttgtttgtcttggtatatggtttctaatttctattgttattttctaatacttaaactatatttatgttttaattattagattctgagtcccaaatacacatatacttgttacttgttgctattcatatatatacatccttattcctcacttaatgatctctattactgtttgttttcatatcaagttccatgtgcaggattaatgagccattttagctattgtaattgttaagaaattttatcactgtttaactaagtcggttctactgcacagtaccaatctttcacagatccttcagatgctaagaaatatgttgaggagcaaggagcccctattgttgttaaagccgatggattggcagctgggaaaggtgtagttgttgctatgactttggaaaaggcatttgaagcaatagactctatgctggttgaaggttcattcggttctgctgggtcacgggtaatagttgaagaatatttagagggggaggaggtttctttctttgctctagtggatggagaaactgctttgcctcttgaatcagcccaggaccataaaagagttggtgatggcgatgttggtccaaatacaggtggtatgggtgcatactcccctgcaccaatagtgacggaaaaactcaagtgcaaagtgatggagagcatcattgtcccgactgttaaaggtatggcaactgaaggatgcaagttcgtcggtgtgttgtatgctgggatcatgattgagaagaaatcgggactgccaaagcttattgaatacaatgtgcgatttggtgatccagaatgtcaggttggtaatcctttatatatgacgttagcttttgaacataaatcatcctaatttgcagttttgcatgctgcaatttagctttagaaacagatactgtcgttatgatgttattttaacttcttcacaagcagtggcggagctagtaatttaaccttgtggggtcgattaataccagtttatatttaagtggggtcatttttctaagttttctggatttatatataaaaatcaaggtttttaaagggggtttttaaaaacctgtggggtcagacaaccccagaggatatgtatggatctgccactgttcacaagcaacatttgatgaaaggatgctcttttagaggcacaaaaatagccaacatgaagatagcatatttcatatttatatttgaaatttattattacagaacatcacagtccagctcatattgggatgatttctattgcttgtttttctcctctggacaatatctgcagtgcagatgtgcaattacaatagcatatttttcatcctttaatatgtacttcctctgtcccaaaatgaagacatttttgaggttggcacgggtattaagaaagtaggtgagaatgattggaggaagtgtgtgattggttgaaaagagaaagtaggtgaagaagaatggttgtgattggttgagaggaggaggtaggtgaagaaatagcttcattttgggacaagacactgtgctagaaatagctacattttgggacggagggaatattggcatagaaggttgcaatgttgggatttaaagcctaagagtagttcaaacttgtcccataaaaaaagggagggaaatttggacttgcattacaggtgctttaaaagtgagtttaattcaaaggccctcacattttgcattgtcaaaattgagctcccacaaaacaaacataagtcgaggaaatgcttgaaactacagtttgaatatggaactcatatactgtttcatttcactttgtcattaggtactgtgtgcagaacaccagtacttgcatgtgcagattttaagggagctactgattacatctcaaactgaaagacaaaattgcatcctagttaagcagcattgtgcttatagtggaggaatttcaatatttactgtttaattttgtttttgaaataatctagctgtattgttagcctgttcatgtcatcattctaacaatacattttccttttttcccaggttctgatgatgcggttacaatccgacctcgcacaggtcttgcttgctgcatgtaggggagaactggggtcagtctcactaacctggtcgcctgaattggcaactgtggttgtgatggcaagtgaaggttaccctggtgtttacaagaaggggacagtaataaaaaatatcgatgaagctgagcaggtctctcctgcagttaagatctttcatgctggaactgccctagatcgagatggaaacttcgtcgcggcaggaggccgtgttcttggtgtaaccgcgaaaggtaaggacattgaggaagcaagggcaaaagcatatgacgctctcgacgttgtcgactggccagaaggatttttcaggcatgacattggttggagagcacagaaatatcggcgcatggttgcacactgataggcatgtactgtaaatctgtaactatgttatgtttgtgatgttaatgggaatacagcgacaggggaatgggcataatatttaagtagtggatgcatggagatggaagtaattggcagcttggattagttccttgatcgaggaacacgttcttctcatcactagtttctttttggtagtacatgtgtttatattttcaccttctgtattgtaataagaactggtgtggaccaatgatgaatgcaacttgcttatcaatatactccctcccttttttaatagatggcgccgttgactttttct

SEQ ID NO: 81789 - DNA, 3776 bp, Oryza sativa
cactgcaacaggagcttcttggggtgctattatccattcctgcaatagcggatgccgacgagctgagacgaagcaacaacacgttaaggtcagcagcatctcccgcccgttgccatctcttccgcccccaactgtcgctcccatccccccccaccgtcgctcccagccaccacggtcgctcccaccccccaccgctgctctagttgtcgccactggcctaaggggaagagaaaggagagagaaagagaaagagagataaggggaagagggagagagagaggaggaagaaggagaggagagatgatgacatgttggacccacatgttagtgggtcccacgatgtttttgtgtgaataataaatgagtcccacacatatttttttaattctaacgtcaaataagcgccacgtcaacgccatatcgacaaagaccatatcaacacctccacgtaggtgccacatcagcaaaaccgtcctccaaaaccgttaagggagtcaaattataccggttctaataattgggggtcgagatatctagtaccgtggttcaaggaaacgaatcatattcgccaaccacttaagggagccaaagtgaacttattcctacaagaaagtaacaaacagcacacatcatagaagctcatggaagatatatgggccacaagcccaaacattctgaaaataggcccaagtacccaacaacagaaacctgaaccagaatttatctttgttttttttccctggacaagtctaccagacagcccaatgttattattcccggttagagttaacatgaggagaaagggtagataaatttacaagagaatccgcgaatttcataggagtataaagcaagatattttcataaattgaaatattatcagtccacagaccagtccacacgagcatgcaatgcaagtaaaataacaaacatgatgttggatatattagtcttctctttcacaatggtggttcttgtataatggttttgaggatccttctttgtgaagcttgaaacaggacttcatcaatttgcatctattcatccttgtgcttctaatcatcttcgtctgatccaggttcttcaaaataatacaaaatatcactacccattttttaatatacggcgcagttaacttttttcctgaaactttgactaacaatgtttattcaattacttagttaagtgaagtgaaacaagtacaactaaatctgccatcaaaatcactttaagcatgtcttgtatgtttgtatatttgcacaaatatttctaaaaaagatgaatagtcagccgaattacaaaagtcaattacattatatatttaaaaaaacagccttcttcggaagcatcagaaagatagcagcatctttattcagttattcttactccaactaatgaatctttgaaattctgacatttaatttgcattatcatagccttcttcggaagcacagaaagatccaacgtcagctttcttggtagtggtagctgaaataaacatcaaactgtgcacctatgacatttatataatgttccaagagcaaaacaaattatagatacgatagatacctctctgatggcatcagtcatgatggttcttccaatacctttaccgtgtgactaccacgtctaagaaaaaccacttaaccagtatacaattcaaaaatcttcaacaaagcatgttagcagaaatagtttcacatggaagcatttagttcccattcttttttctagtcatttagcatttatttcaactcatggtgatgacagaaatagctgcatcacagcacatgtcataatagaaaaaaagggaaaaaaaatgaaaagatatgtttcctcattgttttggtaaacgaattgaaataggtcatcgtaagtgctgaataaccttcaaaaaatactactagtaatcagtaagatgtcacattatcatatttttcaagtgctttttagtgtctttatccctcttcatgccatttgtagttatgattttaattgtaactaacattatgtaaattcttattttagattcatgtggcaaccatagaaatgacaactgcaatctgcattcttagatttctactgttggtacaatttgccactggattatctacagatttatagagtttgaactgtgaaggcaaaaactataaatcaaacaacatatacagagagaacattgactttttattgagaacattacctctgaaagtatcagctagtgatactctgtttgccaaggtcatcaccaactcaactaaagagcaggtgtatacacagtgtcgtggcgacactgatattagtacctgtaagaggtgtatcaccaaggccattaaggacatacaacaagtatattcttcaaagagggatagtatagcattttacaacttttgccacctcggaatttctggaaaagattttaagtttgatattcaacatgacatggaaaatatagctttataggacaaccctggttatatcagtcagggcaggtcgtttagtgagacagtcatgttatttgttgatgatgtggcaagaaagataacagacctatcaaaaagatttgctacaggacgagagaaggtcctagggaatgaatataactacaccatattcggcctcgcacagtgctcacctgagttaaacagtttagagtgcaagatttgtttggagatctagcctctagttcgcattttagtatgtcaacaggtgggacaagagcaacaatatggtgtaacttgcgttatgagggatatcctttcttcacgggccctccaatgttggaccaactcatctatcaagctacagtcaagcctaaaggtatgagatgcaaaatttatttatgtttgaaagtttatttatgcatgatactctattgctatacattgattgaaatatttttagtttacattcgttcaaaaggtactaggggccctacaattttgctttcatttttggtaccgaactcactatgtgttatattagactcattccgtgtttaaaagtatgtttatacatgctgatctattgccatacactgattaaactattgttagtttatattggtttgacactatctactaggggccttggtagtataccaaactcaccgtgctttatatttacattcttgtttgtaaatagatgtgttattttcattcttgctaatgaaattgtaatacccattaaattaacaattgacaatcacatgcaggaacaaatcataagaaccatacaactattctaatagtggctatagtggtgccgagcgttgtggtaatcatagtagtcctagcaccactatttcttttgaggaagaaacatgtactgaagaaacgaacaaagctctcgagtaagcacttctaaaagaatgaccaatgatatgtactatatatacttcaatcccaaatagaacttatgagcattgtttcacatataggtgtagaactatctgggagcaaaaatattgaaggctttgttgattctagaggtgaaaaagatgcagaactaactgagagcaaggaaattgaaggctttggtgattctggagatgaaaatgatgcagaactaactaggagcaaacagattggagactttggtgattctggaggtgaaaaagacgcagatccaactaggagtaaagagagaaggtcctagggagtaaatataactacaccatattcggcctcgcacagttctcgcctgagttaaacagttcagagtgcaagattttctaaggctgatcttgtacccgctcaatgtaactagaggggtgc

SEQ ID NO: 81790 - DNA, 4751 bp, Oryza sativa
tacataaaatttttgaataagacgaatggtcaaacatgtgagaaaaagtcaacgtcatcatctattaaaaaatgaagggagtattttgatattgaagaacatatccatttatatttttcctattatatttagatatagtaaggctctaataatgataaatctcaaggacaaagcaaatcatttatttataactcttttgacaatgcatctatataatttagccacctttgacaataagagtcaatggcaaatctaggataaaaatagaggtgatgctaatactacataacgcaaaaattattggaaattgtatttcctgaaaaatatggtcttaaatatccgtgcttcgttttgaaaaaaaaaaaaacgttcgtcttgttgaattattcaattcgatgtgccatgcatgcacagctcaacgaagtaatgctgaaaaaggaaaacaagagctcctggtagatgataatatctgtttgttctcactggtttgctaatcgagctgtgtttaattatcagaagatagatgggggcacgaagcacaccgtagaactatagaggagttatgagttatctcctcctagccgctgcctgtttcaatgtatcttttctgactgtcctaatgttccctacaagccttgagcttacgggcggatacttgggaccgcaagctggacctggggcttttgcgccccaagcccaatagtgaattcccccctgatgggctgtaaaaataacatagaatattttttactctagagacactttagtgatacttttagtatatttcgttaaatttatcttgtagagtcgtcattttaactctttaaaaatgcatcatatgtagatatattttcttaagacatttaaacctgtgtagagctacttttaaaattattaatatatacgtagtaactagttataaaacacaaagacaaggcacatatgttcaactgataatatgagatgagatggctcgtacgtgggaaatatgtgttttttaaggtaaaaagagatcttgtattaatgattaaacatagggttacattcttgcactactacataactcattttcccgtgcaggcatatacatttttccgtgtggtcgtttggtcctcctgcacccagttatttgcgaaaatcagtattttcgcgtgtgggcggaacgattatcccgtgtggtcatattataccacccgcacagaataaaaaaaccaaaaataaaaaaaaaacaaaaatcgccgtcgacccgtcggcccgcgtgcaaccggccgccgcaactcatcgtcgcgccgccgcacgcacgaacacaccaggccgccaccgctgcggccagctaggctgccccggtcgtcgcctcaaccagccacggccgcccggtagccgccgcgaccagccacgaccacccggtcgcgtcattgttgagcccgcccgccgccgctcctcaccgctgtgggggacggccaccgctgctgtcgccgccacagtcgtgccggttgctgccgccgccagatctatgcgggggacggccactgccgccagatccgggcatgtgggggccagttgccgtcgcccctcgtcgccgcctcgactggtcgccgccgcgcccactctccgctgcctcgcctcatcgacagcgaaagtcaggagagccggagaggagaggagtgaaagtagggagaggagaggagaggaagtgagagagatagaggggtaaagtgaaaataaaaaggaagagagagagaggaggtgtgaaaattttgaacgcccgcagaggataatgcattttcccgtgcgggcgacagcccggcgccagttcccctattttcccgtgaggttccacttacggaccgcatggaaacagaagggggcggcgtccagaagaatctatctggtagtagtgttggttcaataaattgattatctcaggagcactgctgatagttattaagtaccaattttgaccgccaactagcacaatgaataaagggaaaatatacatttcttacatgtatatcaataacaaataatgtagttgtattaggattagagaattaacatagatctagggattatagatcaaagtgaaggaaaatgaagtcattatgcaaagaaacacacttcgggcgaatcacgtgcgagcatgaggattgatgggcccacaagtcagtgcaaaccgacataaaatggggccaaaccaccaagaaccgtcattggggcccacatgtcatcctctcatcaaaggcagtggcaaatggcggtggccatggttcggctgatccaggctttgcgcccctagcaccgagcttccacgtgacgactcctccttcactcctgatggcggttatgcctgtttcccagtatacaactgacttaactaccgtcattaggaggctataaaaggaggagcctacttcaccattgttatggcttagcgacatattttttttggctggaaggtatgcatctttcttactttattttccattaattcttcttttgtattatcaattatttcttgaagaagcgaaaaatcggtgtatgtaaagttgcttagtattattcacctcttacttgagacttgtccgagcagtcagctccctagctagcacaatctaattccttgcttttccacaattgaaggggaacctacaatatatctatctattatatactaaaagcccattaaacttcctagaaacgcttcaaaccgccatgtgtcaccctacaaacgttcctaagtcaccatgtggcactctaataatttataaaaaaaatctagaaaaagaaaaacatctaaccgtcagtttacatttaaaacggtggacctgataatactaaccattagatcaaaactaaagcccctacacccttcccttctggccggccccacacatgtgtacgtacgtacaaatcctccgtatgcacgatctatccaattcctccccgtcattctcttttttccctaattaaagcagttcaaagatatacaccataatttgttaccataaatgattatatcagtttatccatggacttttagcaaggtagtgagcgtgcaatcactagctgtttatatacaggagcggtctcaatcctactgtaaataaataattatttttaggtgtctcatatttatgggaaaaaagaacatgtttgaaatatgagtttaaggatgagttgtcaattatataagatagcataatggtgacccattatatgtatacgtttctattttcctcacactatctttattttctagctaacggttttatacataaacatcaataattagattgttaaaaatttatgaatttttaactactcaatttgtagtttgatcaatattgaccatgccttgatatataataaatacatcatttaaaagccgtatcatgtaagaaccaatggaaattaaagattatttgaaaattgataacatatgtcatgtcaattaaacaacctctccattaatgattatataaaaattaataacatatatcttgtcatcaattaaacaacctccatagtgcttctaagtaatcacgtgtcatggctaataaattattttaaaaatcctaaaatttctaagacaaaagaaaataatgggaacatcgattacatttaaatttctccacataatacatacatacatacatacatacatacatacatacatacatacatacatacatacatacatacatacatacatacatacatacatacatacatacatacatatacatacatacatacatatacatatatacatacatacatatacatatatacatatacatatatacatatacatatatatatatacatatacatatacatatatacatatatatatatatatatatatatatatatatattaaatttgttaggtgctccatagtgtccgggctccatggctatccaccatccaaatgctttaagatccgtgcaacgcactagtagataacatattaatattagcgggtctaacccgataagatattgcatgcacatactttccatatccatttttaaagtattgcgtgcatgtgtttgcaaatttagtatcctcaccaatcatgcgaggcactttccattttctatatccactttttcgaaatattacgtgcaattgtttccaaatttcgtgccctataatcatgcccaccaattataattagcactttgtattttctatcacattttccatacaatgtttgtatgcagatacttacctattgaaacatgattcttgaaaaatgatgacatctaatcatgtccgctaattgcaattattaccttccattttcaaggttactttccattttctatatacatatataaccggcgacggtattccatattttgatttttcttggctatgctggtaggctcacggtcgaagggctatccaccaaacaccactgagctacctcgctgacgacatttgctcgcaagctctgtgatcttcatcgccacgctgtgaagagggcggacgaccccaagcttgtttgtcgctgccgcagcagtacgtttcgcttggcaccatcctcaggtacgtgatatgtatgtatctcagttgttatctctcgcatagtttacattcacatgcagtccccgttatgcacggatgatttgccattttgtttcgtggtatctactaactgagcacatgatgaatcacctggaatctaaattttacattttttgttgacatgttgcttaatttagattgttctaggtatataa

SEQ ID NO: 81791 - DNA, 15463 bp, Oryza sativa
cgaccgcctcctctcatcctcgtgcagcaccttctccatgtccagcgcctcggccgcggcgccagcatcgtcgtcgtcaggcgtcgggatgaacggcggaagaaggcgtgccgcttcacgccgtgggcgcagagccgcctgcccgggtccttctccaggaggaggccgatgaggtcgcgcagcggcgtcggcttgccgctctcccgccggctccgtctccggaacggcgtgcgcccgtacaacatctcgtacagcaccacgccgaggccccaccagtcgacggcgtagtcgtgcctgctcccagccacgatctccggcaccacgtagtcctctgtccccacgaacgagttcgacttcgccgccgacgagcagcacgtggacgacgaggaggacgaggccatcctggacgcggacccgccgtcgcgctcgcccgccgcccgcccatcgcccatggccgcctgcccatcgcgctcactcgaagaagaagaagagaaagagaagagaagaaaagaaaagaaaaaacgatgtgtaactgatatgtgggtcccacgtactttttttaatttttttttgctgaataggatgccacgtcagcgaaaccacccacatatactgccatgagaccttctttgaacggtttgtgtgagtttagggtatacattttttgttttgtggtttagggacctcaaaaaatctcgctgttaagttgagggtcctcgggtgaacttattccattgaaatctgatccaattggaaaatccaaaccattcggcccatttagcccaaaccaagactactactgtcatctacggccaagtggatgtacactgtactgttcatattgccctaccaaataattattgactaatctaaaccaatccaaaagggcaggagaaaaaaaaatgtcagcatcttgctaagagagaatcttctatagtttgtgcttggaatatcccctacctgccacatctgttccctcgctcatgtctcctccaaagccttttgattagatatccattatgaaattcgagcatttctagttgctatcatcactaatgataaggtcaccgataattaatttcctttgatgaaactggttccagatgctctcaatttctcctttaatgaaaagaaaaactacatgtcgctgtcccaaatgttctatggattggattcttccatgtcgtacctattgtgatgactttgacctaatctaatcataaacccgtcctattagagccacaaaaatgtgaaaataaaatgtttttatcagtatcataatttccaattaggtcgtcacatatattttcaccgtagaagttcagctagcttagtccaacaaagcaaagaaaacaaaggtggcgtgcatttgtaaactaccacggagataactacttccccattagtaaacgacacgctaattaaattaattaattaattaatgcgctctttacctaactttttggatttgtttaccaagctaatctatcttaaattcttaaatcacctgtactaaatttctccagaaaaatatcactaagctacaaagacacagccctttggagttgtttactaagttaatctcatcttaaattcttggttgtgttcgttattccagattgggaacttatccctttccatgacaaacataatgactcgttagaacataagtattaagtatgaaaagtttgaaaagcaactttattgtagaaaatttgttaaaaaaagtatagttttgttgttcgaaaaacgtgtgcgtggaaaacgaagattaaaggttgataaaaggcctatttagatctcggcaaaacttttcaccttgtcacatagaatatttggatacatgtatagagtattaaatataggaaaaaaaattaattacacagattgcgtgtaaattacgagacgaatcttttaaacctaattgctccatgatttgacaacgtagtgtctcgctgtttacagatggattctataatttgttttattattagtctacatttaatactttaaatgtgtgtccgtatatctgatttgacacgctaaaactttttgccacttaatctaatcacagctaaagatgagaaacgaactcagctaatcactcatactaaatttctctctcaaaataaatcgctaagctatacaaagagacaagaacccttctaagcaaagcagccagctaggaggaggagaaaacccaatcaaaatcaacccacgagctcttcctcccacctccatggccgccacccaccccctcctcctcctcctcctcgccgccgccgccgtcgtcgtcctcgtcgtagcggcgacaccggcggcggcgagcggcaacgggacgtcgacgccgacggcgtacgagatgctggagaggtacgacttcccgcgggggatcctgccggtgggggtggaggggtacgagctccgggaggacgggagcttcgaggtgtacttcccgcgggactgcgagttcatgctggcgaggacgtggctggtccggtacggcgcccgcatcgccggcgccgccgcctccggccggctcacgtcgctccagggcgtctacgtcaaggtgctcttcgtctggctccccgtcggcgaggtcgaccgctccggcgacactctcagcttctacatcggccccgtctccacctccttccccctctccgacttcgcccacagcccgcactgccgcggttacgaccacctccccgccgccgccgccgccgccgctgccgccttgtgattgggtagagatgggtagttcattaattaatctgggtgatttggctggggtaattacgtgtaattaatcacaggtgctcctggttgattggctattgatgcgaatggaatttacgccactatgggatttattttgagtatatcatttggtggcttctttatgaacaagtgttggatgcagatgctgtttgtttgtctggggttttttttttccttggtttttttggtagagattgatcattgggcttgtcacattcgaccatttcttccgtttgctctttggatttcatttcgattccatgccattcagataagaggtaaacaacagataagtgtactgtgattgaatggaaaatgcagtgagctcctcatctgctcaaggttatttgacggtgcggggtgaaagagctgtgattggttgagaagagatgtgattggttgagaagagaaattagatgatgcatttgaatggtcgaagatggtaattgattgagaagagaatttagacgataaagttgttatattttgaaacaaatttcaaatgggaagttgtcatagtttgtttctgttagcatccaaagctctatattctgtttttagaatttcaccaaataacacttccaaatagcaggtgtaaaacaaatttccagttttccgatgccatggcgttcagagatgagaatatgcaaggagcacctcattttcactcacaaggttattttgggtggtcaacacaagaaaactgtctttggatgattcctgattgggtacgttgtttttaacttctataatagcacaagaaatatcagttcactttagtagctgcaaataaagttgcttccattaaaagcaacaagaactagatccagttagcggctaatctcacatacaaactctaaacttcctcatttttttaagcatgtactttaaactgctaaatagtattttttttctaaacattctatatagaatatgcttaaaaatcaaataaatttatttttcaagtttataataattattattaattaattggtaatgagttttctcgttttacgtgcacgaataatctttcttcaaactcacaaaagaatgcagtctaaggatacattatatactgtactttctccacttcttctccccaactcacatttctgtactttatccacttctctccgaacacatattttccaatctgctaaatgatatatttttaaaaaaaattcataagatcgttgcttaaaaaattatattaatttattttttaagtattttatctaataatacttaattaataatataataacacattgctttattttacatattagggaggaagggttcccaaccttccaaaaaaatgtttcaaaaaaaactaagggggcagaaagagattttcacatgtttcagaaaaaaaaaagagattttcacatgttcccaatatgaaacgtagagtgataaattggtactccctccgtttcaagttataagacgttttgactttgtcaaagtcaaacttctctaagcttgactaattttatagaaaaaaagtagtaatatttttaacccaagactaatatattataaaaatttattcaattataaatttaataaaattatgttggttctacttgagttagttattcttagagtagtttgactttaatcaaagtaagacgtctcgtaaactgaaacgaagggagtaacatctacttttcccctttcctttctagggacctaccaagttattatcacaaaaaaaaaacaatgtaaaatcttgtgtatagacatggaaacgatgtattcaacaagctgtcttccgtgcacaggaatttaagctgacagaaaccaagacgccgcaaccttgctgtataaaactgcagaccactggcaggcttggtgttaacacagaatgtccgactatgctgcaccgagtaaacatatactacaagaataattagtgacagaatgtttttctttgcccaattacgctacagatattgaagattatatcaaaaacatgcatctattatttgtcaccgtacagtggacttacaagcagatctaactttgcaccgagtataaattgagtactgaatctgttcttggtatagtcttcttaataactctttcaagcgtgtgcactgctgtaaggagggtgtgctgcagattctgatagaaaatggtacacatcaccaggccttgagcacccagagtccagagaactaacccaaaaccagaaatctccaaacatttgatgacgatacgaccaacatatctgacaattggaagtgaaaaagcttatgtcaattgtcaattctatcatttgatattgcggtattgcctgcaacaaatgaagtttccaagataatctcatgacgactcatatactgaatttaggtggtgtttgggaagaagggactaaagtaccttagtactatctgatgttcttaaggcttttatagagaccacgtgaatggagatgtacagaattagaaaaaggtgacagaaaggtactatacagaaaagggaaataacaacatacaattcatttcttcactccaaagatttgagcagccggaataagccagctgcttcccttatccgtgagaactcaatgcagaaagcttgtacctcgatgaagaggtcttgaactgcaaagaatcatgcacaaaacttataaataagtaaaagatttcaataaatatagcatgcaaccaaagaaagataaatgaggctggaataaacgagttaaatggctttagatggcttaaaaactctatgaattacaaatttcagcaatcaattataccatattaacacatgttgcttctttcactaaatatagaaaagagtttaatcaaacaaaaactgaatttactttatgacgatcaatatgaacagttggcaacttggttactatcaatccacaaacaatttaacatacttgaatgattctttgtgaccactgtcacaaatccaaaaaaaaaatcctaatcatttacggttcacagaccaaacagcatatccacaatcaagatgaatactgagaaccaacttgagcaaattaaaggatcattcaagaaaaaggggcacgtctatggctagtaacagtgtaacacacaagagttttcaaagcaaagtaattccttgttttttttcaaaaaatgatgttttagacacatgcacacattaagaaaatgcaaaagttaacccccatatcatattcatgtaaaatttgtcttctctttctggtacactcttaatcttatcttagtgtttttggagacgttattgtacattaaggatagtaattagtgaaggtaaagaaatcaaaaggtttgtattatgaactttaaagtatcagtattttggatcaagaaagcagatatgtaaatgtttataatcaacataataatcaaatgataacagatcaatgactaaactgtatatatgagacaaaaaatgtatctgttccatagtccgcacacaacagtgcactcaccgtttatgatcttgtttcggatgagagactgaaggaaaacacaaactagtctcaccaacctgttctgcatgtatttatcctgcacataataaaataatcatactgaaggaacttcaagaaagtaacgcatttaacaagtgaggcagccacaaaatgcaaattacccatcacccaatgagcaaaaaaaaaaaaacaagatacagtaataaaattgtaacataaggatttttatcagagaatagagaaaccagtaggcaaacaatgctcttcccaacttagcaagcaagctactggatcaaaggacttaaccgaacaaatagaggagatggcagttgattggagcatgccattatataaagcacataaattattttgcaacaatctaaagcatgcaataagatctgccaattgcacgtacatttacttacaggcaccatcactacacaagtgcttcagttcaccaaaaaagtcagtaaaacaagtatttctacgaggaaatgctaaatctgaacttatcaaagaaacaaacaagcagaggctacatatttccatggaaaacgtagcccaggttaaatcaccaactggatcaaacagactgacataaagcattaaacaatctttgtttaaccatcagcttgaagtaagccacaaaactacagtaccctgctaacaaattctccaacaaatttaatttgaacgagcaaaataacaaacagaccttaacgttctgacatgattggatgcaattcgagatgtactcatggacaaactctgtcgggagttctacagcagtagtaagcctgtttacaacttccatagaatgcaggctcatctccatatgcacaagaacatctaagtaactgaaaaagaaaagggtcacaattaaaatatattaaaaaaaagtgttggtgatcatattgactagcaaagaaaagaaacagacatacccatcaatgtcaggagagttcatcaatttcgaaagaatttcaacagcaatgagtggattgtgttcaacaaggtcctaaaaccatgcataaattctcagatataagatatgatgaaatatggtaaaataagtaaacaacatttttagcaaccaaaaacacaacatttggcatgggtgcatacagggagcttttgtggagtcatcccgcaatgatacaccaacttcgagtcctttgccagttctattacgacttgctgtgagaagctgtgcattaattacgcttgtaccatatgaaaatatatagtaccaaaatgtatgcatgtccatggggaagggggtaatgaaaatacttgttaccataaaagcaccagcacctatgctaaacaaatatatattataaaaaagacaaaacaccaattaatagtgcttatacattcatgtttattagtgatccatagatgcaagatagctagcataaatacaagaatgtagcagagaacctcttgttgggaaggtgcaagtggaccttttaaggctcttgcaatcaaatctcgaatagcagcacctcgacttgtgtcagcacacatgctataatcccataatagctcgtgattgttgtcagggttcaaccattgtagctgtatgttcgatacaagcacagttgcacttagaaacagaacgggtacacagatgcaactcttggctggctaagacactctgttacctctccatcaagtatgtgaagtcttgggggtgtgggtcgtatccattgcggacccaatcttccccatgatttttcttggagtaaaccagcaagagcaaaatctctatcatcagaagcagattttggtttggttccaggtaatgatatgctaggcctaataaaaaaaaccaattttgtaagagaagaccaagaagaaaaatatgacgaattctagcaccacataacaatttcaggaggagttagctgagcctacatactctgacgaatttacacagctttgaggtacatctggatccggtatagcacatctaacagttcctgcactaaaactactggtctgaggctgagactgtacactattactgctgaatagcttctcaagctgttctcgtggaagtaaggcctaaacaaataaatgaacctttttattaatcaaactgatcttgaaacaattttatattatggaatcagaatttaacactctacctgagatgcagaatcagacccatttatgtaatctacagctgactgcttcagcacctgagacatacaaaccaatgccaaaataagcatacatatgtcagcacatgaaaggagcaataaaatcgccataatgtcctacaaccaatatgatttactaatgtttgtagataggccacacctcaatgttattgtttccacttgctgaagtcaacaaaagttggacaaatgcccgttccgatttttctgatgtttcatcacaggctgcctgttgatataataaaactataacttcaagcatgataaacaataacaatagaaacataagactctaacatagtaaataattctgcaaaacatatatattaaataattcttcaaatgccctagtgtacagaaaaaaaaaacagatatttaagtgttcagttctgtgttcttcatgtattgccatcatatgttacgaacaaagaaatagtatccaagttgataaaaggcaaagatccaacttccacagaaattattgaaccaagctggtgtagatgctacataaactatccaacccagctgcaagttgcaatagacatttattcaacatggtgttagtccgataagcagccgtggaggcatatcccactggtcagaaagaaatctatacaaaactatatagactagcaaatccatgatcttgacaccaaggcaaatatgctacaaaattattagggttacattttggaatactactccctcggtcccagaatataagaaagtgttagagttggacatggttattaagaaagtgggtggaattaaataggaagaggttgtgattggttgagaagtggaggtaggtgggaaaagtgagtggtggagggttgtgattggttgggaagggaatgttggtgaagaagttgttataatttgggacaaacctgagtgctaaaagctgttatattttgggacggagggagtactaccaaacatacaatgatacaaacattggcatgcacaattgaacttagtgttatgggatcaaaatcaaatgtcagatcctatgcaggtaaagcagagcaatgtaagaccctaattgacagtttccaaagtacaactgtttttgtagagctagaactagcaagccagatgcgatgtcaatttatgtagcgatcaataggagatcagaaaaagaacccagacgttaaagaaagttataggtctttcataacccttttctgtcaacaagatgtgtagaaccacgaatgaagaaaagatttggacaaaatgatactgttatgacatcaatctctagagtctaaaatgacaaccaaaaaatccagcaaaagagaaaccaggggcagcataaataattcattaggagcccagcttgcacatggcgcaggaatataaagatctatgatatatcctggccaaatggggcctgacagtcttcaaagctacaagttccgattctaaattactacaacaattcgcagttgcagaatcacctcagtaaaagcctcacaacattaacaattaaatttcattactgatcaaaaactaaaacaaaaacaataatattcttgtaatgtatgtatactagtagtctattatgcagtataacttaagggacagggatgggcaacctggctgaaggttaggcaagcacccagcatcacaaaggaaagcaaatgatagacgaacaagcttgtctgaattgacctatgtgtctactagtatttcaacacaactcaaagttaccagcatgcgtggtgttttaccagtttatatagcttcctcgcagcctatgctcatgtatttacttcttgaaaattaaagcaatcttgaaacatatcaaatgaccttgtaatttcacccattctgaattacatagagtgaagggggaattgggaacccttccatttcatgatgatccaaaatacaaaaaaatgaagaaaaaagtttattgcttacatttaataaaagtggaacatatgggtttgccggctccgaggaataactctggtgaagaatagcaaatgcaatcaaccgaccagtaggatgaagcatcttcttgtcctagtcaaaacgaaacaaaatatatcaaagtctgaacttcatttttcctgtgaaataaatttcagaactaaaagaatctttacaaaaacatgcatcctccaaatatctcttagcatggtcaagaataaacagacaaacagcataatcaagaaaagaattgcaaatgcatggtgaaataaagacaaatacacttttattgcccattacaaaggtcaaataaaaacaacaatgtgtctttggtcgagaaactggataacacactataaaggagaaggggttgcagttcttgtctaatggttaaaagcttagtgtccatcttcatcagaacataggaatgcattaacaaactcattaaatgatttctccagagaaagttccttatatggcatggaaggtttcctctgtcccctaattgttcactctaaattgttctttttcctacaatgcgagcacattcaaaaccattaccctcacattctactttcgcaagagtaatggtttaaatctacagtagtaaagaaaagaacaactttggtgtggtaaaccataaccacaaataagggatcatccgatgggcgatggcacaaaaggaactacatctttctttgataatctgcattgttttgttttcacacaaaaaatatgacttgtcatctctgttagaatccgtgcagataaatagatctctttctgacatgtgtttaaacagtgcagtttcattgataatcgagaatagagtcagctcaaatgcatgttgccagcagggataaatcgaaaacgctgaatttatctagctcctgttatgttgggaggaagagttcttccatgatatgtgtggttcagcattgcttttggaacgagaagtaaaggtactatcaggatcagactattgcatgaaatagtggaagttgagaataaggaacagatccatggtctcctctatttgtttttactcaacaccagacacttgataaatagtaattaaaaccaatcaagtaagcaatgctcacaccactgcttgttagtattcacttctgaaacagctgacaagtttgatagatcacaaagagcatgtttattaaatcgatcgaattataccaagaatgaagcaggtttatggattaaaaatgttaataatgtttctttaatcacactgattgttcacttgaaatggaaccctaattaagtgctaacctactcaagaacaaatgaaacccaaatatttggcgattcggtgacatcacaaaattgaccaactaagacaatggaccatacgcactcatacggagtgtagcatgagtccatccctacgttgtgtattgcaacccagatcctcatagacacaaaatcagcaaggcaatggagtcaaaattttcatcatctgcaaacatgaatccatccaaacctgatcaaactaacaacacaaggccataaagaaatttaaaaattctgcatctccgctctgctaaagcaaaacaatgccactaaatctagaagttgagcaacccatccgagatcaagcaattcgtaaccccaaaggttattaccaatagtacccaaatatagtgagctaagttcctccaaaaccccacaaatctgtgcctaacctaacattctctagcccaatccaaggcctaacccccagcaagtgaaaccccgaacgaagccaccaccgtaatttcacgtcgggaccaactggagcaacctcccagacatcgtaacacgcccataaccactaaatctaacttcccaccacgaaccctaagccgatggaaccaaaccgctccccgatccgtttccgcccgcgaagatcctggacgcaatctgacgaaagcaagcaaagcggtgggagggcagcaggagggagggccgagaagggcgtggggagaggggcagggggggatggggatggggatggggcgtggcccctttacctcgaggaggaacccgagcgcggcgccgacgcggaggcggcgctcgagggggaaccgcgcgaggaagtcggcggcgatgtcggcgagcgggcgggaggcggcggcgagcagcgagaggaggttggaccgctcgtccggctgcagcttcggggcgggagccagcgccgacatggtggcggtggcggtcgccggcgtcgtggcggccggcggcgaaatgttccgttcgcttttttggttttgggtttgtgttttttttccccctttgggcgagggattcgggggtgcagtggggttaggcgacttgggatgtggttcggatcggacgggtgcggctgtattcataatcgtacaggtcagctttgtttttttttccttttttattaaccatttttttaaaaaaagtttttttttaaagaaaaacggtataaatgtaggcgcccacagcgcgtgcacactcacctctataaacgcacacattgacaagttaacatggagtctcgctatcagcggtatgtcgcctaccctgaaagaaaattatccataaatacgagcactcgtgtcaaatctagaatttaaactcggataagctggttccaccacaaagaacttaacaagttgaactatgctcacttcgaacaaaaatgtagatatattgctaagccgaaaatattagtggagccttgagtactcataatttgaatttatcatagaaaatcgtaataaaatggcacttgccacttttgtctagctgagtttcatcattgtcaatggttaatatgttcattccctaaacctatggtaccaaagcattgaaaccgcacccttttttactctctctactctctctattagtggatggatgcctgacgagtagtcggggtggttccaaagttgggtaaatctcgttgtttctcctcagcccccacccccaccctcccacccccaccctcccaccacccaacctatcagagaggtgctggcatccaccatctttgtcctagtagcgactggtagttgtcgggctgttctctgacatccgacgatcgacccgtggcttcttggtgcaccaatgccatttgaagcttagggaacaacatatctgcaacaaaggtgaggcatgtggtggaggtgttgccggttgatcgatcctctctgacaagttctctacaactacgatgtttcctccatgatctttgtcatcgattcttcaatgtgtggttttgttcttctatcatggtaagattgtcgcaaccttccttcttggaggcccttgctaggtttgcatccaggctacatcaactacaaccacccttgctttctcgattgtcatcgttggttgaatcacacatgttaccagagcaaaggaagaactacctcgccttccacacaacaacaagacagaatcggtcactctcatattcttgaattctccgctttcccacttatagttggccagtgctaagctgggttggcccgagcacggccatactgtagccagcccaagcacggcacacgcattttgcccgtgtcatgcttgggccaacaactccacctatagaccggcatggcacgacatgacccaactggcccatctatttttccttacaaatttcataatgttccctatttttccatttttatcatatattactcatatttttccttatttttcctcctttttactaaattttccccatactttccctactttctccatttttttccttctatgttcttttatttcgctttttctactaatgggtcgtaatagtagtcatgcctgtctgacatggtgcgggtcctcattgcgtcgtggcctttgcctgccatcaggcccttgctgtgttgggctaggccacctgtttggcctactatactccctctcatacaatcttcttcgtgcctctggcaatggattcttaacaggtagctgaagttcaaatgtgtgccaacaacgccacaacatccacatcctagaggcccataaaggtttgtgaattggcttctcgtgctattctccggtggtgctgtcggtgtgttcatcaagttggccaaaatagagagaagtagacccgaagacctgatgtaggatcgagatgtcgactagaggggggtgaataggcgatttaaaattaaatgacacctaatcaaaactaacctaatttgctaggctcggtgagggacaagtctaactaagcaattaagttatgttttgcaatcctagggtgaaagtggctcaagtatatcactaggaaagtaaaacacttcctaagtctagtttagcaatcctagggtgataagatctctagtatatctctaggaatgtaaattgcacaaatgtaaatgcaacaagtaaatgagacaaggagacaagagatttttcaccgaggttcagaaactcgccggtttcctactccccgttgaggtgagcccaactccaccgctcaaccacgaagccaccgcacgcccccttcgtcaaggggtgggcaaggcgggagccggcccacagagaggactacccaagcctcgatcactcggggtagttcttccttcactccgaaggtggtgaactccaaaccactcacaaaccggcaccgggcctcctccataatcttctcggagaggtcaccgggcaactcctccacaagccgtctaggaggcggcaacctccaagagtaacaagcgatgacgcggctcggagatgatcaagtgccacactagctctacaatggaagcaatgcacttgactcttggctagaacaaccttgaaacacactaagtggatgaacataaagctcaagtgggtgtatgagaaatgcaaggggtgtatacaattgaattgggtgccaagagagaccccttgctgctggtgggggagtatttatactcccacccaccaaaactagccgttgaggacgaaatcccccaactcagtgctctgccggtctgaccggaggtgtgtggccggtcagactgtgctactctacaccagctagttttctagccattgtagccctgtcaatgggtcctactgccctggtcggtcagactgacatggggtggcc

SEQ ID NO: 81792 - DNA, 19634 bp, Oryza sativa
  unsure (1)..(19634): unsure at all n locations
ggcacggtaaacagcgctagttgacgtggcgctgaggtgtctaagttcaacgccacacgatttgacgcggtcatttttgaaataagttttggcaacagtttatttataaaattagttttttcaaatggtcaaattgtcaaaatttgtacggtatcatgattggcatacagtgcttttgcgctacattattttgatttatttttcaactacgagaacttttgctaaactgctattggaaagtttcagggttaagaaaaccttaataactgcttctccatcctaaaatataaggtacaaatctagataaattgattgatggtctcataagagagttgggagtctcctttccaaaaaacaaaaaagaagagagagttgggagtttcttcaaatcaatattgaaagctcggaggaaatcaaatgcaatgtgggccaggagctcacgacatgttaagccactcccaaaaactttggactcgataatggtgagttaaaaccaaaacatgaccatcttcccggaggcaactcaagagcgtaccaaaatgtcaaaaaagagaaacattctctctttatactccgtcaggttacataagtagaaaattagaacagaacctgatgcaccaaaacagagttgggcgcaatttggatgttggcaataagccaacaaactgttccatgttcactagatattgatagttacagcctcccaaaatagacaggatttattcaatttaccacaagataatcaagcctttattttactacaaaaagtaaaacaatagtacattcactcatggtcttgctttcgagcagagcagaaagagaaatgaatggggcataataagtcatgtgcttataattatcgcagccgattgtgccatcatcaaacctggcattttgtacaaccatccgtggagtggcaggagcaggtcaaaagatgaacacaacgctgtcgtggaccctgttcttctgattctgcgcaacacactctgatatccacatcaagttcctaatctcctgctcccgtagccttatgtaagcaaagaaaacagcatagtggaactgcgcaaacaagatatggagtcaaagatcccagcatgagaatccgcaatagtggcataatgctcacaagtttgttatcccctcatattggactagggataaaataaacagaactagatgagtgcactcaagcatgtatgcaggcttcagtgccacatgcattcttttagcaagagaaactagctctttgcggagtgcttattattactccctacggttccataagtcccgtcgttttggacaaggttgaggtcaaactattagagctttgactatcaataacttcaaaaatatttagtttgaaggcactagaacatgtatatttatttatcgtatattgtatagtaggagatcatagtcaaagatatgttttggagactgtcgttgtccaaaatgacaactatggaactgagggagtaaactcgtaagtggaactagaagatcccttgaagaaagttggtatattaaagtccaaaatgagaatgcagatgcacccccaccatggaggtcctaaggtaactaatataaaacaatgaaaatcatacctgctgttcaaatgacaagcacagcctccgcacttcctcctcatagaaggccttatccaacatttggctttccccatacgaaattttggcaaaaatagcctggtatggagggtacttctccattacaccacggacctacatgatgtgaaaaggaaaaaggtgttatggaagtccaaaaaaagaaggatcaatgtaatggtgatgatgatgcaaaaaaagaagaatcaaggtaatgtgatgatgatgcatatagtgtaactaacatattttacaggaattctttatgtatgctaatggtgcaccacactcttttttcatctacctatacaacaaacttaacaaaaagaacagcgtcaagccagaacaaaactatggttatactagtaagcatggtagaccaaagggcaataactaaaactacctattgctactaatgacgggcacaatagaagagaagacaaaacatataatagctaaagcagctttccaatctgctccagatgaaaggcacagaaaaaatagtttggcacacattgatcaaagcataaaacatgtgtaagaccatgcgctcccatgtaataatatgcccattccattactcaaggaaggttccaacacagaattttcaaaacaaataaatgtaataccagtatacaaaaaaaaaatcattgtgtcttggctgaaccaactactccacagacgttgatatagagcagtcagaaaaccaagttcgatgtatgcccatcacacgtgatacgtgtgccacaaaaacatctcccgtggaataccacgattctccatctcttgtgcagaaggcgttcggcctagggcatcatttttgttcgataggacttccaataaatctatttagtatgatgagtggtccttttgctaaacatgttggtaacactccaatagtgttcatttttcatattagcagtttaagttggccaatgtaagcaaatatgagaagcaagatgtgattaaacaattgaagatgtatgtatactaaaacgtgctagaactgaactatgagcataaatgaagacaaacctgatcaacatcttcacaaacagccagttcttcatgaccatatggatacctggaggtcgaaaaaaagtattacaaacatatcttggcaaaaggtactatcaagctggttctaatagaaacctacaataaaccaaagttggagtacagcttccgacggtcatctctagtcaactctgtaccaatactagaaaacatgacagagagatgtcagtatcacatgattgtgcacataacaacaaacaaggaagtatgtaacaaaattatacggtttgaagtggaaaacagaaaaaacttggcaacctacctgtttattgtaatgttcacagctcttctgtctgcttcaaatgacagaagatcgcacataatctcagcagttgcaccaccaagtttctgtataacacaaaaagtcaatatgaacactagatgaaattggaggatacagttgaagccactatatttgtgtagttcatacttcacagaatttgtaaaagtcctcaaggtatgctttgtaaagagtgttcctcataatctcgatattcatgtcatccaaatcctgtaaaattcaggcaactctcattatcaagttagccttggtgttcaaattattaaatggattgtaatttattggacaccacaaaaggttacagctatttacctcagatgtaatgcattctgagaagtatggggctaacggtgtgtcaaccaaaaccaatctgtaaagctcgcgcatattttgagcaactgcaagagatgcaatgctattgcatggcaaaaagaacacttagtatcataagaagacctccactcaacagattcgataaagaaatcaccagaatacctgtcaaacattcccaatggatggcatttctccaatagttcattaacatctctctcatgcaatgttccggtaacaataagtacaacattgtcgatcatgtggccatacctgcaaatgttatctcatcagaccaaactatgctgcattactaaagttgggcacattgacatgtgcagacaaaacagaagtgaaagggcatatcctagcaatattgttgcttacgttatatactgtaagaatgtggatagtggttcagtcgcctggcacatcatgtgtttgtactcatcaaccagtttaagagtgcacttctccacaattgtagttgtgtgcaggggtgaaggttctgcagttaatcagaaataagttcatagtacagatgtatcacattagcgtgtaacaagcatgcactgatgcactgcaattatatcacgacaagcatcaacgcaaacagtattccatataagaatagggacatgtggattctaggaactatagcaattattcctaaggaaaataactaaatcctcagtggtttaccggaattcgatcaaaatatacccttccgagtggtctctagtaaaagctaagttgcgaccctctacatgtatagggcaaatcgtatcctttaactgctgcactcctacagaatgcgaaacctatgatactctagaccaagctaaacaacatatcagaacaatctgttaaagcgatccattgactttggtttcttgcaagcatagggcatcgtgggcttaatcaactacttgaaaatttcaggcaaagagcaaccaaattagggcaacccccaaatccccaaattggcatcgcaattcgcgcggaccggatcggggatcgccgatcgatcaggacagtcatggcggcgctacccaatccgatccgatccccccaaaaaaggagatcagagggcggcggcggcgagagagggaggtcgtaccgttctggaggtaggggccgtactcggtggcggtgaggtgcatcttgacgtcgtcgaggttctcgcactggcagaggttgttgtagtcggcggcggtgaggaggcccgaccggttcccccgcacgatggcctccaggaagccgtcgtggatgttgaacgagagcatctcccacccgtacatcctgtctctctcgccggccggcggcggcggcggtggcggtggcggcggcgggaggggtggatcgggaggagggggggagggaagccgcggcggtggcagatccgggtgcggatgcgggcggggtttgtatgagacgagacgagatcggtcgtgctctgctcgcgtgagcgtgtgggatccaggattggcacgtcggcagtgggccccgtgcccgcgtcagtgctcggggaccttccaggccgggccggggcgggtcaggcttagtgggctgggtattttggttgcgggtctaaagcggaaacgctaatacgcgcgcgcgtttcgggcctagaagacccagcgccgctgtgccagcgcgcgcgcctccttgctcttttttcctttttttaccatttttttccttttctttcccacttttttctgattttttttatctttagcatgttttgagtttgaaagtttataaattttgatttgaaaattttaaaatctgaacttgaaagcttttaaatctcaacttgaaagtttttgaatctcgatttgaaaattttcaaatcttgatttgaaattttttgaatctcgagttaaaagttttcaaatctcaaattgaaagttttcaaaattttcaatctgaacttgaaagttttcgaatctcgattctcgagttgaaagttttctaatctcgattctcaagttgaaagttttcgaatctgagttgaagtttttaaaatttgactttaaaatttaaaacttaaatcaaaagttttcaaatctaacataaaatattttcaatctattagtaaaaaaatctccagaatctttcctaattactatcattagtgttaagtatattaactaatactagcaaaatgcccgtgcgttgcaaccgggtagtagtgggatgagtactgtttgatcttaaaaaaaatatcgaagcaactaagcctgatcataagcatcaatgatgtgttctatgaccacaaaagcaaatttgttcttggacaattagtctactctacatgtgtggcatgtaaatgatgcttataacatgtgggcccgatgattgtagcatgggaataatggatgggcgaaaaatactgttgcctttgcacataaggcgacagacgaaaatttgcgtgacaaacaaataaactgatatttgtaagcctaacgagtgtaaattggaaccacaacactttgtaaggggtattacacactctctttataggttgaggtcatttattatcttgtattatattttcttttatgaaagttttatatttttttcgcattcgatgctttttatctcgataaatatttaaattgaagagcataagatttttatcttagcgaattaaaataatagtaagatgacacttatcctctagctctctcgtttttctctctccctcgcttcttctcaccactgctcctatccgttgtcacaggccaaatcaactactgaccccattccatcgtcgttggtcttctttttcctctcggcatgtgctcaaatcaaccaaggagacgtgatcagtgagtttggtgccaccgaataaggtcgattatgatgggtgcctctttctcatcctactgtcaccgtatctagattccctaagtttagaccatgtttgagaagagggaaaagaagaaaattaagaagatatgtaaaacgaggtgagtcattaatgcataactaattaagtattaattattttaaatttaaaaaataaaataatatgcataggaggagcggaagatggagaaaaatcgagcatgggagacggtccacctaagatgtacattagctaacacacgggtggtcgaccatggatgaagcatcgtgtgcgcgtcgagtcatggttctggggtagtgttgcgcttctctttagcgacttcgagctcctcgtctatgctattgtagcctccgggcactggcggcatggaaagctcatgtccgcatgcgatcaacactcagaatgcgacgatttagcttagtttagggcacatgaccaaaaatatgcaacgttttcttctgtctcactatcccgatctgatgctatgagcggaggatgattgttggatgcttggagtgaaaagaatcccgatccgatgtgataagcggaggacgattgttggatgcttggaatgaaaagaatccaggaaatgcacattactacaacaaaaacatttttacatatggtcaaaactgatttttttttcgtgtgatttgaccaactgtctgccctgaaaggtgtacggaaatattgatttttccatgcgggtgacgcatccacatgcgaaattttgattttcgcatgtgggcgcctaagtcgtcctcacgcgaaaatgaaaaacgcaaagaaattccaaaaatcaaaactggaaccataaccctagccagccgccaacgccatcatccgcccttcccgtcgccgccatcggcggagaggcggcgggatccgggcaggagggggaggggacgcgtggaggccggatcagcccctcccgtcgccaccgtcggcggaccgcgcgcgtggaggccggatccacccctcccgtcattgtcgctggagcccatcgccctcaccccccacaaccacggcccacggtgccctcgtacagtgcctcctccctagctgacaacacccttatcccgatgagcaacgccctcgcacatcaccctcccccagccagcggtgccctctcagcggcatcaccctattctccggcacaatggtggcaacctcttcacggtagtgccttggcaacagcaccctacttgcggtgcacaacggcatgcccaccaagcttccacagcctcgggacggcggcgtgcttggcctccattgatcagtggtgccggtgttttagtttttatgatttaattttctggaatgattttgatttattgttgttggattttttattttatgatttagtggatatgtgattttgtgattcagcggggtgaaggacgaaaaatcaccacgaaaaatccgaatatttatattagttatagtttatagataggtagttattaagactaaaggggagggggaacagtccccagtctaaaggcgtacatgtcccaaccttttactttattatttttcattcgcacgttttcctaattggtgtgtgtgttttaaaaaatatatatacagcaaagttgtttaaaaaaaattgtattaatatttttataacttttttttagaattacacagtacaacgcaaacacacataacgcacgcgcactcactcctatgaacacatgcaagtaaaccctacccctataagcatcttcgaagactggaccagcaaatactggagagattgactatgagcatcttcgaagactgggccggcaaatcctggagagattgacgaagtcaccacaggtgcctcatcttcgaagactgggccggcaaaccctagagagattgacgaagtcaccacaggtgccttgctgtcgacgggtacgtcgcctaccactgaaagcacaacgccgttaacgcactcactcctatgaacacatgcaagtaaaccctacccctataagcatcttcgaagactggaccagcaaatactggagagattgactatgagcatcttcgaagactgggccggcaaatcctggagagattgacgaagtcaccacaggtgcctcatcttcgaagactgggccggcaaaccctagagagattgacgaagtcaccacaggtgccttgctgtcgacgggtacgtcgcctaccactgaaagcacaacgccgttaaaatcctggaaaattcactcccatagggagtcgaacccaggacctcaagtgttactgaggctcttgtaaccactaggctacaggacctttcactaatatttttataacttaattaaacatgtatgtcgttttgggtacgtgggagagaagtttacaacctttcctcccgaactaaggggtgcctttgatttgtaagaaaaaacatagaaaattagatgatttcaatcctatatgaaaaattcctatgaaggcatttgaattaaatgattgaatcatatcctttcctttggaatctattatattattaaaacagtcttgaaaaaaggcaccacgttcgctgtggaggctagaaattcccacattaatcggtgaaaaagaaaaggagagtccaactagaaatacaatttaaaatagttgaaattcggaattaaaaataaacactattgaaagaagagcccatataagaacccaatacgaaattcattaatattcagaataaaaaataaaataaaatccgaaagtagaaaaaaaagaaagaagagttcgagtagaaatataatttaaaaataactaaaattcagaattaaaattaagcaatattggaagaagagtccatataaaaacccaatatgagattaattaaaattcgaaataaaaaaaataaaaaatcgaaattagaaaaaacaaaaagaaaaattcaactaggaatacgatttaaagttagctgaaattcaaaattaaatataagcaatattgaaataagagtacatataagaacccaatacgagattaaaaagagagttcaaataggaatgcaattttgaaacgactaaaattgaaaataaataataaaatattaaaagaacacaatacattattagttaaaattcgaaataaaaaaaataaaccctaaaattagaaaaagaaaaataagatttcaactagaaatacaatttataaataactaaaattggtgataaaaaataaagactattggaagaaaagactatctaaaacacatgacgagattaattaagtaatagacctataaaagagtagagtggtggcggttaatgggacatctaaaaattattaataaaacaccaaatagaatgatggcgggtaggtcgtgaagcaaccgatcaaggctgttggcgggacttctagaaagtaaaaaaaaaataagccccaatgataatcatatttgatttgtaaaatctcaatgacaataaaaataagaggcagcggacaggttgtacgggagtacaatggcaaagctgccgatggtttggggaacttctagaaagtaaaagaatgaattccaacgatagttatgttcgatttttagaatcccaatgacaataaagaatagatagcggacggtcgtagaggagtatagtggcagcgcttgacgggatttctaaaaaatataaaaaatgaaatccaatgagacaataaattataaaaactataaggtccaattttaaaaggttcgggcttctgaaaagtaaaaaaataaaccccaatcatgatcatgtttgattttaaaatcttaatgaaaataaagaagggaggcagcgggcgagccgtattggagtacagtgacaaagtcgctgacgttttgacgaaacttctagaaactaaaaaaaatgaacctaaacgataattatgtttgatttttaaaataccaatgacaataaagagatgaggcagtggacaggccgtagaggagtataatggcagcgtttgacaggaattctagaaattataaaaacgaaacccaacgagacgataaactctaaaaattataagatccaattttaaaaggctccaaagagaatgaatagaaacaatgatagatcaagcaagcaaataaagaaggatatgacagaagtaacgggtagcaactggtgtaaaattataaaattagaagcacgagaatgataaggtttggtctttcaaaccttatcatataaaaatatataattttgtatgggtgctagccgcgcaattgcgcggtaacaatcctatagagattttggagaaaaaatggcaagagatccaacctcttgaaaaatttcctattggtcaatctctctcatttgattcatgtatttttttctactgcataatcaaatgattattcatgtattttgtattcctatattttacacttgcattcctatcaaaatctttttttcctatttcttcgttttctcaatcatgtgtttcaaagggccttaaagcctgtgttcgggagtgagggttgggaactttcactccctagcacacaaaacgaagcactgtttagcgcgtgattaattaagtattagctaaaataaatttgaaaaatagattaatatgactttttaaagtaactttcatatagaaattttttttagaacacacaccgtttagcaatttaaaaagcgtgcgcgcggaaaacgagggagatgagttgggaaagtagagataaaaacttagccaagtatctctgtagtgtgtttttcatggcagtgattcccctgttgaagctggtataaaggagttggatactttgggtagtcattttgctcggtaatgtgagcaacaatatctacagcgaaatatcacgaatgcggaatctattttgccgtggctggctttctttcaacaaagatattgcaaggggaaaaagaaanagctttgttccaatggaatgaggttcctatcatgctttctataaaagagtggtatttccctacatgcatttgtgtaagtgtgtaacaagtgattccttgaaacatggcaatcactttctgaatatcctaccaccaatgtgatacataggtcagattattccctagtggacaattgtgaacacattacactaatggaatatttgtctttcccttgatgaatttatgcgatactttatccaaagatcgtgatcttcatacatggtcttacgactttgctgaggcctgtgtttttgggtaaacagtcacctccgcctggtcactccgcctggtcactgtgaccctcttttgcgagggggcaccccttctccaagatcacgattgaagaaaaattcttcaaatttagtcaaaaacgttggtgtgaaattcagagaacactaatttataacacagtgtgtcttattaacccaatctagaccaataagattttcaccattgtgccgtaattgcaatgcttttggtttagcataaaagggaaacccaacccctgtacgaggaagcaaaagcctagtgatcttctattgtttgacaattggagaagaaaatggatgattggcttatgggtggtgacttaatggctggctcattatttggagataagaaactagtggaagcttggagcatagattgtttcctgaaagatcatgttgtcatgttgatgccatcctttagtagatgtttgacatttggagaaaatcacacttgggagttgggactgtacttagagaaggctactgcaactgcaattcaaagggtgtagttcacatcaatcaatggcctttagcacatgaagttctgatgcttatgattcgcatcctaaattcctaatatctgaacattgtagatatagtttcagacttctgctagtttgcttttggaaccttgtgggctgttctgtttgactacttccataactgatgaagtttgatgctaactgaggaagatgaagaaagcttgatgtaactgttatgttcttttaaaaaaaataaagaagaagtctgatactaattgctatcatgataatgacgggatggtaaaggtccactttgccttgggtgcctcagccatgagtcatctgatattctttccctcaaacaccatccaaaaacactgaacaggtagtactgatgccctgctactgaagagcctctctgaagtatttctagaatcctaaatagtactactctttggtgaaaaatactttcttttttgggggcaaaactctacaaaattgaaggcacaaaattggtttatatttgtaaatgagcaattttacggtccttgagaagataccatgaggtactaaaaatttagtataaaatttggtacctcataaaatctagatattaagaggtataaaatttacaataaaaaaagtggtaccttatagtatcttatcaagaactgtaaaattgttcatttgtgaatatacccaaaaaaaatgtgaattcattcactccaatgcccccggtatgattaatgccatgaataatctagcaacacaattacaccaaggtatacctgtgtgatacatgcaaaccacaccttttattttgcaagattatgcgaaattacataggtaaatgcaaaccatatttctgacctgtgtaatttattactactatatgtaacttccttatagaatgaaattgtgtgttagaagtagattgttcatttcaagtatgcttatggtatccgttattctgacttgtcaaaatggcatcatctccttagagaaaagcttatttcctttgttaaaggttaacatcaaagcggttctatcatatggtccatggcttattcctcatgcatttatgcatcaacgaaatcaccaaagttttcatgatatcataaaggtcaagtgaagtccatgcactcaagtgaccagaaatttttggacctgcctaagatcagcaaatctagtgaagccatgctgttgacatgtgagattaaggtcactctccaaagtccattctactccttttcttcctttcttgacacaaccattaatctcgtgctctgcttttgtccatggcttgttgtgttcctaacttattgttcttggccacttggttccattcagagaggagtagtttgcactcacaaagtgaagtgacaatcttctttgaagggttaggacatgatcacctgttaagtgagattctgtcttgacttgtgagcagagcaaagcagcaggagcagagcttcacttgatttgcctcctctctggtgaagcagagatgaactccccaaattatcatttcaaaagtggcaaatcaccacttcaactatatatataataatgttcaaattgtggtgtatacatgcttatgaataaagtcgaattttcttctttatttttcttctatccaccgattttctccctatatcgcacgctcgttattacaccagaacgaaaaccgattgagctcagagcatcctgtcggagaggctgggcagccgccggaagaagttgacggccgccggcggcatggggtcccggaacatcgggtggcggaggtagtagaacccgccggcgacggccaccatcttggacggcatggcgtacagcgcgacggcgacggcgaggcagacgccgacgaagatccggctggcgcgcgggtccctccagctcaccagcgcctgcaccctctccccctgcgccgcgacgtcgcccatgacgcgctgcacccgccccgccagcgtccgcagcctctcgtagcgcgcccggagcacctccggcggcggcacggcgtcgaactcctcctccaggtcgtcggcctccaccgtgtcggcctgcgacagccgcgcgtccatgccggcggggccgcgcggccggaaccggtagtaccagacgcccatgaggaagacgtagagcgacgccgtgggcacgggcagctccgggtaccanacgaggacgaggtagaggacgtgaacgagcacggtggtggggcgggctgcgccaccgctgcacgctgtcgagccaccgcgcgagcccgacggcccaggcgagcacccccatgatgcggaaccagttcgccttggcgcgccgcacgctccacgtgtgcgcgtccacgtcgagcatgtggcgcaccacctcccgccccagcggcggctcggaccgctccagccacgcggcgacgacgcgcacggcggcggcgcgcagcgcctcctgctgcgcgacgccgatcgggcggaggtagtgcatccgcggcagcagcggcgaggtgtaggtggcccaggtgtccggcaggtgcgccggcgacgtgaaccgcacggcgagctgcacctcccccatcttcttgagccccgaccggagcagcacgagcagcgggtacgacgccgtgtacgcccggttgctctccagcgtggacacgcgcacccgcaccttcccgatccggtagtcctgccgctgctcgtccccggcgccggcgaaggcgaacatccgccagttgtcgaacaccgccaccgtgagcaccgtgcacgggtcgtacacctgccacgtgtactgctcgttccaccgcgggttgaggctgtccgtgacggtgcgcgtccgcacccacttcttgccgtacttggccacgcagtaggcgtccgtcgaccccttggcgccgcccttcgtcttcatcggcagcagcccgcacgccccgatgatgcccagctccagcacgcccaccggcggcctccacagctgcttcgccgtcggccggtagtcgctgcacacgtgcgccgcctcgtcgagcacgtggtaccctccttccaggcacagacggaggtgaagccggccggagtagaaccccggcgggccgccgccgggaccaatgccgatgtcggaggtgccaccctcgaggctgaaccacctcgacgcgacgagttgccgctcgtggagacgctgctcgacggagttgacggggatggtggcgtgtccgagcagcgccggctccttgatcatggagcggtcctcgacgaggacgacgaggctctcgtcgagcggctcggacacgacgaacatgaggtcctcctcccacgcgaacgccgagccgctgctcctgctcgccaccgaccgccgcgtcctcgccgactggaacccgacctggatcttgacgcgcacgtcgaacggcagccccggcggcggcgccggcacgcgcaggtcctgcgcctcgatcaccgacgcgcgcaggtaccagagcttgggcgactggtacaccttggagcgcgtgtacgcggcgtacggcgcgtcggtgttccacgcctccgggaacgcctcgtcggcctgcgtgccgatccacaccgccaccatgatgtcgccggtcaccatgccgggctcgccgccctcgagccggtaccactgcggcgccagcgggccgtccggctggtcgcggaccggcacgtcggagaggtcgaagcagacgccaccgaggaaggcctcgatcggggacggcgcgccgccgtcccagacggatatctccagcgtcggctccggcttggcgtggttgatggcgaacacctggttccactccgggttgccggtgccggagacgtcgcggccggggcgcgaccggagcgtgtgcgggccggcctggatcttcacgtacggcccctcgcaggcgcggatgccgcgcaccttcacgacgcggacgaacaggtagcgcatcggctccaccaggtcgtacgacgactgcaccggctcgacggcgtcgccggtggacacgaaccgcccggagatgacgcgcggcgaggtggcgtagtactccggccccaacccgccgctcaggtggcgcgcgatgcggacgcgctccgtggccatccgcgtcttgcgcacctcgggcgggtaccccgcctcgccgccgtccggctccggttcaggctccggctccggctgcggctgcggatgctgatgctgatgcatcggcggcgccattggcccgtgcggcccgtgcaccgccggcggcatcatcgggccgtgcgggccgtgcatcggcggcatcatcgggtgatgcatcggcggcggcgcctcttccacgatgatgacagggggatgcaccggcggctgctgcacctcgacggcggcctcggtcggcgcggggatgtccgggaggtccctgggcgcctcaggcgggacctcaggcggcggcgcgttgtcaccaccaccaccctccggcggcctatcctccggcgaagacggcgcctagtcgtagtagtaaatcttgaggccaacctcgccgcggatccagctgagcaagctccgcttctcgaacgggaagtacacgatcccctcctcccctcgccgcgagaactgcgacccgtagatgcgcacgcggccgaggaagtgattcttcccgccaccgccgccgcngccgccggaagggttgaagcggcggtcgtggtagagcgagacgtcgagcgcctcggcgtgcatggcggccgggtcgtgcacggcgaactcgagccgctcgtgccactgcgggctgaggtcgcgcggcacggtgcgcgtccgcttccgctgcccgtcgaagtccacgacggcgaaggcactcgacgtgccgagcccgtccttgggcaccaggtcccgcgcgtccaccacctccaccgccagcctccgcgccacccgcatcgcccccggcggccccggcggcggcggcccagactccggcgggggcgcaccggccgccatggaaacagagtggaggtgggaaaggaggtaagcgaacgagagagaggggagagagtggcgaatggaatagggttcgcttatgatgtgaggctcatggattggatgctttttttgcttttggacgctgcggcggcagctgctactatcatactatggtagctagagtgcgtgcttttggagggagaatctgggcaaagagtgagaggaggaggaagatggatggcggctttcttggcctggaagctcacgatcgctttggtgctcgatcgatggcgcagaatctgatctgcttgcttgctttttttctttcgagtatgtgtgcaggtgatgccggtgtgatctgaattgtcgccgactcgtcgtcttgctgctgctgccgctgcttcttcttcccgccttttttcacctgcgttcccaacagaggcggttaaataacttccaccaaccgcgcgcggcgccggaaaggaaaaaaagaagagattttacacgtgtcatctctcatctgtcctgtgttgtatccttctcggaggattttgatagtattttccttagaagttctaacttttctgttaaatcaaatgtttgaacgtatacataaaacataaaatatgaaaaaaaaaaccaattatacagtttacatgtaaagtgcgtgacgaatcttttgagactaattacatcatgatttgataatgtggtaataacggattaattagtcttaatatatttgtctcgcagtttacaggtagaatttataatttattttgctattagtttacatttaatacttgaaatatgtgttcgtatactttaattttttttaaatggaactaacacggcccttgtgctttgctgcacgctgcacggggaatgcccgaccttttcaggttctcgcctctttggggtaaacgtatctgtttcttccaagagagttaagagtatatatatatatgagtatatatatatatatactactatgccccgttccctaattttttttccaaaaacatcacatcgaatctttggacacatgtataaagcattaaatatagataaatgaaaaaactaattgcacagttagggaaaaataacgagacgaatcttttgagcctaattagtctatgattagccataagtgctacagtaacctagtgctaatgccagattaattaggctcaaaagattcatctcgtggtttctatgcgagttatgaaattatttttttcattcgtgtccgaaaagtccttccgacatccgatcaaacatccgatgtgatatctaaaaattttctttccgcgaactaaacagaccctgtgtacacagtacacgttgcaggggtgcagagttctctgcttttcttgtagattcagtgagatctatgcgtcgtctttgggcaggattaccgattacacatttacacccaatcgtcaaatggccacgtgcaccaaactagaagaagtagaagaagaactctgtttcttttgctcaaaattgcgcaacatcctcaagatgttgttcgacgagacgacggcgagcttaaatcacgagatagctgagtatctccagttctccacgtcgcagagcaaaattagacccatccccaacaaaacacgtgcgtatcatccaggtatacacggtgtatacttagcgtggcactcaggctatctatgtggaatgtggtgccctgttcggtactccacgtggcttgcttatactggtgccacgtaagcactgaatgagaaaggcgttattttttttcctgattcctacttatgcattttctttctttcaaaataaaatcactttgcttatttcatttcccgcatataattccctaatattttagccttttttaagtcgttggttaaattttactcttatcccgattgttcacatttgttccgtcttaatgaatatcttcctacattcgccccgagatctagacaagaaattattgagcacatgagccactggcccaccgcccaagatactttctacgggtagtctaaccaccacctcacatgtgttcctctaccctctattctccagtggtttcgcccttaaccattctatcatagtcatagttatttttttcttctcaaatatttccatgtgggcacaccgtgtgcttctgctcctcggttgcttgtcgtctcctgatacatttatactttgtttctttttcctctttccctctgtcacttttgtctcgaatgcctcatgatcatttagaccttacaacccttattgtcactaacgtgcatagaggttttaatagccttaccattattgtcttgccacctttgtcactcatgcctaggctacctttatcccaacctccttaaggatactaatgatgtcaactatgttgactaatttctctttttattacttaaaagtgtagtcattcatcttccccttccctccctcacttcgtgtgcagtgcatactgcatactctcgcataaaaaatagaaaattccccagataaatagttgttagttaaaaaaattcccattctttaggctagatccattcccagtgatatagccaaaagtatcagaatttaggtattgctaaaactatagaagacaaaagatgaagcatagtcaaccctacatacaacgaatcaaaatgttaagggttcgacccattttctcgaagaaaccttggaatgaaccgcaatgtcgattgcttagctcattttctctagaaaatcttttttttttgaaaaagaaaagttgcctatccatttctactcattgaaacgggggaaaatatgtagtgcaaaccatatatacagtggaaactaccgttga

SEQ ID NO: 81793 - DNA, 39665 bp, Oryza sativa
cccccaaacagtctaaattttcacctagactgtgaaatgatgtagctgtataatccagaaaatgaactagaagccataagctggatttgtcagcttctccagattgtcacctgctgcttctcaaaatactaagctcccccaaatagggccaagtcttgcctgcgtcgacaactcaaccatggttactaattaactttacatttgtgttggtgtcatggtgtgtgataatattgacagtacgtttttctctgtgtacacacataattttggagatgacaaaattagcatgcactcatctttatatgctcagtcgtatctctactttagaagaatgtggaattgaaggatggggcttaaacttctatgccttatgttgatcacctgcagctatatcctccacccccactccccccccccaaaaaaaaaaagagaataagttcacctgatatcccaaaactttacgtcgagtttgtctgaggtccccaatctccaataccagaaattctaccgctcaactattacaaaccgtgtaaaataggtctcaaggcagtatggaccaaatttaaccccggttttactaatgtggcatacagcaagccccacatgttagtgcgccgttagggcgttattacactgagtcatctctcttgttgggttggcgcgagtttttccccttctctctctcttcgaaaaccctaggttaggcggtagcatggtggtggcagcgatggcggcaaggagaggagtgcatgcgaggagatggcgagttcgtatagtgaatgctcttcgacttcctcccatcccaccaatcgtgctcccatcccgcctcatgttgggcccttcgagtaccacccggtggtgatgtgcaagggtggtgcgaaagcggcacggtggatctcgtggggagtcgacaacccaagtcgtcggtaccacaaatgtcacaatcaggttagtgttcttcgatttgttttgtttggttgttgttatgggagttgggatttagcttgtggtgaatttgcatgtcgaactttcagggcgccggctgcaatttgtttgattggtatgatcccccatctagcagtttcatgagagagccgttgtatgatcttcgagatgtcgtgttgtcactaagagggagaaggctgagcttgagcattttgttgatgaattgaggacgaaggaagaagagcagtgtgcagagattactgcagcaaggcatgaactagcagctttgaggcttgtggcatctaaggatgaagcaaaaattattggactgaagccaagtaggctagagaaacagagatatgtgcttctaatgttactgttgacatgtgtgtttatgttgtttgttttggtgttagtgaagaactgagctgtaatatgttagcatggtaagatgtatggtggattggtggttgttgttatgtctgaaatttcagtgaatgcatcaatatgttcttttgtttgtcatgaaatttgagtgaatgcagcaatatgtttgatatgagatgaaacatattactcatcttatgtatgtgcagaaatatttgacataagttgaaatgccatcaagtatgactgaagattcatttgagatgggctaagagtttttcaaagctacaaatattacatgtgagtttggcacacatattatgtggccattagttagccatcccatacacagcacatgacatgcccaagagtttggcaatgcatcacaaaatagctgctcaagtgtgcagaaatacatcacatcttatcagattcccatggaaaagaaacatcagtcgactaggggttgatttctttgtcttggcactagcaggttcttgaacttgaacaaacacacatgcttttccagaagtgatcctcactaaagcagttctagagctctgagaatgtggcactatggcctgaagattcacactggctgaaccaccttgtcgggttaatacccttgcactggctgctaccttcaccattgggttggttttgtttggtgcctacaagcagaagatacaattagaccaggtgaatgagagtaatagtttagtccaggaaatggtacagacctttttcacaggaggtgatctcctccaagtctggcaagcagatgtgctagtactgagttcaactgcctttcttttcctgctttggccaatgctgctaggtactgagttgttggatgcattggcagcattggtagtgtgccgagaagctgttgtgctagttcctgcatcagtgtacttgtgacagcttgatttgttatgcccagatttcttataggtcctgcacctgatagttgttccaaacttagaaaccttttttggtttagctagttcattgagctcccttctccttttactcctaggcttccctggcaccttgatataccctagcacattcagtgcctctctaccatcctctggccaactagactttccctcaatttgctctttcttctaataacctcaccatcactgccaatctcatcaaatgactcctcatcatcattctcagcgtagggggtgctattttcatctggtttagccctaccatgcatagcaagaagacttctgtacccctcaaacaccacatcattcaggttataagcctttctagtcttcatcttcctcttgacctctttgtaatgtctctctatctccctagcctcagcatcatcatcagatggagaatcatctccagctacctaattattgtgatcctcactgtcaaatggcatcaaagtggccagaggtgatgagttgtctatgtaaacaacaagcattttgtcactagcatcagcatcttcttgcactgctttgtcctttagttttgctctcatttcattggcaccattaggttcttcttacacagcttagcccttcccttcggctctaagcttgccatccttatcttcctcatcctcatattcttcatccacatccaattacatttcagcctcaccatcactatcttcatctaaacctacatcaataacaatagactccttggctacaccaccctcactgatacaatcaaacatgaacttgttgacgaaaaatccacgctcagccgatggtgtcggaactgtgttggcgcgaactaagtcgatgaacacaacgacctgggagatctgcttagctccagtccaggtccaaaaattgatgagatatgggcgtgccagtcggtttgatcctgcaactgacaagatatataaattgaagatcaaagagccgatcggctgataagccgatggagtagttccagccgatgccgatgccagccgatgcctatagggttttgaacaatcgactatatatccaatgtaaattatgatacttaagtaaacaacgatatatagacaatcgacttatgataataaaacaacaatataatccaatagaaaccaatcggctaacaatgatataatagaataagtgatccgatggttaaagcatacattggtttgaggtccaatgtcattaaatccaaatgattaaataaacaatgaaacctcgattatcattggctaaatccaatttctatgcaatccttataagccgatgcaacgtctagataacttatcggctgaaaccccgatgaaacccttattggcaatcaaaggtaggttagtttttatggttctaagcacgagtaaggtcgatgcaactcaaagtatgcaaaaaaaaaacataaatttcagagacgtcagacagacttgacaaaaagttcagagatgtcaggggaacttattccccctcccacctcccccccccccccaaaaaaaagaggaatgtggaatgtgctccacatgtggactctcggagtttgtgcggtattattaggggtggaaacgagccgagccaatcctggctcggcttgcagtggctcgcaacaaactagtcttgccttggctcggctcagttagggaaacaagctaaaacttgagctcggcccggatcctttcctggctcgagccagctcgagctagcttgcaagccttcctattgaaacacttcttcatatatattttgtaattattagaaaaagcaagaacaaatcatcaacatgtaaaatttaaataagtttatatattcaattcttcaaaatcttaatgataaatttcaagttgtcaaataataactccataaaaagttaagtaatcgatataaacacataatgggctaggctcgcgagccagctcgtgcttggctcatttcagcaacgagttgaaaaggaggcttgggctggctcgtttggttaacgatccgagccaagccaaccaagctcgagccaagtgttacgccccgaagtttccccctttgtagctttaaaatccgtttaataaattgcctgaagaaatggtttaatttaacctagagatgaaccttaatcaataaatgcgattaataattggaaagggcatggtgggatttttcttgagttcaccatgccacaatacattaacaggatttttagcggaattttcagagcctcgaaaataattttaaccaattataatcaattctatgcaatatataaatcccaggaaaatccttttcctttttcctctttttcttttctctatcttcctttcttgggccgtcggctcactccttaggcgccttccctatccttgctgggccggcccatggccgtgtcccattcggcgccgcatccttccgtcttagggtcaccaactagttggggccacctgttggccccttcttccacctccagccagcggcaaccgccgctgctgtccaccttctccgccttccgtgccccactccacaccgcgcccacatcactgcccactactccgattttcccgcacgcgcgcctccccgcaatggccgaatttggcttcgaatcccctcctctctctctgcacctccccatgtcgccggcgcaataggccaccctcctggccacgtccgcctctccctcacctataaaacgcctcccccgagccccattctctttttccgcgctcaccgccttctcccgcgctcttcccacgccaacccgagctccgccgcccaccgtcgatctctgaccgccgctaaccgccgctagagctgccgccacgccatgccaacactgcctctagcttcgccgctgcgagagctacctcggccgccgcctcccgtcgccggaaccccaccaaaaccccatttccctcgtcctccggtgagcccgccatttttctccatctctggccagcgatgcaagccgtcgtggtcgtcctctccactactaatccctctccgctctctccttaggtgtcgtcggcgcctgtccgccccttcgcgtcggtgggtcgtcgctgccgccttcatctcccgctccggccgccatgctcgccggggaaaaccccctccccctcctttcttctccctctcccatgtgcgccgctgcttcgggcatgcgccaccgccttccgctccgccgatcgccactggtgaccgtgccgccgccctcgccatagccggtcggccagcttgaagccgaggccgagcctggcaactgcttcctgccgccgtccgatcggccaaaggccgatctggaacgtcggtcccgtggatcggcggtggaccgcccacgtggtcccggtccacggtggaccgacgtcctggtgccgctatcaaatggggcccactagctggcgccactcccccctccccgagccactgacatgcggggcccgcttgccggcaccgccccctcctttgctgacgtcagtcctaggtattaccgtgcaataaatcaattaaggcttttccatttatagtaaaaacacagataatcttctaaaaatcataactaattcatccgagctccgtttaagtccatttaagtctcaataaattcataaaaatccctagaatccattaaaatggttttatttcctgtttcagtagacttatagcatgttttgcttgtgtgctttgtttgtcacatagattccggtcgtttcgtcgctccgcgatacctcaagttcgttgtagaagtctcataagtgcgagagcaaggcaagtcatgcattacaattgatcatattgtacttggtttacaaatgtcccgctttctattaaatgttgcattattttacaatgtcatgtgggatggatcctattactcggccatatattgtttcccttatgtcattgataacttgggtattaatttgattagatgttggtttaggaaatggttagccatgcttagatccactagttcacataatgtgataattacattattagacacttagtaccatgacgagctgcgtgctcgagacatccgaccatgtttcattagtcgtaattatccaattaaaatgtgactgaatggtgggctgtgggtgcatggttttgctggtcgtacccatagcatttaagtaccggttcacgggaaaccctggaagacttattgtgcttaccacaagcgggagtgggtaactgcttaacttgtagtatagcttgaccctttcctaggcaccggtggcgagggtgggcgtgatggagttgggtcagccggggtgtccggttgtccagcttccagattcaccgcagcgcacagggagactgcccactgcctgtttaggagtgggggtgaaacctcatcatggtgtggatggttaggggagggttatgcgatgggtctcgtcacgatttccccctttgcagtaacatagtggtactgcaggacatggcaacatgtgtggaatcgtgtcttgtgggtacagttgtacagctctgaccaaagtaaaactattcgaatagccgtgcccgcgattatgggcgatcaaccagattcaccgtgattagtcccatccctaatagttggcttgatgaattggtgttgtttaggtggttggttgggtctgttgcaacgtggtgtagcgttggacaatgatgattaatattgcttaatttacctcaacagctttactgcttttaaatgcctgctttatgcaaatgaacctttagcctcctttggatacatcttgcatcatacctcctcttccggtatgatttactgagtacagtgggtagtactcggtctctctcttccccacaccagagctggagttttctcagctggagctttctcgaagaagtcgacttcgtcgctgccgtcaaggatgcccgtggagtggagtcgtcacgccgccgagtcaaggatccatgcgagaggcagcaattaataaggtgcaattaataggggcaaattagtctttaatgttaaaatggtaaaactttaccatacatctgaacaccaacttgtaaaattccaatatcaaatcttttgccaccaaaacttttgcaaaaaaaaaaaaataccggagcaaatttatctaaacatggccttgttcatttcatcgttcttcgttagttgtcatatacaaatatccataaatgacacagcagttattgtactgaggtaacctaagaaaaacaagattgctcttcggttgggttaatcttaatttcagggtgtgtttagtttacgaaaagaaaatttttagatgtcacatcagacgtttgaccggatatcggaaggagtttttggacatgaatgaaaaaacgaatttcatcctggaaaccaagagatgaatttattaagcctaattaatccgccattagcatttataggttactataaaatttttggctaatcatggcctaattaggctcaaaagattcgtctcgtgatttccaagcaaactgtataattagttttttaaatttatatttaatgttttatgcatgtgttaaagattcgatgcgaacttttttggaaaaaaacttttaggaactaaacacggccattaatagagagcgtttgtttggtttcggtggactggaatttgattgcgggcagcccaacgaaaaattgataccatcgaggtcaggcccatgggttaacccttccccggagcttggagcaccgtcgccatcgctcgcgtcctgcccgccgacgccgccaccgccgctcgccggagtccccccgcgctagattgggccgaccaatcggctccaccgtcctgtgccctctgcagcagcctccgcctgatctggtaatctctcgcctctgttcttggattgctgctgcttcttgcgtcatgcgcgattcatcccctccccctcactccaatcccacactaatctgcgtctgagcttggaatccggtgagtcccatatcttcaacccctcgctggattctagtggtggagctggatatatctcaatcgataaaccctagtattaacttgctttattcctcattttgtaataaataaataaataaataaacaaataatcttgactcatcctaatccagagttatttttgtgtaaaaatgctagtggtctccattcactgcatcgccattgatgggtagaagggggtaagaaaggcaggtcagtggtgggtcacaaccagaggcctaaacccggttccaatttggagggggtacaaacgcgcaagcggcggaagcaagatgatccaagtaagaatgaattactagctagttaactcgcattccctcaaccttaatttcctctacatgacagcgattgttgattgatttcatagtagtatatgatattgctgatgcgagttatatgcgataatgctcaacaaattcagaagataatgatggaagctttcattcagcagcagctaatgagagtgatgagagtggacctgttcaaggaaagggtgcgaggagtcgtgtccctattgggccaaatcatcaggctaagttaccagattgtacatttggcaagaaagacggaaatgttgctgaggactctgctgatagtctctcatgtctttatctcggtagtgataggactgaaaacatcagcaacaatcaggctcctgtgcggtaagtccaacattattgttcaatttcctgtcctttctagtatcctttgatatctcatacagtgtaatgtgcagcagctctgttcttcatccaaccgatagtatgccaactgatgccatgccactgctgttgactccaacattggggcctcccattgatgctcctcagccagaaacgacagcggtcgttcatgagtccgctggagaggcatcgaccacgtcatttgactggtcgaagttaacagagatggggtaccgggcggtggaggtgatccagacttggagcagcgaagtcaagcttcttaaaaccatattcgtggaagagaaagacaggaatgagcatcttaagaccatgctcggggaggagaaagacaagaatgagcactataagaccatgctcgcgaaggagaaagacaaggccgagcaccataagaacatgctcgaggaggagaaagacaataacaagcgccttaagaccatgctcgtggaggagaaagacaagaacaaacaccataagatcatactcgaggaggaaaaggacaagaacgagcgtcttaagaccatgctctcagaggagaaagtcaagaacgagcaccttaagagcatgctcgcggaggagaaagacaagaacgagcgtcttcagctcagacttcacggggaggaaaaagataagaatgagctcctaaagaccatgctcgcggagaagaaagacaagaatgatcgccttcaactcagttttccaaagaacgaacaccttccacttggtcttcagagagtgcataccaggttggacgaatgcatagccttgatcgacagaattactcagaaagacacggtttttctggaaatgttatagaaggtggaataaagaagaactgaaggtgtgagtcgtagatttgaagtatggcaactttgcagttgagcaagctggctgtagtgtattgtaaaaaatggtcgtgtatcgcttgatttctgctatgttgccgttcagcacaggcacagcagtcttggcagcaaccaaagcgattttttgtaggaaattaaacttgggtatcaatgtgaaaagggaagtgctgaatttttggcaactaaagtaaacaacttttagaactaaaattcttctgcgtggtcaaaatttacaccaacttacatgcttgcaccacatcaaacatacgttctgcctgagaggaccatgtactccctctgtgccacaaaaagtcgaattctggagggaagagtttgtcccaaaaaaatcgactcttgcagaaaaccaaaaacatcccacaaaaagtcgaattttagaggggggagtttgtcccacaaaatatagactcctgcgcagaaaaccaaaaacgtcgtcttggtgtacatcgatgggcccatgacctctctctcctctcctcacattcacatcactcgagccttatcccctccccgggccctggcatctcgttctcttgcgagttcgcactcctccaaaatcccgcatccagttcccctcctcactccgtccatctctcccgctcctccccgcaccttcctccctgctccatgctgctcccgcttctcccgcctctcctgcttctccgtgtccacctagttgcggccacgcggatgcggcggcggagggttacgagcaaatagatctgatgcgggaggcggatctggtagaagggttcggctctccagcggcgttcatggcagtggcggagcggtatatggctttgattcaagagacgcgagccaaggggaggaagcatgttgtcttgcagttctgatccaggaggcggcggcgaccgcgacggcgggtggaggtgactcggatgcgacagcggcttcggaggtgtgtaaggcggtggatatgatgcacaaggcggaggcgatagatggatgcggtgctgttggcggatctgatgcagatttattttcttcgttgttcttggttcttctatgttcttgcttgtgaatccagagcatttcttctttttttttcttttcaaattggagaaatgtctcttctttatgtagtataaaaatccaacttaattttgtcccttttttatgagacagatgcctcctatatgtactggagtacttattaatagtgagggtattttggtatttccactttagtccttaacttgtattgggaattatgaatcgactctttccgggacggatggagccttaatcagaggacaatcaatcctccccaagaatcaaaatatgaaggcggcaagtgttaggattagagatatgaggggtgtttttctgctaaaagtggagtaggcactaggcagcccctgcagttaaatgcccctctaaacaaatgtccccaaaatctagcacagttggtacaagaagctacaggccttcccgcaaaaaaaaaaaaaaaaaaagaagctacaggcctaccccgtacggcagaagagtcacgcactcacgctctgtttttccccatccctcaagaagatcgattcctcctccactggtcctctccccttcctccaatcctccccttatctgcgcaggatctcggaagcaggtaagtctcatcgatctctcccccctcactggattcttgatttctcttgtgatagagccggataaatctcaacccataaaccctagtagagtataaactttgttccattaactttgtttcattgattcattccctgcaagcttcgcttgtggtcctaatccggagttgtttggcgtcaaaatgctggtggtgatcttccagaccggaggagcagggcccgattcatatccatcatcggtatcgatggcgagaggcagagggggcaggacgaagggaggttcagtgggtcacagcggcaagaggggcaggcccagcgccatggcggaggagccggagggaggagcagcgcgcaagcggaggaagcaggatgacccaagtaagaacgagctcgtgttagttactactcagctttcatttcttccacattgatttgatctccacatgtatattaattaacatatatgatgttatatttctgtggaaattgttttggtatataggagtacaagatagtagcagcaaattgttgattgatttgattctagtaccttcttttatcccttaagctctatcgaaattgattggtattcagaagacagcaattgttgattgattcgatgttagtattatagaaattgattggtatgcagacgacagtaattgttaattgattcaatgttagtatacggtaatgctgatgtaagttttataagataattatgctcaccacgcagaggattctgatggaagctttcattcaccagctaatgagagtggtgacactggacctgttcaaggagagggcgtgaggagatgtcccaattgggccaaatcatcaggctaagttaccagattgtacatttggcaagaaaaagagcagtgtcgccgaggactctgctgatagtctctcatttctttatctcggtagtgattggatcgaaaacaaaagcaacaagcaggctcctgtgcggtaagtcctactttactgtcgaatttcctctccagtatcctttgatttctcatatagtataatgtgcagcaggtttggtccttgtccagccgatagtaatgccatgccgctgctgactccatcatcgggacctcccactaatcctcctcggccagaaacaacagtagttgttcatgagtccgcgggaggggccttgagctcgtcatttgactggtcaaagttggcagagatggcgcagcaggcagcagaggggatccacacttggagcagtgaagtcgagcgccttaagaccaacctcacagaggagaaaaacaagaatgagtgccttaagatcatgctcgtggacgagaaagacaacaatgagtgccttaagaccaaccttgcggaggagaaagataagaacgggctccttaagaccatgcttgcggagagaaagacaaatatgagcgccttaagaccatgctcgcggatgaggaagacaagaacaagtgccttaggccaaccttgcagaggagaaagacaagaacgagcaccttaaggccacacttgtggaggaggaggacaaaattgggcaccttaagaccatgctcacagaggagagagacaagtgtgagcgccttaagaccatgctcgctgatgagaaagacgagaacgagcgccttaagatcaaccttgcagaggaggaagacgaggatgagccacttaaaggcatgctcgtgggtgagaaagacaaaaatgagtgccttaagaccatgcgcagcagctctggtccctgcccatcctttacattgactgatgccatgccactgctgactccaacatctggacctgccgttgacactccttggccagaaatgacaacagccattcgtgactccgcaggaggggccccgaccacgccatttgactggtcgaagttaacagagatggctcaacaggcggtagaggtgatcctgacacagacgagtgaagtggagcaccttagagccacgcttgtggaggaggcgaacaaaatcggggaccttaagactatgcttgtggaggagaaagacaagaacgagcaccataagacaatgctcgaggaggagaaggacaagaacgagcgccttaacaccatgctcgtggaggagaaagaaaagaacgagcgccttcaacttagtcttcaccaagcaaacaccaagttggggcaatctatgccctatgccgatgttttgggcattttggataagtcgattgacaaagcatttcagaaacgtgacatgaaaaaatcgtcatggaaaaagttgtagataaagtatggtacgatctgtgtaattggatatgcagctgtagtattttgtcatggttgtgcatcgctagatttctgctaatctgccgttcggcacagcagtctgggcagcaaccaaagcctggattatacctagccgcgtccgatagtccaagaccgagatgaaggagaaagtaatccaggtggtcagtgctctgatactttttctggagtgttaggtccatagttcaccttgttatggatacttgtgtgctgtactatgtacagccctgtatcaggattggtggcttcgagtaactattttttgttagtaactttagaacaaaatttgttgaccgaaaattttcgttgccaaatatttttcttgagttgacagttaattgaacttggacaatcaattctccccaagaatcaaaatgataatccttctggggaatgaaaagtattttctttgagttaagctgttctaggcttcacatgaaagattctttactgattgaagattgcaattctatgtttaatccttttcttggctagccaagcttttttcttcatgcataagaagcataaaccagtatatcagaaagagtgcaatagattatacttttctcgacaagaaagtgacttgtagaacatgtaaaattggatggtcatttatgttctgggctaaagcctgaagatgattcaaactgaagattgagctcaagcctgaaaattgtacgactccaattgatagttggggttgcaattcagagttggaggaagtgtagaggaaagggatctctaaatgggataaggcttccaatattcctcaagtgaaaataggtacctccaacattgtattttacttccagtctataagctactttgatccacaatttacggaccatttttctgttttcagtttcatactggttggtgctacacgtttcttatttattacgcatcctttcctttctactgttctttagtcaaatggtatttagcagtgctttttactgctctttgtttcttttcgttttattctgcaaacttgccattgtgttgtcttatgcctgttaagtgtcagcccctttctttaattttatctataaacatgacttcaaatttgtttctgtgattatttgcaaaaaaaaaaaaaattctgtgaaagtcttgagaaggataaacatttcccttgcaaaggaatttccattgtaattgtgtatttcacaaacagtgagggttaaatgttgtatccacattttctttctgggcctctgtaagcagttgtctatgctactgtctttgccttaagatcatattttatattttccaatgttcttaactttcgttgtataaccaattaatttactcctgacactcatcgatggataaactacaaaacctctgcatgtttaatcatgggaaaggaatgcagcaaaaggacttaaaatatgctgtggtaagtcattttgaagaaacatgaacaatctatgtgctcccttttacttttttttttagataatgagaatcaattcattgaaatgaaattacacccggcaaacgcatcaactagggatgcacacaacctgaaaatgaaaaaataattaagatatatacttttcttaacaggaattaacttctaggacttgaaaatggcagtcatcttagtagattaccaagttgaattccagaggaattcgtcatggcacggcgcacaccatcgagtgccaattcaggagatgaattaaactggccaagaattgcagcagatatgcacatcagtaacatcgccaaatgttaattacaaatttataggtcttaatcttctgcgtgcatgtcaatctctatgactgtatcttcatggatgagttcacctcgtccatcaataatcttctgaagccggcatgtaaattataactatatccagagacttatgagagcatgcatgaagcagtcctctgatttttggttttgtattcacctgactgtctgaagtgttggttaatttaccataattatcttatagataaggacagtgaaagctatagttagactgccacatcatgcatatagaccagttctctgattcatgtgcttattactgtaacgtttcttatcttgtagtttgccggattagtagttttgatgcagtcactccaattgcgatggtttgcaaaagcatagacgctacagttttgattattttgcctcaggtagaaacaagaaacatggatttaggtggacacagtcttttcttagcctgttcttgttatgttgcttcttgattggtattgatatggtccataaattttttttttgccctttgtaattatttgcggtaagcctatattgtcatcagatcactgaactcttcaaatctatcgtaatgtatatattcattcatgattcatggcatacatgcaagcgtgtgaatgaactagcttgtgtattactaatggtgcctttgttgattaggatatacttaaaattaatttatttatgttctttttctctgctaattggcaattctctttaatttgctattttctgtacaataactttttaataataggtagagatccggcatctatatccacaagtggatatatacaacccaaaagttataatcaggggtacttagaccctaagcttaacaattgaggagaaaaagaaaaagagttgctcccttcgttttatattataagtcgtttgatttttttcctcaaatttttttaagtttgattaaatttatagaaaaatacagtactctatctgtttcatattataaattgtttgacttttttcctagaagttgtttagattgatgctattttcaatcatactatttttgacaaagttgtaaaaaaatatctacatttagtttattgtcaaactttggtaaatacataagaaatcatgtcaaaattttggtaatattgccaacttggtaatgtttattttggttacaatctgaacaacctcatggtcaaacttagtttgaccaagtttatagctagaaaaatatagtagtaatttcaacacaaaacaaataaattatcaaaatatattcaatattagatttaatgaaactaatttaatattttagatgttactaattttttctacaaacttagtcaaacttaatagaaaaaaagtcaaatgacttataatataaaacggagggagtagtagactaagagcagttataatagcaagctataagccagctataaccacatatcaagaagaacagagaggagagagaagaaagcgggctacagatttatagtcggctgcaacacggactccaaaacatgtgtgtatgagaggtgggaccggatattaatggtatagtatatttttatagttaactattgtatgaatgggctattatattagctatagtcgttgttttggagccaacggttagttatactattaaacttagcaagtttaatagtatagccaactactagctccaaatcatatataaccaatgtaatagctaattcatacaatagttgcttactatactattaatacctggtcccacctgtcatatacacattacgttttggagtccgtgctacagctaggcacagatctgtagcccactgctcttctgtctcttcttttatcttttaaaaatatgtttatagctagcttatagtatgctattatacctgctcttaaggggaaaaaagttgaagaccttgctaatccttgcaacaatgatacaccacatcgctcgtttatctagaaatattgatgttagaattgtcctttctaacatcaattattgtataagtgcattttgaaagagtataaacgaaagcattgaattgggctcacttatctggggccatttgttgttgttggtagatgtgttgcttaccctggaattgttcagcacttcagctatatcttggtgcttactcatttctcttttttatggtttgtccacttattagtgtcacagttagatagctcactcaagaagactcggtataatgatagttacgtacttacacccattttttttcagactgaaacattctacatcgctatagccatgcattggactggtccaaatttaattaggcatgcatgaccacttttaattgtctcacacttgagatatttagcgaatcttcttgtgatgtgtcattatctagtcatatgaatttttaatttgcatcatataactgcaaaaatgaaaaactgtagttctttttttcgagaggctactgcaatcagctgaacaccaaggttgcaggtaaggttgcttacttgctttgcatcgctttcgttctcacagatccatcacaaaaaggtttatgtataaatagctaattaacacgttgcgtcaggaaaaaggtacacctagaataagtccactgtttgctggaactgccggatttatcataaaaaaatcacatcttttttcagctacagaaaacataaaggtggtagcctgagatactgacgatctttgcatgaccgggcagactcttatatttgtttgattgctaagtctgattgctcccttaatcagacagtaaaaaagatgttttgtaaaaaaaaaatacgttgttcagtaacctaaggtgcagccatttggtaactatgacattgacaggtaagagcaacattattgcaaatatagttggggactatacaaattatagtgctcttacacgtactgtagcaattaaaacagcatgtgaaaaaaatgttatatttctgtaagtcggttttagaaatcgacagattactcaaaaatgttactatttgagtatgctatgaaaaaaatgttactattcttttgagtaggctacaaaatccacagaaatttggcaagcaggggcacctctttccttcctgcctcttgcttcaatgatgtcaccctctaattgattgtcgtcgtgctctcaccatgcacttagggcaatagcaatgcgtccttcattattatgtccttcatttcgtttggcccgggctgccaagtagacctcaagaacttcaaaagacacaagacccacagtgcattttggccttaaactggatccataaaaatctgaagacaagaattccccatctttatcttcgttgcgtagactccaccaccgacgccatttaccgcctcgttttcttctcggttcccacggtgccgctcccctttgccacattaccgacacagctcctccccctctcccccgctccccttctccagaagcgacgctactctccctctcccactggcgacgcctctcttcctccctagctctaccgctccccctcgccatctccgcagcttgactgagctggagacgactcgacgacggacactccatgcccctcctcgccagatccgggataagagtcgccaaatctggccttggaaggtggcggtggcacgatgacagctgtccaacgccccccttcacggcaggggcagcctcgacgatggcggggcggcctcaacgaaggtggttgcagctcgacgacggtgggggtgaggggatggccgtggcttcacgttttggggcacggtctcgccaacgcgatttcgcccatctcctcacgtgtcacggggcttcgtcttgacaggttccgatgaggtacgggtgatcaaatgaagctccccgttcttcgcaggggctcgctccacaccgacgtgactaggaatcccaagctagtgaggtgaggccgaacaccacctcactatattgtgaatggccttatggtgacagagacatcatcattgaggattcttacgatgaattgtgattatccacgttatttcagttgtaaccattgggtcatttctttgcgagtaaattttaaataactataaccattctatcaaaattatcaattcactataattttctttagatatttgagaaaactaaaacaatagtatatgattttattataaagatacaactttgcgtttttgataagtttattccgacctatcatacctgcaatatgtttgctggtgttagtggggtccacatcatcatacacacaaagagggctaaaggtaccattttgtgataaaatcatttgctatttgttgtgattttgtgaaatacacataaaaaattatagcaaaataattgttttgacgaattaattatatttttatgaaaattactctttctttataggttgaaacacacaaaaataatatttcagtgagagaaatgttagttagccagctcagtcggcagcacagcacgtcaccatccagtttcccgtccgcgtcgatcaactccaaccacgtacgtacgcaaccaatatgcaagccacggagttccagctcggagagccacatgtcatcaaaccaaggaaagaatccacaattccgcatgccatgtcagcgagattgagacgcagtccggaggttggtttcaactgcaaggtctgatcttgtattctcgtttttcatgctcatgctaaacggtactacttgttattaaaaaacattgtatacatgtttttttagaaaattatattaaactatattttagccttttaaagttaatacttcattagttatatgctaataaactatctcgtttttagtgtgcaagaaataagtttacaactcatcttcccgaacaaagccttatatttactccctctgttataaaatataagtatttttggagtagtgctaagttaaactttttaaattttaactattaatagtgataaattaagaaagattaattatgcagatttgatgttactatatttattattaaacgaaatatcataatatgtaactctttttatttaaaacattttacttttatagatattgttggttaaaatagtatctcggagaccatgtcgatgtctaaaaatatttatattttaggatggagggagtatctatttccgttttatctcgctacgtcgactgatttggcgtcgcacgcgcgccgaccaaacgtactgaacctgaccacgacgacgacgacgacgacgacgtcttctgcacacgctaccggaggacgcgcctgcgccgcggctttgctttgccgaagctgccttccagcgtgcgctgctgccgactgatgatatatatctcgatctctcctgaaatatatacctgacgatgttgaacgattccaatcatttgccctgaacatttcctcatgaatattttcaccaccggcagatatattgatcggtcagtccacctgtaatctattttccacacctgaccattttctacggtaataattcggttttactttttccaatcgtctatatattatggatattatgggtaattgttatgaaactattatctcctgccagagataaatatggactcataccaaatatatggaaacgtatcctaatagaactcttcctattatgggtatatatattgagagagagggcttgagagtttggttgatgtatccacatctgagaaagcaataaagctgtgatgcctctccctatatccatgttcattgttcatctactatatgattgtgtgcatgagatcgtcgttttctactccggatcagcgagctaggccactagttattcaatacgttatcggcacgagattgctcgtacgctaatccgggtaagtgttctagtagatcaattgatttcggtactaatcagattgatctgttatctgtgtactgctcgtcgccggccaacacgaccgcccgcccgtgcgcacctgcacgccgcgctcgacgcgtggctaatggtcgccggttacgacgccgcaccggagcatgcacggcagcaggacgcatccagccgcgcgtgcccaaggcaaccagccgggcggctctaccacacgcagtacgcaaccctgcggctaggatccaggagcaaaggatcaagcagacaaacatacatgcacatgaatgttcagattggtttatgaaccaatctaatacatgcacgtatcgatctttaccaagcctataacaacatgggtgtgcaacgacgtgtcgacagtgctgggctatacacagctacaccatcacgcaactcgtcgacgccgcgtcgccgatacgctatgcggacgtgcataggcggatcggctacctttacatcggataaacgagataagtatcagtttcatctattctaatactctgcagtagcgagagtaatatgttagatcatgcctctagtcgttttattttctcgcatgaatagatgtatttgtccggcctttgcgccgactcttctcttgttatatcgccgaccacgaagtttgacaccacgcgcccaaatgcgcttaccatgcacacaagaaggtgcacatacataatccgttgaattgaacgacggattgttgtcccgaacgacgacacctaacactcggtaacacacgacaccacctagaagttgtcgtctttctagttaacatagtcgttaatctatgaatatattaacacactcgtcatcaccgatcttatggatcagcgcgcttgggacactctgtcggttgtgacttgtatgttaataatccatcatattgctatctgtatgaagtagatggtaacaaatccgagtcatcggcacctgcatgcgccgccgtcgccgtctgcacgtagcaacaccctgacgccaccgcatgacgtcttcccctatgtcaatggttgccgaatcaatccagagacattccctcgttgatccgccatctgaaacgccgactcgacggcctttcgaggccatccgtaacgcaattgacggccgccgcccgtagcgacgccgaggagcttacgcatgcctcccctcgccgccggtacgcacggcatgcctcccgcgctaccgcacgcggccgggacgagggttgaagccgccgtgagcgcccgccgccgatagccgtccgccatgccggcctgtatgccgagccgagtttcgtcgacacgtaacatggagctatgattgtcggacgccggtcatggcctgatgccaacgaatgccggtgtcggtgctactagatgttgcaccgccgctccgcctctaaccatggcaacttgccatactcgtccatctctaccgagggctcactagcaagtttgccattggttccatccatcgtctccattgaagaatggcaattggatcatacctcacccacttcttgtgggagaaggtcgtaatagcccattgggcaacatatgagatgggctggccaaattttcaagctagccagtataaggaggtgggccaagtagaaattggcctattaaaaggagtcggcacgaaccatgattttggtccgaaaacggtattttatttcaaaagtccttagtttccaaggcattatgcgaaactcggaaattatgcggaaaagtcctatggggcattagaaaaactaccgggaatatacattcgccatttatactttgaaccttcatgaattgggtttacgccaaatagagaagaattaatgatttataccttagtcccgtatttctaagtatttgctttaactatttagttagtttcttgaataaccataatcaatcctagaaacattgtttttaggcaaaagaacttccatgaacttgtgaaacctttattttaacaccccttttggaagcataatattatatggtttatttcctggcaattgtttatttggggtaattgattgttctgtgggttagtagttctgtaaattacacatacctttgaatagcagaaaatcatgttaattgctaggattgtaataaaaggtgtgtatagaaaaccattctttactattttgtactcgttttgtgcactttatttactagaagtaaaccggtagaatgttgcataaaaggacatcatgtaagtagttgcatgtagcaaatacatttgttgggcaaatgagtaatagaattattcatatatcttctctttgtctaattgtcgccacatttgtagaaggcataattatatattctccgtatagaataaatgtatacactcatcatgaagagagtatattattgacttagaaatatatattagtgcgtgactatcatagaagataaactaaaagtaatttatattaattgtttccaagtagatacaatgtcatcgaatttgcgaatatctagacgagaagtctatatgccaatatgccctgtaccaaaattatctatcaaaagactatgtacctatgcagtgtctatagttcatttgattgataatgttatggccatcttccacgtataaatgactttacaaatgaagtattgtttttatggatgtatgtaaattattttgagtcaattggtcatttgcatttgaagcaattttggcctagatgcaacatgtttagttgttagaattgatacacaagaagttgtattactgtcaacatgtgcatttgcacgcacatatatgacttatactattaatatgttcatgaaaaacgtgcatactcaaaatttgtggaaggaaaggaatttggtgtatttgaatttgatgttcaactcagggggagacgaatagtaatgacagtaatcttgcattcgttcttttcaggtcgtattttacaatacatgagttacattatagtttagattaagttcaatatgaagaacatggttaagctcatgtagagcttctttatcttttgctttaggcatagaagcttctgcattagataactgaatatttttttatataggtcatctcacattacctatattgcttttttttacctgtagtaattagttaaccttttgtggaataaaattgtgaattatatgtctaacattgaatgtaaatatttgtcttgcctattatttgaagtatttttggcggatgtattcttattatccactaagcctcaatcaaccatgtaggttagtagttctaagtgcattgacgccatattggcatacatgtaaagttgtttacttatgcacatgaacaattagaatatttatgtttaagcattgaagcttaaatatatccacctgcaaccacattatttcttttagaaaagttgtaccatgaagttacaacaaatatgtgggtttcacgacaactattttgtaaattttcttatgattggcgtgaaaaggggaggaatatgtgtattttgcaaattaatttcagaatatttgcaataaagaagcataagaaattctggatatgtggcaggcaaattggtgtgttataggtcaaatgctagaagcaaaaatagcccaaactattagcgaatcttatttgcgataattataaatgattgtcacacaacgaagtgtgttatttattggccattgaaaattgcatattcatcaaggaagtatgaaattgcatgtagctatttaaaagctattggtttacttgtagtaaacaatatcctaaataattaatgaccttttggattcaaatgattctgaatgatcaaatgacaccacatttactttggcataatgaataaaagttagacatgtcacctaattaatttattggcatattcaagaagaataaatattctcgtagaataatgtttgggtgatttgaaaagttccatgatggttaaactatgttcatagattaatgttttattgttatagttatgttcttgaagacatcatgaagttatataatactaacacatccatcttgtgatcatatctatgttgcataaatataaacacgaagtttattgatccaacttaattcaagaattgaatataatatgagtaattggatcaagtcttgggcaaataaaaagggctagaaaatagagtaattttgtcgactagtggatatttgtttgggcgtcattgtcgcagaataataaccctctatgaattgggataacctacagtattagggatgtgcaatttttcatgccattgcattaatttttatgttagctcactacatataatgtctttaccccctttattttgtataagtgcgtgttcaatcaatgaacatttccctcgtatatcaccaccatagcatacatatatgggcctccacatgaagttggggatacaaatggaccgaattccattaatccagtgcctatgataggggatttttgtgatatgctattagataaagatcgaatatcagcatcagggggagaaaagcccatgtgttaaagatgccttatattttcaagaagaaaaaagatctttacaagtaagaataacgcacaagccaaactaaactagaaggtttagtttattctcctgtaagccagaagcgggagcttgccagataattatgaattaaaggagtaattagaagttatgtttacttgtagtaaactttctgctaacagtggtataccccgggttttgaatagtatatccacaaatgcagagtgacatgttagtcaatgttctaaaatctacggggacgcctgcggattctaagatctaacaactattgtcaatgtacccattaataactccttacaactcctgtagagtaatcaccatgaaggtgaattgcctcatgaagaggttcataatgaagatgaaaacccagaattaaagtgcgcacatctatctaattctgggatgcggaacaaccatacatcatatgtttgggaaatgactaagatatggtttataatgaattaacctcacggaatgagtatgtggagaaaagaatagttgtcgacaacatcgcctctatgattgctaatatttttgtaatgagaatccggatccggaaccaaagtccatggcagatttgcatagtagcactcatatcgggtctattgaagaaagcaatgaggttgaaccatagtcgctaaataagtctatgtgaacatagaagttcagacttaataggaaatgaagtggtgaaaagcgacggttcatttggtcatggaaaagactgatattctcctactataaatgtattaaattctgttatatatatcactggcaaaaggcatgaatggataaatgatatgcagtttatgggttatgaaaatccatatgaagttttcactagaaagaaaacaatttcgcaacatatatataaatctcatactaattagtgtcatgaagcacactatattctcatgaagagaattgcaagactcgtagaagagtttatgatgactcacgaagagtttttctcctagaagtgagaatatttctcatagcagaaaaaatgacttccggaagaataagtcgatccctataggactacgctaatgtatgaattaccggttaatctctatataacaccgataactcgtactcccatgaagtggacaaacccgttcaaacgaatgaattggaaaatcacatccactagcatgcaagtgggtcggtagttttctacatactatgaaggtgtaagaatttatatatcatgaagatatacttattgatggtatttggcaatcttattaattcccctaatgccaaaatatagaccggtttagtcactctaagtggtttaagctaattgttgaagattagtgagacaatcaaattggtaatgattgataaatccactaagagaaagttgcataatatttaacctcttgtattgagctaattattttatacataccgcatatgtgtatcgttgcaacttattttcccatagtcctccgtaaggataaaactttgtttgtattgcacatttgaataagtggttatacatattgctcctatacgttgatttatttctcatgttcatagtagaacttatgaaataagtaaacgaaagattaaacattgtggtaattttattatcattattttacacattaataaaaatatggttatgacattggaacatagaagtttcaatggatgtctaattgagggggagcatatatgctaaacattgattatcatacttaagacttggcagtcttatatttgttttaccaagaattaatcaaattaatcattgttttgataatttaccttgaaggttactaccgctatattgttgtgttaatctaagttgattaatataataaagcatatagatcattagctatttatgaagaatagtcgatcttaaagattatgcgatcaagaagatcgtgtgttgtactctttttcccttagtgagtttttacttgaatatttctcacgcaaggtttttaacgaggcagcaagtgtaatataactagcgtgtacgatgtactcttttctcctatccttttctcctactgggtttttggatggagtttttaatgagacatgtgtatagcatggtattcacccaagggggagtgttatgaaactattatctcctgctagagataaatatgggctcataccaaatatatggaaacgtatcctaataggactcttcctattatgggtatatatattgagagagagggcttgagaggttggttgatgtatccacatctgagaaagcaataaagctgtgatgcctctccctatatccgtgttcattgttcatctactatatgattgtgtgcatgagatcgtcgtcttctactccggatcagcgagctaggccactacttattcaatagttataagtggctatgccagcctgcagatatcgcaagagaaagtttgactatgcataactggttgctagcttcaaaaattaacatgacatttatagttaatttaatagtttactcacatatataatagctataaatatatactacattattaatatctaacccaccgagccctaggactgatgaggacatcctccactattacccgctggcaaagacgcaaaaggcgggcggtgacagtgtgagcctctgaataatcccaccttgcttagcttgggaggaggaagccaccttaaaagggagagccacccttcccctattggactagtcttttagggagattgggcattttcccgagtgggtgtgtctatgaactgttggggtccgggcaaccttaagttattggacctcagccaaccccacttgggccggattgttatcaaggacgatggcggtgtcttcgacgttgcgatcttcctagagacgtcgtttccgaacaataatttccaaccaatctcttgtgcagacttttgtcctctccaatctcttgtgcagacttttgtcctcttgcggtggtgcttctgactgccacaagatgaccatgttgacgtctgcgtgtgtgggagaatggatccatcttctctctcgccctttccctctccaacccaaagacatggatgaagtcgagtgtagttgggatctgtttgttcttgggggttctttttgtctaggcgtgtggtgtggctgttttttttttcatttgtaggggttctttttaccgtagacgtgtgtgtggttgtttttttttctttcctgattatagcctcataaagctatatatggtctttttttcaactaatcaatataaaaccgcgcactatcttgtgtggttcgttttttaaaaaaagaacatctggactaccaaacgtgtatagtctcttagcgccgcttactaattttgttgcacttagctcttatgtttgtgatatatatgacgggttttgatctgatgagagtatgttgttttggtatcaacgtgtttgtgccaacgggataagcccagtgaaaaagtgtactaatctacgcaaagtagatgaccctttttttacaatgctttagctacgcaaagtactcaatctaatataaattacttattgtccgaaaggaaagaaaacttaatgaacttgtcaaatagtagtataatttactatcgtatttcatattataagttgttttaactttttttaagtaaaacttctttatatttgaccaatcttataaaacaagcaacaaacatatagtaactttttcaacataaaacaaatatattattaaaatatattaaacttaattagatttaatgaaattaatttagtgttttaagtgttgctagttttttcaaacttaattaaacttaacaaattttaactaaaggtgacttataatatgaaaattgaggaagtatttagttttaaacacaactttcgtgagctaactgtaaagtgtgtatactttacgtcgctctcatacaatgcatttatctaggtcttagtagtagacatttgaatttttgtagaacctgttggagtcatttaatgatttgtacattaaacaacggtgtctcagatagctaggcaaaattgtcgtgcaaccatgcatagttgagaacttatgttaaatatacttctaaaataattttatgatagttttatatttaaatcaaacatcggtgttgcaaacctatgtaaacggtgataagggatatataatgctatctagcatttcataagttggaacataacttatataattataaaaagaggtaaatgtgtttagggagtaaactaagtaattaagccattgtaggagggtaaagaaagaaaaagaaccttatcttaatttgtgtgtatgcacaattctaattctagtatcggatgggataagtatacaataaaaaatatttgttactgatgtggataatattttattgccagtagctagaatgtgtcctattgaactttaatttctcttatgactgaaaaacattgtatttttcttgcttggcaagccttagctaacaaaattaattaattaattagctagctagtcaaccagagcacgatcttctctctcggaagagagaaatagtactccctccatattttaatgtatgacgccgttaatttttttgataaatatttgacctttcgtcttatataaaaaaattatgtaattataatttattttattgtgacttgatttatcatcgaatgttctttaagcatgacataagtatttttatatttacataaaaattttgaataagacgagtggtcaaacgttggttaaaaagtcaacggcgttatactgtatacggagggagtattaattaaccatccaacctcgatcagtcggcagctggtcaacatgccaagatccagcttccccggccgcgcgcggtcaattcaactcccaagtcccaaccacgcgcgcaaattcccaagtcccaaagctacaattaacgaactctcatcatcatcggaaaacgccacgtacgcatgcatattcgtcatccaagacggtcacaaccactgatatgcaacattgcaacgacgacgacgacttctgcagatcacacaacgtactgtatatgctttgctcgtcgtcctgtgagcggccggcggccggccaagctcgccggcgccgctgctttcttgaattgccgtatagctgagatgttttgccgactgatggcttatgtgtctccaagtcgagtactattagcagctgccggttgtttttgaacggttctaactcttcgccctgaaggatttggcaccggcagatgtacagtttttctctttatttcacacctgaacagtcatgtgtatttttacacgcacatgcgtgtgtgtgtgttttatgatcaggttttaccctttccaacgtcaacgtccatttagagatgttatggtcctcgttctctccgtgatgaattctctcattagagactagctaagatggttgcaattgcttctccataacgaatcaaatgaagggagagaagtgtcccaatcgggtctctggcgggagcagggatggccctccatcccctatcccaattctttgcagagacgacccaattagggtcaaaatccaatgcaaagttttacattcgtaaagattcaaaccgagccatgatcagtataacggatgaatgataaccttgtgtctcttgccatatggattaattagtgggtatataataatttattaatatataaagtgtggatgatatgtgtatatattaaagatattgatatttgagatataaatgatgttttaaatgaggacgtgggcctagtgaacatttttaattccccgtgctggtcgggaggtaaaaatgttccacgttgcagttggcaagatggggaccagaaaatttctagcccataaagattgggatttggatatattttctcgtgtaaaattccccgctgccatccctacaccattcacgctagctatatatgcgtgtgggtaattgcagttaaacctttgggttggcatcaaaattggatattagaattaacgcgatgctctattttttttaagtcaaacatggagaaatcaggttggtgtttatatgacaaaattcataaatatttttttaggggagcatatatataaatattgtgtttgaatcaaacttatatggttaataagttgcaatggcttaatagatttaattaattgaaggataatcgaaccgtgcctcctctgtttccatcttttttttttcatttcaatatagaaaaaatatatttaccacatactatcacaaatttttttgacataactataaaaagatatttttgacaaaaatatcacaacattacatatttaaagtcattctatcataaaacaatatagttaatgttaaacttatcacaaaacaacatatttaatgaacggtattgcaaaaatatatatttattttattatcaaggtgatgcagaggatggaacctccacaatacttagttttgcgataaacctaatattgtgacttaaattcagtgtttaaatatataaatttgagatatagcagcttaaattcataagtttttattctacaattatgtggtttaacaatgcaaagaccgacattgtccaagatatgcataccaagttgtgtacgatataccatcccctctccttacatataaaaataccatgcatttactccataatttccacaacttgcacaaaccaaatttaaaatcaccaactgacaagaaaaattcaacagtgtgtacttgccagacagaaggaaaaaaacccacaccttttcgcagactcacagaaaaaaaaaagggaattaattgcatgtgacaaatacgcaaagcaaagcgtaaagtgacaggtagtagtaattcgatggtttccatcaccgtcctcacacacaaatttcaaaaaaaaaaaagataaaaagggatatatcctttgaccggtcaaacctcgcgacttcttcttccacctctcgctccgggcaactatatatatgccctaccgcgcgcgaacgccacaaatagcaaccaagaaaccaaactaaccctacccttgctgcgctgcccatttccgtcgccgctgtcgttgatatctccggcgatgctctgcggcgtcgagatcctctgctccgtcgtcgccgtcgtcgcgcgcgtgctcggcagggcgctcatgacaatctgctcgcccaagttctccaccgccgggctcatcggctcgccgacgacggcgtggggcggcggcggagccaagaagaaggtgcacatggagagcgagaagcagcagctgccgccgccgccgtcgccgccggcgctggtgctcccggcgttcaagaggaattgcaccgaccaggagcagagggcgccggcgacgtcgacaaaggcggcgagggggaggccgccgaggctggtcattccggctgcggcgccggtggcggtggcgcgcggcggcgtggacccgttcggcgggagggagacggacgtggcgacggagacggaggtgaagggggaggggttctgcctggcgagcaggagaggggtcaggcatgcaatggaggatggatatggggtgatcactcgtcacaagattgaaggaggctcccaattggtaaatttatgtctaattaatttgctcaaaaaattaggatcaaactaatttgaatgttggaaattttggggggcgattataaaatgaattaagagacaaagaggtatgaagatagatcaaggtggtatgaatgatagtagataatatggataaacataatttcttcagatatatggtgcttctatgatcccaacaaagctaagttgcacaaatctccaagcgtttttgttctggtgtattacaaatcaagcaattagcgtggctatacaacagttttacttattgaaatgcttaaaatagaacagaaatttgtatggattatttgccgtcttctgatcttcctaaaaggataattcaaggtccataaactaacgaaggattagtactcttcacagagacaaaatacactagtataactattttgaatcaacacacttttattatatatagtgattccataatctaatcaaaaccaaaattgcacaaacctagctaaaacaaatatttttcagggctcgatctggtcctgacaaaatagaatttcaagcttgtaaaggcaaaagggtaactatttggggggaaagagtatatgtttggcatgcttacaaaatttgaagtaactacaattcttaaaaacactatcaaaatttttgtagaccatgtgtttattatcttgcctaaattaaggagaatttgtagtctgtaaactaatgtaataattgttcctaactgttttgaatcaacacacttcaaggcttcaagctatatcaaagtgatcaacaatgatttaggcactctccgtagtacaatactacaatatattagtaaccctgttctttcttacatggcgtattgtcagcatcaggctcttccattaatatgtagtgatttcatgatctgatcaaaaccaaatgccacaaattaacctaaaaccgagattgttattgaatattttctagggctcatgatattgacaaagatatcatttcaagcttgtaactaggcaccatgataatattatttatagaaatataacgctaatacttaattcttatttatatctatttaaatcagtgcacttgaatattttccagagctctgtctctgtgcattgaaaatcaactataaaagatataacatgcatggctttctattactcataagcaattctacttgttgcagcaaatttatatgaagtacatatatacacattcaaaatattttgtataacttcccttgataaggacattcatattctaacctaaatactaagacctacaatttgccataaacaacaacaatatatatatatatatatatatatatatataagacagatagaggaaaacttgtgggctcacaaaaaaatgggatagcatgggcaacacgttcatcgacccacatgcaacgcacgctgattccagacaagaatcttttttttttaataaaacgacgcattttaccaggtctccattttgcttagccacgaaacttccaaaagtgcatcatttgtttcaagaagcatatatacacaataacgcataacgtgttgatcaaaccttcaagcagcaacaacttggttcgagacgttcacattattaattagtttcaatatttttcgtcagtacacaattaagagtaataatgagcatcggttaagtaatcaaaatacagcagtactacacacgcagagccacagccactaattgagactctcatgatctgtacgtctgattttgcaggcgttctacggtgtgtacgacgggcatggcggccgggccgccgtggacttcgtcgccgacaagctcggcaagaatgtcgtcaccgccgccgccgcggcgacgacgatgagccgacatcaagcagctggctcatcatcgccgtcgcagcaacgtcgagaagaagaggacgatgtcacggcggcgatcagggctgcgtacctgaccacggacagcgagttcctgagccaggtatattagtcaactacagttactgttccgtacgttgtaagtcattattttagttttgtgataaaccaaactataaaaaagaatcatcatcatctatagtaacatatatcaagatataaatgatagtggattatatttgataaaattaatttgacctgttgtatatgttagttgcttataaaagatcttttataaataaacttgataaagttaagtttaacttttgataaatgtaaaatggcttactgtgtagggaacagaacggagcgactgaatgacgtctagctgcttgattgcataatgtgcacatgcatgcatgtcaacactatattaatcttaattagaaattaacatgcaactgtacctgtaccaataatatacgcgatgcaacagcgacatacaactgcgctgctgctgctgccgctattgttgattaattagttggcgatttattaatcggcttgactaggtcttgcatgaattagcagatgaactttgaacggttcaaaacctgctatcatttttagctgtctgtttgtgaggcaggtttgatgccgatggtgttgatggccacgttacgcatgccctcacgtactgcaacttttaattttatccgtaatccggtccagattaattgagttccgttgccgtgttgcttctggtgtggccgacatcgaccgatagctatatcttgttttatgaacgacgatagctatatcttgtgattatcaagggagggactacctatatagtattagacagttttttaaaaaatagttttaaataataattatattgtgtaattatattatagctatataactttgtgtattatatgcatatatatagttgacatgctaaaattaaaagtattttatttcggtactagtacaactaaaagcacatatatattaattagtacaaaagaaatgtgcaactaacgtacttcgttttgatgatattaattaattattaattagctaatgttgatgtacattattgcttgttgtgtagggtgtacgcggcggcgcgtgcgcggcgacggcgctggtgaaggacggtgagctctacgtgtccaacgtcggcgactgccgcgccgtcctcggcagccgcggcggcgtggccaccgccctcacctccgaccatacccccggccgcgaggacgagcgcctccgcatcgagagcacggtacacaactatatatcatgcatggttcttgcaagattttcaatggcttccgtccgccatgatcgcgcgtgagctcgatttaggttttatttagggagcttctaactactgcagtttctcctaaaattaaaagctcccaaacagtccatcttttagtacagattctaagaaactctagttgtagaatctagaaaatgaactagaaggcagaagccgagaaaccaagcttttcccaattctgataagctaactactagccaactatttcttagaattttaagaattttaagctcccaaacaagcacttagtcgtcgctgttgccgatcaattaatgtatgtgcgatgcatttcagggcgggtacgtgagctgcggcggcagcggggtgtggcgcgtgcaggacagcctcgccgtgtcgcgcgcgttcggcgacgccggcgtgaagcagtgggtgacgtgcgagccggagacggcgcgcgtcagcctcgccgccgacggcgactgccgcttcctcgtcctcgcctccgacggcctctggtgcaaggtgtccaaccaggaggcggtcgacgccgtcgccgccgccgccgccgccgccgccggcgtggccggcagcacggacccgtgcaaggagctggccgccatggcgaggagcagagggagccgggatgacatcaccgtcatggtcgtcgacctgcaaccattcttgccggtatagagccggcaaacgtgcataccgtacgaaacaattttgatgtgatttttgttttagaagttatactacgaaaagatatatatccgattttgtctttctttttttttctcacttcagttgcacttagaagttgtaacttgtacatgtgtttgtaacttgtaagtggtttttgaagtgagcttgctaggtagatgcataagagattatacaagagtgactgtaatttctttcttacttatataaagggggcttacgcatgcacaccatcacaaaatgttcatgattgtgtttattttaatttaacattgcccaaaagacagaggctgataataaatatgtaaaacctcattaaattcgaaaacacactcatgtatgtgtagtggtggatataacgctactcaggtactcactgatctggctgctaaaaagctacttcctccgtttcatattataaaactttttagcattgcccacatttatatatgttaatgaatctatacacatatatagctcattaactattttttctataccaacatggctattttattgtataaatagtttttgcaacttacaagcttattgaattactggaatttagggaaaatataataaaaccatttattttagataatatgataaaccccaaccagctctatctccaacatggtgtatatgggccaaaatattttttagataatagataaaatccagcatttgctatcgccacttattacatatgtatggtttagaaactgtgcataatagtatctaacaaaagataaagagaagacacgttataaagccacaaaagaaaggaagaaatacaatttatttaaagagcaattatattagtaaatctccaattaaaattgatgaaaatttatataaccgtcgatcgtctctaagttccggcatacaacattaataaaatctgtatcctatatatacatttgtactggggcccaaaacaaaatatagttaaacaattcataaatgcattcaagcaccagtacatcctcatctgttgagcccaactgagaaaatccactcttagaggtcgaattttttttttatgaatgtgcaagagatttgcctgagaattcaattgtgggccgcaggatttttacctgaacccttttcaataaactacataaataaagtatataatacatgaacaattctattaattgaaaaaaagtgagaatagaaatcataaccaaattactcaaataaaaataatatcaagagggtgaatcctggagtatggaagataattaccctcatagtttagccttttataagcataagagaaaatttaaatttaaaaacataattttagagttgatttgaagttttttttgtcacggtttattttctagcatttgcttttaaatcgttgcacttgtataaaaattttaccataaattatttttttaattattaataagtagttttgatgggttggactggaaagtggagaagcaggttgctcaaggcaggggaataagtataatgttgtctgagaagttgagagtggagtttgcagggtaaactagttataggttcgtgcaatgcaacagtttgttaattctgtttagtgaaaggacttgaacagggtgggggttgattggttttttaaactatggtcgttttctagatatcagtttttatgagaggaaagcggtttttagaaggttttaagtaatagggatttaatcgttaataagccgtttggatggattggactggacaagtggaggagcatgtcgttcgaagcaggggagtggagagctgacagtacccacgagcagcagcacgctggaaggggaaaaaaaggagaaagagaagcagcacataggccatggccagcagcagcacctggagtggggggttgagggttcaagatttccagtattgcggttaaggatgtgattcaaactcgacgtcgtcgatataagagatctaaagacaatttattctgaaattatatgaccaaattaaagtggaccaccctaaaaaaataaggtggaccaaatcattttcccagcctgttagtcgcctcagtccatttccactaattgaaatcggaataagttcaccgcccgtccctcaaccacaaaattagaaatctctacccctaaattatacaaaaccgttcactcaaagtccctaggcagtatatatgggtggttttgctgacgtgacatcctaatcagaaaaataattaaaattaatatgtggggccacatgtaaatgagaggaaatggtgcgtgcccacatttatcccttcttttctctcttttcctctcctgattctctcgacggcgccacggcggcgggagaggagaaatggcggccggcgcgacggcgagcttggcggcagagaggagcagcgcgtggcgcaccggcgggggagaggagcggc

SEQ ID NO: 81794 - DNA, 5923 bp, Oryza sativa
tccgggttggttacggtatcaagaaattgcaaatcatgatgaccattgtcgatgatcttgtgtcggttgatagtttgattgaggactacttctacaccgaaccagcgaatgagtacatccagagctgcgacattgttgcgttcaacaagatctgtaagttattccataagtatcagagcccgtcgttttatttgctagcgttgttcttgttattatactgaagcaatcggatgaccagctgtcttattttaaggaatcgatcctatattattctttaaatgatgatgcatgccatatatattattctgtaaatgataatgtcctgatgtttcatatctagatacctcatttgctgcacattactctctttattcagtaggcttagatacctgatttgctgcatattactctctttattcagcaagttgctcatatctagatatctcatttgcagcacatcaatttgatttcatatggtcatgtaaatttcatctgccttgagccatccttgttcagaactaatgttttgattatgttttattgcagagatcttccttgagtcaggtgatggcgatcggtgcacaaagataaaaagaaaaatccggaagtttgaattaccgttgatacttcaatctagaagtttgaattaccattgatgtgtcgttcgtggtgtcaactagtacttgagcccgttttgtgttgagattgtagcactctacttctactgagatcgttttctcctcctttaatgtttaaagaccaatcaggttattattactgtgtctgcctgtgtcaccatagcggcattgttggtcgatccagttttgatgcggtcttcaattctcccgtctttcgctttgcttgattgcttcatcgcttttgcggctaaagtttttctgctcctaccaaaactgtaggggaaactttggttgtgctgtttgttctatctcttatgcattgcacagcctggttttttcgctcttctgaagtatagccctgtgcgctctcatcaggcctgtcctgaaatacgtgatttccgttcggtatcgatgttcggtttgtcacacatatcttctactttcttttctgtaatgaagagcattgtctactgttatcacttatcaggttcgaattggtgaattcacagctgagtgttggtgcatatatcacgatcaaagtaacaattatcatggcaaaataggtggtttcacctctcggtatcggttttcttccattggcatccctgactcgtggctcgtgggctggcattgctgaagcagcacttaggcaacatgcgataaataaagtttctcttcacaatcctcttgaaagctgctcaaggaatattcagcttacgataagcacatccgatctttgacctacataggcagcatatgatcctgagcagtaaaatttcctgcttcacctagtaaccttcactctttccattaattctttgtcagtctaccctggaaatcctcgactagtgtctactaggcactagctagtcaactgctagttcccagagggatacagcaatatctgagtgattcaccgcagatatgtcacccatcagaagttgaccatcatcagttactaagagcacccgcaatggtaaagtaaggtgctatctataaaacatgtacatctcagcaatagactcgattaatagtaaaccaccttaatagtatgtctacattggtatctatagctctctcatgcattgtctcgtttttctctatagactatctctaagttagtagatagctttgctctctctcttcatttaatacattccaagtaggaaaatatgctgacatgaatctcttatagagagcctatagataaccattgtgggtgccctaacaccatagattagtagtagataatctataggactgcatgcaatgcgatgatatctaagctcggtgtagattcagaaaccgcatgttcagatatatatgcatttcttttctagccgaaaagcgacacgggattcaggaccacatcgcggcagcttctcgctgcttctctagccttcattctagaactccacacacacccagatgtgtactacttttattttgttcatcgatccaacggtgaatgatgatgggtgcctcttttctgtccagacattcttcaagagtcagagattaatgaatgcacattaatctggactattagctcttgataacaaactctaccagcatagtatcatgcatagctcctatttaagtttatctctcatcttgtggatccctaggatccttcctcatctaacaaagaccaaatgtctcatgagagaaaagggcctcttcatcaatcatccaaatcaagtactccatccgtcccataatataagggattttgaggttttgcttataacatttgaccactcatcttattcaatttttttttcaaatataaaaaacaaaaagttgtgcttaaaatactatagataataaagtaagtcacaaataaaataaataataatttaaaaaaatttgaataagacaagtggtcaaacgttataagtaaaaactcaaaatctcttatattattggatagtgggagtaccaatgtattttagcatactagtagtctactagtagagtacatatatggatatattagtacatctgaacataagatacagtacataaatgtacacacacaagtgagtagtgatcacatatatattcaatggcacatcggcatttgccaaaggtgtagaatgttgcttggcagccactcctggccacctttttttcccaaagttgggcacaaacacacacaaatgtgccggccggggggcctgcccctgatcagagaaattcaggatgccgatggagatttgggaattttgtagcctctgctccaggttggcttaccgatttcggccatgggcatgccccaagaaccctagttgcactgctgtttcggtacattctggtgtatatttatcatgcaccaatgttcttgagatgatcaagggtaggtagaataagagcatgaggggttcactagcagatgaaatgaaatgaaaacttgttgctgtatcccacaaatttaatggaaatggagtatacattggggggagtagtactatatggtgaaacgtacaccaactgtatctgaaatctgaaaaaaagaaaaagataacagagcttgaaaatttctcctattttcagctcaaatccaataatgattgaactagccagccagtcgacgtttgatcttcgttcagaattacaccgtcgcgcatcgcattcggttctgtatgttgtcccgtgcgatcgattcgccattcaactgaacctcatgaacaaatggggattattgtggcatcaaaattactgcgaattttcctccgcgtaaatcaggacaccaggccaccatcatgtagtctgaagaaaacagaatggcatccagaattcagtgcttaatttgactgagcaagagtgtagggttcacattccactatatatcacttaccattgtgcaaacaataatgatcgcattgaatcgtgcgtctcggtctacatctccagaacaatgactgcaaaaaacatcaagaaaatccactcataagttgatgcttaatcaattacttctacacaaactatacttactgcaatatatatgtaatcttttcatgcatatatgtttgaaaatatgtccatgaatgcaaacaaatatatgcagcaagaagaatattaactctcacttacaatctgaatcagttttgtcccatttaaagatatcttctgcattctcatcatcatcttcatcatcatggagatgctccctttgcatcttctccctcggcttatcctcaagatagtatttcctcgacgacgacgccgcagcattactcggtcgagcgttcatcctcttgtgaagcatcgtcctgaacaactgcatatgaacacaaaatgcaaaacaaaacaaaacaaaccatattagtttgcactgtttcatactttcgtcactgatcatatcattattagttactccctccatttcatatcataagttgttttcactttttttcctaatcaaacttctctatgtttaaccaacatttcatatcataagttgttttcacttttttttcctaatcaaatttctctatgtttaaccaagtttatagaaaaaattatcaacatctacgacgtcaaattagtcttattaaatgtaacattgaatatatttcgataatatgtttgttatatttttactaatgtaatcaaacttaaaagaaagtttaactaggaaaaaaaattcaaaacgaattataatatgttataatatgaaatggagtgagtagatgataacttgttctactgtttaattgagaccttttcgattcttgattcgactggatccttcaaggtgggcggcggcgccggcgacggcgagaagccgccgcggcagacgaacatcttcttgaggaggaacctgaaggatttctgcttgatggcgccgccgccattggtgttgacgaggaggtcgcgcgccttgctgaggatgatctgcgtgtccggcgagaactcgccgtcggccgccgccacgcgccggtcgacctcgaggctggaggggcagttgaggaacctgtcgagcggcagcagcagctggctgccggaggaggaggaggaggaggagcgctcgtcggcgtcgtgctccgccgccgtcgagccgcggcggctgccggacttggtggacttggctcgccggagcagcttgttcagcgcctcctgcagcttcttcacctcctcgatggtgaagtccgccacctcctctgccgccgtcgccgccgccgccgccggcggtcgcggcggcgactcgttcccgagcgtgccgatggagaggaggtgatctccggcgatcttgatctcgtcgcgagcttcttcttggaggaaactctctcctccccctcctcctcgtcctgtagcatccatgcatgcatccacgtcgacgaacaaacgtcaaaaaccatgcaaaatatatccaactccacttacatacgtatataacttacacatgcacgtttgaatcccaagaatttaacatgaaaattataacagttcaaatgttcaaatcaaaacaaagtaaaacttactgcgagctgacgaggccacagcagcagcttcagttcgtctcttgtcttgtttagcagtactgagtcgattctgcatccagttaataatctgcaaacagaacataattacaaaaaaatcaaacatatatctcatatgaaaacacataatttactgaaacctaacatgcacttgatcgagcttacttacccccatggctatggttaattagcaggtagccctagagctctgatgattcgagcaaagtgacggcggcgaaacgacgatgttaggaggcaacagaatctagctggatgatagcaaaccagagtagtttcagggttgtttttgcaggagctctctgattggccagtttcagactttcagtgaggcagcttgatttgattgggcttggatgctgctgctaaaacagtagctagtattagtgctactattaagtgcccattaccattgagtttagagcttgagagagagagatggagagggtgagattggggtgtaaaagaaatgggaagtgggattcagggtcccctaccccccatggaatttaaataggaagggttacaagtgaagtgagagtgctacagagattaagtcagcgagccattggctaatctcgatcggtcgagcgagtttagtggccaaattgcgtacttgtttgaatgcatccatccattcataaggcggccactggattttagtgtgtgtatctagcttagccaatacatgctcatggtattcgttctcaaaggtacattgcataggttgtatgcggatctacaccttttttggacactgaa

SEQ ID NO: 81795 - DNA, 1177 bp, Oryza sativa
accaccactcaagctctgccgacatgtgagacccctgcaccggcgtccccagccggccagctttcgtgtgccgaagaccgcgccacacccgccggcagctcctcctcacaccgaggtcgcctcctccaccaccggccgagcctctcgcgccaagtcggcctcctccaccggacacgcctctcgcgccaatccggcctccctccatcggctgcgcctctcacgccaagccgacctcggtctccgccgcccgcgcctctcgcgctgagtcggcctccgctgccatcagctgcgcctctctgcgccaagctggcctccgactcctcctccaaacgatgccacgctggccagatgcagccgtctgccacaccctcgactagccgtccgaagccgccatgcctccggtgaccgtggtcaccgccaccgcagccgctgctgccgaatgcccagccacctcgccgtcgccatcctcacctcctccactgcagccacgtccacggtcgccacggccaatgccacaagccgtccgccatcgcagcctgcagccaccagcacccgatgtcgccggtcgcgactccacaccgtcgccggcctccatgacgccctcccgctgccgcacgacgctggcctccacgacaaccacacgccgccggcctccacgacgcctgcacagcaggcctcgccacccacgaggccgcacgaccgcctccacgacgcctcaaccaccacggccgttgcctcgccagccaaccgtcgcagtcgatgccgccacagccgtcgccaccgtcactgctgccgtcggcagccgccgccgccgccagctagatctggctagagacgtcattgcctcctcccgcatcgccgacgtcaccaccggctctcgcggcacctccaccaccacacccgtcgtccggccacgcctccgtgctcggctaccggagctagctccagcagcgtctcccgccaggtcgtgaccgcccaaacccaccgccaaaactcgccgccgagctaccaggacgccgccgtccgtcgttgggggaccggatccgggcaccacagcaccggatctggacgccgccagtcggcgtcgacgccatgccctgagctcctaccgtgccgacgtcccgaccgtcttgaccgtgaacgcgggagagagagcccctccgccgccgtccttgca

SEQ ID NO: 81796 - DNA, 3518 bp, Oryza sativa
acgccacctccacccccacctcctccgtctcctccccaacctccagctccatggctggaaccttcagactccaagctactagtctcctcctcctcgccggcgtctgctgctccggcgagacggcgtcgaacaccttgtggccgtcgcgtcttctctctctcgtctcctcttcgtgcgcgcgtgatcgttttgggccttgggctttataaacggaaggaggaggagggtggggcccacgcgcgagggaatcatggaggtgtgggggcccacaagtaagtgggatggggacgccacgtcggacgggtggcaacgggcgttgccagctgtctccaagtgggcggctggcttgcttgctgttgctaacttgctggggttgtttggtcggtaaagtattttcgtttgcttgattgagaaaaccacggtaatatatttgttttttttattgggttgattaagtgtgtatactttgtgcctgttcagagtacggcactggttgatattattttaggagaactaagcagagtccactaaataatgacaaatacaggtattatatactatacattattacatggtagacgcatggtgttatgattgctttgttgtttatgtatatatatgagtgtattcgaaataatcaaattgactttgaggaaagacttccattacagctgttgataaaatttaagcacgcacctgcacggtttctcgtggagcaatgaaatgcatttcttgaagtaagaaactttgatgaaacgtactaaaagattataaagaacaatcagtactagaagcaaaggcagctagtaggtagtaaggagattttgtttatccctattaatctatccactactattacactacagatgaagcgtttacttgcaaggaaggaggagcgcgaggcggcgtcgcgttcgtttcacacgcacgctgacatgcgtcgccattgactttcgccgccgccgccgcggtggcgcgcgcgcgcacgcacgctgggcgacacgccacgccgccgacgcgacgcgcgccgtgcgcacgagcaacacgtacgcaagggagaaggagagatcgctatagcttccacgcgcaaagcgcaggggcacacgtgcgtgttcgacgtagacataacacggcgcacaggcaagacggcgcggcccggcgcgggcgggggcgacggctccgaccaacgaacggcgtggtggacggttgggcgcgtcgcgtcgcgtcgtgcgtgggcgaagttggtcggcgtgtcagcgcgcgaccgcgtctcggtctcggcctcgttgctcacggcatacgaagccttgggcttttacgcacgggagaagcccacatatactgattcttttgggccgtcaatctgaggcccaatcaggctcgaacatggcatatatgctgcgtggttttatattagtcccacctcgcgccctagacctgattggaagaggagacatgggtatatgagatgacccagggtttgtaaccaaatcatacctttctcggccttttggctaagatcaagtgtagtatctgttcttatcagtttaatatctgatatgtgtaccatgtgttcactttgatattaaatttattttagccaaccatgtcctcggcgcctagggttcctaggcgactcaaggtgggttctgcgtgggtagggtttcaatcttctctcaaccccatcggtctcatgcctgatcggatcgatctcttcggtctagatcctgagtcggatcgatctcttcggtctagatcctgagtccacatcccatccttcctctgtgtccacggttagattctctgttttggagccgagccaaaccttgctagccggggaggggtagttttagggttcggagggcaccatggaggcgatgcaggcactgatgaagcgcatgcaattgtcggaggcagagaagaaggggatccggatctgcgaggcggagtctggaagtatgggatcaggggatccgaaggcgatcgggaaggtcctggcggagaaagtggtgaacgcggagggtttggcgcaagcactggggaagatctggtgtctgattaggggaataacgtgcagagatctaggcgagaaccatttcctgtttacctttcatcagcatccgggaagcggcatgctctggaggatggaccctggatgtttggtaaagatctggtgatcgtcgtggattatgatgaatcaaaggttttggaggagatggtgtttgcctttgttcctatttggatcagggcttcaaagatgcctttatgcatgatgaacaaggccatagggagagcgatcgggggagaggtgggtgaattcatgcgaatggagtcggaaaaggatggcactgatgtggggcagttccttcgtataaaggttcgtctggatattcgtaaacccctgatgcgtggtgtaactctgagtttggcgaaggggaagaaggagatatggtgtcccctggtgtatgagttcctaccgtacttctgctatacatgtgggatcatataggatacctgatttaaaatgtagtgtggaacttaaatactgataaatgtgtagtgtgcagctaaaggagggagaagagcaacgttatagcaaaaaactgcggttcatcccagaaaagaggaggtgggaggagggaagtaacatgagacaattgggtggaaggggggggagcgcagagaagatctggggatagcagtagtagggggagtgatgcaccatcttggaggaggaaggattctggggcagtagttactggaagagaggccagaaatggggaggaggaggaagtgacgagtcctgtaaagaaatcggttcagatgcacaaacctgaacaggctaagaaagcattgttttccattgagaaggagatggttagtgcgggaaagaatcagccccaagggggcgaaataggaggggagatgctgaaaccagctcaacatgacagagtgcaggaaaaagcggacgcccaggggaaatacatggaaaacaacgccatgcagcccatgcacgtcgacggaggggctgctcagggagaggtgccatcgggagtaaaagggccaggaggtagcaaacagaaaactttcaaaagaatgacaagggagactagaggtaagattttgccagcaggctcggggacggtgatcccgggaaagagaagatagatggagggaggggaggaagtttcgggaaagcgaaggaaggagggagagctaaagaatagtgaggaacaaaacccaatggaagcgggacttgcgatccagtcctgcgggaagaaatgaagctagtggcttggaactgtcgggggttgggaaaccgcccggcagttcggggacttctggatcttcagaagtcggaaaagatcgatattcttttcttgtcagaaaaaaaattagacaagagaagaatgcagtgtctgaggtggatgttgggtttggttaatatggtggtgaaagattgtgaaggacaaggaagggggggaattgcagtgttatggaggaggaggattgatgtg

SEQ ID NO: 81797 - DNA, 2288 bp, Oryza sativa
cgctgaactaaaacgtctcagcactacccgacttggcacaaattagccatgtaaaaggaactcagcgtcactatacattacgctgacctcttaataggtttaaaatataggcatgcgctgaaatcctgagtagtatttaactttatccgttattaaaaagtgcctataagtattaaaaatagataaaacaattttaaaattaagtactgaatttaaatttatatgagtaattcatagcacatactacgagtacatatgtaattttcaattattaaataaaccaagattagtataactatgtcttaagcctatggtaaaggttagcatatatacattagaaaagtgctctcacgaattgtgtgtatctagttaatcctagaatgaattcatattggtatatgtatttctttctgaaaataggattccaaaggttagcctatctgctattaaatacatacatgcataattagcccaagggcaaaaaaaaaaacaagcataccaaagtatattataagatcacaaattacccatcttggtcatctcccagtcgcagagaacatattacgacctctgctgattcatcatcaaaatagacatcctgaaaggagaaaacaatggaaatccactctgtcagaagtacagcttcaacaaatatggttatagacactattttccgcatgcaacattccgttctttttacatggctgattgaagcaaacgttaaggagttgtactgaaaatttaatcaaattgaacataaaaccaggtgaaaagaacaaaaaagcaataaatgggggtaaactagaatccttaaatatacctcatcatcatgttcaagtgtcccttgattctgcattcaagaaacaagcatcattagtatctagtatagtaaggctgtaaggaactgcaaatctggaatatggtagagctgctgagtcactcaagtagataatgcaatagcacgagtaacaggatgatattttatccaccatagaatcctctcaaattaaacctaacaaaatgtgctggcagagaaacatgttgaccgacgcaaaccatcaaagcgatagaaacaaaatcattcacacacacacctcttccatatcatcattgctatatatcccatatcgcaatgcctggctcaagttattagtaagagctaccacatcataatccatgtctcggaagtcgtcatcatcactatccctaccacagtcatgaagtgatgttgggcgcctgtagcagcaagacatatagagaaactattcagtgaaaaaacagaagtaaagacatccaagtttagcatacaatcaaaaaaaacaaagagtcacatgcccacaagcccaatgatacgaattctccacctcattatgcttgactttaagcatgatttatatcttatacatttgcataaatgttctggataaaacgaatggtcaaacacttatttaaaagtcaacgacgtcatctattaaaaaatgaagggaatatattctaccgatctctcgtaaaaaaataatctcataaaatgcatggacatttgcgtcatatttcaccatactttcagaaccgataagatttagttctaggctaataagccttgaacaaaacaaaccaaaaataatttatagataaaaccaaaaaaaattgtagacagatatatagcaaatcccaacttttacatgtattactagtgatttaaaactaagggtagaaaaagataaacaatgatggaaaaatttgagaataactgaaaactttactaatctcaaaatttaatttttagctgcgatagttagtcaacaagaagacaatgaaagttatgaaacttccttagtgataatacacaaatgcattccaggagtactcatgcaatatatagccactcagttgattcttaacactctgtataacatatctgttgttttttcaggaaaaaaaagtaaaaaaagaatttgaaacatatttaatcactaccaaaacctacaaccttacccacaaatgcacaatcaaactgtgcatataatctggtgaagggaggtgtaggtgccaacgaaggcgatgcatactccgatgactagtattccgacgatcgccgccacctcgaagcggccaactccaaatcgaggcatgtagatcttgaggtagctcaggcatgggaacaacacgacaatggtgaagttcagcgaagatacgttgaacggcatgaggtagctgaagaaaggggtaccgtgcacgccagcaccaccgtgctgacaacgacggctgtgctggtgagcaccctggta

SEQ ID NO: 81798 - DNA, 18962 bp, Oryza sativa
  unsure (1)..(18962): unsure at all n locations
accacaagataatcaagcctttattttactacaaaaagtaaaacaatagtacattcactcatggtcttgctttcgagcagagcagaaagagaaatgaatggggcataataagtcatgtgcttataattatcgcagccgattgtgccatcatcaaacctggcattttgtacaaccatccgtggagtggcaggagcaggtcaaaagatgaacacaacgctgtcgtggaccctgttcttctgattctgcgcaacacactctgatatccacatcaagttcctaatctcctgctcccgtagccttatgtaagcaaagaaaacagcatagtggaactgcgcaaacaagatatggagtcaaagatcccagcatgagaatccgcaatagtggcataatgctcacaagtttgttatcccctcatattggactagggataaaataaacagaactagatgagtgcactcaagcatgtatgcaggcttcagtgccacatgcattcttttagcaagagaaactagctctttgcggagtgcttattattactccctacggttccataagtcccgtcgttttggacaaggttgaggtcaaactattagagctttgactatcaataacttcaaaaatatttagtttgaaggcactagaacatgtatatttatttatcgtatattgtatagtaggagatcatagtcaaagatatgttttggagactgtcgttgtccaaaatgacaactatggaactgagggagtaaactcgtaagtggaactagaagatcccttgaagaaagttggtatattaaagtccaaaatgagaatgcagatgcacccccaccatggaggtcctaaggtaactaatataaaacaatgaaaatcatacctgctgttcaaatgacaagcacagcctccgcacttcctcctcatagaaggccttatccaacatttggctttccccatacgaaattttggcaaaaatagcctggtatggagggtacttctccattacaccacggacctacatgatgtgaaaaggaaaaaggtgttatggaagtccaaaaaaagaaggatcaatgtaatggtgatgatgatgcaaaaaaagaagaatcaaggtaatgtgatgatgatgcatatagtgtaactaacatattttacaggaattctttatgtatgctaatggtgcaccacactcttttttcatctacctatacaacaaacttaacaaaaagaacagcgtcaagccagaacaaaactatggttatactagtaagcatggtagaccaaagggcaataactaaaactacctattgctactaatgacgggcacaatagaagagaagacaaaacatataatagctaaagcagctttccaatctgctccagatgaaaggcacagaaaaaatagtttggcacacattgatcaaagcataaaacatgtgtaagaccatgcgctcccatgtaataatatgcccattccattactcaaggaaggttccaacacagaattttcaaaacaaataaatgtaataccagtatacaaaaaaaaaatcattgtgtcttggctgaaccaactactccacagacgttgatatagagcagtcagaaaaccaagttcgatgtatgcccatcacacgtgatacgtgtgccacaaaaacatctcccgtggaataccacgcttctccatttcttgtggaggaagcgctcggcctagggcatgatttttgttcaataggactaccaataaatctatttagtatgatgagtggtccttttgctaaacatgttggtaacactccaatagtgttcatttttcatattagcagtttaagttggccaatgtaagcaaatatgagaagcaagatgtgattaaacaattgaagatgtatgtatactaaaacgtgctagaactgaactatgagcataaatgaagacaaacctgatcaacatcttcacaaacagccagttcttcatgaccatatggatacctggaggtcgaaaaaaagtattacaaacatatcttggcaaaaggtactatcaagctggttctaatagaaacctacaataaaccaaagttggagtacagcttccgacggtcatctctagtcaactctgtaccaatactagaaaacatgacagagagatgtcagtatcacatgattgtgcacataacaacaaacaaggaagtatgtaacaaaattatacggtttgaagtggaaaacagaaaaaacttggcacctacctgtttattgtaatgttcacagctcttctgtctgcttcaaatgacagaagatcgcacataatctcagcagttgcaccaccaagtttctgtataacacaaaaagtcaatatgaacactagatgaaattggaggatacagttgaagccactatatttgtgtagttcatacttcacagaatttgtaaaagtcctcaaggtatgctttgtaaagagtgttcctcataatctcgatattcatgtcatccaaatcctgtaaaattcaggcaactctcattatcaagttagccttggtgttcaaattattaaatggattgtaatttattggacaccacaaaaggttacagctatttacctcagatgtaatgcattctgagaagtatggggctaacggtgtgtcaaccaaaaccaatctgtaaagctcgcgcatattttgagcaactgcaagagatgcaatgctattgcatggcaaaaagaacacttagtatcataagaagacctccactcaacagattcgataaagaaatcaccagaatacctgtcaaacattcccaatggatggcatttctccaatagttcattaacatctctctcatgcaatgttccggtaacaataagtacaacattgtcgatcatgtggccatacctgcaaatgttatctcatcagaccaaactatgctgcattactaaagttgggcacattgacatgtgcagacaaaacagaagtgaaagggcatatcctagcaatattgttgcttacgttatatactgtaagaatgtggatagtggttcagtcgcctggcacatcatgtgtttgtactcatcaaccagtttaagagtgcacttctccacaattgtagttgtgtgcaggggtgaaggttctgcagttaatcagaaataagttcatagtacagatgtatcacattagcgtgtaacaagcatgcactgatgcactgcaattatatcacgacaagcatcaacgcaaacagtattccatataagaatagggacatgtggattctaggaactatagcaattattcctaaggaaaataactaaatcctcagtggtttaccggaattcgatcaaaatatacccttccgagtggtctctagtaaaagctaagttgcgaccctctacatgtatagggcaaatcgtatcctttaactgctgcactcctacagaatgcgaaacctatgatactctagaccaagctaaacaacatatcagaacaatctgttaaagcgatccattgactttggtttcttgcaagcatagggcatcgtgggcttaatcaactacttgaaaatttcaggcaaagagcaaccaaattagggcaacccccaaatccccaaattggcatcgcaattcgcgcggaccggatcggggatcgccgatcgatcaggacagtcatggcggcgctacccaatccgatccgatccccccaaaaaaggagatcagagggcggcggcggcgagagagggaggtcgtaccgttctggaggtaggggccgtactcggtggcggtgaggtgcatcttgacgtcgtcgaggttctcgcactggcagaggttgttgtagtcggcggcggtgaggaggcccgaccggttcccccgcacgatggcctccaggaagccgtcgtggatgttgaacgagagcatctcccacccgtacatcctgtctctctcgccggccggcggcggcggcggtggcggtggcggcggcgggaggggtggatcgggaggagggggggagggaagccgcggcggtggcagatccgggtgcggatgcgggcggggtttgtatgagacgagacgagatcggtcgtgctctgctcgcgtgagcgtgtgggatccaggattggcacgtcggcagtgggccccgtgcccgcgtcagtgctcggggaccttccaggccgggccggggcgggtcaggcttagtgggctgggtattttggttgcgggtctaaagcggaaacgctaatacgcgcgcgcgtttcgggcctagaagacccagcgccgctgtgccagcgcgcgcgcctccttgctcttttttcctttttttaccatttttttccttttctttcccacttttttctgattttttttatctttagcatgttttgagtttgaaagtttataaattttgatttgaaaattttaaaatctgaacttgaaagcttttaaatctcaacttgaaagtttttgaatctcgatttgaaaattttcaaatcttgatttgaaattttttgaatctcgagttaaaagttttcaaatctcaaattgaaagttttcaaaattttcaatctgaacttgaaagttttcgaatctcgattctcgagttgaaagttttctaatctcgattctcaagttgaaagttttcgaatctgagttgaagtttttaaaatttgactttaaaatttaaaacttaaatcaaaagttttcaaatctaacataaaatattttcaatctattagtaaaaaaatctccagaatctttcctaattactatcattagtgttaagtatattaactaatactagcaaaatgcccgtgcgttgcaccgggtagtagtgggatgagtactgtttgatcttaaaaaaaatatcgaagcaactaagcctgatcataagcatcaatgatgtgttctatgaccacaaaagcaaatttgttcttggacaattagtctactctacatgtgtggcatgtaaatgatgcttataacatgtgggcccgatgattgtagcatgggaataatggatgggcgaaaaatactgttgcctttgcacataaggcgacagacgaaaatttgcgtgacaaacaaataaactgatatttgtaagcctaacgagtgtaaattggaaccacaacactttgtaaggggtattacacactctctttataggttgaggtcatttattatcttgtattatattttcttttatgaaagttttatatttttttcgcattcgatgctttttatctcgataaatatttaaattgaagagcataagatttttatcttagcgaattaaaataatagtaagatgacacttatcctctagctctctcgtttttctctctccctcgcttcttctcaccactgctcctatccgttgtcacaggccaaatcaactactgaccccattccatcgtcgttggtcttctttttcctctcggcatgtgctcaaatcaaccaaggagacgtgatcagtgagtttggtgccaccgaataaggtcgattatgatgggtgcctctttctcatcctactgtcaccgtatctagattccctaagtttagaccatgtttgagaagagggaaaagaagaaaattaagaagatatgtaaaacgaggtgagtcattaatgcataactaattaagtattaattattttaaatttaaaaaataaaataatatgcataggaggagcggaagatggagaaaaatcgagcatgggagacggtccacctaagatgtacattagctaacacacgggtggtcgaccatggatgaagcatcgtgtgcgcgtcgagtcatggttctggggtagtgttgcgcttctctttagcgacttcgagctcctcgtctatgctattgtagcctccgggcactggcggcatggaaagctcatgtccgcatgcgatcaacactcagaatgcgacgatttagcttagtttagggcacatgaccaaaaatatgcaacgttttcttctgtctcactatcccgatctgatgctatgagcggaggatgattgttggatgcttggagtgaaaagaatcccgatccgatgtgataagcggaggacgattgttggatgcttggaatgaaaagaatccaggaaatgcacattactacaacaaaaacatttttacatatggtcaaaactgatttttttttcgtgtgatttgaccaactgtctgccctgaaaggtgtacggaaatattgatttttccatgcgggtgacgcatccacatgcgaaattttgattttcgcatgtgggcgcctaagtcgtcctcacgcgaaaatgaaaaacgcaaagaaattccaaaaatcaaaactggaaccataaccctagccagccgccaacgccatcatccgcccttcccgtcgccgccatcggcggagaggcggcgggatccgggcaggagggggaggggacgcgtggaggccggatcagcccctcccgtcgccaccgtcggcggaccgcgcgcgtggaggccggatccacccctcccgtcattgtcgctggagcccatcgccctcaccccccacaaccacggcccacggtgccctcgtacagtgcctcctccctagctgacaacacccttatcccgatgagcaacgccctcgcacatcaccctcccccagccagcggtgccctctcagcggcatcaccctattctccggcacaatggtggcaacctcttcacggtagtgccttggcaacagcaccctacttgcggtgcacaacggcatgcccaccaagcttccacagcctcgggacggcggcgtgcttggcctccattgatcagtggtgccggtgttttagtttttatgatttaattttctggaatgattttgatttattgttgttggattttttattttatgatttagtggatatgtgattttgtgattcagcggggtgaaggacgaaaaatcaccacgaaaaatccgaatatttatattagttatagtttatagataggtagttattaagactaaaggggagggggaacagtccccagtctaaaggcgtacatgtcccaaccttttactttattatttttcattcgcacgttttcctaattggtgtgtgtgttttaaaaaatatatatacagcaaagttgtttaaaaaaaattgtattaatatttttataacttttttttagaattacacagtacaacgcaaacacacataacgcacgcgcactcactcctatgaacacatgcaagtaaaccctacccctataagcatcttcgaagactggaccagcaaatactggagagattgactatgagcatcttcgaagactgggccggcaaatcctggagagattgacgaagtcaccacaggtgcctcatcttcgaagactgggccggcaaaccctagagagattgacgaagtcaccanncaggtgnnncttgctgtncgancnngggtaccgntnncgccnntaccaacntnngaaagncnnacaancgncnncgtntanancngncnnactgcactcctatagaanncacatgcaagggtaaacccttacgcgcactataagcatcttcgaagactggaccagcaaatactggagagattgactatgagcatcttcgaagactgggccggcaaatcctggagagattgacgaagtcaccacaggtgcctcatcttcgaagactgggccggcaaaccctagagagattgacgaagtcaccacaggtgccttgctgtcgacgggtacgtcgcctaccactgaaagcacaacgccgttaaaatcctggaaaattcactcccatagggagtcgaacccaggacctcaagtgttactgaggctcttgtaaccactaggctacaggacctttcactaatatttttataacttaattaaacatgtatgtcgttttgcgtacgtgggagagaagtttacaacctttcctcccgaactaaggggtgcctttgatttgtaagaaaaaacatagaaaattagatgatttcaatcctatatgaaaaattcctatgaaggcatttgaattaaatgattgaatcatatcctttcctttggaatctattatattattaaaacagtcttgaaaaaaggcaccacgttcgctgtggaggctagaaattcccacattaatcggtgaaaaagaaaaggagagtccaactagaaatacaatttaaaatagttgaaattcggaattaaaaataaacactattgaaagaagagcccatataagaacccaatacgaaattcattaatattcagaataaaaaataaaataaaatccgaaagtagaaaaaaaagaaagaagagttcgagtagaaatataatttaaaaataactaaaattcagaattaaaattaagcaatattggaagaagagtccatataaaaacccaatatgagattaattaaaattcgaaataaaaaaaataaaaaatcgaaattagaaaaaacaaaaagaaaaattcaactaggaatacgatttaaagttagctgaaattcaaaattaaatataagcaatattgaaataagagtacatataagaacccaatacgagattaaaaagagagttcaaataggaatgcaattttgaaacgactaaaattgaaaataaataataaaatattaaaagaacacaatacattattagttaaaattcgaaataaaaaaaataaaccctaaaattagaaaaagaaaaataagatttcaactagaaatacaatttataaataactaaaattggtgataaaaaataaagactattggaagaaaagactatctaaaacacatgacgagattaattaagtaatagacctataaaagagtagagtggtggcggttaatgggacatctaaaaattattaataaaacaccaaatagaatgatggcgggtaggtcgtgaagcaaccgatcaaggctgttggcgggacttctagaaagtaaaaaaaaaataagccccaatgataatcatatttgatttgtaaaatctcaatgacaataaaaataagaggcagcggacaggttgtacgggagtacaatggcaaagctgccgatggtttggggaacttctagaaagtaaaagaatgaattccaacgatagttatgttcgatttttagaatcccaatgacaataaagaatagatagcggacggtcgtagaggagtatagtggcagcgcttgacgggatttctaaaaaatataaaaaatgaaatccaatgagacaataaattataaaaactataaggtccaattttaaaaggttcgggcttctgaaaagtaaaaaaataaaccccaatcatgatcatgtttgattttaaaatcttaatgaaaataaagaagggaggcagcgggcgagccgtattggagtacagtgacaaagtcgctgacgttttgacgaaacttctagaaactaaaaaaaatgaacctaaacgataattatgtttgatttttaaaataccaatgacaataaagagatgaggcagtggacaggccgtagaggagtataatggcagcgtttgacaggaattctagaaattataaaaacgaaacccaacgagacgataaactctaaaaattataagatccaattttaaaaggctccaaagagaatgaatagaaacaatgatagatcaagcaagcaaataaagaaggatatgacagaagtaacgggtagcaactggtgtaaaattataaaattagaagcacgagaatgataaggtttggtctttcaaaccttatcatataaaaatatataattttgtatgggtgctagccgcgcaattgcgcggtaacaatcctatagagattttggagaaaaaatggcaagagatccaacctcttgaaaaatttcctattggtcaatctctctcatttgattcatgtatttttttctactgcataatcaaatgattattcatgtattttgtattcctatattttacacttgcattcctatcaaaatctttttttcctatttcttcgttttctcaatcatgtgtttcaaagggccttaaagcctgtgttcgggagtgagggttgggaactttcactccctagcacacaaaacgaagcactgtttagcgcgtgattaattaagtattagctaaaataaatttgaaaaatagattaatatgactttttaaagtaactttcatatagaaattttttttagaacacacaccgtttagcaatttaaaaagcgtgcgcgcggaaaacgagggagatgagttgggaaagtagagataaaaacttagccaagtatctctgtagttttgtttttcatggcagtgattcccctgttgaagctggtataaaggagttggatactttgggtagtcattttgctcggtaatgtgagcaacaatatcttacagcgaaatatcacgaatgcggaatctattttgccgtggctggctttctttcaacaaagatattgcaaggggaaaaagaaaaagctttgttccaatggaatgaggttcctatcatgctttctataaaagagtggtatttccctacatgcatttgtgtaagtgtgtaacaagtgattccttgaaacatggcaatcactttctgaatatcctaccaccaatgtgatacataggtcagattattccctagtggacaattgtgaacacattacactaatggaatatttgtctttcccttgatgaatttatgcgatactttatccaaagatcgtgatcttcatacatggtcttacgactttgctgaggcctgtgtttttgggtaaacagtcacctccgcctggtcactccgcctggtcactgtgaccctcttttgcgagggggcaccccttctccaagatcacgattgaagaaaaattcttcaaatttagtcaaaaacgttggtgtgaaattcagagaacactaatttataacacagtgtgtcttattaacccaatctagaccaataagatttcaccattgtgccgtaattgcaatgcttttggtttagcataaaagggaaacccaacccctgtacgaggaagcaaaagcctagtgatcttctattgtttgacaattggagaagaaaatggatgattggcttatgggtggtgacttaatggctggctcattatttggagataagaaactagtggaagcttggagcatagattgtttcctgaaagatcatgttgtcatgttgatgccatcctttagtagatgtttgacatttggagaaaatcacacttgggagttgggactgtacttagagaaggctactgcaactgcaattcaaagggtgtagttcacatcaatcaatggcctttagcacatgaagttctgatgcttatgattcgcatcctaaattcctaatatctgaacattgtagatatagtttcagacttctgctagtttgcttttggaaccttgtgggctgttctgtttgactacttccataactgatgaagtttgatgctaactgaggaagatgaagaaagcttgatgtaactgttatgttcttttaaaaaaaataaagaagaagtctgatactaattgctatcatgataatgacgggatggtaaaggtccactttgccttgggtgcctcagccatgagtcatctgatattctttccctcaaacaccatccaaaaacactgaacaggtagtactgatgccctgctactgaagagcctctctgaagtatttctagaatcctaaatagtactactctttggtgaaaaatactttcttttttgggggcaaaactctacaaaattgaaggcacaaaattggtttatatttgtaaatgagcaattttacggtccttgagaagataccatgaggtactaaaaatttagtataaaatttggtacctcataaaatctagatattaagaggtataaaatttacaataaaaaaagtggtaccttatagtatcttatcaagaactgtaaaattgttcatttgtgaatatacccaaaaaaatgtgaattcattcactccaatgcccccggtatgattaatgccatgaataatctagcaacacaattacaccaaggtatacctgtgtgatacatgcaaaccacaccttttattttgcaagattatgcgaaattacataggtaaatgcaaaccatatttctgacctgtgtaatttattactactatatgtaacttccttatagaatgaaattgtgtgttagaagtagattgttcatttcaagtatgcttatggtatccgttattctgacttgtcaaaatggcatcatctccttagagaaaagcttatttcctttgttaaaggttaacatcaaagcggttctatcatatggtccatggcttattcctcatgcatttatgcatcaacgaaatcaccaaagttttcatgatatcataaaggtcaagtgaagtccatgcactcaagtgaccagaaatttttggacctgcctaagatcagcaaatctagtgaagccatgctgttgacatgtgagattaaggtcactctccaaagtccattctactccttttcttcctttcttgacacaaccattaatctcgtgctctgcttttgtccatggcttgttgtgttcctaacttattgttcttggccacttggttccattcagagaggagtagtttgcactcacaaagtgaagtgacaatcttctttgaagggttaggacatgatcacctgttaagtgagattctgtcttgacttgtgagcagagcaaagcagcaggagcagagcttcacttgatttgcctcctctctggtgaagcagagatgaactccccaaattatcatttcaaaagtggcaaatcaccacttcaactatatatataataatgttcaaattgtggtgtatacatgcttatgaataaagtcgaattttcttctttatttttcttctatccaccgattttctccctatatcgcacgctcgttattacaccagaacgaaaaccgattgagctcagagcatcctgtcggagaggctgggcagccgccggaagaagttgacggccgccggcggcatggggtcccggaacatcgggtggcggaggtagtagaacccgccggcgacggccaccatcttggacggcatggcgtacagcgcgacggcgacggcgaggcagacgccgacgaagatccggctggcgcgcgggtccctccagctcaccagcgcctgcaccctctccccctgcgccgcgacgtcgcccatgacgcgctgcacccgccccgccagcgtccgcagcctctcgtagcgcgcccggagcacctccggcggcggcacggcgtcgaactcctcctccaggtcgtcggcctccaccgtgtcggcctgcgacagccgcgcgtccatgccggcggggccgcgcggccggaaccggtagtaccagacgccgatgaggaagacgtagagcgacgccgtgggcacggccagctccgggtaccagacgaggacgaggtagaggacgtgaacgagcacggtggtgggcgggctgcgccaccgctgcacgctgtcgagccaccgcgcgagcccgacggcccaggcgagcacccccatgatgcggaaccagttcgccttggcgcgccgcacgctccacgtgtgcgcgtccacgtcgagcatgtggcgcaccacctcccgccccagcggcggctcggaccgctccagccacgcggcgacgacgcgcacggcggcggcgcgcagcgcctcctgctgcgcgacgccgatcgggcggaggtagtgcatccgcggcagcagcggcgaggtgtaggtggcccaggtgtccggcaggtgcgccggcgacgtgaaccgcacggcgagctgcacctcccccatcttcttgagccccgaccggagcagcacgagcagcgggtacgacgccgtgtacgcccggttgctctccagcgtggacacgcgcacccgcaccttcccgatccggtagtcctgccgctgctcgtccccggcgccggcgaaggcgaacatccgccagttgtcgaacaccgccaccgtgagcaccgtgcacgggtcgtacacctgccacgtgtactgctcgttccaccgcgggttgaggctgtccgtgacggtgcgcgtccgcacccacttcttgccgtacttggccacgcagtaggcgtccgtcgaccccttggcgccgcccttcgtcttcatcggcagcagcccgcacgccccgatgatgcccagctccagcacgcccaccggcggcctccacagctgcttcgccgtcggccggtagtcgctgcacacgtgcgccgcctcgtcgagcacgtggtaccctccttccaggcacagacggaggtgaagccggccggagtagaaccccggcgggccgccgccgggaccaatgccgatgtcggaggtgccaccctcgaggctgaaccacctcgacgcgacgagttgccgctcgtggagacgctgctcgacggagttgacggggatggtggcgtgtccgagcagcgccggctccttgatcatggagcggtcctcgacgaggacgacgaggctctcgtcgagcggctcggacacgacgaacatgaggtcctcctcccacgcgaacgccgagccgctgctcctgctcgccaccgaccgccgcgtcctcgccgactggaacccgacctggatcttgacgcgcacgtcgaacggcagccccggcggcggcgccggcacgcgcaggtcctgcgcctcgatcaccgacgcgcgcaggtaccagagcttgggcgactggtacaccttggagcgcgtgtacgcggcgtacggcgcgtcggtgttccacgcctccgggaacgcctcgtcggcctgcgtgccgatccacaccgccaccatgatgtcgccggtcaccatgccgggctcgccgccctcgagccggtaccactgcggcgccagcgggccgtccggctggtcgcggaccggcacgtcggagaggtcgaagcagacgccaccgaggaaggcctcgatcggggacggcgcgccgccgtcccagacggatatctccagcgtcggctccggcttggcgtggttgatggcgaacacctggttccactccgggttgccggtgccggagacgtcgcggccggggcgcgaccggagcgtgtgcgggccggcctggatcttcacgtacggcccctcgcaggcgcggatgccgcgcaccttcacgacgcggacgaacaggtagcgcatcggctccaccaggtcgtacgacgactgcaccggctcgacggcgtcgccggtggacacgaaccgcccggagatgacgcgcggcgaggtggcgtagtactccggccccaacccgccgctcaggtggcgcgcgatgcggacgcgctccgtggccatccgcgtcttgcgcacctcgggcgggtaccccgcctcgccgccgtccggctccggttcaggctccggctccggctgcggctgcggatgctgatgctgatgcatcggcggcgccattggcccgtgcggcccgtgcaccgccggcggcatcatcgggccgtgcgggccgtgcatcggcggcatcatcgggtgatgcatcggcggcggcgcctcttccacgatgatgacagggggatgcaccggcggctgctgcacctcgacggcggcctcggtcggcgcggggatgtccgggaggtccctgggcgcctcaggcgggacctcaggcggcggcgcgttgtcaccaccaccaccctccggcggcctatcctccggcggcggcggcgcctcgtcgtagtagtaaatcttgaggccaacctcgccgcggatccagctgagcaagctccgcttctcgagcgggaagtacacgatcccctcctcccctcgccgcgagaactgcgacccgtagatgcgcacgcggccgaggaagtggttcttcccgccaccgccgccgccgccgccggaagggttgaagcggcggtcgtggtagagcgagacgtcgagcgcctcggcgtgcatggcggccgggtcgtgcacggcgaactcgagccgctcgtgccactgcgggctgaggtcgcgcggcacggtgcgcgtccgcttccgctgcccgtcgaagtccacgacggcgaaggcactcgacgtgccgagcccgtccttgggcaccaggtcccgcgcgtccaccacctccaccgccagcctccgcgccacccgcatcgcccccggcggccccggcggcggcggcccagactccggcgggggcgcaccggccgccatggaaacagagtggaggtgggaaaggaggtaagcgaacgagagagaggggagagagtggcgaatggaatagggttcgcttatgatgtgaggctcatggattggatgctttttttgcttttggacgctgcggcggcagctgctactatcatactatggtagctagagtgcgtgcttttggagggagaatctgggcaaagagtgagaggaggaggaagatggatggcggctttcttggcctggaagctcacgatcgctttggtgctcgatcgatggcgcagaatctgatctgcttgcttgctttttttctttcgagtatgtgtgcaggtgatgccggtgtgatctgaattgtcgccgactcgtcgtcttgctgctgctgccgctgcttcttcttcccgccttttttcacctgcgttcccaacagaggcggttaaataacttccaccaaccgcgcgcggcgccggaaaggaaaaaaagaagagattttacacgtgtcatctctcatctgtcctgtgttgtatccttctcggaggattttgatagtattttccttagaagttctaacttttctgttaaatcaaatgtttgaacgtatacataaaacataaaatatgaaaaaaaaaaccaattatacagtttacatgtaaagtgcgtgacgaatcttttgagactaattacatcatgatttgataatgtggtaataacggattaattagtcttaatatatttgtctcgcagtttacaggtagaatttataatttattttgctattagtttacatttaatacttgaaatatgtgttcgtatactttaattttttttaaatggaactaacacggcccttgtgctttgctgcacgctgcacggggaatgcccgaccttttcaggttctcgcctctttggggtaaacgtatctgtttcttccaagagagttaagagtatatatatatatgagtatatatatatatatactactatgccccgttccctaattttttttccaaaaacatcacatcgaatctttggacacatgtataaagcattaaatatagataaatgaaaaaactaattgcacagttagggaaaaataacgagacgaatcttttgagcctaattagtctatgattagccataagtgctacagtaacctagtgctaatgccagattaattaggctcaaaagattcatctcgtggtttctatgcgagttatgaaattatttttttcattcgtgtccgaaaagtccttccgacatccgatcaaacatccgatgtgatatctaaaaattttctttccgcgaactaaacagaccctgtgtacacagtacacgttgcaggggtgcagagttctctgcttttcttgtagattcagtgagatctatgcgtcgtctttgggcaggattaccgattacacatttacacccaatcgtcaaatggccacgtgcaccaaactagaagaagtagaagaagaactctgtttcttttgctcaaaattgcgcaacatcctcaagatgttgttcgacgagacgacggcgagcttaaatcacgagatagctgagtatctccagttctccacgtcgcagagcaaaattagacccatccccaacaaaacacgtgcgtatcatccaggtatacacggtgtatacttagcgtggcactcaggctatctatgtggaatgtggtgccctgttcggtactccacgtggcttgcttatactggtgccacgtaagcactgaatgagaaaggcgttattttttttcctgattcctacttatgcattttctttctttcaaaataaaatcactttgcttatttcatttcccgcatataattccctaatattttagccttttttaagtcgttggttaaattttactcttatcccgattgttcacatttgttccgtcttaatgaatatcttcctacattcgccccgagatctagacaagaaattattgagcacatgagccactggcccaccgcccaagatctttctacgggtagtctaaccaccacctcacatgtgttcctctaccctctattctccagtggtttcgcccttaaccattctatcatagtcatagttatttttttcttctcaaatatttccatgtgggcacaccgtgtgcttctgctcctcggttgcttgtcgtctcctgatacatttatactttgtttctttttcctctttccctctgtcacttttgtctcgaatgcctcatgatcatttagaccttacaacccttattgtcactaacgtgcatagaggttttaatagccttaccattattgtcttgccacctttgtcactcatgcctaggctacctttatcccaacctccttaaggatactaatgatgtcaactatgttgactaatttctctttttattacttaaaagtgtagtcattcatcttccccttccctccctcacttcgtgtgcagtgcatactgcatactctcgcataaaaaatagaaaattccccagataaatagttgttagttaaaaaaattcccattctttaggctagatccattcccagtgatatagccaaaagtatcagaatttaggtattgctaaaactatagaagacaaaagatgaagcatagtcaaccctacatacaacgaatcaaaatgttaagggttcgacccattttctcgaagaaaccttggaatgaaccgcaatgtcgattgcttagctcattttctctagaaaatcttttttttttgaaaaagaaaagttgcctatccatttctactcattgaaacgggggaaaatatgtagtgcaaaccatatatacagtggaaactaccgttgaatcgaaaaatagacgtccga

SEQ ID NO: 81799 - DNA, 11212 bp, Oryza sativa
taccaggtagtccaacacttgcgagttaagcgtttcgtgggagtgctgacaccaagaggtcacggatctcaaggttagagtaacggctgaaaatttgacaaatcttaacggaaaaatttgtcgagatatttttagcttaatcgattattaattgagagttgagatgagatctaattttgaatgggcaggatatgtgagatttgtacgtagagatatcttgaggattacgtgtacgcaaatcaaactatagaatgcagttatcaatttaatgaattatctaaaaaccatagtgccattgggaagttcgtgttgaattattttcaaatagtagagcggcccttgggaagaagttgcatattgaattatctcaaaccgtagagcctttggaagttactgggatatccatctagtaatctggtccgttggtaaaaatgatggcattttttgacttctgatcaaaattagcatagacagctttttctggaacttttaattttagccaaagaaaaaggaacaagaacaacatcggaaatttgtggaaaccgtgagaaaacaactaatatttgcaccactgaagctagcatgctaattaattaaccgattgacactattacagtatgcttattagctgttcattcatatgtgtcaacaaaattaatacagttttgctacatgtgtggcaacatatttgggggctgattacaattagattttttttgtcagatcaaagctatccgaaagcgtaactaactgggacacctgatcaagcttcaactcttatgtgctcatttgcacttcgtggactcgtacaattgataataaattcgctttttcttctcttatattgtgtccacggttcaccattatgtccacaatcggttgcaaagttaaattacatttaaaaaaacaaaaattacatatgtaattttgggacttacattgtaaatacactaaaattacatatttaatttacagacttacaatgtaaatacatgttgactattttttcataaaaaatatggtagcataaatataggtgctctgaattagtaatccctctaacatatgggtagcatactgctggactgagggagcaaacaaaataataatctatctattattctcatgctggttgttctgccaactgcctattggtccaggtggcacaatgcttttttgatgcgtgtatgacgctgcctatacaccccgcctatacacggttgcgcatgcctcatgcaatatcatgggccaggtgccatgcatgcacgattgaatggactaggtaggaagaaagaaaagaggaaaatattggtctatcattgtacgcattgatttggctacttctgtttacgccgtagttttgacacattaatccttctataaaaactttaaaaataaaccatgtcaaaaactacttaaaaaaatagaccgtgacctcagcgccaaccctgatgacactaaactaaaacatctcaacaccactcgacgtggcacaaattagctatgtaaaaggaactgaacgtcactatacattacactgacctcttaataggttttaaatatatggcatgcgctgaaatcctgagtagtatttaactttatctgttttatcaaaaaagtacctataagtaataaaaatagacaaaacaattttaaaattaagtagtgaatttaaatttatacgagtaattcttagcacatactacgagtatatatgtaattttcaattattaataaataaataaaccaatattagtattactatgtcttaagcatatgataaaggttagcatatatactttagaaaagtgctctcacgaattgtgtgcatctagttaaacctagaatgaattcatattggtatatgtatttcttgctgaaaataggataccaaaggttagcacatatctgcttttaaatacataaacgcataattagcccaagggcaaaaaaaaaaagaggataccaaagtaagttttaaggtcatctcccagtcgcagagaacatattacgacctctgctgattcatcatcaaaatagacatcctaaaaggagaaaacaatggaaatccactcagtgagaagtacaatttcaacaaatatggttctagacactattatccgcatgcaacattccattctttttacatggttgattgaaacaaacgtttaggaactgtactaaaaattttaattaaattgaactaaaaaacaggtgaaaagaacaaaaaaaaagcattaaataggggtaaactagcatccttaaatatacctcatcatcccgttcaagtgtcccttgattctgcactcaagaaacaatcatgtatcattagtatctagcacactaaggctgtaaggaactacaaatccggaacatggttagacctggtgagtcgttcaagtagataatgtaatagcatgggtaacaggatgatattttatccaccatagaatcctctcaaattaaacctaacaaaatgtgctggcagagaaacatgttgactgatgcaaaccatcaaagcaatagaaacaaaatcattcacacatacacctcttccatatcatcattgttatatatcacatatcggaatgcctggctcaagttattagcaagagctgccacatcataatccctgtctcggaaatcatcatcatcactatccctaccatggtcatgaagtgatgttgggtgcctgcagcaacaagacatatagagaaactattcagtgaaaaaacagaagcaaagacatccaaggttagcatgccatcaaaaaaaaaaaacaaagagtcacatacccacaagtccaatgataagaactctccacctcattacgcttgactttaagaatatcatttatatattatatatttgcataaaagttttggatgaagtgaatggtgaaacactcatttaaaagtcaatggcgtcatctattaaaaaactgagggaatatattctaccgatctctcataaaaaaataatctcataaaatgcatggccatttgcaccatatttcaccatactttcagaatcgacaagattcagttctaggctaataagccctgaacaaaacaaaccatagataaaaccaaaaaaaaaaaattgtagacacacatatagcaaatcccaacttttatgcgtgttactagtgatttaaaactaagggtagaagaagataaattatgatggaaaaacttcagaatatattaaaactgaactaatttcaaaacttaaattttagctgcgataattagtcaacaagaaggcaatgaaagttatgaaacttagtgataatacacatgcattccaggagagtacacatgcaatatatagctgctcagttgattcttaacactctgtgtagcatatatgttgttttttcaggaaaaatagaatttgaaacctatttaattactaccaaaacctaccaccatacccacaaatgcccgatcaaaatgtgccgataatctggtgaagggaagtgtaggtgccaacgatggtgacgcacactccaatgaccagtatcccaacaatcgccgccacctcgaagcggacaactcttcctcggggcatgtagatcttgaggtagctcaggcacgggaacaacatggcaacgacgacgttcagtgagaacccgatgaacaacatgaggtagccgaagaagggcaaagtgcacgccagcaccgtcatgttgacaacgacggctgctggtgagcaccctggttagcccgttgttcctattgtcagccaccgccgccatcattgccgacagcttgtcctctatcgccattgtgatgggctggatcacgagcgcgtacttcgccagcggggtgatcagtgtcgtcaagatggcgatcttggtgtacagcttccccgtgggtaagttcagtgtcaccttcacctgcacatcctcaccatagctcagatatcccaacactgttgtcactgtagagttgagactgcacatcaccgaagagattagcaaaacctgcacattaattggagaggaatagaacattattggagaggaatagaacattattggagtactgttccattatcatcatcgtcatggtttcataaaccaaattatgataactggaactgataatccaatgatcaattatcaattggttgccaaatctctctaagtgaaaggtaaaacttaaaatgcaacatcattgagctacatcatctgaagatatgtaccattgaatgcaacggttgatataatatccactgttagatcctggataagtatcagcaaaagaatggtaaaaggtccaagattgttcaagaaacttccatgagttaattgtgcaatagtcaatgccctaccacttttgcatcttatacctaacaattctcatagctgttggctgagtcaaaacttagtacaagaatatatacaacacaacacaatagatctatcttttaactcggcattaaaaattttatgatgcaacagatcttccaaatttagatacgctaccttttaatttatctaaaattgtattggactacgcattaaattacttaaaatttttttcataaactatgtattcaaatggctaatataattatttcattttaagtgctagacgcatcttccaactttaggttttagcatataaattaaaccgtattaggcggctcttgattagctttatctttaagctacattgcttttacctgggtggatgagaggtaaccaaatcccaacttgagaggcagccctaatcgctaccattcaccagtttattccgctggggtaataggctttaatatagcatagtacgcctccacgctagttaccagtttattccactggtgtgataggttgtattgtagcacagtacgcctccacatcaccgcacacgtcaaactagtcgaaaggctaacgcgacattaccctaaatttacatcattatgcaaaaaaatatattaatgctaaattgtgaatattgcacttgccattccatatatctgaaattaacattacaaaatttataagtagtacaacatcattttttagcgatagtacaacttattttaataaatgattttaatgttgatttcgtatgatcctaattcttattagacgaccaaaataaacttattagctcgaattttatctacatgatgtatatgtagacctgctatatgatgggagcgccaacaaagtatatgagagccatgcaatgctgagtatgatgagaacatagcagcgatgatgattaagaggtgtgcatgattagtgatgtacgagttctaaaaataattatgagtgtgcgcgtcttccatgcatacatgtaataaaaaagtaatttgtttgtattcttactaaacctggtgctaatttaataccaccattgacttttaaattttcattaaccataattctaaatttacattgttaattgttatcacaaattgtagcaaacttactatcaagtacaacacataaatacattttaaaagtgtataggaattatgagtgtgcgcgtcttccatgcatacatgtaacaaagaaacaatttgtttgtattcttgctaaacctgttgctaatttaataccaccattgacttttaaattttcattaaccataattctaaatttacattcttaattgttatcacaaattttagcaaacttactatcaagtacaacacataaatacattttaaaagtgtataggaaaatccttcttagacttcattgagcagtaaacggtcgggaagacgccatagccggcgaagcagacgaagtagaggctgagggcagtgggcaacccgctcagcgcaaccgacaaggccagcccgaccgccgagataggcaagcacgctgaggttcttgagccacgtcgtcgggaggatgacagtggccgccgcgagcacgaatagctgcttcccatgcacctggtaccctaggatctccaccaccgtgccggggaggagcttgtcgaggttgtcgcccaagaggatgacgaagctgatggcgacaagctagagctcgacgtacatgatgaggccgatggccgtcaggccatagccgctgaaggtgaggtggccgatgtccagtagctcagcgatcgacgcgcatgcagcggtccatgaggttgatggtgtagaagcatatagcttggtgaagagcgccaggctaagccacctgccctgcgagggtagatcagcgatcgacgcgcatgcagcggtccatgaggttgccggtgtagaagcagatggcttggtgaagccacctgccctgcgataccagcatggagagccacatgccctgagatagcgcgtacagcacggagagcatccttacgcttgagggagcatgttccttacgctggagggagcacgtgcgctgtacgcgatcgtccctagatcttcttgctcatgtttaccatagaagggagcctcgtcgatagggctcttatccgccgccataatctcatgttccagacggttgacgtttgaccgcacggaaaaaattgtttctctactagtgtactaacggcttctataattagtttttttctactagtgtacgaacggcttctataattagtttttttattagtgcccaaacaactcatgcaataccctatataatatccgatgtgacgtgccaaagctttatacccatggatctaaacaccccctatgaactgtaaatatgggatggatgtgctatttatttatagcctagctattatttgtaattttttccgacatgacgtgggtcagttcgaatggaacacgtcctttttgataaaaaagaaatctctctgcactcctcatacactacacaattgattttcgaaacgatttccacatcagccttctgttatgttacattactactaggttccatcaaaatttgaacaattttatatgttcttgtacagctctttcaaagagggccaattgatcttcatgatcactttagcttacgctgctttctactactcgactcccctggctgcacgttgcacctgtgcttagtgtaggggctctcctgatctccggtgggctcgaagtagagcttccggtgcagcctcgccgtggggctctcctcttcctcttcctgctcgcgtgggtcgtagtagaggtcgccgacgttgatgctccggtggcggcgctcctcgaactgcacgctcgccgccgcctccagcttcagtttggagaggttctccatggccgccatcctgatgccgtctatggagttcgccgtgttgcggttgcggtgcaggtgcttcgtctccaacttgtagtggagcttgtactcctggttcttgtagaacacgtcgaaaccatgcttgggtatgtcgttggggatctccttgccgatggccaccgccgtctgcatccatccacagaaattcatcacaacgcgggatcagcattgccatcaaatttggataaatttcgtaagaaacataaaaaaataaaattctaatatctcgagtggataactcatcgtgtagcttttacttccaaattcaatacatatggttgtaagaaattctgaaagaaattgaccgtgttgagtataatagcatctatcactctaaaaatcaagttgaaattcgacttaagctttgattaacaaatgataaattcgggtgcgaatagtattcatacaataaattagtcccttttttttatatctcaatgtgtgatttgattttgtacctaagttttttccttttggagtgggatatgtatatatgttgtatatatgaatattgctacgtttttttaataaaaaatcataaactaaactatttgaaagggttttaaacaaatgagggacgaggtatcaaaatagttaatttctcgtacaaacagttgagagtgagtttggcagaaattaaattgagtgagttttgtaaaatttagttacctcattgcaccagcaggaggcgacgtggttgatggtgtagccgccgccgccgaggaggaggagcggcaggttgaagctgcggatgaagctgacgcactgggcgtggccgcgcgtggtcaggttcagctcgccgagccggtcgccggcgagggagtcggcgccgcactgcagcacgacggcctccggctggaacacctccatcaccctcgccatgatcggctcgaacagccggtggtactcctcgtcgccgatgcccacgctcaccggcacgttcagcgcgcagtagcggccggggcccttcttgccgacgtcggcgacggcgccggagcccgggaagaagccgccgccgtgctggtggaacgacaccgtcatcacccggttcgacgcctcgaaggcggcctggacgccgtcgccgtggtggacgtcgatgtccacgtagagcacgcggcggaagtgggcgagcagctcgcggatggcgagcacgatgtcgttcacgtagcagaagcccctcgcgccgccgcggcacgcgtggtgcatcccgcccgaccagttgatggcgatgtcggcggtgccgctcccgagggtgcgcgccgcggcgagcgacccgccggagtagcggaggcagtaatcccagaggcggtcgaacaccgggttgtcgacgccgcggccgccgcccttgccctcgacggcgtagatgcccctggcgcgcgccatgtcgccgaccccgtcgtcgcctccgcagccgtccggggtgaggtcctggaggagggcgaggtagccctcgtcgtggaagtcggcgagctccgccgccgtggcgggcgccgtgcggaggcggcgcatgtcgccgagcatgccgtaggcggcgacgaggttgtgcgccatggtgacgcggtgcggcaccatgacgtggccctcgccgtagtcgacggtggagatccccgggtcgtagtagtagcacacccgccgcttcttgtcgtcgccgcacgacggcgaaggcagcgaattgccgccgccgccggccatggccatgtttaacctagctacaccggcgagatgcagacgtcacggtggcgcatgcaccggacgtacacacgcacatatataggctaaacatatgtaaggctgatcgaagcccagttcgtgccggagttggattgttaattgacttttaaattattaattaatccgaaaacaacttccaaattaacttccaactacctgatcggaagtttggaacggaactcgtatatatatcctcttaactttcttcccgtgcaacggcgtctcctccccgcacgcgcgcttcctaaccctacctttcctttttttttcttttaaccttcttccatatatagatctaatcctctctcgctattttcttttaaccttcttccataaccccggccggtgagagctctcgtccacagctcgtcacatcatcgttgtcacgcgcgtctccaccggtatatctcctccgggcgtgcggcagcggtgtaggcggtgcgcacgccgcggccgacatcgatctacaaattggtgggagaggtgagaaattagctacgttcctataatttcttctcttttttcccaatttttgttattaggctagttaccctgcatgttctgctatatctttctatacatgcttccttcgtaatttccttgcttggatgggactagaaaatcgatgcgcccgttggcgcgctcaatatttatagcctattatattattatttaatgggttttaaaatttaggtttaaaactagaatagtgcccgtgcgttgcaacggataaaaaaatacaataataaatggatgacaacgatttaattatatcttcaggatattatctaaataacattatatatttttttatgaaaccttatatgtttgatattgtgcattagagtggccatgatggtaaataacattccaggaaaatatatttgttaaaccagccgtatcatttagagttttatagaattgaaagaaaaataagtactcccttcatcaaaaaaaaactcaacctagaagtggatgtgacccctcctagattgatgtatgttgttctaggaggtttttgttagacggaggaagtatttgttgaatcgtcatggccagttcattagttatactaggtaaaaccccgtgcgttgctgcgggagttcagtataataacaataagtaaaaataatgtgtaaaatagctaaacaatataaacttacataagttgatatggtttatgataatttaaatttaaatagatatatataataatgattcaaatgtaaaagtaagatgatgtggctttatgagagaagaaagggagtgagatactttggaccgtagattaatcgtgtaaggcaaaaaaaacaattgatatgatatgatttaatgggagaagagaaaaataatactaactaagtgaggatgaatcatataggtatatacgatattataaaaaatgatgaagatatatattgaaatattatgtgaattatgtgggatgatgatttaacatgcttacattttaaaactctaaaatgtaataaattataaaattatagataatataacatgtttgcatgatgtttaaatgcaataattgttagtggatgatgatgtggcatctttgcatgttgagctttgggatctagtgggttataactttataataagaaaagattatatataaccctatttttgctcatattacaaccctgataattgatagcaaaatttctgaaataattttgatgccaaattttgtgaatttaattttgaaataatttgattgatagcaaaataattatgtctgaatttaaatatgcatcaatgcaaaataatgttgtatgagcaaacaatacaaaatgatgtgtgagcaaatgtttgcccagagataagattgccttttcatacaacttaacggagaggagttaacaatagtttggctgtgatggaatttctgggagaaatatgcttgtacgatggcattttcaggaagttgtgtttgtcgatggcatttctgggattagggtgtttgttaatggtatttcatggattttctcttgattatatggatgagtatatgttaaatattataaaaataatgaatatatatgtgtgttaaaaatattgtgaataataatgtgaaggaagatgattggatgttgtttcgtagaattaaatgaattgtagatgatgttgcatgcttgcataagttttctatttaattattgctagtgaatgatgaggtggtatatttgcatgttgagttttagaattagtgggggttataat

SEQ ID NO: 81800 - DNA, 4656 bp, Oryza sativa
catatttttccttgaaacggcttacataaagttcttaaaacccagaaaatcacatgatgtacagtgatgatacacaatggttctcaactttttctttttctgttccaaactaggctagcccacgacggtcaacgtaatgcacaatacccggagatgctcgatcgtctaggaagggaggcatacgtatcctggtgttcgatcttgagattgctacgaccgctggtggtgaaaggcagaatttattctatctgcgtcacaaaagtcacaggccagctatgccgacggcgtcctcctcctcatgctcctgtagagtcatagaatgattagattggatagattgtgggcgagtaaggcctgtttaagtttccaaaaacttttttcaaaaacatcacattaaatctttgacacatatataaagcattaaatatagataaaaaaaattaattgcatagtttgcatgtaaatcgcgaaacgaatcttttgagcctaattaggccatgattagccattagtactacagtaacatatgtgctaatgctggattaattaggctcaaaagattcatctcgcggtttccaggtgagttatgaaattagttttttcattcgtgtccgaaaaccccttccaacatccggtcaaacgtccgatgtgatacccaaaaattttcatttcaccaactaaacaggccctaaaacagtactctagaacggagatgatgatatctactactccctccgtcccataatataagagattttaacattttgcttttattgtttgatcactcgtcttattaaaaaaatttgtgtaaatataaaaaaataaaaaattgtgcttaaagtactttagataataaagaaagtcacaaataaaattaataataattccaaatattttttggaataagatgaatggtcaaatagtgtgtcggagaatgaactcctccaccagggaaccgtgaggcccccctttgtgagttcggccggggcagcgggtgagattcgaggatttggtgagcgaaactgtgtggtcttgagggggttagccccctccaagacgatcagatcaaagaggtttatacaagttcgggccgctatgaagcgtaataccctactcctgtacatgattgattgaatgtagaacacaagtgcttgaggttgtgagacccaagcgccagttcgccccctcgtcccccctccaccactaggcctggacctccttttatacctcaaggggttaccacatgggcccaacaacctaacctagctctggtggagaagtattataatctttgcattaaatgcatgtcttgtctcttgacttgggaagccaagcacgcgtcgtcttgatgatggggcctgtcaaatcttgccgcctgacacggggggtgcccctgtcagtcaccatttaatggataaagacttctgggctcctattaaccgggaaacgggagccttgctttgaccagagcggaaggaccgactccggctgggataagaggatgagaacctctcaccatcactattagatgggacatgtcaggctgcacgccgcctgacacccgagcagcgcacaggcgcactagccagtcccatcggtcattcgaccggtcacagaccggttgagtgcaatgcacgcagtagtggcgcgaccgctcgggacgccataaatgcgggtaggtgggcacctggaggtggacacctaacccaccgtacgtggtgacctagagagggggtcgggggagcccgacccctagttacgggagggggcggctgccgcctgacctcaggcccgctcccccctcgggggggagccatgaggcgcctggggcggccttctccctctagtctcggccagggagtggcagccgccctacctcggacccgacccctctcggggaagggccacgtagcattggagggcagcctcctccatccagtctctgggaaggagtggccgccgtcctacctcgggcctgactcccctcggggaagggccacatggcatcgggggacagcctcctccgactagtctttggggaaggagtggccgccaccccacctcgggcctgactcccctcgggggagggccacgtggcatcggggggcagcctcctccctctaaacctgatacccccggatccatatcaccgacatagtgcaagaaaaaaatcaaaatccttatattttatatcatgagacggagggagtagtagcttgcaacgaactaaagcagtgacgtggccacgctcctgtaccgctgactatgctcaaccttggcaacgccgtcgacaaacagctgggtttatgtgacgacgcagacgtcacgccaagataattgtgcgatattgagccaccgtgccgccactacttgaaaaaagttatttgcaggcaagccaaatccatctttacgtacgggtattctgtctgtaaggaaacgcctatgaagatagataaataattttttagacggtagattcacccgactacgaaaatattttcagtgaaaaaaaaatgccgctgccggcgtgtgacaccctgaaaatttcaaatctagattacgggaacaaaattcaggattatcaaaaaacttttctaaaatccgtcacgctggattttatctcccattttctgttgcacttggaccacaaggacaaaaatctacggacaaaatctattttagattcaaatattatttattaaaagaaccatgattatgaaatgtattaattaagaaaatatttgtaaatacaattatctttctgaaatcccttttctatgaattagaacctatttgatgtatttgttttataaataaaaacaaatactagatattagaaaacatcattgtaagggataattccctggaaaactatttttacaatgaaggctaatgttaactaacctctgaaaatctagaagttaactattttggagttgttttacaaataaaaactagaggaaatttactagtgaaaccctatttgcgaactaaaatttttaaagaattcatttcaaaagattcacggaaaagtctagtttttcctccttgaaaggcctagcccaacacgcataatgagatttgtgttaattgtgtgcatttatatgtttgtgccaaagatctccgttaatccattcttgtgaatcccaatccttgttgggattcctccagattcgaattccacagttcgatcctcctcctaagttaataccctcctcgagcaaattattcgggcatctgcaaatactcgaacccagtgattttctggaaacgcctctcagtgtaatatccgttctctgttcctcctcaactccactagacggttacagtaccccgtcttttccttgaaccgtcagaataacacagataaatcgatccacctaaagagtgttcccccaaaccgacatccttccttaccctctctttcccccgtttgtcttgtcaagcacttcgatgttaaactgatcgaagtcccaaaattctttcatttgccacaataccatttctttccccgaacccttggaaccttgcgatcgaatcaaaacccgcttcatcttttcgactcagcctccctcagattcccttctttcctattttccctctactcgaaatccccgagttcggtctttcgcttgaaaccactaaagttgctcggcagatctaattgtcgtgcgtcgacccgtatattctcaattctatttctacctttgaaccccaccatgacgaatggatttgtatgccataaaccgctcctaaacccatagtcgatattgtccctacctttgaaacactaccgcgtccgatggatttgcatgcccaagcgtcgcttctaaaaatcccatcatatcgtcgtcaatttattcaagtggtcgcaaagaaaccctaagtcaaatacttgggcgactaaatggccgaatcacttccaatccaaaccccagttacaatttcagctcaaagtcaaaagtccagttatacagtccatttataaggcgcccagttatacatacaaaagtccagttatagagtcccgccttatatatgtttgtggagtgatgcaccgcattgatatatcttgttatttttttagtgaattttaaaaacatgaaaaaacgagatatgtgccctcaagagacaaatagactttctgtatttaacttgtttaaaacctaacaacctgaaattaaacgtttcatttatttccctttaattcgaagtttccaacattctctaagccttagatatacaccctccatcctaaaaagattagcttctgatccttagaagttgattttttcctttttacggaacattacacatcaatgcctcatcaaatttagccttacatatttataaagtaatctatcccatattaatggacgtgactacacagctagtggtagctggtttgtctaaatcatctaccacttcatctataagagatactatccacctatacttcaaatacaattttctcttaaactactcatccaatctacgatccgattacaccgttgtgttcgtaataattaaatctttacaacaagatctcacatgattatattttgatgaaaaatcacaaattacttttatgatatgtctaaattatttttagatttcactaagttacttcttagaaatacaaaagtaaattcagta

SEQ ID NO: 81801 - DNA, 3320 bp, Oryza sativa
cttctgacctcactgtaaacttggagacaacagacaaatcctattttgattaccgcagcatctgggagtaaatcgaaatgaatattcaagtttctttttatttgcattctgagatggttttctaaacctctagcacaggccaatgaaaacttcgtttttagcttaattatcccaatagaaagatgcacatatgtctctggtatttaaccatgtgtagtactagtacatttctagctcatgccatgaacctgattttaggtcggcacaacaacttaattaatcggtctctgcaacgcgtgagacacgattgatgttgatcactgcctccaattgctggccttacatgcaccttaattaaacctgtcttaaggaagtctccaacctctcaatcactgcgtacttatctatcctatcagtgccatctcgatcgttcgttttccttgcacactaatagtactagctctttttctttactttattaactgctaattaaccagtcaacacaatcaacacacagatgtacgtcagagcccagctagctttacatgctccattggaatattacactttgaagagaaatatggtaagaataattaaacctagcttaagaccagtgatctctagcagataaacatgggctgtagaacgacgtgtcaaaggtaattaagctggttattaataaccacatcttgcgtgctctgagatattgtaatatcttggtcactttctgttcctagctcactgctcacctgtcgaagaaatggccatgttgttctgaactttcagacttcaccttgcccttactgtttcttcacctggagccatggagatcagatggacatttcctactcgacagatgtgatgtatgaaaggtttgttgtttctgattcgaatggcatgaatttatcatgatgtgagagagatgagctaggatgcatgaacatgttcaggaaaatgggccatatctttgtcccctgtggtggttttcgaattttttttatttataattttttttattaaaagttttacaaaaataattttccattttgaaaattgacggaagtagtcgcctaccgccctctgggagaaaatcgccctctcaaagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcgagggggggcatggaattttgcaggcggcccccttgccgccctgggggagggcgatttttgcctcccccctataaagcccagtccctcctccgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaatatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagtggacgacgacgcatcatccgatgaggaaggtaatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggtaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaat

SEQ ID NO: 81802 - DNA, 4027 bp, Oryza sativa
ctatgagttaaaatttaactcggcgattcactcatgagttaaaatttaaaaattttactggagttaaattttaactcatggtgacgtggacgaatctcggacatctatttctcgatgcaacggtagttttcaagtttccactatatattttccttttttatagatgcatacttttgaagaagtccataatggaagagacaagtagactatataattaggagtagaatgctagtggatattgttaattgtcaactgccaaattgcccatgatgattgtctgtccagcgacggattaactacccggccaacatgggcagttgcccgggctgcgcgtgctgacccattgagatggagttatttatctactttaaaatccatcgattcgttgacttccggacaaagttgagcaggctgacttttcattatacaattagggcctaaacaccgttgttgatttgcctgtcccgtaatggaggacgtgacctactcaactagcatgcatatgaatcgtctattttataataaaatcgtcttgcttttcaagctatagtgaaattttacatgcatattgaactgtttttttttagaagattgttctgtcttcaattgatagtaagccaagaggttaattattgcgaatagttgctaattgacatcttaatttatgtttatgtgtttttttacttaccaaatcaagatttgacaggtgagcatatatacatacactcgactaatcgatccgacataatggttatagcttcttcaaaataaaggtcgaaattcgcttcattatataaaaaaaattgattcgacgtgtacgctcactggctaactagctcactgatcgtggcctatgatttactcaagggcaagagatatataatctccttaattcagagtttcacattttttttggagcaataggtgttaccatattcatatatatctcttgccaattatatagatcgacattggaactggtctaaattaattaattgatctttgaattgtcataaacttaccttaaaagtatttagagatggacaaacctctgtccttaaaattatttttaatcctcagtgtggaatctctttacgccaatttatatagcagtactaaagtttaggttgtcatgaatgcacacatgctgtttactatatagagatgggcaaagatctgtccttcaaattatatttaatccttgttaggtaaccctgttcttctttctccttgctaataataggtattcggaaattaaggagttgctgaagtgttagacatgacaaattaccttctgaaaaattggaagatcaaattataaatgtttgaatcatgagagacgctccgttgccctctacttgcagtattctactccaagtagaattaatctcaaccgtttattttaaagggtagattagtaaagtgctaaaaccgaataggggtaaatctggcacttaatttttttttctcatttgtgcgtcctatggtcaagcgtcgccgatccctcttcatcgaacagcagagtcgccgtttcctcattaatcaaaaaggagagcgcagggaaagaaaaagaaaagtagatcgtgaggtccggccaccgccggcgcttgtgcatcgcgttccatagatgtttcttgctgtaggtatttggtttccattcagcttgattgtttcatatgaaatttaaatatattagttatatatctgaatattacacacgatggacaaatcgaaacactccaatccagcaatgacagatacaaggcaacggaagaataatccggtatgttttttacatagactttacaattgcaattacaacaagtaatatacattgaaccacaaaaacgatgatatacacagatgggtactttcaaaaccacaagctgttaataagctatagttctgaaaaaaaacatggccataagtaacaagccaaagccacccaaagccatcttgagataatgaattcacaggaattacaggacatagcacaccaggaatctctcaagcgttgattgacgtagtgatcattagcttgtccaccttgtcatgctcagtcatttgaacaagctcacttgctccggattcagtttactggcattcaacttgaatcccttcttttaggaggaaaaattatgaccaagaactgcagacaagcagaaaaactgttcgagaattagaggccaacgaaaaaagaagattcagtgcagatgttcgatctgcaaacctgcaagcagcaagaaaaacaaatcaaatctgacctgcaaagcagaaaaagagtctctcatgtcagctaatccgttggagagcagcgctacagccaatgagaggagtcttggatgatgattcggaggtcgagagattggtggtcattggctccggaggctgcgggttccgcttgggaggatatggattgggggcttgccctcgcggctgtgggatcaacggcgggcggagatggacagggctggagccaagcatgggggaggaggccgacgacgaggaaggggggatagcgaggaggacgaggtctcggcggcggccggtggcgcggtgctgggatcggaggcggagatccgagaggcgaactcgtcggaaggtgggccgacgcgggggagcggtaggagagggcgcagctctggcgatcccggacagagatgcgaactcgtcgagggcggctgaggcggcgagtgcggcgggggcgagggagtaggaggcatcgagggcagtggagcaggcgaggtcgtcaaggcggtgatgggagccgcggggttctctccgtgtcggctccagatgcgcgattcggggggaaaggacgaaaatatccctccgtagataatttttcctgggcaaaagtaccctccacgattctactaccattaagtgtggtggtagtaaaaatagatctgaaccattggatcaaatgagatcagcggttcagattttttctactctaggtagaaggcaccgaagtgagactcttgaatcatagcagataataattaatgaccgtagtatttagagtttacaaattagaagcattgttctgcatttttaagatatgttaatgcttttgcagcttataggaacacaatatattctatcatgttggaccagccattttcattgttttttaacacaacgatatatttcaatttttagtttgactataaaaaatgaggagcaaatactaatcgtttcattctgcttacaggaagaaagtagctagaagaagtgagaaatagaaataataatcctcccgaactgactttattctgctcttttaacatgttagctctattttgagcacattgcaattaccacacaactaaatttcccattttcttactagagtggtactttagtcgtttttaaagtaaatcgtagttagtgattaaaattatggctggatgtgcgataccatttgcatattcctctttaattaactatgtgttagtagtatatcgtttactgttgaatataagaggggataaggggttcatccggtcatgcaacagccggggagatggcaacaaggtgtcaaggtcggagctcaagcagcagcgaagtgggcagttatggctgcgcctccacagataggacaaaaggaaaatgctatacgtactaactttttcttactaaattcttactaacactgatatgtcatgctatgagtgcatctagattttttataacttccatctacttaaatcaaacggttgagatgattgttagtaaatgtttagtaagaaaaattttgtacgtgtagcattgctcaggacaaaacagcggcacagaaggtgaataaaaaccataactgtagccattgcactcaatgtttcgttcaaccaaaagatgggttgggcttttcatattacaacatatttacaatatgacctcaaatgacacatttagaaattcagcagattgtggtaaatgtcacggtaatgtatgctaaattatttattgttatgattatattcttagttacaaattatgataaatttgttaatgttccttcatg

SEQ ID NO: 81803 - DNA, 3768 bp, Oryza sativa
atatactgctacagtatatatgtgctgctacagtatacctatatactgtagcagcatataacgtaaaagttacagttttatgataatttcctacgctaatgttgcagcaaactgaaacatgtcgctaatgttgcagcaaactgatagttttatgaaatttactctatttttaaagcggattcagagcaggtgtggatggtgtgcagatgcggacatggagtggattatttcggatgttgaaaatggtgtagagtcggtgtggacctggttcggaatcggagtaaatttgacagatgttttgtgtatatgtaatcaacacaacatcaacttaggcatttaacaaagcaacggacaacaatagagtaatcaatggacaatccatcgtgataactatatatttaagtgctaaacaatatgaatacatgacggccataacataaaaacgtagctaagactgatttagtcataatagtattagtgttgaaagagggcaatcccaaacgaaaaaaagttatttctcaatcccaagaatcaagctttcatcattttccgctatcgtcaagacaaaccttaaaacattccacctcaactatttcatccatagaagcgtatctgacaactatgtcatcatcgtttttttcttccaaaagctagaaagggcctacctagtgcttgcatttcggggtaaagtagctttccccagctcaataagagctacctacaaacatggaatgccaatgcaatgatcagaacttccttgccaagaacatcctgatttattatcaggctttaacctttgtaagtgtaagatgagacggtgagagtcttaggccctgtttgggggagcttaagattctgagaatctgttggttggtagccagcttctgagaatctgggttttccagcttctgggttctagttcattttctggattctacaactatatattctcataatctgggtgacaatttggactgttttggggagctggagattctgagagaagctgcagcaactagaagctccccaaacagacccatagattaaggagtctatcttaattgatgtatttaacatatagagcggttacatgggttgacaatttcagattatctagcaaacggcctaccagataatctatatccgccgaattttaaagataccacatccacacagaatccatatcacactatccgcatccacatccatatctatcggatttctataaactcgtaccatattctcgttttgagcggatttggaatggatcagataagatgttatccgattcgttttcacaccaactctaacccgataatgcccgagcattatagttgtgtttggtagaatttccacttcctatctattaagcgcagatgtaagcattgcgttcctttcgatcgtcgtctgtcctactagtaccgtaagtacgtgagcctctgttaattacgacggcgactaagatcgaatgtgagattttatacgaatcaacagactaggacgtctatggtgagtagggttagctaggcaggtcgtgcagcgttcgcagcaacacaaaaaatatgtatggcgtttgtgcacgtcgaaatggagtgtgatagctagttcgtcgtacgtggaagctcttgtcaaacatcgtagctgcttcatcggcaggcgtgatgttgagaggtagcgacgttgttgcttaagggcccatttaagtttaagttttgcaggcccaaacttaacttttaaaactcaaaaatcatctctttggcaattagatccatcaaaacttccaaacaaaaaatttacttgtagcaaatcaaaccaaaacgaaactcccgaaacacatgaattttggcaaagtttgaaatttgagttttggttggggtgcgccaggctttggcggtagtgcaacgcttaagtgacgctcaagggctctaatggcaagccactattgtgagccccttccctatgaaaaataaatttaatattttttttgacatggaaagatttccattactccatagactcagtaatatcactggtcaccaaatcgtccacctcggatggggcttcattgtcacgcccagaaattcacgaaccagaatttctaagctgaatgtgcattaaatccctgtccaggaccagccagggtacacaaacgacaattgttgacatacatatccacgtcttacaaaaatataaaagattacaaatgcagcggaaagataaaagcgagctaaaccgggaagcttgacttcagcagcgggacgactccactccacaggcaaaccttgacggcagcgacaaaaccaacttcaacaagacagctccaactagaaagatcttcagctctggtgtgggggaacagagagcaagactgagtactacccactgtactcagcaaatcataccggaagaggaggtatgatgcaggatataaccaaaggaggctaggggttcttctgcataaaactagcatttaaaagcagtagttgaaagtagtaaaacagctgtagtaaattaatcaatattaaccaatcactgtccaacgctacaccacgttgcaacatgcccaaccaaccacctgaactacaccagttcattaagctaaactaggggtgagactaatcacggtgaacctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctatgaaagggtcgagctatacttcagatcaagcagttacccactcccgcttgtggtaagcacggtaagtctcccagggtttcccgtgaaccggtccttaattgccatgggtgcgaccagcaaaaccatgcacccacaacccaccattcggtgtattttaattaactaacaccattgcggtggcaccaatccaaaactatgctcatagtcagagtctatgtaataatgtgatccccatttgtgtactagttgagctaagcatggctaagtatttcctaaaccaacatctaatcattttgataccaaagttatcaatggcatatgaacaataaatggctgagtaataggacccatctcacatgacattgtaaaagtatgcgacatttaatagaaatgcgggatatttgtaaattgggtacaatatgatcaattgtaatgcatgacttgccttgctctcgcactgatgagacctcagcaacgtcttcgagaaaccgcggatcgacgaaacggccgaaatctacgcgacaaacaaagcacacaagcaaaacatgctataagactactgaaacaggaaaccaaaccatttttaatggattctagggatttttatgaatttactgagacttgaatggacttaaacgaagctcggatgaattacttatgaattttagaagataaaccgtgtttttactaataaagaaaaagttcttaattatttattgcgcaataaattccaaggctgacgtcatccaaggggggaggggtggctgcgcttacaggtgggccccgcttgtcaacgcacaaggggagggagaggggg

SEQ ID NO: 81804 - DNA, 18027 bp, Oryza sativa
tttcttgaatggaagttggagtgtagcttctttcaaagtgggtgctcgactagtcagtattcaaccccaaaggcccaaagcacatgcaaggcattctcacaaaaaaaaaagaaggaaaagaaacagaacaaataaagtgtgtggtaataatacaatgacattgacaaatggtttgcattcctagactagtccagactccacagtagctagataccacgtaaaatgagctcaaataatggtggtgcaaaattaatctctccatcgacttctcctgtttgcttagttgactcctttttcttttacccttttagaatcgatgggaatcgatcttgactaagacttctactgttccttttttttttcctcacgtttgattccctgtcctgcctatcaaataattgactgaaaaaatctagctagacttgtactgaacccaatcaaatttcaacagtgactatgtaagcctggttggacgaacaagtcagagttgttagcccatccagtttgtttgatttagagaggtcgagattatcttagtttttaggtggcatgttgaggttatatagtccttgagatgggaagtacacggcatacaagttggatgacttacagtgcaatttgctgtgatggaaacaatgagacaattagtgctcttacatcggccatcgccttccttgcctcccactagcaaatgtttctcggttcaggcacgagggcggcatggcaccattagcttcaagacgtgcgtaccatctcagaaatagaaaaacagaggaaaaaaaactcaattcggtctcgggaaaaagagggaaaaaactcaattcggtctcagaaaaaagagaaaaaaaacactcaaatcggtttcatgctttcgatcaaacgaacactcaaattttgactattatgtttaattttctttgcaataatctagtagtaaataaaagaatatgaaacaaaccgatgcacttctctaaattcgtgttggtgtgatgtatgcatcctcaatctagatcttctgtagatggatattttagacatgtgtctgttatattttatattactaaaatgttgtattattttctacatgtgaatttgtagatgcgtggttatcggtggatggtattattatatgtatgcaattttttgttagagtataattatttttgtaaactcagatcatgtgacatattcctatcttttagtatctcgaccgtacattggtagtaatgaaaaattgctggtaccatttccatttgggaaagtctaataagtacttggagatagtggtgtacaataatttctgtgtttgcaaagcagaatatatatagtacttacaatggatatttgtgcacaagtgtgcaacgtgccaggaacccactttgaggagcaaagggaaatttttttccacaggccaagtactgcaggaaaacagcctgagagcttccgaaagcagctgcacggatcgcaattgctgttactatattgaataatggaatggtactaatgaaaagattagaacacctgtagcaaagatccacaacacgtgttaaatctggttatccaaaacccaatcgatcagcttagctggttgttgtatggaagttgcaggttgaatgattggtctctggcctattatcatggcagtgacagaacgtgaaccaaacacacggggaagccaaccaaacagatcaacacacttttgaagagttttgcaaaagagctaatttgatacttgagttgcacctaaacggtaaaaagtagtactacaatttacgtgcaattggtggatatagcatcccagcaaaatgaaatttctggtgacaagatgagccaagcttcggccagaagcccaaaactgtgtgaggtgattattgaagattcttcaggagggaaaaaatgaaaaaatattaggaaataccattatcattgcaaaggtacatgagttgcgaaataccactgtacgtaagaatgacacatacagtgctattttccaaatccgtgatttctttgatagtactgggcaaattgtaaaaagaaaaaaaagaaaaaggaaaagaaggcttactctgaagatatgggaacatggacagtagttttttttttttaactgcggtacagtcagtgaactcgttgaaatagagtactagtaagtttcttgtgtgtgatgtggatctgtgctcctatggacccattgccagcttaattgtgaggcaaagtgaattgggaggtcagtgtcagagagggttgtgaacttgtgatatggaagttcttgtgctatatactcttactcaggcggagtttagttccaaactttttcttcaaactttcaacttttccatcacatcaaaactttcctacacacacaaactttcaacttttccatcatatcgtttcaatttcaaccaaacttccaattttagcgtgaactaaggtggtgtttggattcagggacttaactttagtccctgtctttagacactaatttagagtattaaatatagactacctacaaaactaattatataaatgaaagctaattcgcgagacaaattttttaagcctaattaatctataattagagaatatttactgtagcatcacataggctaattatagattaattaggctcaatagattcgtcttgcgaattagtccaagattatggatgggttttattaatagtctatatttaatatttataattagtatccaaacatccgatgtaatagggacttaaaagttttaatcccatctaaacagcgcctaaacacaccctcagctgcacgccacaactgactagactttttcagagtttagttgccgcaagggaggcatagaactttcagggaacgtgcctgaactgaactgcatgctgatgcactgcagtccccatcagggagagtttcttttcctacatttttcttacctacacactaactcactcttctaggaagcaactgcctggtttgtgtgtgcacatagattgttgcatgattggtgggtttttggtagttgcccaaggcaagcaagaaagaagggatgggagggcttactctgtatcaggaattcaggatgaatctctgaaatgttgtttgagtcaggagttcagagtttcgctccattgatttgaggatattcagttaacctgtcatttcattttgctgtaaccgaaatgagaagaacatgtaacaactatcataattcgatcaggtgcagatcatcatcatgtaatgaaagaagattttgtacacgaaatggagatcaatcaccttgtggagagagagagagagagagaggagacgaagaacagtacaacactgctgccttattggttcatggaatcatgtgactcttgttgtcctcgcggtgttgaattgctgataggaagaggaggacgatgggcatcttcttccccgggagcggcggcgccgtggtacgccgccggccggagggaagcgcgcggatacgtgggcggcggcgcgtcatctccccttctctcttctcgctccgccgccgccggccggaggccgcactcgacgggtcagactcgaaggcggtgggttagagcggagacggtgcagaggaggatgggggagccccctcgccggccgccggcgccgccgccggcggcggcggcatggtgaagagagagcgcatcgggaaggaaggagagagtgggcttgggcttgaaatccatttgggccctacttcggatccagaagtttgtagttgggcccccgtgattccgattattatgtatgggcctgaatattacaaagtctgctactacaatttggcctaagcgaatactgcgagccgtaattttccagtttggcccccgtttaggatagctacaattggataagttcagaaaatatactgatagtatattttagtataggaattacagcgttaaaccatgtctggaagtaacacaactggctgttgctgttccaagatctttgctcaaactcaaaaaaagaaggtaattttgtgcagtcacatagctgcttcacatcgtggaatcctacttcgcttttgcaatggccgagctgcttctcgatctggctcactgctaatgctgctgctacacagaacgggcgatttcattccatcacgtcgataagtcgaggatgccggtgcttgacaatcttgggaggcttgccggagcgccgccgcctctcttcatcagcctgtaaagtagcaggcaatagttcaggataagctgaagaacctgtcgatcataacccatttttgacagatatctccagcttcatgtgcctcacaaagcagattatcacaaaacacaagaaacatactgcaataaatataaatgaaatagaagcatggcagcattttggagaaaacctcaaaactaagggtgtgtttagttggagaaaaggaaatttttgggtgtcacatcggaagtttgaccggatgtcgtaaggggttttcggacacgaatgaaaaaactaatttcagaactcgcctagaaaccgcgagacgaatcttttgagactaattaagccatcattagcacatgtgggttactgtagcacttatggctaatcacggactaattaggcttaaaagattcgtctcgcgatttcccccataactgtgcaattagtttttctttttatctatatttaatgcttcatgcatgtgtccaaagattcgatatgatgtttttgggaaaaaattttggggaactaaacgggccctaagacaatgaagctacctccagcatatctgacatcaagtgcacaaacaaaattcatcttccaaggttcagttaaatcgtaacaaactggaaaacatcttgcttccagaatcgggttggctaaatattcctttggattaaaagaacaatattctgttggcaaataagtttaaattatactacagattatctagtacgtgctggcaaaagaaatcacagatggctggtctggaacaagtgtacacgtgaaaacttaccatctcagttggatgatcaggtagaagaatagcaatagactagtcgagatcatcacctgcataacaaaataaaagaaaaccgattagttttcctagtacatcaagcagatagatcgaaaacacttacaaatggagactgcaatatgaaaccattcttactggtgtgccgtcatagagattgcccagtaccttctctttaccagctggtccaatggtgttgatcaggaaatcatcgccaatgaaagaacactggatttgcgataaaaaagtgtcaggtaaaaccagtgaacagaatagagatgtacataaatgagtcagactaagcttagaggttaaagtccacttcattagattgaaaaaaaaacggagcatcatgtgtacttaatctatggctacttctgaatggaggttaaaattttctttctaacagtttccaggattcaacttgttgacagttaaggagcagacagcattcagttgtaagttgaaaacagatatacaccaagtatatgagaaaatacgacagctaaacaattccaggaacattattccagtcattcaattagtgtaaattggcctcgactaattaagaccccaataatatcaatctaacatgccaagggaataagagatatgtatcacctgcacaagaatcagtattgcaatgtcatgcaaggataaaactctaaaatcggaacaaatattacatatctcaagtcccaacattgtatgaccaaatcaagcagaacaagaattgacacaacagaaaactggttaatgtggctgagtacctttttgtttatagtcatacccatttatatttgtctaacccaaatcatcttcctcttcatgggtcaatggtggacctgcaaaagggaaacaagaaagaccaaagaggttttattaccgcatgtaccacttgcattacataggatggaagcatcgagcaaaactaaacagtagcacctacttttagttaatgtgtcaacagaggagaaaagatcagcaagaacagcgttaacagtagaagcatcaagcctaatcacaattggatctgaaccctgcaatcttgactcctgaagaagccaaaaggcaccaccattccacctacagagaaatcaaaaggcacaactgtctgaatgtaatggatgcactatataacctagaccatcaacacttcaagccttcaacagcaaataaagtgccgattgacaaagaaaaatatgataaacaacaaatacagcgcaaaatgggaatcaacaatgacatataagttactaatgtgttaatatgctgtcactaatttgtcagctgcaattttaatggatatattcaattgaagattaatttgagaaaccatatatcaatgcatgaaggacgaacagcataattaaccaatggaaggaatcgcaagctaacattttctctattgcagtatcatcacatagagtcagatgaatctacagaagaagtggttatgtaactgcatacatgttttgggattttacatctttaggcatccaaagaaatttactcgtagaaccacccaccttggtcacccagcagcagccatagacacatgaaactgcaggcgccggagagtacggggaagcttagaccaaatccgcctgaaatccctgaatgagctcaactgagctccccaggtgctgtttatggataaaactgtcatgtcttgcccatttcttatctccacagtccatagtagagaaataaatagacctaataatcaatccacagtatgtgggttaatccctttaaaagatatcccttgaacaatttgtagatctcaatggaaatagctaagatacatccttctcttttggagaattatcaacatctgcatcattgccaaggtccaatatgcagctcagcttggcatctggtgtaatacctctctgaatcatattatgatatgtcctataggcacttttctcatctcctgtttttaagtatccaattattagatctgtataagttactacggtaggtgtaagccctttagtttccatttcttccatcaacaactccgcaaaatccatagcacgaactttggtgtagccaccaattaaacatgtataaacaaaagtatctggcgatatacccccatttttcatctctctgaaaatttccatagcttttttcatgtttgaacgcttacaatagcatgcaatgagagaagtgtacataattctgtcgggtgtcacccctccaaaatcatattctttaacagtggcgtcatttcagggagtctatcatcatggcacaacccatttatgaggctagtatatgtaaagatatttggcatcgtcccctcatccaacattttatgatacaacctgaaagcctcctgcaaatccaaagctttcacaaagccatcaataataatactgtataggacaacatcgggaatatatcccctttttatcatgtccccaaagaatccccacaaatcatcagattcgttacccttgaagaggccattgatgataactttgtatgtgtaaaggttggggacaatgtcaaattggcgtacttcatccaagaaaagaaaggcttcactaatcagcccttctttcatgaagccgtcaactagaatagtgcatgtaatgatattggggtttatcttgttgtcaagcattagttcaaataaccccaatgcttctttaaggtatctatgtctacaaaatgcatatataagactagtgtaattgtaaacatctggaacaaaattatggttaaccatgtcaatccaaagaccataggcaacctctatatccatatgtcggcaacaaccatgaagaacaatgctgtaagtaatttggtcatgcttgaaaccttgatatttgagacgttcgaaaagttcaagggcctcctcaacttttccagctttgcaaagaccatgcagaagtgaactgtaaatgacaagagtaggactgactctgtttctttccatttcatcaagcaaattagagcctaatgatagagcaccttgtttgcaaagcgcatcaactaatatgctgtagctatggacatctgggacaaccccacctttcttcatctcatcaaatacctccatggctttgtgaacctgattatcgttacagaaaccatgaatcactgcattaaaacaatagctgttgcaagggtagcctctctgccgaagcacttgaagaaagtcccatgcagattcgacttgtttggcacggcaaagtccataaaggtaggttccgtaggttgccgcagtcggcttcacgcctctgattttcatttcacaaagaagatcaaaagcttcctccaaacatggtttatcaccatgtgtatacatactcatcaaaactgaataagagtagacatttggtgagggaccagtgctcttcatatcatcaaacaaactcctcgcatacatgaactgattcctcttgactaaggacttcagcaagaagttgcaaagctgaagctcaactccaatcttcttggcctcgatgtaggtgacaagagcatcctcaaacattgacaactctataaaaacccgtatgagcgcagcataaacttgaagcaatgttatcgatccacccaaattgttcaccagcataagtgccaactcaaacaactccggaccagcatttccacagtaattgacaatgctctgaatcaagcaccggacctctatgactctccgaggcaagaatgactgtataagcaatgcaaacaacccaattgactgggaaaggccatataacctctcacactccctgaagcttatctttcttgcgccgtcccagtttgaagtccgcactgctagtgtgatcaagggaagaaggcactgacgtctataatcaccagaaatggtactctgagtgggctcttgatgatccaggttgttcaagcaacaagccagtgaagtaaatcgcgacgcctgtgggtggtttctggttatgagggctcgacgcaggaaccctggcactgccctgtgcatagacaagggacgcccaatcccctccttacattgacaggatatgagcaggaagaagatcctacacagaaattacacttcatggaccaggcctccgagaaagaattcgcccaggtttacaaatttgaatcaaatctcctgcaaagagaacaaaaacacaaaatcatatcgctataacaataccagtcaagctctcacttgaagcaaagaaataatttaaaaaaagaaataataaaagtttgtgtgttccagagaatcccctggtcagtgagctcccgcgaacgagagcccggtcatcgctcaccgacgaagcagccgtccactctccgagtctccgggcgcgagctggatgagaggggcagggggtgggcgggcacagcggcgaggccatggggagcttaccgggagggacgacactgaggtgagctggaggaggagcacgccgaggaagtggcggaccgcagtccgtcccacgggagcagcgctagggtgaggcggcggcggaagggctcgccggcggtgggcggagggatccacggcggcggcggcggcggggaggcggggaagagcgagaggcgatggccgtgcagctcctggggtttaaggatgtggttgggccgtatctgctttccatgggtgggccggatgcgcggctcagaagatcggatgggctcctcttcgggtgtactgagttagtgggcctcaaatatgggcttcggtttacggaacatccagcccataccgtcgtgcggcccgtccgaccgtaccaaagctcatcagttcaagtagggtaggctgagtgggaaaagctaacgcgcgtgcccgttggcggttgagcgttccggatagtttagcctaactaactaagttattagtagataatgacgataattaagatacgatttcctttttcccggaagattttttctactacctgactgaaaactttcaagttagatttgaaaatttttgaagccaaattttaaaaactttcaaaactcaatttgaaaatttttaactcgaaatttaaatgtgtaagacaaattttgaaaactttcaactcagatttaaaaactttcaactcatatttgaaaactttcaactcgagatttgaaaactttcaagtacagatttgaaaatttttaagttaagatttgaaaaaatatgaaagctttcgactcagatttaaaaactttcaacttgatatttgaaaactttcgactccgattcaaaaactttcgatccagattcgaaaactttcaactcgagatttgaatactttcaaatcagatttaaaaattttcaagttaagatttaaaaactttcaaatcaaaacatttaaaaaaataagtgtgctaaagattaaaaaaagtaatcagaaaaaacgggaaaaaaagcgaaaaaaaatcgcaaaagaaaaaggaaaaataaatcacgaaaaaagaacaaataggctaatgggccttgggctgggagtagctggcgcgcgcgcgagactagcaacccccaggttgagtctcacttttccaacccacctatcttttttttcacgccaaactgctgaatggtgtgttttttataaaaagtttctacacaaaaattgttttaaaaaaatcatattaatctattttttcgaaaaaaagataatacttaaataagtatcacatatataaaatacagtatgagtattacacattggtagtttggtaaaggtagtacaaaatttaaaattatgttgtcattttaatatattttaataataaattgagaaaaaaaacatatatatactattatacgagagaaaatataataatactagctgcgcaatctgcacgggccaccatgctagttaattaattaatcaattaactagtcttgatttttgatcttgcaggcattcacgtcccattgacgggattggagtttgggacgttgcagtctacagataaaaatgctaaaagcgatgttgcaaaacaaaaaagaaaagacagagaaacgatgaatgagatgtttaatcgtgcgctaatgagttacttcggtttacttgcgtgagatgttagatcctactccctttctaggttaggtttttttggatttgggacggagggaatacatcctagccaagtttgtcaggccattttagattaatgccaaaacatactctaccaatatttaaatagttttctagatatattttggtatttggaatagtgcatacggtggtttatatcattggcattaccaatgtccaatttaaaatttctagattccactcaaagctttgctctaagttgacattaaaaaggcaactctacctcagaaaaaaaaattggtggtaccaaaatttatctaagttttggcactagcagggtatacaaactagctcgtcatttgtcaacattgacaatctttcaaataaaatcttagtgccctataaaaaataatcttagggagaagaaaatggagaatttaaaacatttagtatatacgcctaactgcaagtccaaatatactttctctagtcaacattactcgtcgtttccgagaagcaatttgcactgagtgtagtttaattgagttgtctgaaacgacgtatatttctgtccagagggagtatatatttatggcaaaatttgctacgggactcttaaaaaacgtgtaattagctgtgggacaccgtaaaaacgtgaattggctatagaacaccgcaaaaaagtgataattagctactagacaccggaggtattattttattatttcctataaaaacggagagagagagtgttgaaagtaccaaaatacccctgtgtcgttttgcttgttctggagtcccactgatgccgctgccccatgccagcgagctgccacgccatgaccggactaaacaaggagagaaagagataagaaatagaagaagaagacaagagaaaaaaaaaaggaagagcaacctgtagccatcgcgtggccgccggcgaacagcacgccgtgccgtgccacgccaccacggcatacggctgccgccgggcagcccacaccgagaccgcggcgctcacacgcgcgccttggcacgcactaccgtcgctcacgccgtgcctctgccctcgtcgtcgcacggtcatgccggcgccgtccgaccattcctcattgctccaccgccgcacatggcaaggaaccatgaaaaggaggaagaaatggaaaaaaaaaaaggaaaaggcgctgatgggcgtcgccgcacgccgccaccgcatagtcgaatggcgccgttgcccggcccccacaacgcgtgaacccatcgtatctaggtggtatttagttggagggactaaagtggggctaggctaaactttattcccggtagagacttatgtttttgtgagagggactaaatttagtccctagttcccaaacacccccctaatcgcgcaacagttcccagctgcacccgtgcccgtcgcatccggccacgttgccatgtccagcgccccagccgcttacagcgccgaccactcacgacgtcagcgccggccactcgtgacgttggccgctcaccatgggcactcgcccactccaccgctcgtagcaccgactgtaccgcctcgcccctggtgccgacaggccaccgcgactctccagccggccccctccccccgcgcagcaaggcggggcagatggagctggagcggcgttgcatgacggcaaggcgtgcgtccgcgccacgtgcgtgagggcaatctggtctttttcgatcatttctctctccatgttgtttgaaaataataaaataataccttcggtgtctagtagctaattaccactcttttgcgatatcctatagcaaattcatgtctttgtggtgtcccatagctaattgcacgttttctgagtgtcttctagcaaattttgcctatatttattaagaccatctaaaaagatgcactttttaagatgtagtagtataaattgccctagcaaatgttgccgctatcttaaaattgcttctggtcttatcatttgctcctttactcaggcttatggatggctaactttatttttttcagggaaaaagaacacatgctacttgagttaaccagctatccttccagccactataaataagtagtacatgactccactaaagcaatgacgtaaaaaaaggcaaacaagagaacacatcactatatatacatcaaaagcaatattttctgtggatatgctctgaataaactatgaactgagaactcattagccctaacagccacccttttatacggggaagaatatagccaaaaagaaaagaaatattgatgtcaaaagaatggtcctgcatgtttgtgtgctctgttctttttgggatgatttgctgatgtgatgcaaggttccatgatatgactttgcaattttgtacctttcttccctggccgctagttgccatttcaatgctgagaggtcatttccaagaaagaaatattaataatatcctatagcttatataattatcgttttgaacgagaacatggtattgaaaaataacttcgaccactattcccagttataatgtatatagaaatatcaataaatatattattttatttaaatagtttttaagattaatttatacatataatcttcatacttctaagatatatattttaaaatttatttttcttggtttttttctttttccagcggcaaaatttctcaaaagtgaaggaatctcgaataggcaaatataacttatggcccaagataataaaattgccaacaaagcataattcacaaaatatcctatacttgttccttttcttggagcaaccatcaacctttgtcacacataatttggaactatctccatatatatagttcttcatcgttattgtaattcttgaaaaagacataaaatctataatatatatattccttcaacttgtgcttcgagtattttttttccttggagtgatgctataaatcgaaaataataatgtaatactacaaaccgcaatttagatgtaccaagaattttctatggtgaggctcgctttgccaaaaacgagtgaccatgtggggtagcctctgcctccaaacatgctgaactagcagtgtaacttcaagaagatccccaaggaatcatatccctttcatctgatgctctacaaaacctagaagcagtgtgggagcaaaagtcactagccacccatggttttggctatacgcctagaatatgcttcttgtatgcttagaattttagtcaccactctttctctatccgtgctctagggaccccccatgtcacaccttttaccaaaaatcactaaatccacactagccatcctgcctattgcgacattcttactctactttggagtttggaggtgctgctaaagttaaaacacaccaaataaaaccatacacagaaaccctaatgatctggaactacttttaaccctaatgatctggaactacttttatcaagatttttgtcaagttcaagaaaactttatattcaaacaagaaaattggggcaaatacaaggagttaattccatttgatgttcttataagatggaatttcattcaatactttgggtctagatattttcatatatggtatatttattatgcaacaattgtgcacgaataaagataggtttttttatgaaatttcatgatggaacaatatgttacctgaaattataaattataagattacgtgatgacaaataaccctcggtattttcaaaaaaaaaaggaaagagagagagaactcgatctatattgtaataatattactctatctcaaatccatgctacaaatcatacgcatgtataataaaaccacaaacttaaaacgtgacacccgacgcgcaaatagatccacggggtgtccatagcacgttttgggcaatcacgccagtcaccacgcttggcatatgctggtaaatattccacgaaactctgctcttatatcacgagcactcaccacgcacaaatccaccaaacacagatttagctaaccaatgctgttcttgctacaagattaatcagttatctgtaggtattgatcagtgatcagttgcagagatgaagtttgggaagctgctcaagaggcagatcgagcagagcctcccggagtggagggacaagttcgtgagctacaaggagctgaagcgcatcgtcgcctccatctccggctcgccggccgacgaggccgccttcgtcgccgccctcgccgccgacatcgacaagatcgactccttcttcctcgagcaggaggaggagttcgtcatccgccatagggcacgtacaccaattcgcttcaattcgtttgtgaatttagataagttttctgatggcgaaatgggttcttgccttcttggttgcaggagttgcaggaggcgatcaagaaggcggcggaggcggcggcggaggtggccggaatccggcgggagatcgtggacttccacggcgagatggtgctgctgctgagctacagcagcatcaactacatcggggtgggcaagatcctcaagaagcacgacaagcgcaccggcggcgcgctggcggcgccggtggcggaggcggtgcgggagcggcggcacttcttcaagacggagacggtgtcgcggatggtgcgggagtgcgaggcgatgatggcggaggcggcggtgctgccggcggaggcggcgcccgaggcgctcgccgcggcggcggagcacgggatattccggaacaccgtggcggcgctgctcaccatggaggacgtgcggcgcggcagctccacccacgggcgccactcgctgccgccgctcaccctgccggactccgactggctccgctccttccagccgccgtcccccatccccatccaatgaccaccgcctcttcgtcctcgtcggccgcggcggaggctttgccgggaaattctgcgctgcgaaatctgtaattaaatttgcttaattatcttcttgatcttttttctttttctttttttttttgctgcttcttaaataggagcggctaaataatgtaaaaatgcgagttaacatacatacagacgaattcatacgtgttttggctttcaaatattcaaatgtaatacgaattttcctcttgttttcgaatgttattgggttaggggcagtttgacagagttaggcgtcaaagagagaaaaaaaagaaatacaaaaaaaaaagaagaaaaccacatggacgatgtcgctgcggcggcgaagcgttgaacaaaaaatcatttgtgatttgatacgctcgagtggccgtgatatatactcctatttcataatcttcagatcatgcaacgagtcaacctcaactgttcgcagcgatcctcacctgcaaattagtgctcggtgacacaacgcagcgtagaaattcttcatgttaaaaacggttacaataataggcaggcatgccaattgtcaaaattcaaatcgaaagctatgcaggatgattctcttggcccggacggatatacctcacatgtactacaggagttactcactccgtcaaaaaaaaaaaatctaaactggatgtgatatattataatataacgaatgtcatatccaatactaaattaatttttattgaacaaaatgagtagctgcaaagtaggtacatagtggcataagagggatggcaaagttttagtttgtctacggtgaaccgtcaaacagacggatgtcaattggaagatataataatatgcccccaactttcccactgaagctgtgtgttttggtgtggtttgggaagtaatcccatacgcgaaaaacggagtgacaatattagctacttcctcggttacaaaatgtagctacctagtacgttatgcaacactaactagtactacgaatctggacaatccaaaatgtagctagtacgggtgtgacactacctctcatgttcagattcgtagtactagatagtacggctgtccagattcacagtactaggtagtgtcacataaggtagctactttcgggacggaggaaataacctttttataaaaatggttaatatgatttttaaggtaaatattacatataaaaagtttataaaattgcatcgtttaacagtttggaaactgaaaagcgtgttcgcgggaaataaggaagtggaggttaggaacaaccgcaaacgaactcggcctaacttcattgacaaatgaagtctctacacttccattcagccattctcccatcttctcaggataaccggaaggaagatggcaggaatattcttggcatgggcagataactccaacgaaaagccggcgtatttatcaaagaattaacacttgggatattcctcaaaaaatgcctggtctccagaaaacaaatgtgggttgatcttttgatgccaagttgcttctgcaagatcacacactctctgaaagagatggagtaagaaataaatagactttgccgatgtcagtgaggagttgggcagcgtcgccggtgtctcgttcaattcctcactgaaatatctcctcgcttcatggaggcaggcaagaactggttacggaatacagactgaaacagcttttgagaaagggacatactcctttgaattttgaatttggtagggagagcttgcaggtttgcagctgattttgaaattttgaatttggttttgtgttcgttttggccctttttcttgtcactttcgttgaacagcgttcacgcttttcgtgattgctaaaaggatatgtaaaaaaaaggacctaatatcaaaatccaaatttcaaaatttaaaaactgcttcggcttttaagagtgagaaaaaaaagttgagccaaacatttacatggtcatggaaggctgaatttttttcatttttaatttttttttaaaatatttacagaaataatctattgttacaaaaatttaaaaaatagaccctgccgccctagcggagggcggcaggctgacgtggcaaacgacggctcgacggcgccgtgtgcacattttgcgctttggtggcggcaaggggcgtaatgcaatttgcccagctgaaaagaagcatttggctagttttttt

SEQ ID NO: 81805 - DNA, 10091 bp, Oryza sativa
ctagatgcaaaaaaaaatcaagtcaaatgcttctttccaactctgttgatatggcccttcctgggttggcttttttgcatggaggccccttgccgccctggcagtgcgcggcaagggtgttaatgcaaaaaattcaactttttcaatcggccgtcatcgagctgccatctgccacgtcaatttgccgcccttcactagagtagtagggtctatttttgtaaatttttccaacgatagattatttctgtaaatattttaaaagaaacatttaaaaatgaaaaaaattcatggaaggctttacctcggccttcccgtggtttgggcctggaagggcatctacatgggcccctgtgtcttttttgggcctctggagagttatgattgcaagacaattagcccaagtaacagaccaggtgcagtgctctgtttagtaccacaccgtcagttttcagagaaaggagcatcaggagagctataataccagggttagtatcacgcaacaactcatacctttctcggccttttggctaagatcaagtgtagtatctgttcttatcagtttaatatctgatatgtggaccatgtgcccactttgatattaaatttattttttatgggggagggctcacaatagtggcttgccactaggtccctcaagcgtcgtttaggcgttgcactacagcctaagcctggcgcaccccaaccaaatcaatttcaagtgttagcacgtcaaagaaaattcgcatagaaatttcagctgtcagttattgttcattaatcttaatttgaagtgttgtcaattcaaatatactacttagcaatttcagttttcattggcaagtgcacagtttcggttacttgcaattttgaagctgtgcattggcagggtagttatcaatttcatacacaaatgaaaacatagggaaaaggccgaaaggctaacgggcgatcgatcgctgccagcgatcgttttttttttcttttcctctttttagtaagtttatacctaaagtttacacatctaaactttatccacctaaagtttgtagagcgaatgtgtataagtcaaaagtttatatacccgattcaaattcgaattcagattcaaatattttatataaaaatatttctatacacaaagtttatacgtgcaaaatttatggtataaagtctatgcacatgaatgagagtattagattctaattgtcttttacttttttttgaaatttatgatgtaatagaaaagtttttgaactcgtcattttgacggtttgaaggatagatatatgaggaaagatgatacaaacaattaagttctttgattaatataataaagcttttagaatgaccctttttcctaggggctgttagtgggcgggtaatcgtttccctctcctcctagcgatcatacgtccctccctctaatactcctctttcatctctctttttttaacaaacagtgcccctaattgaagtactcagttgacacttgacagtgtacctaccagtgtttaaactaatcaactccttcttaatcacttagacattttctgtcccatatctgctagcacgctcctcctcctcacaggctcacacccgtttgtactcttcgccggctttagcgtacacgccagagtccgtcctcagtatgatcttggcgtcctgcgtgacgtagcacgcccagttgtccacgtaggacagcggcccggccctgatcagcggccgcgtgtcctccacgtcatcgtcctcgtcattgtgctccgtgtcatcctcacactcctccctcgagtaggcgaacctgcttgacacaccacacgcacacacccacgagtcggtaaacttttgttcatattgatataagatgatgggctgtagtaatggtgagcagtagtagcatgtacctcattgaattttgtgagggcgtccataggatgcagatggtgcagaggaggaagaaggagatgagctcccacaccgcggggattacccacgccactcgccaccgctcgttgtgctcatcagtcgtcttaaaatggacctgaattttgattttagaatttttttcatacattattttgaagtgctaaaagtcttcttatgttaattaatttacgagcttgtactaatgtaccacatgaacagttagtgtcatgacgataaaagtcaccagtaatgtggacgaaaacaactaaggttgtgtttagttccacgcaaaattggaagtttaaagaaattagaatgatgtaacggaaaagttgaaagtttatgtgtgtaggaaagtttgatgtgacggaaaagttggaagtttaaataaatgagttgaaacagggcctaagaaaatgattagtcatttatgagagcaaaaacaaatgctgaaatgttcaggccctgtttagatgagactaaaacttttaaatccctatcacatcaaatgtttttggacactaataataaatattaaacgtagactattaataaaacccatccataatcttggactaattcgcgagacgaatctattgagcctaattaatccatgattagcccatgtgatgctacagtaaacattatctaattatagattaattaagcttaaaaaatttgtctcacgaattaactttcatttatgtaattagatttgtaagaagactatatttaatactctaaattagtattaaatataaagttaagtccctggatcctcagttctctgaagttgctgagccatcagaaaacagctaggactgcagcgaagttatacctcaaatgtgatccagccgagcgacagggccacggcgatggtgagagaattcgcgaatttccgatacatttcaagcttcgccgtcatcctcctcgcctgcaagaatcagattaatcacagaattcattgatgattctcgaagaattattcgaattttggtagaattttgaaagtgggaagttcaaatgatgctaccttgagcttgctgatagttcttgacagcgaggtgaagatccagtagatgaacaccgtgttgagggcggcgacggggagaatgaagaagagcctcctcgccggcgagtggtcactgacgatgccgacgttgtcgccgacgtcgagcacctccgccgcggcgaggaacgcggcgccgagggcggccaccctggcgttgccgcagcccagtgcgggcctcgtcacgccgtaccccatggccacgagcagcgccagcacgcggcacgccgcggcgcgcacggcgcccgacgtcgccgcccagaacgtcgtccccgccggccggacgcccgacgcgtcgaactcggcgaggtcgaggtaccaggtggtgacctccaccatgcccagcgcgatggccgccgtcgcgaagttctgcagcggcgacacctcgcgccagaacctcgcgtaccgggcgaaccagagcgcggcgagcgcggcgaacgccagcgacatggcgccgtaaaacggcttgagcggcgccatcctccccgggaggtagccgcggctgttcttccagatggtcttcccctccgcggccaccacctgcccggcggcgagcgacgcgtcgcagtggacgaagtggaggctgtacatcccggtgcgcgccacggcgacggtctcgtcggggaacgccgcgacgaggctgcccgggaggaacgacgcggcgagcaccttgggccagcggccggtggcgttcgacgacgcgggggcgcggtacacgaccgccccctccgtgcacccgcctcgcctcgccatgcccggcgtgcagcacagcgcgcgctcgccgccgacgacgtcggacaccgccccgacggcgtcgcggtcgccggcctcgaagatgaccgccgccaccgtgaccgtccggttgccgtcctcctccgccaccgacgccgcctccggcgtcctcctgaacgccaccttctcgaatctgcaccaagaaacccccccatggcgagcgcgtcacatcccaagaaccaattcaaacaacgaagcaatgacacttggcacccacaaccagctccggccaccgtaccggacgaacgactccgccgtggccgacgcgtagacaccctcgctgccgccgtgcagcacgaagccattgccgacgccggcgaacctctcgccggcgtactcatgcaccgacgcctccgcacaaacgacggcgcaagaaacgaccaccaccgccaccgccgcgccggcgaggaggagccgccttatcgaaggcatcactgacatcgccggagacgggagactgctgctaccaccaccgccgccgcggcagcatcggcggcggcgtggagtagaaatacgagaggtggagggatcccgagaagtggagggagaacggaagagacgactttgacgttgggaggcagccatgaattttgttaggtccacaccctaaactacagaggaaaagaaaaagaaaaaaatacagagaatccattgcaataataatggaacagtgacaaaaccatgatggaattaggcagacatgcatgacaaaaatgacaaatgagagggaacaaatatgagcaagatttagcattgagattatcttggtgcatgattggctccatttcgttgagcactatgcaatatgaagtgacacggggatcgtttgatcacgcgttttaaacaaagatttcgagggaaatatcattctctaaatcaagtaagaatacacatagttatgatattatcggactaaggagaaaaaagaaccatgaccaaaacgcctattgttttaaaacgattttctaacctaaaaccgaagtggtaatataggttgtagctcaacattacaagggttatgtgggcaaatgtttggtaccttgagcagataaacatcgctcctgggtggagaagacctaggggtttgagaagagcagtgatattgtgacaagtttccttaattcctcttgctttgtttagtggcagttttacttgtggactaagggatgaccgtgagcttgtaatgccagagctgaagttgaggttttagtgacgtgccactggggttttagcggtttgaaagccacgtgtgtgtcctctcctgattacacttacaccatcactttcttggtcatgtcaagtcaacgacgatgttaattaccgcaataagaacaaatctaatactcctccgtcccaaaatataaacattcttagcatagtgacgagtcaaatgtttttaattttaactattaacagcaaaaaaataaaaaaaaatcaatcatgtaaaattgatattagtagatttatcattagaaaaactatcataatatttaactttttttatttaaaacatcttacttttatagatattgttggttaaaatagcatctcagagaccgtgttagagtaaaaaaaaatgcttatattttaggatggagggagtagttatctacattcactctaatagcttagtcatataataaatttataaatatatattttactatcaatatttgatcacctcgcatacacacgtaaatacatgatatattgaaatccgtgtgtcacagctgactatatctatagctcgtttttctcctctctacgcttatctcttcttgacatttacttgtagctaacatatagcctgttgtcttaaaaaaaacatatagcctgtatttgctacgcgttgttatatttctaccggtaccactgccctgagttcttgatttgtagcataaggtacaatatttttttcccataaacgtgatcattgaagaagaaaaaaaagggatattgcagatgtgctgactgagctaattaagaataagatattcaggcataaaccaagttagctagtgacttttgcatgcatttgacatgcataagtccactagcaaatatctgcagccaaaaatcatcctaatcctaataatcaaccaaaaaagtccaaaacaaaaggaaaaggtcaaaaggtactcatcgcaagcctgcaacaagtcgcacagcaagacagaaactcacaccagttgggcaggaaaccacatgaccgtgtgtactgcatgccccgtttggctcacaacctaaccaccagcacacgcctaattagtttaatcaataattaccttaccttgtttttgctttcagaattaagtgatcgtctcgtctaagcttcatgacctttacgcatccgatcgagtgacaagagatcaattggagtagttataaataagcgtgagtattataattaggagaagttttactggtgtttttatttcaaaaataaaaaaaaatcaacggtctaaaatagaagtattatataagggtatttaagtatcgatctaacagatgacatggtgaagggtgtcgacaaataaccatattttactgttgattaccctgttgtcattatttactgtaattttattttaaaaatggaggattttcccatataactatataaaccgatgttcaatgaccgaacgaaaatgggaaaagtttcaaaaaggaaaaaaacttttcgccttcaaccgggcctaattcaaaacagcccaactattttgcctctgtttttttacgtgatttttcaaatgttcaatttcaaaaaaaaaaggtcaagttcaagcttgacatgaattttgaccttgtttttacatgcattttaaaatggaaactgaagttcaaaacataggggagaaagcaatagcctagcaaacaaaaccattttccccctccaattggacctaatttgaaacaacacccaattgaaaatggaatatgtctactttgactcccttaactagtgtcttaacctaatttgtatctttaaaccgtaatagcggatattttgacccccaactattaaaactggtgtaatttgtctccctcaacggttttggaggactgttcactatcatggagcatacgtggcggtgttgtaagcgtctgtcgaggagtgatcctctctagcaggagatcgtgagacccccctttcgtgagttcggccggggaagaagctcgcctctagaaatcgcgtatccgtccccaaggctcctagctagctcgcacacaaccaaattatacaggttcgggccgctatgaagcgtaataccctactcctgtgtatgggatttagactgagagttacaatggttcctaaactcgggagaacactcttacttccctcctccacaagctcaggttttctgagagtcgtcctctttctcggtgggtaaggtcctccttttatacctcaaggggataccacatgcaccgcttctacctactcttttttcgggaggggacccaccatatcttgactggaactcgacccgtgccttcgcctggaagctaaaccatagcttgtccttgagcggggcccagcaccgtccctcgcctgacacgggggacagccctgtcattccctcattaataggtgaagacttgtggtggccgccgtccgaatgaccccccgacgggacgggccatacctacctccactccaccggaagcagatgtgacgtgggagcacggttgtccatccagtcagacgtgaccggcgtcaggccggtcacagaccggtcattcttgaccatcgcgcgtcagtttagcacgccgcacgtctgccccactgcattaaatgtgacatggggcagttgaggcgctgtgcggattaaaggaagttcagcctggggcccctcctcgcttgctccccccgccaaacggcggctgggcgagggcctcggggcaaagcagtgcaagggcccgaggggcatgacgtggcaccccgaggccccgacaccccggccgctcctgcggttcgtggaatgcggggacaggaccatgctgtagggacacgtggtaggatggaaaggtagattcccctcacttcgcatacccccgggcccatatctccgacagtttagggcttagggtttaatagttggagagtcgagatatccggtactgcgattcaagcatacgaatcagattcggcccaataatccagatgccaataggacggcccatcaatccagatgcaatacgacggcccatcagatcccgtccccgagaaggaatccccctcaccgttggatccgatccgacggctgagaccagccacacaaaccctcaatatatattcgctcgccccccgctgcgtctcgccgctcctacaccgcgccgtcgccagcagccgccgccgctgcctctcctcctcctcccctcgccgccgatccaatccggtaagcctcgccgccgcaagctccccctcgtccctcccccggatagttcgtcgcctcgtcaggcatctcgccgatttggcgccgttctgttgttctgtttggtggagccgtgcgcgagatttccggtgtttgttgacctgtttagctctgatggattcaccttgtgttagttagttttccgtcgaatggtgtggcgattaggtttggggggattggttcgtctgtgattttgtagctagattttttgaaatctagggtagtgtgagtggggaagctgctggccttagtggatacatgctgttcgtggtctcctggttcttgaaatcatgatgagttagtgctgtttgaaccttgaagcaaagttttaagttattggagttcctgtgcttagatttgtatactattagtgaagagatgcatagctgtactgctgtagtggatataggagtgttgtttttgatttgctggtgctcttccatagcatccggatgcggtgttcaattgtgtagttgtttatgtagttcaatgcactagaagcttttatttctgaatgcctagttattagttgggtatgaagtccaatgtgtgaaatgctgtcatgtttcaacttttagttaagatatgaaacttgagaaacaaatgaaaggtttagattcagtactgatgtacaacttaagtaacatctatggttgtaaattgtaccatgcattggttattgtgaattagctcttttggttgattgaaacaattctctatgtgccaacaggtcactttcagtcttttttcttgagggggagatggcggtttctttcaccaacgttagctcagaggcaggcctcaaaaagctcgatgagtaccttctcactcgcagctacatctctgggtatatgatcagtgtccactgtccaccttattttctgaattgccatttatgttcactggacttaaacccttcaattatctgtttccaggtaccaagcctccaacgatgacttggctgtgtactctgcattttcaactgcgccctcttcaagctataccaatgttgctaggtggtttactcacattgatgcactcctacgtctgaggtatgcatttttcccctttttttattctcttacattttatgttcagtgttgtgaattttctgaatgttgtatttcagtggagttactgctgatggtcaaggcgtaaaggtcgagtcgacagctgttccttcagcttcaacccctgatgttgctgatgcaaaggtcatacaaccctagccttgtcttgtttgcctgaaatctgtgaagtgttctagcatagtactgtgaattgtgatttgatgctgtttgcaaattacgtttttgtggttcaatggtgctggttaccatctctaatatatcatcatatcttctaatttcaggctcctgcagctgatgatgacgatgatgacgatgttgacctttttggtgaggagactgaagaggagaagaaggcagctgaggagcgtgctgctgctgtcaaggcttctggcaagaagaaggaatgtatgccatcctgcattatactataccatttttatgcaatgaataatacaattattcattttattttattctcatctgtagctgtaaattaagaccaaatcatcactattcattataatgcaaagtgctacttctaacttgtcaacacctttttattcagctgggaagtcctcagtgttgcttgatgtcaaaccatgggacgatgagactgacatgaccaaattggaagaagctgtgaggaatgttaagatggaaggcctcctttggggcgcatgtatgttactacattaaatttcttcctacgaatgtactgtcttttgcttttgctagtttggttagattgtgacatgaatatataccactgtttgcagc

SEQ ID NO: 81806 - DNA, 11526 bp, Oryza sativa
aagccgtcatggtggccgaggggaacatcaagttgggcggcgctcgccgtcgtggcgccggccgccgtggcctcacgctgtcgtccggttcccctcctcgtctcacgccgcgcgccgccgtgcgtgcctccgcccatgagagagagaaagagagacattaggaagagagatagaggggtattacatgtgggtcccaccatttaaaaaaataaaatgctgtcaggactgccacacgtacgccacgtagaccaaaatcgccgtggattgggtcaagggcgtaattcgtccggtttgcatagttgggggtaaagaatatccggttttatggttcagggggtaattcggtcgaccgcgatagttcgaggggggtaattcgtactttttctttaaatatatggtaatcacttgtttgaaataaatgccttactgttccatagtacaaaaaatatcataggctgatttgtaaaaactaaaataatgtgtgtcactgtgcttgtgtttttttgaaggagtacagaaaaagaaaagcacttgggggtgggggggggggacaaccagcgtgcacgtaacaaaaaccaagcacaagctggcgagggaagggaaggaagggggagggcgaaagtaggaagggaagaggacaagtggagaggagtttcggtggcagtggaaagtggcagttctgaccacattccctacaccaccaccatcctcaacctcaatccccatccattccattccatcctgcacgagttctccactggagtggagatccgtactatacttttttttattattaccacctgcccgcaaaaccaaatccccgcaccttcctctttccccttctttctcctcccaaaaccgctctctttcttctcccaattgcccacctaccggaagagaggaagagagagagagagagatgggttcttgcggattgaggagggtcagatgatgccattaccaatttaacatcttctgcatcttttttttgcctttcttggcatattcttctcttctggatgtgtagatccttctttccccagtcctgcttagctttcaagcagaccaacaggtccgagattggtgacctgggagcggtttcttgaggtgtggtgccgttctgggtaaggtaaggcaacgaggcgccccacctcgcgcttctcttgaagaatctgtggctcttttctttttttgggttcatgtccgcttcttgtttgttgtattgcctcgctcgctgtagctgatatcttgatacctctcgtttttttagatcgactctgttgccctgcaagaattcgatgcaggagtaagggcggcggcagtatgtaatttggtgggcggttgttggagaagaggagcaattttgcccatcggtttcttgggtgcaaattgagggcaaatttcggtgaatttcgtcggaaattgaggaagcccgtttggcaatcggtcctgtccatgtcccatgcctagaagctggggcattttgggtgtgaattgtgacgaattccagccaatttgggttgggccaggaaagtaccctttgggggtttcagtttgtggtgtgatctgcaatctttccaagattggtggggagttctttgtgtgtgctggtggcaaatgggttgcacacactccaaggtggaggatgaggaggccgtcaggaggtgcaaggataggaggaagctgatgaagcagctaatgcggcgccgagttgagcttgcggctgcacaaaccgcctacctgcagtcactccgaaacacaggagccacacttcgacaattcgccgaggtggagtctgcattgtcacagcagccccctgcaggtattgcagtgcatccatcaccaccaccacctccacctccacctccaccgccaccaccggtgccagtacctcctgcatactcagtgacatcctcagtgccaccgtactcgatgacatcctcattgccaccctcaccacgccctccaccaccgctaccgtttagtccaatagtgataaggaggaaaaagagagacggtgaacttgatgaggatgattctacagacgacgacgacgacactgacagctgctcgactcctctaccacctcccccgccaccaggggttgagtgggagtacttggaaccttttgcaatgcgtcccttaaattttccatcttcattggctgataggattgataaagaagcggcctcacaggtgaccatggatgatgataactgggtggagactaacacagaatttgatggatatgacgatgaaagtgtgtctggtaatgttgaaggcattgtgagcagtgtccagttgaatcaagccaagagtagggctctaggtgatgacaattcatcaatggttagctgggtgacaaaggactcagacacttcagcgatggcctggaggagtaagaagtcgctggcaggaattgccaaggagattgatgaatacttcttgaaagcagcggcgagtgggagtgacatcgtcatacttttggactcttctggtgggcagccagatccctcagagttagaggcaaacagaggtattatatacagtatcttgtctctgtttagtgtttgccatcattttaatatttcttaatgctactattttataattccaactcctggaaacacatatatagatataaagctacatccatgggaaatgaaatgattggttgtactaaacttttcaagatcatgaacattctattctttactctattacagtaaagttaagtacgaaaggacaagaaaagtgtttattcgcaagcaatcacttccagagaataacatttgttgtcctaggtgcaggaaaaaattccaaatccgccaaggttttttccacaatttcttggagctggtcattcaaatctgcgcaagctaatagacaatcctcaatgcattcaagtgatgcctctggatatggttaccatggcaaaacactagagaaactttatgaagaggagcaaaaactctacaagttagtcaaggtgaattacagaagccctagtttttgcatttctttacaatacgttacacaatgcaatcatgtagccatgcaggagataatagcttatatggtagatttcaggtttcttaattatccgggagttgtttcttgagcagagaagtttgtaatccattaacaggataccttagtacctgatgaagaaatgcctacatattaccacattttactaaccaaaactcaaaaagtctatatgttgttgattattatcatcctatgttgcaggatgaagaatttgcaaggctccagtacagaaagaacacctcgttgctacaaagactagaatcaggtgaccatgataaattgcatgcagagaaagtgcgagataatatagaggaattgcaagctcggataatctctttggaggaagctgttggtttgacatgtttgtccatatcaaagctcagagatgaggagttatatcctcagattattgaattatctgcagggtgagcttcaaactttagttacctaagttctaggctgttatattacatttatgtgcatggtatctgatttcagttcataatatgaattagcgttatagagtaatgcatttcaaatttcattccccgatgtagctgatagtttcattcagagctcccaattataatttttaagctaattggtgttgtcttacattctgaagcccatgacaattggcctatggaaataattagtactactaagtgccctagttatgatgtgcaacatcattgtggtagcacgtatctcttcaattatttttgtggcttagttattttcagattgttcactgggttattaaaacagattatctgttccacgcttctaaaatacattttctcaaaaaactttcttctactgcattgctatttgtgaagtttatctatcaaaacatttagtttatccctataatcaagtagataatccgctcaataatatgtttcaaactgagccagtgctatggctacaatgatatcttgctaatactgaaaatattccttgttatgatgctattttgttctatgatatatcttttcacgttctaggcttgtgcatatgtggagaaacatgtatgagtgccatcaggttcagaaccacattgcccagcaagccaatcttctaggcaatttaccagggaatgaaccaacaactgacactcattgtcaggcaacatctcagctggaagttgaagtttctgcatggcatagttcattctgcaatctcatcaccttacagcgtgactacgtaaccatccttaaccagtggattaaactcactgattgcctgcctgataacgatggctttatgaaaagttcgtcaggaattcgtagtctctgtgcagaactccagcgagctcttacaggattacctgagaaggtagagtaaaaccaacttgttttattagtttaacattgtgtgttatccagtgaaatcaagcttgtaggaacttttgcttaagaatatgccacttttctaaataaagatgttcccagtatattgtactcatgtgccagaatttgagctctatcataatcattcacttcgattgccttcttcgtggttttttttcttataaatgttctgtttataaacaggtagctgcagaagcaataaagacttttctgtcagttatacacactatagttgtacagcagactgaggagcgtcaactgaagaaaaagtccgaccaaatcgagagcaagttccatacccagttagagaaacacagcaacaatgcaacccaaaattcgggccagcctacacttgcaaagctggacacgttcaaaaagcaggttgaagaggagaaggctaggtatctgaactccgtgaggactagtcgagccatgacactgaacaatcttcagacgagccttccaaatgtgttccatgctctgatggggttttccggagtatgcgtgcaggcgttcgaaggtatcagtagatgcagtgagattgtcgccagccactcgggagcagtttcacctgccatttcttcgtgactgcatccggcatggttcgttgtgattgttcattgtaagtaggcaaagaaactggttctacgtgaatacacttctcttccaaaacttaaaaagggaaagaatttagcgacgattttaagtcagtacaggcatagtagtcttttgaatagatcaacatagtctcgatttgggaagaggtggatgtctatgaggttactgggaaatgattcatgtgtaactagatacttgaacagttgaacagtagtctgttgctgcatgttctcaacttctcaattctcattatatgatgctattttctatttctcaacaatacagttccaatatcagagtactgaatgtcaagtctcacatgacagatgcttttattcattgcttggttgttatttttttgacgtatgggaataatgctctgtaatctaatctgtgcgtattcctctgcattttgttacagcttctgatttgttggacaagacgtttgaaacgtctgaattgttatatactgttactccctctgattaaagatgccataattttaatttttaccgtcatcgttgagtctgaattgccagagttttaattttgaccatacatatactccctccgtacttgtaaaggaagtcattttggacagcaacacggtctccaaaacataactttaacttcttatttttataaaaatatttattgaaaaatgatatatgtatacttttatgaaagtatttttcaagacaaatctattcatataacttttacattttcagacttaacaacttgagagttattcatgatttatattcccaaggtttgatttaaacattgtcctaaacgacttcctttacgagtacggagggagtataagagaaaaaaatgtctacgtacatgctagatagactcgtgacaatatgacatggatgatgatggatattgctaaaaaaactcaaaagacaaatgttttaagaaataacgatgactttttctttttggaacaaaagagcttttggaatacgagcatgttggctataggggtccgatcatttctcatgaaatatacttatgttgagagatacgaaagtgttcaaatcgagttgcagcataggcaccaccgcccggcttctatgcagttgtcttgaaaacaaattaaagtttacatgagcattttttcggatgggggatacagagtactatgttttgtaacatgttttaagtaatcatactttttaggtctaaatattttctaggaccctagatttatatgtacgtcatctatttgactaaggcatttgaaatacttgtacaaaatagcatgtggtacttttaaaagtaaatatacatactagtcttctgttttctgtttatgtagtcttggttaccttgaaacaaattgcaaagatcgcaaaccaaacataccatttgttgtttattttgactgtgcaaatatgacatttcaacaatcccttatatttcgtgaattgttataatcgtgttttcgccataaaagtataagtaatgttttcctctatgactaagtatttaacgaaaagttttatacctatattttcttccattcttcctataccttaagagttaatttctttcttccacgtctacttaacccaaataagagtgcattcagtttggaggaatttcacagaattttcaaggaagtgaactatttctggtaaaaggcatataatttttttccctacgtttctaagatgccctagcttggcgaggagggattttgtagcttataccgtgtgcaaatatcaaagcaggcacgatggcatttgaaaaaccaaggcactttctttttaaaactaagactaagagattcactattcattatatagagagaagaatgaatcatccttaaaggaaaaaccaaccgtagaagatgagcatggacaccatggagtagacaagaactccattaaagcaccctatgcaaacatagagcatgcgtcttacgagttaagacaacaaccaaataactttataatacattactcatcctccaataattaagtatagtcatagccaaacacaacgcggtattcacattcccaggactactactatgttatgacttcggacacatttttttagtttgttatacgcctccgacaaggacgacaagggtgtcatgagacggctcacgctggactacgacggtagccttcgcctctacagcctcgacggtggcggaatatccccaggaacgcggcttgtcggaggcggcgaggcgatctcatgttaaggcacgtcgaaggcagcggaggaggatttccggccgacgccaacacgagccgagataagttgagaagacgaggcggtgacgagaggagaagcatgtcacgttggatgcatggggcctatagccacagctagctccccgatcacctttttggtatattaagaccttaccgaggcgagcatagccgatggcaaaattgtcttttataaaaatttctctctttgttttcatcgaaaataataaaataatacagcggttgtccaccagctaattatcatatttttacagtgtccacgagaagataaacattctttggatgtctcttagacaaggccacaaactttgagtgtctgtaggaaaatttttatcttttttggtttgtttcgatgagattgaaacgaatgaaagtggttccaacttttttttttatagaagccctcgcaaatcattgacctatcaccatccactccccctcttcgccaaaaagtaaaattaactctccatccatccaaaaccaaatcaaacccaccccccctctcaaaattaaaaaaaaagcgtgctgttcttttctcctcctctcgtgcgcctcctccccctcccccaccctcgccctcgcgatcccaattcgatccgctccggcctccccctcgatccgccgccccccgccaccgcccctcgccggccgcggaatccgcacgcccacgcccggattcgcgcggcgccggccgcggattcgtggccccacccccgcccgccgtcgccgtcgccggaaaccctagatccgcctccgcctccgccgccatgttttggcgcatgaccggcctgtccgcggcctcgcccgtgagttcttcccctctctctagctgctgcctggttatctcatatcttcgtaggattggtgcgcgcgcgcgcggcgtagcggtgagctgcgtgtttttttttttccttctgtctgtttatttattttccgttgggtgttttttttgttgggttggctgtggatgaattgatggggcggttggttgggctgttgtgccagccgctcgtgttgagcttgtgattattgcggtggggggggggggggagcacgtagctctgctgctcccggcggatttggatggtgctgttgggtgtgctgtggccacgatttggttaggttttactgatttttgggggaggattggatcagccccgcgtatggcatgaaagggactggcgtattgttacaaatgaatcctgtgtgattctgtctggtgatacaagtcttagtttgcatttgcattgtgaggtgaagattccgattcgttgggcactgacagcgttgctcaaagaatctttattgtgagggtgtagcattgttgtagtacaataggctcttaccctttttgggcattgccattggacatcaatcttttgaatcactgaacttatgataaagtttttgttccattttatgattgctgcagagttcatatttgaacataatgccatgattaacctcgtttcaatgttatgtgttgatgagttctggaacttatttgtattgcctgatcctaattgagcgataatttcttttcccttttttgtattgttttcctgttgtcaaaatagccttatatctagttgatgcctcaagttattgatacatatgcaagtaaaggttctggttatattgcctaactcaacattttattgcttcaggtggatacaatcctagacaaggaaaattttacactggaagaacttcttgacgaggatgaaattattcaagagtgcaaagctctgaatacacgactcataaatttgtaatttccttaaatatttctgttattagtttgaggagacttgagtggcatgacatgattagtgtactattggctgttgcaacttaccattcattccttatgttgtacgtgtgtagcaaataagaaacatttacggtgttcttatgatttcacttattcattgtgattgatgcaaaggcaattcagttgcttcttagataagctagcagcttattgggtagttgctattttttcctggcacttattgttcgttggacctgcacaattctaattccatcatatggaagaaaaagtagctctttcatttgttgggcaatataggtggaatactatttttgggagtattgtatgtcatagtgcctttttatcccttattatatggttcaaaaatttcctctattatgtttacataactatttccatttcctcccttttctggggcacaattgttctttctcacttctacttcatgtctttttatttgcattcatatacccagagtctactggttgaatgcattacagtataatagtgtttcattgtttcttcaaatagatattagttgttacatttatttagtccgcctataataactaaaaattttgtttgtagcttgcgtgacagagcccaggtggagcaattgcttcgttatgttgtggaagaagtaccagatgatgctgaaaaaaagcgctctttcaagtatgacatttttgttaacatatgccatcatttatgtaaagagaagaattttccacctcaattttctgtccatctgttgtaggtttccattcattgcttgtgagatatttacatgtgaaattgatgtcattttgaggaccctagtcgaggatgaacaggttggcatttcttcatatccttttgaagtgtttgttcagaacattagtggttgtagctaatcacaattgtctagctaatgttatttatccttctgtatgttgcagttaatggaattgcttttctcatttgtgaaatccgatcatccacatagcacattgttatctggttacttcagcaaggtacttcatttgatcaggcattatatgtaactttaccatgggtaaactcatagtatgaaggcactgtagaagttaattttttaggtgattattgtggttacgatgttaaactccaacctgcttttttttttttgctgggttgaaatcagcttgattaattgtttgttctaggtggtaatatgtttgatgctgcggaagactgctcctcttatggcttatgttcaggtattccttgtctttctcatataattgaactaatttattgattctatttaagctgactaggtctgacattcaaatattcgatgcatctgtcctgtcttctgttcactttagttgtgttgttcttccaattatatgctgtttggttaactggaacaagctaatcatccacactgaaccattttctttgagatatctgcttaagataaactgttatgcacttacacttgtatgttgtttgccctgtgagattttatattttttgggttgatcattcagtggattcatgacacctaatctgtacttttatagggacatccagaaatagttgtccaactcgttgacctgattggcatcacatcaataatggaggtaagcaggctatcaataattactatttgctctgcgcttgcatttggctaatgctgcccttgggatccttcaggtgttaatacgattgattggtgctgatgagaccatatactcaaactatggcgatacattgcagtggttagaaaatacagatgtccttgaaatgattgctgataagtttagctcatcggtgagttcctaaagcttgtttgctaagaaatgtatgtaataaacatggaaatgtttttaatcatccatctggcacagtaggtcagcacttatatctgcttgtaatttctataaaattagcagtattttgatgctaatcccctaaatattattatcccatattcctattttttatatggtatgttatttttatgcaggactcccctgaagtgcatgccaatgctgccgaaattctttgtgccgtgactcgatgtgctcctccatctcttgctgcaaagatatgcagcccaaggtttccattttataaccttgttacaaagtcacagtttaatccttatcttgtgatttcgggaaacctttttaaaatgaactttgtgcatggatattttttttgcaatggacagaaaaaaagatgtttatgctgttctcccaactcttcgatgaactttataaccctaaagaggttttgaataatttagaacaaccaatcaaacaaatatgctgttcattgttgaattctgtttgtgtcaccttctatcatatgttctatgaaatttcagttttgttgggaggctatttcgtcatgcacttgaagaatcaaggcccaaatccgttctagttcgggctgcaggaat

SEQ ID NO: 81807 - DNA, 29367 bp, Oryza sativa
gccaccgttgcgtccgcagtcgctgaccgcccgtccccgcgccgtactcgccgtgcacgcagcgcgagccgcgagagagaaaaagcgagagagagagagagagaatagagagagaggaagaagagaagagtatggtaggcgggtcccacaattttttaattaaaaaacgctgactggattgccacgtgtgcgccacgttagacaaaaccgctcttaattggttcgaggggggtaattcgtccggtttgcatagttgggggtgaagaatgtccgattttgtggttcagggggtaattcggatgatagttcgggggggggggtaattcataatttttcctaactaggtaactgagttatcctcgtagggaatttatctctaagtacaagcagtttttgccaaaaaaacttgaagatgatcaaattaagataagctcctaaaaatttgctaggaaggatttataagaaactagaaaaggcaatcaagtccttcttttctctactagatagcaagctagatccatagctgcaacgatgatgaagaaactaagagtagctaaaaatgaaggtgcaaggaagcatacctacaaggagcctccacttggaggttaaggcttccatgataaaatcatgaaaatactgcttctctttgaagatgcaccgtcagtgatgaagaaggattgcaaccttgtggttgccttgttataaatgaaccaaatgaccgatgcaaccctttgtgaagcaaattttccttggaagcgtctatgccaaacccggagaccacttcatgaatggatttggttggaatctatagatgactaccgggacaagagaaatgtgacgctgccgaattcttacactacacaaatgtatcaaaaagaaaaagaaaacaaagaggaaaacattacttcgggaagaacctgactacctggactctcccctctcgccggtgaactgagtcactgaatcgatggaggaaaagggccagatgaagaggaaggaagacgatacttttttttttcgtctgaaggagtcaccaatagtgggagttgaagtgtaatcttaaacacgtataaacttatcctctactcctgaatattaggtgcacatattacgacaattttcagctcgctggtcatgctactaatcatttcattgagaacaaagtaaaataccatcctgtcttccaagttccaagacaggcaacttgagctcctaaaaggctgaaataccatcctgacatagatttgaggagccaaaaaggggtacgatatcttccggcaatgcagacaaacgccaaccggcaaaacgccaaggaacgccaaggaaagaagagaagacggcagcgccaggctgggggcgccgtagatctgtgagcaaaaccggcagccagctgcgctgcagccaaaaagagtctattggctgtcttcttttctcacgggaaggtttcctgcacatgagcgcaacaatttattatcgtgtgattaattaaatattagttaaaataaattttaaatatatattaatatggttctttaaaattatttcaggttgtggaaacataagagtaaaaagaggaaatataaattgggaagaggcgataaagaacacatccttataaatggcgtgggttttaaggaaagaaatagaactttttttcattggctttttcaaaaataccttttgaatcaatttttaacgtattggaataaaattaaaatttattttacgatccatcgtctatcctcgtttcagaatgaagctgccaatggcatggtcgtctcttatagttgttgggatcctctgcagtaggtgaatagtaaaatacaatctatccggccataaatatttagcgccattgactttttaaacatgtttaaccgttcgttttattcaaaaagtttaagtaattattaattattttcctatcattttatttattgttaaatatacttttatgtatacatatagttttacatatttaacaaaatatatttaaaaaagttaacggcgtcaaatatttaaagacggagggagtatatattagctaagtactattttttcaccgttggatctagaatgaatggatgatataaatcgctacagtaacatgacaaatttaaacagtaataaacagtgcgtgaactgtagaattggtacagtgctcagattagctgcgtagcagacccagatggacacaggtcgttcgttgcagtactgcaggggatctcaattggactcggattgctggaggtacaattctttctctgctgtaatgtagaggatctagatccgtatcagataggggtacatggagccctcgaacccatgtccatgtgttttctgcttgtctttagttaattattggttcgtaatcacatttgtaaatagcttcctataaaacaatgtagttctatttaaaagacaaattaccaacgaagaaaatgaccaagataaagttgtcatcttaacctttaaccaaaccccatttaataaaagacactaaagtatttctcttccaccttaacatttgtggatgaagttctactataaaagtgcacttattttggataaattttaaataaagggtgtaaatacatatgctcctctacgcaattgcacttttaaattgcgatgccccaaaatatccttaataatgtgtgaagtaaaaattgtaagttaaatgtaggaaaatgcattaggatattttgtgaaacatgaagcatccaatatgcaaaaaattaatctgaagtagcagtagtagtaccaccgacgataataataataataataataataataataataataataataataataataataataataataataataataataataataatatgatgatgatgaaaatgatgatatgtcggatttaggcctctagccatttagttatagccaaaggcttatgcccaaagaaaccacactggtatcatccaattaaaacaaattatctatcgaattgtcgagttgaattaaatatttctaaaaataaacatagaaaatagcttaaaaatatgtggtactaagtaatctaagtagaacaattttttttagaaaatatattttctaaagagatgtggagcaaataattcactgtaataatttaatttgatgaagtagctgaaaacaatttgatctaagactactattgttgacacaaattagggtgtgttcttttctctaattttccaactcttactctctcctttttcgtacgcacgtttactctctcgtgttccgtacgcacgtttcatgaattgttaaaaggtgcatcttttaaaaaatatataaaaaactcctttaaaaatatattgatgtattttcaagtttttagttaatacttaattaattatgtgctaatgactcaaccttctcccgcgaacacaaccttagaataatcaatagatgtcttgcccctgctcctttctatacttaatgtcatatacacacacgagcaaatccaatgctaccatttcgtttaggcttatgtttatacgttaatatcaattttagagtttttttattgtatattattttaccgtatttatttttaatcgttaaagacatgtatatacaaattttacttctactactactattattacttaaaaaaaagtacagataagtattagcataagcaacacaacgagcccaaatagagtaggcctctacctctgtttatgttacaaaagggtcaggatatcattgttgattgcttctcgcgggcagtgatgatggatagttgcgggcgtacgtggcacatgacgtggatctgactgtaaaatcgatccaagcttgcacgctcggcttgcaattgacgcgtgtgccgcacacacggtgtcgtgactcgtgaccggcgtcgaggtgcacactaaaaagaaaaaaaaacaaaaccaaacttgccggccacccaaaccagcaccaacacgtaaagcctttctccgagcaaaacatccaaacggcaaaatataccccacaaaaactaaaaagtgaaaaagagcagagaaaattaggcaagctccacgtgtcgggcttcctccgcgccgccggtcacatccaacccaacccaaactgccagccacacctcggttgggaactggaatagtatgcacggaaaacagagcgatccattagcacataactaattaagtattagctaatattttttaaaaaattaattaatttgattttttaaataacttttatataaaaactttttttaaaaaaatatatttaatagtttaaaaagcgtgcgcgtggaaaacgatggagagttgtcggaaaactgggtgccgaacacaccccaacccggcaacggcaacccgacccaacctgcgcgcgcctccccgtagccgcagaacgaacctgatgccgcggagtcgaagcgacgcgagagcgcgcacacgtgttcttcagccaagccgacgtcccgcctcgctgcagatcggccgagatgccacgcgaaaactcgcgaagaaaacgcaagggcgaaaaagaagaacagagcagatcaggccgcgcaccgaccggtccacgtggaacggacggcgaggatgaagcgacgattatagtttgttattatagtgttaaagtatgaacaaacaaacccacgggatggagcagatgtgaaaagaaaaggaaggaggcggaaaaaaataaacaaaacaaaaattaaacagaaaaaaaaaaggaaggaaaggtggtgtagattgagccattagaagccttcggctttacggcttcggcgagaggaaggggaggggaagaggagaggaggaagggactggaaggttcgatggcgtcggaggtggaggacgatgcggcggcggtgctcaccaacggcggtgccggcgccgcggaagtccggcggagggtgggttctcttctctttccctgaccatatctcccgtcccattttttgttgtttccgttttgcccctaatttcctccgtttttttgctaatcttttttgttccttcttcctcgggatggttcgttgtttgatgcgcagagggaccaagcgaaggagattctgtccaagcaggccgtcaagatcgccaccaaggccgaggagcacgagcgcttcatcttcaaggtccgttcctccgatcctttttgctcatctcgcgtcgcttcttgcttaaaaatctttttttttttttgggggggggggggggtgtccatgttctctttattcaaattgtatgcgtaacctgttcattttggcgggcattgatgcaaatgctttaaacgagcgtcagagggggtgtatatttactgtttgggggcatttgggcacaatgtaatgctgtagcttccaatttgtgcatctatttttttaaggagcaatttcggcatttattgacccgtacttgaagtattgcctctgtcctaaaatataacaacttttggctatgaatctggacgcacagttatctagattcatagctaaaaatgcttatattttgggacggagggagtatttactaccaggagaccaagattgcgaacaataattggatggctctggatggatgttcttacatggtgctggctttttaatgtgcaggtcacacacttgctgggtgttcttggatttgggacattttgctacctcctgggtgccagtaagctactgcagcattgatctgttctgttggcgtgttactgcatctcaatgttttggtttgtcactaagaatgctctggttttgtttgcaggaccacaggatgtgccgtatgtgtactgcctgttctatgtcatctttgttccgctccggtggatctactaccgctataagaaatggcattactatctcctggtgagtccaattatttttcagtttttcagagtttactatcctgcaaatgtgggaagtaccggtaaacttgtttccgccaaaatttgtttattttatcttgactgctggctggacaacatgtctaacagtttagctatggttattacaacagggaaggtaattcccgctaggcatttgtagtattgaagataggatattaggaattgccctttacctgatgaatgctatgcttgtgatttttgtgcaattcaacatcatgtttcctggtttactctgcaatgcgagtgttccatttggttagtgaaaattgactctgtttttatgctcttatgatagaagcattacagtttcaagccattgattgtttggtaagtcattaataataatcccctgttttataagcatcgtcatttctctgcaggacttctgttactatgccaacacttttctccttgttatgattctcttctatccaaaggatgaaaagcttttcatggtttgcttctcatttgcagaggtatgggaagttagaagtattcatgttgatttctggtctgcacccatctcgtagcatgtgtgattttttggtttgccatgaattcttgcaggggccgcttgcttgggcattaattgtgtggcgctgcagcttggtttttagctcatttgataaacttgttagtgtcctgattcaccttttgcctggtaagcggtctcacaattcaaagtcccagtttactctctaggaaatgttagttacgtaagtgtggtatcattttagggtagtgaaccacatgatttacttgtttatggaatctcttttactatcatttgcaagtaagatacagaggatttacagcaaaaccttgtagcatattattccaatatggtagctcatgattttttaaactagcacattcatttttagttactaaacttctggtatttttcttattgctgacaatttcatgctctgttctaaataaagggtgttgtggccttgtaaaatgttgtttacaagggaaaggcagtctatccatcgtattaaatttagaggcaattaagcgtgcaaataacctagaaatttagaccgtttggcagttgagcattttctagttgttgtacggtagaaatcctcattttggattacaaaatatagcatggaacatttaattgaagcattctagcaagctgaatttagtcaaacctttcttttttgcttctgccatggacattactggcagctccattctgtatagagtaataatgactagatccttattttgtatcaaatagacatggatacatctcttatttggaattgtaaaacgatatatagttgtggaaaactggaaggccattttgcagtcaaacactataaggtcagatggttgtttgttaattattaaatgttatttacaaggttgctttcatgacaattacaagtggaatccgaaaatttttttagcaacacaaacagtaaaataatcaacatttgttctgaggaatttgacaagcgcgtgaggaacctcctgaaattgttggtaccatggtcactggttgggtaaggtctgcagagtgaagacttgggtgcgggtgtgggtgtgtgccttggggggggggggggtctcagttctcagttaactctgaccgggcttgtccctgttgaactatcaagctctgtggcttgttggactaacttaagatttgttgtttgattggcaatgtggtacatggggcccctttatatgtatggatgactgacttgacccttaagaaagtaatcctaatatcatggaaaccagcagcctgattgttatctctaattttttgataaatcttatcacttccttacctaatcttccaaatgggtgccacaaggattgcaagaagtgttggtctacgaccataacagttgacaacctcaagttccagatatgaaacagacctgtctgtactaaatgtattagggttatatgtacttatattctccatccggcgcattttaaaatattttgagtttacatgactgacatactggcaaataatttttacaggcatagttatattcactatccggtggtggaatccacaaacttttgctgcgatgcatccagaaggaagagcagccagagtcacatggccttatgtggaggacaaatcatacctgtggacatggctgtttgctgttcctctagctgcttacaccctgtggcaacttatgtattttctcatagttaatgtgctgcgtcggcaaaggctgttaaaggatcctgaagtcatgacatcatacaggtacatctttgttgttcttggcagtgtacctatgtagtgtggattacattgcttgatatacagtacggtattaatgttgacttaaaagatataaactcatagagctaaaatagctggaattatgaattagagtcgtcgaaaagacgaattgcaatggcaggttgcatggatagttttgcacctggaaccctgtgattggcacactcaatacactaagacccgtaggtaatagttggcccatttccgttcaactaagtgaactaagtttcagttttgaacccctgaaaatgatatttagacccactcccattcaaataatatgggtaaattcacgggcccgtggttgtatccttaaacatttttttagacaatccttgaacaacattgtagtgacatgtgtgcactaccgttttgatctagtttacatttgttctcttagcacaccttttcctaaaagtttctgcccttgatcatttttagctgtgtcttttactgcacaatagtttccaattgttctagcttaacaggttagtttagtaactgttcacagttttaaacagtgtttggtcatgaaagaacatgaagtagcccaataatgtgtgtttcttcatgaatttcttgtagggagctctcaaagaaagcacagaaagcaaacaacatctggtggagactcagcgggcttcttggcgacaggaaccggccactcatgtacatactactccaagcgctgttcacggtggcgacaatggcgcttaccgttcccatattcctgtccttccagatgcatgtggtcttccagatactcaaggtgtgcgcgtcgacatggaacggtggaagcttcatcctggaggtgatgcctaggcaagtcgtccagaaggagaagaagaagctagagatgaagcccatggaagaggctaattcgagccagaatgctgaagaatcacaaggggacctgtcagcaaacggccagcactcatccgagcatagctaagtcactgaaaaaccaaaccatcgcaaacggtagcatttttcagtttttcaccagttaatacactgtggatagcttctctgtgtgttgtgtgctcgaaacaaattatccatgttctgttgggttgagaattttgatgcgtgtgtgaggtttgatctattcagactccaggcagggagcatttctcaggtagaaaattatttttcttttcccagtcaacccatgatattcactgaaacttctgatattgaccatgacaaatttccgtgcgtgacccgtcatctgctagtacttgctggacaagttattacatgactagtacgtaatttcgctgaagtacactgcgtttacgtgtttggcttgggtcttgggtcttgggtccttggggctctatatatacctcgtttctccaggccggtaaaaagttcttttctttagcttctggccttctgctgctccgatctactactacttattacgtactcgcatctcaccatgaagccgctatcgcttctgtcagcgctcgccctggcgttccacgcggtcaacacgggcgtcgccgtgtaccgcagccgcgccgacgccgcggccgtggcgctcgtgctcgcgtcctcgctcgcgctcgcgctgctcttcctctgcctgcgcctctacgagggcgcgccccccgccgaggccgcgaggcgccggtggctgcgccgcgccgtctggctgctctccgcggcgctcacggcggcgttcacgcgccgcgtcgcgggcgcaatgccgccagcgggggccgtcctcgtgtgggcgatgagcgcggcgaccgctggcggagggttctacgccctcgtcgtcgtcgacgacggccgcgatctcggcgcaaaatagctaattaataataataataataataataataaatgcatatgatgcgtatatatatgtgacgtgagttacttgctagtcaggcgatccatagaaacaaaataatactactattaaaagggatcaaagtacacaaaatgtgtacgtatgagcacttcacgctcgtgtcgatgttcagctagcccagtggatgcagtacgaaccaataccagcatgctctgctggctatggtgttatacagtgcttgttattgtgattattcgttgagctctatatgtagtgtggttgttgttgattagggatctcaatttgatatcaacaaaggattatatatttatccattgagtgatcgattgatttttctatcaatcattcttctttttttgtttcaatatatagcagtccatacaattttaatttttaaagggatgacatttgttatctcttcctaaaaatagggaaatatttttgtcatctcgcctcaagattgtcctttttgatgaggaactagaattttaaaaaaagtaagatttgcttaatactagccctggggctctgcagaaccaatttttccttgaggactgcaaaaccacagttaattaacaatgaaacccctgtgaaacctttggaaccctgccaattccattatattcgaaaaccaactattataaaaattacaagttgaatgaccgcgaattacaaaattacttaactaatagttgtttctgctcaacagcttaattcttgtcattctcaagctatgtgtagctatggatctaaactctagaatctatagatgacttcattactaaacctgtagtttgtgatattatgccttaagttttagttttaagataattttggtgctaaaatctgtagttttataatatatatagttgcatacgtattttgtgaaatttactcgaaagttctaaaatactacgtagtattttagaatttttgagtatactcactggagatgatttaaactctcacggagatgttttcttgcatgtcatttaaatagttatgaaataattaaaaagatttgataagatagattaatatattatatattgttccacaaacatataagttcaaattcaacatctacaaattgtaacaaaaagaataaattaagctcaagctagtatgcatattatcacacccattttttttatcaattcttagaagttaattttttaagaagaaaacaagttttacatatttgtgacgtgataaaacacatattaatttatcttattgtttttaaaatttttaattatttagataataggcaagaaataggtgtttaaaatccattgtcaactccactaaagaaagaaaaaaatccattgtctgctactatgtgtagtgacgccactttttaggtggagatgatgttaagcaatctgacgtgatcgcagtgcgtaagactgaattctacaggaagttcaccggcacaaactaaagttggtggaagcaacaagcaagtcaaattaacaaatgatccgataataaaccgtgggtacacttatatactaggtgaaacctgcgtgttgctatgagaatttactataataacaataaataaaaataatatgtaaaatagcttaaaaaacttaaggttatctaagttgatgtgatttaaatttaaatggtatataaaatgatgattcgaatggctttctgagagttcactgtgactccgctttgtttgtgtacacggctctgtcgagcatcgttgtccatcaactaattatatatgttggcatactattgaagagttcagttaaattgcgtttccgcttgtcatctaagggtgagtttgaggagagggggattgagaagattggtaagatacgtaaaacgaggtgagtcattagcgcatgattaattgagtattaactattttaaattttaaaaatggattaatatgattttttaaagcaactttcatatagaaaatttttgaaaaaaatacactgtttagtagtttgggaagcgtgcgcgcggaatacgatgtccttttctcacccaatcccccagaactcatcacaacgaaagcagcctaatttttgtttcatcttggaccggacaccatcactataagtacctgcacaatatacatacataagagttattactttagaagacgagtttctaaatcaaaaataatatacatacgacgctgtcgtccaactctagtgtatgaccaatgcaatgatgaaatgcctcacacatgatagatgattcaggtcgtgatgaatctttggttgcgcctgttagttgtgccacgttgtaacacggtcggacatcaatcagacaacagctttggacatcaatcttcaaatgcggcgtctctggcctccgctactagtcgagtcattccttccgatccttccccatccaattcccaatcctaacccttcaaaaactataggtgccgtagctcgtggctctacgacaatagacaccgtaagtcttattcaaaaacttttatgagatatataaaactatatgtatacctaaaaatacattttaacaataaatcaaatgataggaaaagaattaataattacttatttttttaataagacgaacaatcaaacatgtttaaaaaaatcaaacgtgtttaaaaaagtcaatggcgttacatatttagggacagagagagtatctgtgtcaatgtgtgtggtttggggggggggagggggggtttacttgtagagaccgactgagtaaacattgatttttaggcagtcaattttataaattcaagcaacagcaaacaatctcagccgttggggacaagtgataagaaacttacgaggggaaaagattatcatttcgaatgaaaaggagagatgccagtcaattcttcttagataatgctgggaacaagtcaatagcacacggtaaactaagtctggttaattaattaaggtgacttgtgaactttggttttgtttgcttgctgagcgaaacaatgcagcattaaccctcctctccgggccaactgacgtgatatactgattaaaaagatgtaatctctactgattttacgctcttgcatcggagagattcactaatttactactggccaacagaaataacgcgagacagacacaaaagtgagatgaaatcctactgacaaatattgcttacgttgttacggcgtacgacaaggattttctacacctaggtgccatgacacctatcatttatatatgactcaaatagttatagagaaaattgaaaaaaattagtaacatcgtttgtgatgatacaagtttatgcacaaacatgcatgactcaatttgatctatgaccagagaaacaaaaataataaaatcagaccgtgaatagtacccgcacagtgcagataaaatttattatttttgtttcttcatatatcgatcgaatttagacttgcatgtttgcatagtgtcttatattatcatggactatcttatcaaattttataaaatttttatataactgtttacattacatgcatacacctaggtgccatggcacctagtggtagaaaatactttctgtacgggagctgcaccctgcaccattatcaatgacaacctaagcacaagcgaaattgtccagccatccgaggaagcatttatgcgagaaaaatgctactccttccgtcccaatatataagtatttttagaatagtgccaagtcaaacttttaaattttaactattaatagcaaaaaaatttaaaaagattaatcatgtaaatttgatgtttactatatttatcattaaacgaactattgtagtatacaacttgtcagggttatggataccacatacctaacagtagttgactaaatttcggcaggacccacgtcttatacggaaacaaccttcagatatagaaggagtttcgcataaggaaggatgaatagagttctacatggaaacgacaagggctactcagattgtatccatattggtttccctagttctacttggacaatgggatacctatgggtataaatacaaggcccctaggaggagaggggacacggaacaatagatcaagacacaagatcaacatacaagccaacatgcgccaagacaagccgccggatatcgacatcagagatatgcctggactgaccctatctggtaccttcagtggcctgctgtagggatctagcgctgtctctgatctcgtcgggcacgaattcgaggagaaagactaccttgttgtcgactacgagtcagcacttcagaccgccaagtcaacaacagatagataggctacccgaaatattgtaccggtgtgattacggtgaataagagcaacgactggcttcagccaacaagagtagggttattacctaacaattcaggggcccaaacctatataaaaatcctcgttcccatctcttttattacaatctcgcatatatcctagtaccaacgatctctatactatgcaaataccagaatcgcgacatcaaacgtcgacacaactctttttatttaagatattttacttttattagatattgttggtcaaagtagcatctcggaaaccgtgtccagatccaaaaatgcttatattttaggatggagggagtacacaacttgttttttcatgccatcaaacacgtttaaaacacctaatgctttgtgatgatatcaaatcgccaaccaccttaatctaaaaaactctaaatccagatagcttttgaagattaaaccggctagtggagccaatttagatgaaagataaacatacgtctcgtggatagaacggaaggttttcaggacaaacctacacagagaggattcgcactctcgtggtgaagacgggtagttttcgatgcaaaccagcgaagatggatgaaaactaggctagaactagataaaaagtagatgagatgctgaaaaagtaatttaattggctactgtgttggagtagattgtgtcttaattgaaccaaccatagccattataaaggggttggttttacgttctagaggatcttttttacgtcttactcgggatagaaactaattagaataaaaaaattgtctttccaagaaaaaaaaccaaagaatcaatgtaattcaacttggagtcgaggttagctcgtcttaccgaccatatgccatcggtcagaccagccccaagtcaatggtcaagagccaaatagacgactgcacaggacctacgatttttcggggcccatatgaagatgacgacccaaagtccatttcccacaactataacatgcaaggcaaatcgtcaagcccaggtggccacgcgtacaatactgcaacatcgtcgcattgatcctaattccgtgattgcgtgcgccgtggctgctacgagaatgagacgagattgtcgatcctaattccgcaccgtgttgaccggcgaggcaacaatacagcctgtgactccgagcggcaacggcgatggccctggactctaatcttcgagcagctctacagtatgcagctgcttgctgagctcctggctcctgccctccccctccccctccccctccccctcctcactcttttagtagaacatgactacatgaggtcagcattaccttcttcactcttttattattattatcatatgatatatttcaaaatatggtacattatagcacatattgcatctatataatttaattgaacaaaaacatgttttatttatattagacatgcttttataaaaaaaaattataggccctcaatgtgtatttcaccctagggccccaaattcatggagacgtccctgtcgttggtcggacaggccttacgtgttgaaaaccgagtccttccaaatatcatcatgcttttctatttcatgtctaagtgtcaaatttaaatattaataacaagtacaattgaaaatttcaccactctttaacttgatgctcttttttttttttgccctggctgataataggattataataccaagcaacatattttaaatttagaatatgattttagggatttctatgttactaattttgcaaccaagctctttttaaaaatctaattgccaataagacaagtcggtagccctaaagcactagtagatttgaactagatttgcattataatccaaagcggaaataaggcggcaacttttggtgaaatgcattcaactcattataatcattttttccgccatcgctgattcgcgcgcgcctcctcccagcctttttttttctttttttctaccgtttttttttgttttctttcccacttttttctgatttatttttttaatctttagcatgttttgagtttgaaagtttttaaattttaagttgaaaattttcaaatctgaacttaaaagtttttaaatctcgacttgaaagttttcaaaattttcaaatctagacttgaaagtttttgaatctcgagttgaaagttttcaaatctcaaattgaaagttttcaaattttttcaaatttggacttaaaagttttcgaatctgagttgaaagttttcaaaatttgactttaaaatttaaaacttaaatcgaaagtttttaaatctaacttaaaaaaattttcaatctgttagaaaaaaatctccaaaaaaaagtctccataatctttcctaattactatcattagtgttaagtgtattggctaacagagataattaagacttaagaggggagtgcggagtgcacgcgcttgctaggagcctaggagccccctttttttcccgttcctaattacacaatcatccattgcagcctgaaactccttgaaatttacaacaaattttcatctcgagaaccagtcgatactagtaacacactaagcactgtataaatacggtgattaatacgtacatgtcctagtgatcatcaaaccctgcggcgacgatcagtcggactcctgcaggccggcgaggacgacggagccgacgaagaggccggcggcggcggcgaggaggacggcggcgaggacggcctggagcgcgacgagggcggcggagtcgtcggggacgaggacgacggcggcgatggcggcgacgaggagcgggagcgagacggaggcgagggcgtcgggggaggcggcggcggcggcctcgacgaggctgaggaggccgaggtcctcggccttggagaggaggccgagctcctcgagcgaggagagcgtgacgccgagctcctccgccctggacagcagcccggccttctccaccgtgctcagcaccttccgcctctccagcttcttgaacacgtccacctccacctcctcgctcccctccgcgaatatccccgccccgaaccactgcttcgaccacttctcgtcgtacctgttcacctgcacccccaatatccaaccaattaatccgccatggatggatcatggatgaacacatctccaatttcagtcgagacggggcatggctagcttggttaccttcttctggggagccatggccgtgaccttgaagcgccgcctcctcgcgaacggcggtggcggccgggacaggcaagacgaagagcagcaggtggagattgctgcttggacggcagccatttcttcctcctccccttctctcttctcttcttcctctggcgaagcaagaattcgacgcttctttttgtttcttttttttttaggaaggaagagaggaatcggagtgtggccaatggagagcagcttatctctgggctgggcccatcgtgtgggtgatcaaagcttgagccacagaaaatgccacggtggattggatttcctagtgtaagctgtggagacatctcagccattattcgggcacctttttggaagaagtttaataatttaacacttttttcaattactttaattattttttataaggatgataaatgagaacatctgagtgaatgaaagtggaccaaaatatcaaataatcgaaacccatttacggaggattaaattatattatcaaatctctccttttttttggccgttggttgggtaattgaacggctgagatcagagagtgaaacgaacttgctcgaactctctttctcacgtgtgttcatgggcccaaatcaacagcccaggtgtgtttctggtccggagagtggaggcggcctcgaaagcaagtagatagcccaaagcccaatctaagagggcccataggcccagatcgacgaccacaagacaacccgccgtgcggcccgcctggcagtttgcttttgctccacccaccaccaccgctgcttccaagttccaaccgctccctctctcgtcgctgagctctcctccggtgggcggcgcggcgatggcgggggacccggcggcggcggcagcggcggttggggcgatgaggccgtggaactacgtggtgacggcgcacaagctgacggtcgtcgcccgctcctgcgtcggcaacttcaccgcgcccgatcacctcgacctctcgtaagcgctcgcctcgcttgttcgctcgatcgatcacgcattcaccgcacatgcctgctcctcctcctccgcgggatcgcggcgggcgctagggctttgcggctgcgtgttggtttttttttttttacccgcttaaaccctatttcccccgtcgatgtttgctgtgatgatcgattcgatgctttcgtgctaggttgatcgtactacaccgaggtggaggtgctccccttttttttttgttttttggaatggggcgtgcttgcgatttgcgtcccaatttggacacagtgggttttgtgggaaatttaagagctcccccgtgtatttgttctatttttccttctccatgtattgttgtttggaattctcagttcgtgtagcacactagtcattcacactagtcattcatcagaaatgggcttgtggattcagttgtagtggatgttagcctactcatttattttaaaaaaaattcgtggtactgtgatgatggtgaagcagtaaaacatctgtgagttaataaaacttagattgattgtgttttttctaatatgttttttttgtgtgtatttgacttctatttttctccaaaattttatgtacatccttcatttgtttgggctaaagcttgaccgtacaacaactttcaggaaatttacccgtattgagattggagtatctgcttactcatcagggtcttcaggtcagacagatttgcctcgaccagaatatgttccttctgtttgaacctatctattattatggacagcaaataactgtgccttgttgttagcatcaattgttgaaaaggtgttttttaaggttattcataatggctactgttgttcagataaatgctgatatacttttagttgacaagttagaatttgtcctggcagatcaactggttacatgatattcttacaactataactctgtaagaccttttctttccttaccagcctatgcttgatgcacctgtgtatggtagaattgcaacaattgagctcttccgtccatgtgtaagtttgtactctgtttctacagctaaaaaattgaaagattctccctgccttcagacagtattgttgtaggactgatcttaagatcttatgttttccggtcccatcgttatggcatatttgcaaacgaaaaataatttgtgaataaaacttttatatacgtgtttttagcaatttaaaagcaaaagctgaaaaataaatttcaatgaaaaaaccccaaaatcaactccaaatttgaagttaaaaattcaaattttagttgaaaagcataagcataagcgaaaagataacgctcttcattccttgaatgaacctcaagaattaagattctcttttcatttgtacggaaagatacagatattgtattcttcactgggatgggagtaagtcaaagcttcttacaaggtttgatctctccatcatcacattatttttatatagattgcaattattaaactccatttttatcttaagttccttcctcagtagatattgttaggctgtgtttggaactccaagttaccaacccctctccctcgttttccgcgcgcacgcttttcaaactgctaaacggtgcgttttttaaaaaagtttctatacgaaagttgtttaaaaaattcaaattaatctatttttttaaaaaatattagctgatacttaattaatcacgtgttaatggaccgttccgttttccgtgcggggagattgggttctcaaccctactatccgaacacaacctaaaatatgtatccgtggcaacggtatttttcctgcaatcaaacattcagatggttttaaagtatgcatgtgatagtgacctgactgccagactgacattaaagtccaatctagcccctttagcctctcaaagaattcattggaaccaatcatagacatgcattcattcacttaatctatcaatatatccttgaacgagctataaatttaacatttttcaggaatacgtaaaaagattgcgcacaccttagcaagttattaggagtgagtagccatgaaaaggttttgcttaatttaagtatctattgatctagtgggcagggaaaatgtttcactatgttagttgtagatgaatgtatgatttcaaggttctgcatctttatattaggtattggcatctatcaagttctcaccagacagcagagcaaagtcatcttgcaaatttgtgaacgcttttgtctatttgaatcaggaaaatcggtatgtaatatgcaggtcagggagagatgcttctgaccacattggacgccctacaaacaagggacaggtactgtgttcatgattagaagcatttatttttccacttcgtgttctgtacagttatcagctatgtgtttcttgttaacagacagatgaactcagcagggactataacataacctggatgactgcggttgagatgctcgacgactacgtttatattggcgcggacaattgctataacctgtttaccgtgctcaagcgccgtgttgggaggcttttagtcattgggcagtaccatctgggggacctggtgaacagattccatcaaggcccccttgtgatgcaagatccaggctcagaagtagaccagattcctgccttcatcttcggtgaaagcagaatagactcaacgcaatagattggattgatatcggtgcggagtacatataggcacgaaatctcccttatccactcagccggttcatagaaactgaaccgagagagataaggggaatcggcaaaatagggaaacagagatatacacgagatacaattctaacattcggcacggccagtggcgccatcggtgtcattgcctctcttccacattactccctccgtcccaaaaaagacaaaccttgggtttgaatctggacatgcatcatgttcctcgagaagctgcagcttgtcctcgctgattacatcaagagcgttggcaaccttacccacgcgcagtggcgggcattctgtactgacggcaggagcgtaggtgcggcccagggatttgtggacagtgatctgatcgagtctttccttagcctggagccaagcaagatgggaggaggttgcgcggatggtgtggcttcatgcggacgagctgtgtaagagcatctccaacagcctctccataccactctccaagctaaattttagctgatttgatacaaaaacacactcaaacagaatggctatcccaattgccaaaagttagcaatggccaaacatgggctcgagctagccaaacttggccagcctttggccaccctcagccactgtccatccgtgggcccaccaactttttcctctctctccccaccagccgcaccatccctgcccgtgccctccctccttttgccgcaccgcccttcctcccgatccgctcgtgcctgccgccaccacggggaaggaagctcgccatcgccgtcgcttcgttgccgccggcgagatgggagaccagcagcgggatgatcacctccggctccgggtcggcgccacgggtcaggttgcagaggttgagcgggagcatcgccgaggcggggtggttccgcccgccgccggcaagcttggggagctcgcgggcgaccttgcctgtcctgttgcggcggcagcgcctgtgctagctgagcaccagtaggaggtgaagcagctgcttggggagcaacagcagatcggaaccccatgccgggctgacgcgaaggcgaggaggagaagggagggctcatcgggtcgccggccggtggtggtggtggtgatgcgcggatgaggaggagaggccggccgatgcagcgagcggagcggagggggcggtgcctcgccacgcgcctcctctagatcccgctacgtcatggctgctgaggtcaccctcctctcctcctccggcgactatcgaggaggacgaggccgacgaggagtggatctgtcgttgccatcgccctcttgtccacaggagaggataaagaggggtgtggggaaaatggagaagtacgaggaagaagaagagctgtagaggctgacacgtgtgtcctactgttatagagtcagaatagagagggtgaatggagaagctgttggagtaaacaacgtgtttgacttgctaaattagatggagagttggccaaatagatatttggagagttggatttagaaagactgttggagatgctataaggtagtgaaggcgctgaggaaactgcactgtcatgatcgccgaatagatggcactcatggcagctagattctgatctccatgtgctgctgctgatgtacatacaagactggatggaaaatctgtgcatagctccatcgtcaatcagcactaccaggtgagatgttgaaggtgctatttggtgttttaggcttaactaaacggccacacaagaacacagattttgtaacctcctggttctactggttcaatttttccatgtttagttggatactactccctccgtcctataatataagggattttgggtggatgtgacatattctatccagatttattgtattaagatgtgtcatttctaccaaaaattccttatattatgggacggagggagtactcggtaggaggaaatagagtaattgtcagtagttgcaaatcatacgtcctttgtctgaaaccttttagacaaaggttcagttaggctgcagcatagtgcatcaagatactccgagcatatatgccattgttctggagtgagctagtttggcatcaaagagaaaatgagtgtaattacgcatgcaattcatgtaacgcaactgatcggttattctcagctgtgtgatcatgggaaaaagaaagtgtatcattgtatttcgtcgctgtgtatgctttaccaggacatcggacaaaagtaatgttctcttgcaaacgagactttcgatgaattaaggcattgtctagccgacatgggctccactgctccagatgcccactaaagcctcccgacggaacagaggacaaatgaaagaaacagacgaatggcatctaagaattactaatagatcagtaagatcacaggtgattcttacgcttctttattagcagattaagaaaaaaaacaattatacatcgatactgctttttttcccctaaactttaatgccggaggcacaattattaacagcctcttctaagaggtaccgtataattgtccatagtgacgggcatgagtcactccaagaaagtagtattaataaaataaactaaatacgtagtatttattaaaaattttattttagttgatttttctcaattagaataagacattgctcttttcgcttattcaccagattatttgctctacccttcaaaaaaatatatttttcaaagaaatttcttacagtttattgtttaaatcacttgttttaagatactatttgttaagattatttcttaaattatttaattagctctataataaaatagatgatatgtgacaaataatttacttaatgactaaacgagtaaatttcagaaaaaaaaaccctgtattttatagtcaaaactttatttaaaaaactaggcattaaattggtggcacattaccataatactcttaaagttttataaaaccaaccattctactgttgagtgcaattttttgtaaattttaaaacatagagtatgattattattatttaattgagttcttcacttaaggttctgatcgagcaagactaccttctgaaatttactatcgtttaaatgaaaccagcgtgagttagcgagtagaaatacccacatagtgacccaccccaaattcctaattgctgtcatttctctctcatataattctccttgagcttgtctctggcatccaaggtctagggccccttcttttaagaagagaaaagaggcaagcctgagctggctcttcttaatgagttgctcgcagtcacatgctccatgggtggcgccgtgcaggcaggcagcagggagaagaaggtgattgtgtcctcaggcggcccaagaaggatccaccaccgaatacaccgccatcattctcggccgaacatgccatcatttctggatccaaccgctacgagttggccgccagatttacgctccctgccacgtactccgttgtcccgaaaaatatgttcacgttgattgacttagatgtatcacatcttattttagattgagttattttgaaacgaatagagtaaaactacctaatacgatgtacacggtacatgcatacacggctcattatctgtgaagccacacgggaatcagtcgctccagtgcctttgtccaagatggagctattagatcaaagaaagaaaaaagaaggatggagctagagtagatttttcctttttcttttacgtaagacagaacaaatgcacctatgaagcttacacgcacacaaacactcttaaccgcatacacctcattgtcaacttctcaacagggacgttatctttcaccaaaaaaaaacagttagatgcttaaccacgaacatcttactagtaatgaatacatcgtctatcactaaaaaaataattaactcatatataagtacatcgtctgctattaaaaatataactagtaataaatatgagtatttatgtcaatcgtaggacttaaacatgagtgaacaagttccattaaaaaaaacttaactagctgagctattcttaattcaaattaaactaattaataatgtgttataaaaaatatttaaattggaattgaaaatttagagaaaattttattgtttgaaagtaatttttgtgataaatgcactggtgccatttgcaacaattctttacaaagtttctctctctctctctctctctttttcatagcaactacttccttcgtttcatattataagactttctccacattcatatagatgttaatgaatcaaggcacacatatatgtctagtttcattaacatatgtctagatttatatatatatatatattaatgaatctagactagggatgaaaacggagcggatacggacggataatgctcataccgtattcattttcatattttttaccggatacggaaacaaatacggatagctcgaatacggaaacaaatacggattatctcgaatacgaataagaatcgaatatgaccggacacgaatacggaaacaaatttttctcggaacacgaaaaccaacttaacttctaatagaaacaaatatcaacatatataattagctcactttatattaaatgtagtataatttataaatatttttaaaaatttaaataatatgagtgtggactagtgttaacagataaaccactattaaaatctaaaaatgtatattgaaggtcatatagttataaaaaatggggtatgtctcatagcttctgcggatatccgaattattatccgtatccgacggaaactccgataccatattcgtattcgtatccggaagaaaatatccgtattcgtatccgtatccgaattatccgatccgaaagttatctgtattcgttttttgccggagcagatggaaactatccgctccgttttcatccctaatctagacatatatgtgtgtctagattcattaacatttatatgaatgtgagcaatgctagaaagttttataacctgaaacggagctagtagttgaaaacagatataataattgtctagaacatcgaacataagtatgttccattaataatgctttaaaatctcaccgtcatgaaatttgaccatttattcctactactatttgtttaggtgggcacattttgcaattatttagcattaattagacatctttttattgacataataccaactcagaatgagacagtcagatctgagtgatgtcacatcgaaggatagtgttaatctgttaattagttatgagatttttaaaatcttagagaaaagctcatgacgaacaatcttaatatccgatgggttttggaacattaacggcagtttttgaagaacgaatttttagcgaagagttttgtagggtttgaaatggagaacgttctatttttaatagatgattgtgatactgtgaaattcttttgaattattcaatacataaggattttagatgaaatttaacatggacctaacctctttttttttccgtgaacacgcaaaagcattgtacgtcaatatattaaaagaaaaaattttgttacacgacacaatcagctagattagcttatgccaagaaaagagaaaaaaaacacaacaaaaaaaaagaagagactactacgatgactaaacacaactccaatcagctggggttaggggggggggcacagagccacactaaccttgtagaaattttcttttggtttatttttctccttaaattatcgtcctatttggtggtctattcaaatcatttatgtgttttgtttcgtttcgtttcataaccctatgctttgcaaatgtcatatgtataagaatcaccttttttccgtttatgtgttttaccatacctactactcacgttaaaagaagccatttaatagcttcggccagcactgtgtcaataccctaaagaactagtcaataccctaaagaactagcgagtcaacgggcttatttggattgttaccctatcaattttttggtagtgccaagttttggcactaccaaatatttggtaagttaagattatttttatcatatttagtttgctaccaacatagagtcaaaatgtgaaattgtagtaaagaatgttctagataatgccaaatctagattaggtattaccaatgaatgggcttcaatccaaatcaaacgcaagtactattcaattaccaaaatattggtagggcatgtttttggtagcaatccaaattggcccaacacttatctttttttacttcgtatcatgtttaggtgtatctgtcgtcagtgtgtttgggaaacggttagtgccacccacaagtaggggtgggcattcggtctaaccgaaaatttctgtctcggtctttggtctttcggtcttttcggtctttgaaaagcgaagaccgaattttagtaaaaaaatgtcaggaccgacaaattcggtctcgatcttttcggtctcggtcctgaccgaaattcaacaatattttcatatatgcaaagaaacaatggaaattttcaacataaaaatcacaaaaaaaattcataagcacttatgagtaaagactcttaataggttgcatgcctagaagaagtaggatgtgaaaattagagtttaatctattaaacatagtggattgtatgttgcatttagacatttttttggtaattcggtcttttcggtctattcggttacccgaggagactaaccgaattgaccgaacaaaattcggtctttcactacctaggaccgaattgatgaccgaatttctcggtctcggtctcggtcttttcggttcggtctttcggttcggtctttttctgcccacccctacccacaagctaacccaaacttgtgctacaaccttttctagaagttactagtacactttgttgttaagtcgttgcaaattaaccaattagtattgactagctagttaagaggatggatggttctactaggtgcacgctactctgtcgtatgcaacactctttgattttttttacatacgtataagtacgctaattattaaaaatatcatcacatccataaacaaagaaagcttaccaacccaattataaaaagtaggttgaacagaaaaatagatttggcatgttgagaaagaatccaatgaactttgttggaacatgccaatatgtgcaagccacagaagataagtacaacgtgtcgtacaattgtgagatcctatttatgttttttaattaagaatgtactttatattctaagtgcattattgtttttaaactacatattttctatccacacaaatcaataatacataagagcatataacaaatgaataaatgaggtggctctaacatccattttgctgacgcggagatatgaaagggaggagaggggctgcaatacctctttttaaagaagagatttggccattgttctctaacaaaattgtgaagcttatattagttttctttgctcgtataaaagaccattattataggtaagtgttattttgactgttattttaaatatgatgcgagatttccaataacgagaatacatggaccaataatatccctcctctcaaagttcttatgaatcaacaacaccatcatttgctttttagcttatcagcatatttaaaatttgaatattaaatttagagctgattttaaagttttttttgttgtagttaatcttccaacattagttctcaaatcaacaagataccatatatttttttaattttttatggtttatcaatttatgccaagtgcccctaaaacccagtattcgaaggtgcctatagttgtaagccgtacatgtgtttataaacatgagtgtctgcgcgtatgtgagtgattttgtttgtgctgtgtttttttctaaaaaaaaaatagcaaaacacctatgctttggtataggtaaaataaattatattataatgtcatagaaaaaatatattttttaccaaatatgttagtatacttgtttgcttatttaaatataggaaaaagtacaaattacctcccccgaattatcgcggtcgaccgaattaccccctaaaccataaaaccggacattcttcacccccaactatgcaaaccggacgaattacccccctcgacccaattcgcggtggttttggtctacgtggcgtacgcgtggcagtccagtcagcattttattttttttaaatagtgggacccacatgtcatacccctctatctctcttcctaatgtctctctttctctctctctcatgggcggaggcacgcacggcggcgcgcggcgtgagacgaggaggggaaccagacgacagcgtgaggccgcgg

SEQ ID NO: 81808 - DNA, 9505 bp, Oryza sativa
ggggaatccaaggcgagcagaatggcctgctcgaggtcgtccatgacggtgccggtggtgacgaagaaatctggggcgggccgaaggggggaaagaaaaaggggcgaagggaaggcggagttggggttgatataggagaggagagggtttgctcctcttcctctccactgcggtgcttttctttcccttcccttctttcttcctgtctaatcttccgtttttgccggatttcgtgggtttatggacggttttggttttgggtttgggtttgggtttttaggtttaggactagggaggggagggtcttttgatatttttttaatctaaaaataaattattttgcattgtcctttgagaaatatctagctctaaaagaaatattaaaggaatattagcaatacttgaaaaaaataacaatgtcgtatacatatgaattgatcatgtgtcactctcagacattattatgcaagtattttttgcgcattacatatataatatgagttttgaagtttttatgcaggctccaagttgacaattgcaatccttagggtttcgactcctcagctggttgggacgttatgtgcatggaataattattgctcggggtatagaagttacgtgtttccttaattacaacataccaaacctatcgtttctatgaaaacattcaagatttgacatgtatttattttggtgttggttaaatcatatttttggacggtcagagattccttgtttgtgcatatcattattgatacatgacacaattagtagggatgtagatgggctgggtcaacccatttacccagtgacccaacccacgatctatggggcaaaaaccatatgggtcaacccacaatttcacctaggctaacatgggttggtggcctcgtgacgcacggaccacgcatggggttgacccatatcttacaccacgtttacgcactcacaggctccagtagatgttggtgggtggaggcgacgacggcgtgcatctgcgtcaacactacagcaaaatcggtagcctacttctcatgctcattacctcatcatctatatctccacctctgctcaccccttgtgctcgacgtcgggctcggcatccaattcaacatgtgtctcttggagctccggtcaccatgtttgtgaatttcaccatagagaagatcacgggaggctgaggctagaggctcttagtagtgcttgcttgacggcccagtgtcctcatcgtgttcctcattgctagcatcgtctttctgctagagatccaacaaggcatagactatgacaaaatcaagatgttgctccagaggatcaggggcatcggcgttgtgggcgacaagttggacaatatcgccactatgaaagccatgtaactagacgagatcgaaccttttgcagtgccagtactcatgcatatgcttattcaacttttgggttatgggtcgacccatgggtcaactgcctaggaacgttgcgggggcaagatgacccatgacccataatctagcacggggggcgtggtgggcagggtttcccttaccggcggttaccggacttatcgcggggtacggtaatataaataccgcggtaacctccttaaattcaaataaatttaaaaaataatttgaatttttgataaattttgcacggtttttcatggtttttcacggttaccgcggtaaccgtgcttaccgccggggcgcggtaaccccggccccggcggtttaagaaaccctgatggtgggtcaagccttggggtcgacctaccagtatccctaacagttattctttattataggtaacggtattaccatattatcttattgttctcatcaaacacatgtgttgaaaagataaactaatagtagtgatattactcgacgagaaaagaaccatgtcaagtgattaacacattccacttccgagttcttacaatggttcaaaagacgcttctcttctcttattttcccctttctttgttggctcttatctaactttctatccattgggatgtggcaatcttactgccaaaatgttaaagataaaaccaatgatgttttttaacaaggaaaaaaatatttatcgacacttgtgtggcttactaatagtgagttttggaaaacaacaaaacctttttttttatccttttcctcccctttcatctcatctatgtcacgtgattcctttagggctccaaccgtgtgtccggtgtgacatgggactcttaaaatagtaaaatccccttgtgatgcatttgcatagttcatctacatggagattccacaacaaaaacaccaggacaacacatcaagaaacaaaaatctaatttctttttagcttccaaaaaaaatctccttccttcttggaccaaaatggcgataaaaccccaaaccacagcccaacatcccagcataacaaaccaagagagaaacaagcctaaaagaagcaaggcccagcccaatagcccatcaagctcaccattcctcgcctcctagggtttcctcctatccaatccaccaactccgcctcgccgcctccatccctcccattcccgaacacgtccccaaggtaagccggcggcggcggcgatgacgacgagcctgaggaagaaccgcaagaagcgcggccacgtgtccgccggccacggccgcatcgggaagcaccggaagcacccgggaggccggggcaacgccggaggcatgcaccaccaccgcatcctcttcgacaagtaccacccgggctacttcggcaaggtcggcatgcgctacttccacaggctccgcaacaagttctactccccggcggtgaacgtggagcggctctggtcgatggtgcccgccgagcaggcggcggaggccgccggcgccggcaaggcgcccctgctggacgtgacgcagttcggctacttcaaggtgctcgggaagggtctgctgccggagaagcccatcgtcgtcaaggccaagctcatctccaaggtcgccgagaagaagatcaaggccgccggcggcgccgtcgtgctcaccgcctagggtttggtcctggccctgccttttgttctgcttcttggtttttgagatctattaatctgaagtagtagtcgtttcttgtctcaagctatttgcgttaagaagacttgattagtttgttttctactgtacttcttgcatgttaagacagtacgttatgagaatttttgcactaagcgatgccagttcatgtcagatgcttcagatatatcaatgctattttgtgctgccaattatgattcgttcgatctgacttggcatgcccgcgttatattagatcgtctgatcatgttatgtacttgtctgccaaattatgtggatggtaaggttcacattagttttgatctggcctctgcattatgcttcattacaaatttacaattatctgaaatatgttgagaaatgtatgatgttcctgataagaacccatatttataagttaactgtagacatgtactagtaataagcatgttgaatacttcgggttctgccatgttctggattatcttttagccatatttctgaaaattagatgtaaacctatagcaagcgctgtttgggttctgtgccacatgacaaacttctcagtgatttactgatttgcattttttttctctctatgaaaatttttggtccatttaggcattccatggttgtctgaattattctagaccagtaacttgagcactgattaattatgttattcattcacaaattattggataggatcaatcatgtagctgtcctttctggaaaattcatgtctgctagatactggatgattaaaatgtcatggttgtttgtcagaattattctattgttatttggggatttgttctactaggttgtctactgtctaggggcaggggctggatgatgatcatgttggtcattttgttgtctagtgtcttgtcattcaaccctgctcgcagttcaaatttctgtgggtgctggagtacatggttccgcacttgcactatagatgttgaaatgaaccagcgcgaagtgcagtcatgatgtttttgtgatgaagtattctgatgtttcatattgcgagatatcagtttccactcattttgaaattttgagtagcatgggtggtactgatttcttctcgtgtttcataagtagatcttctgtacggtgaagtcttggtaaatatttcaagaaatatggatgtgcgaaattgatattaggggtgtgtttagtttacgccaaaattggaagtttggttgaaattgaaacaatgtgatggaaaagttggagtagcatttgcccgttgcaatgggacaggcccatacaatcggggataggccgagagggtggattgaggaggtgatgagtccgctttttatgaactgtgatcgatcctgtcgttgttgctttgtactagtagtaaatggtaatgcttgacgtaatgacatgtgtcctagtggacaatgtttcaatctaagctttcaaacttagcgtgcctaacttcaaacaaacttggggtgtgtttagttcacgccaaaattggaagtttgattgaaattggaatgatatgatggaaaagttggaagtttgtgtgtataggaaagttttaatgtgatggaaaaattagaagtttgaagaaaaagttatgaactgaacctccattgcgttgtcgaactgtcagtcattgtctcatcaccatgcaatgtcttgttttgcatcacatcacgctattggtttttttgcgtgaatcagcgtaagtcggatacttcaacatgtcaatggctgtggttatatctaaagtttgatccaaacttcagtccttttttatcacatcaacctgtcacacacacaacttttcagtcacatcatctctaatttcaagcaaaatccaaactttggatccaactaaacacagccattaatatgtcattgtcctgtagcagtatacccttcaatgtttcctgattgatcattgcgtaatgcataacaacactgtcaacacatcatgtttagcccataacaacactgtcaacacatcatgtttagcccctttgaatcacaggaatgaaaaaacggagaaataggaaaaacataagattatgataggaatgtaagtgtaaaacaaaggattgcaaaacacaggaaaaacataggaatgaccgtttgattggaccactggaaaaacacaagaatttgaggagagataaagactcaaaggatttctatttgatgaggagagataaagactcaaaggatgaatttgaggagagataaagactcaaaggatttctatttgatgaggagagataaagactcaaaggatttctatttgaggagagataaagactcaaaggatttcttccatgaggttctacctcttgttaaaattcctccaaaacttgtatgggaagaggcattccataggaatttcatagtattccataggtttcattcctttgattcaaagggctttgtaggaaaaatttctataggaataaaatcctctaagggcccctttgaatcgcaggattaagaaaacgtaggaataggaaaaacgtcagattttgataggaatgcaaatataaaacagagaattgcaaaacacaggaatgaccgtttgattaaaccacatgaaaaacacaggaattggatgagagagatagactcaaagaaaagttagaagctcttgctaaattttctccaaaatctctataggattatccattccataggaatttcaaagaattggataggattcaatcatttgtttcaaagggctttataggaaattttcctataggattaaaatcctctaaaattcctatattttttctccaaatcaaaggggccctaaaatttctatgaatttcctttgaatcaaagggggccttacaaactccctgggggagagttgcagaatcgagaacgtcagtgcgtggtggttttgatccgttgatgcttctgctcgcaagagatgcgcctgcacgtttggttgaaagcgttggagaggttgcaaccgagcgccgctggatcgctggccggcctcaccggggcatcctcctccgtcggcgcgcagggcccggccggccatcattgccgccgacactgaatcacaaccattcgcaatcatgctgctgctatcactgtgcacacggttggccgatgcaggaggcggacagataccagtatccagtacatcgcatgccattcgcatgtaccgttccaaactcctccatctcacacacttttttttttcccttcaaaacgcagtagagacgtacaaattcgttttttttatgggagggaggagtagatgttaatcgtgcgtgcatatttattcatataatacacatgcacaatctacatccctataatcatctcatctcagatgattaggtcattatatcttcatatcgatgaaatcaccataggtttctcgctctcaatggtctacggtttatcacagaaaaaataattagtataaatacgaatatccttatcaagcctagaacttaaactcgaatggacatgtttcactatgagagacctaaccagttgaggtacgtttactttgttcatctcacacatttttgtgcttgagaaaaacacacactagtacatactacatactacagttctcatcccctgaagcaatatttatatacacatcacggtcgttttctggagtcgtcatcgaagaaacacggcgcaacgatctgatcctgacagtgaacggaagaggtaaaggaaagagcaaagggaaattagccaagccaggccaaagccgcccgtttcatctccggcttctgctgatgcttttgccgaaccggcaagcaacacctcgtccgcacgcacaagcaaccgagacgacgccgtccgtctctcgtccgtccgtttcccccggcgaaacggccgccgtcctctttcctcctatcggtccatgatgcgcgggccccaccgtgccgcgggacccacgtgacagagaggagcgggcacgtttcgccgtttctgcacgccgcttgtggacgaggaggggagggagtttccactgaaaccgtgtcgtcgttctaatccttttcccagtgttttgctttgctgatcctcttgcgccatatctttgcccaagacaccctcaactttacattaaatcatgtatggtcacactgctgacggatacttacgattgtttaatttacccaatgggattttaaagcctcttttaaatcacagtaatgaaaaaaaatagaggaatagaaaaaaaatacatgattctaacagaaatataagtgcaaaacagataattgtaaaacatatgaaaaaatataaaaactaccgtttgattgaaccacataaaaaacacttaccatagaatggataaaaaagatagattcaaaggaatctcttgctaacttttctccaaaattttcataggattacctatttcataggaaatgataggatataattcaatccgttgtttgaaagatttttatagtaattatttttcatataattgaaatcctccaaaatttctatatttttttctataaattaaaggggctcttagcttttattgattttctttttgtttctccgggagtctgcaggatttttgttttagcttgtgtacgaggtgatgcctatgatgcacaagctaaccatgagacgccaatgtccaattttcgggcccctttaaatcgtaggaatgaaaaaaatagatgaataggaaaaaatcaggattctgacaggaatgcaattgtataacagaggattacaaaacacaggaaaaacataggaatgaccatttgattggaccacaggaaaaacgcaggaatcagatgagagagatagactcagaggaaatgttccaagaggttagacctcttgctaactttcctccaaaatatgcataagattacccattccataggaaattcataggaattttagaggattttattcctataggaatttttcctatatagccctttgaatcaaaggaatggatcctataaaatcctataaaattcctatggaatacctcttcccatgcaagttttggaggaaatttaacatgaggtagaacctcttggtaactttcctttgagtctatctctctcatccaattcatgtgtttttcctgcggttcaatcaaacgatcattcctgtgtttttcctgcgttttgcaattctatgttttacacttacattcctatcaaaatcctacgtttttcctattcctacgttttctcaatcctacgatttaaaagggcccttaaaggattgaataggattcaatcccttaaaggattgaataggattcaatcctttgtttcaaaggccttcataggatttttttccataggattgaaatcctccaaaattcctacatttttcctacaaatcaaaggggcccttcatgtgctttggagtgtcacattctcaaggttccatactatcatgggttataagcactgaccacatcttagaaaaaaaatactttcatctaatggatttgcatggatatatttcattacttatgtccattatatgaaacaaaccgatgagaaaacactaacattgatggtggagttgaccatgtttaaatcctggttctccacgaatattatgcacgcacggataaggttttcaataggtatgtaagtgtgatacacatgtataaccgagcgagtatgtgttttcattttaaaagaaaagaagctaatggcttaacacctatgcaaatgcatgagtatattaactttccaaatctaaaggtttactaatacgaggtgtaaaacaggcacgagtgtggtgcgggtgtacagggatgtgtatgcatcttccatgtaatcaagaatgtacactggtgtgaatgtgtcttcagtgtaatcaggaatgtacgtaagatgtgtatgcgtcatccgtataattagaaaaaaaaactagggcttaatcagattgtagccaaaataacccttatcaatttttcggtaagttgataatgttaccaaaattttggcaggattttttttatgtatttaccaaactttggcaagaagctaaatgtatacacacctttgacaattttatcaaaaataatataatttaaaatagtatcaatctgaacagcccctaatgaattaacacctatgtaaatgcaaaaagaacagcactaaaatatttcatgtgtaaaacacaaatggccactcgaaacaacctcccagctaagctaagctaggctagcctactattcataacctcaccaccacgcgcgaaaccaaaccacctcgactatttcttctctctctctctctttcccacccatgcctctccctcctcctccaccaccaccacccctctcccctcttctcctcctcctcctcctccattcgccattcctccccgcccagctccccctaatcctgcacgcgcgcgcgtgcggggaggcaatggcgccggcgaaggtgatatcctgcgcggtggtcaaatgtggcgga

SEQ ID NO: 81809 - DNA, 5715 bp, Oryza sativa
tgggccggaatacctgcggattctgggcccactcctgcctctgtggtgcgttgctcacgccgccacgcgggcctcttttgggccgcaagaaagagaggcgagatgggctcctttgctcttccttgcagcggaagaagccgcgggccgtttcctcctccccgagaccaagacacaccaccacgccaccattcccacgcctcacgcggcggagagagagagagagggtgaatttgctagcgagatgccggaagccgaggccgcggcggtggtcaccggaggcggcagccgcgccgccggccccgccgactacgagcgcttcatcaccctcttctccccggagggccgcctctgccaactcggtgagtgcccgccgccgcgacatgccccctccacgccgaccaaattcgctgctggtgtctgcgctttggctaacgatctgctgcttcaattccgccgcccgcctccccgtgcggccgtgctgtgtgctctcgcagactacgcgttcaacgccgtgaagctggccgggatcacctccgtcggcgtgcgcggcgacgactccgtctacgtcctcacccatcggaaggaggtgagcacgtcgcgagagcggaatccccttgtcccctcatttgtgattcattctgcggccgtttgatttgcttcgttcccctgatcaggacaagttgcacgacccgacgaccatcacgaacctgttcgcgatcaccgaccggattgggctgctcgccaccgggatgccaggtgagccacaactttgctctctcagattctcagttctaagtgctgcgtggaacatgcggtgcgcgcgtttggatcccgctggcacaatatcatttacgagttacgaattgcgaattggaggatcactcgactttatcctgccgtagaacgtctcagcgaaaccggttccaataattaatctctgcaactcttggtgttcatgagagcattgcgatgtgataaggatgttttacataccgatgatgcgcttgttcgactggatgctaattttgctgactccctatattgaatcagttttagtataggagtagtatgcacttccaggatacgtcatacatgctgattagatgaaatgttcagtgaatgagtgaaccactgtggtgtgattggatcctacatcctagtagtatgcactagatagaatggaatcttggccttggttgcacaatatactgacttatttggcagtcgatcgcccctttactaccatactctcatctattttgtgtttctgaggttgtaaatggctaatgtgacaatgtgagccagtactgtaactactgtactgagctattgtcttgtttgatttaacctatgtgagacagtaatgtaactaggcaacttttgcttgctaagtaatcaatcgttctatttgactactttcttgtatgatataatgtactgttttgttactaatgcctgataacttgttatatcattctgttggtggacagttccttcagtttagagggagttagggacttctcaattccatagcatgtgatttgtcactgagctctaaatatcttaatatagttctgtttagaattttatggaacagctagaatggctcacatcatcataagaaacactctagaggccaatggcaggacataccatcgcagtatcattttacttgtctgcttgttctgatcttttgagttttgacgggctatatctttattccaggtgatggaagggcaatagctcaggaggcaaggaacgcagctgccgagtttcgcttcaagtggggatataaaatgtctccttgtatgttagctcaatggtaagctttggtctaaatgaaatagatggctcattgtacaatacctatgtcttacaaacatctaaaatgatttgatcatcacgctattttatataatggttatataattatctctaggccgctctctgcttgtagggattgatcatttgccactcccattagaatgtcaaaggatcaatttcgcccattcacattaagacttagtattggatatatgagaaaatatggtgagagttcatatgagatcaacgggctgggaacttttctgaattctgataagcatatgctcgtgctttactatcaaacctacccttattttgttaagctacgtggatacattactctgttcaatcttcaatagcctaacgttgtttactaatttcactgaactgttctgcattttactagtggtgtatcattgcttgtttgtaggattgcagacagagcacagatccgcacccagcatgctcagataagaccttatggagttggttagtgctatccaatttgtgttttgtgagtggtgaaacctgccatcatcgtctaccatcaaaggattacaatgattactttgatcctacacattttcctctgcagtttctatgatctttggaattgatgaagagaaaggaacccccgagctcttcacatgtgatccagctggacaattctttgcacacaaggtattctaggaattttttgcagttcattaaatagctcttttcatcataacacaagttagtcgtgtttttttgtgaatgactacaacaaatgcaaatagcatgctgtattttttttcagttatcatgtgcaactagaaactgattaggtcacagagccactgaacaatctagatggagaaaccaccccataagctcaagcattttctgtatctgagaaacatgaatctcctatgtcattgcaggccacaagtgctggtccgaaagagaaggaagttatgaactttcttgaggaaagaatgaagagcaaaccttctctatcatctggcacaacaaaaggggtgtgtgttactattcttagcaaaccatgaaattgaacttatccaatgctgactagaaatgtataaaatggcattcagattagtgagtaaactaggtaagcattgatctgtaatggaaaaaatgttattgaattttttagttacagtaacatgttcatatgaaatgtgatggttcaacaccaagccacacattgcagacagtacaagatatccaaatctcatacatgcttaaatactagtaactagtatttaacacaacaaaagttcccttttctctgaagctgaatttgagaacatcattattaagggcaccactctgttagttctctttggatgcttaccacatgaagttttagctgtttctttaacaacagagtgcgttttgggatgtctatctgtgcagcatcttcgacagactactgtcaataatgcatgcctgcaagttcttttttccctcatgctgttgcgtatttatttgtacattagcacttttgtagtcacaagccctatccaatacggtgatccaatattttgatcccctttgtgattaatttttactgactttgtttccagttggcaatacggtgatccaatattttgatcccctttgtgattaatttttactgattttgtttccagttggcaaaatctgcgttgaaacatgtcctggagggggatttctatgcccgagaatttgaggtagtgctcattcttagccctattgtagatatgttctgtttgcactcactattgttaaataaaagagtgattttacggttcttgaggagataccgaaagataccatattttctagtgtaaaatttagtacatcccagtgtaaggtaaaaaaaatgtactaaaaattttggaattcttaaagaatgtaaaacttctctaaataaaacgttaagaaatatttgcactgccattatactgaacgacgcaagtcaaactttcttgtcagcttggatttatcaagaaaggggatccaactgtaactctgcacccagtgaaattcaagcgcacgcggaggtgaaggacgagagcagaacaaagtgctcgatataggacgatcaccagtctttcaaatcttttacagcatggaagttatgcaaaaccattaccgctaactgattactgtacgctatagctatatgtatgactgcgctcaagctgtgtcaagtgtcaattatgagttgcccccggatttacgataccaactgatgatcacacatcaacacttcaaactgtaactgtctacgaaggaactgcatcctcctgctcccgtgtaaccttagccagggataattttcctatgaagttggtcgcaaggctgccgaggaagagatctccgttgaactctgtcaccgaagtgaccatgttgatcacattcccttcagagtcaccaagaaccctcacgatctcgccgttcaacgacacctgagccaccactgctcccttgagcgtcgccttggtcctctcgacgagcgccgggaacgacgcgatgaccctcctcgtcaagctccagcgagagatcaggtccagccatggagacctcacctgcagtttgagcacagaaaattgtaagtttgagcactgaaaatgttgtgtagatgcttatggcagcagaaaggttagagagcagagacctggagaagggcaatccagaagtgaccatctgaacccagccgaatgttgtctggattccccggcaggttgtccacgaagatctctgcctccccagccttctcccctttcagccacactctcaagcatctgaacctgcacttgacaatatcacttcatggtcacttgacgatagagtgaacagactcttttttttatgagcaattttaccgttcttaaggagatacatgagatactattttttttctattttaatttgatatctctttatatctagatactataagataccaaattttatactaattttttttacctcatggtacatccttatgaaccgtaaaattactcgttttttattattattttagataagggtattttctatccagattctacatccaatcagatatatgcagccatttaaattaggaacttagccccacaaacaatccaatctgaaattcgttcctaagaagatttgcactcgtaaccttaaaatgttactcaggtcactgcacgtgtcatttcacagatgagaagttgagcttgttactacctcatcgtctcgcagacgacgacgaaggcctcgtcgggcggcagggcgacgccgttggcgaagccgaggccgtcgagcacgacggaggcctcgccggtgcgggggtcgtacttgagcaggcggccggtgaagcggtactcgaagaagtcgaggaaccagttgtcgaagctgaacctggtgctggcgtcgctgaagtacaccgtgccatcggaggcctcgatcgccgcgtccgcgaacctgaagacgacgaacggagaagaacagtagagaattcgcagtcgcagttacagatttgcactgtgcaaattgcatagtagtttgcagtgaaacaagtaatttgcaggaagataacctgatcgtggagccttcgacagtcgaagcaagaagcgtcacgcgtccattctcatccactttcaacaatccctgcagattttaattagtactccctccgtccctaaatgttgacgccgttgacattttttaaacatatttaaccgtttatcttattaaaaaaattaagtaattattaattctttttctatcatttaatttattattaaatatatttttatgtatacatatagttttatatattttataaaagtttttgaataaaacgaatggtcaaacatgtttaaaaatactttcttatttagggaacgaggg

SEQ ID NO: 81810 - DNA, 25460 bp, Oryza sativa
gcagctcctcctcctcccccgctggaggccgctgtcgtcgcccctgtccttcgcgcgacccgccacggaacgcgtggccgcgaggcgagcccgcgccgccgccgtggcgatgaagttggtggaggacgccacccctcccgcggcgggggcggtgcttctcgccggggcgcagtcgaggcacgcgatattcagggacgagctcgtgaggagggctatatacgccgccgaggcggctcaccgcggccaggtgttcgaccgtatcccaccctccctccctctcgctctttagcttctgacatgttgaagtgaccgaagctgcttgtgtgtgggggtggggcgtttggtttcctcagatgcgcgcgagcggtgacccttacctgcagcactgcgtggagacggcggcgctgctcgcggagctcggcgccggccccgccgtcgtcgccgcagggctgctgcacgacacggtcgacgacgcaggcctcggctatggctcactctccgtccaatttggcgctggtgtcgccgaccttgtgaagggggtaattatttcgatgattcgatctctcgatgattcgatctccttagctactactaactgttatttggatgacatgagcatatgcactagaaaattatttgctgggagctattttctcttgcaaaacttactgaatgtaccaaattgattccagcatgtcaacaacattagtaattagcagatcagatattttattccttgctcaactatttttgtaccatcatatgatctgcataaatttccctatgtttgagcatagtataatctgagctgaagtgcaagattagatgacaaacggctgtacttctatgataagtctttgtatgggccccctcttctttcatttttgatatttattggacttgtcaatttcctgactaggaagtggccactgctagatcattgatagcgaccgatagaactttctgattgttactttgttcattggggcttctagattatagttttttatgcctttctgaggtgggtactgagtttccgtcatctctttattatattgagcagagggaacctgcttgtattgacttgtacttcagtattgtagaatctcaacagattcctggttggttatcagatccaatcagcgtggtacagtttggtgatttttgttgcctgctcttttcattttccctgtttgtggatgggctattaaatgtatgatgctttactattttgttgtaacttggggcactttttttttcttttttctttagataatggaagctttattaagacttagtcaaatacaccaagttcttggggcacttatatatgtttagtaagcatggctgttgtctgagaacattgcgaattggctgcaatttaagttctgctgccttttctgtaggtttcaaatctaagtcatttgagcaaactggctcgtagaaatgatacagccagcagagtagatgaagctgacaaattgcgtacggttttccttgcaatggaggatgcgagagcagttctcatcaaacttgctgacagactacacaacatgaggacgttggattctttgcctaaggtcaaacaacagtgctttgcaaaggaaacgctggagatatttgctccgttggcaaatcagcttgggatcttgaattggaaggaacagcttgaaaatctgtgcttcaagtatctttaccctgagctatatgaggaactgtcatccaaccttctcgagttctacaaccaagatatgattgcagctgcaataaggcgactggaacaagcccttcaagtgaggggactatgctatcatactatatcagggaggaacaagagcatgtacagtatctacagcaagatggcaaggtaatctcgtatattatactccttttgtaggcatgaccagaatgaatcaaataattgcacttattttagttatattatttatgttgttagacaaactaacctccattttgaccaagtcaagcacaaaattcaacagaacaccctgaggaatgcttgctatcctgacatttatgtacatatcaacggatatgctaatgggatttacttgattataggaagaaactggacatggatgaaatctatgatatacatggggtgcgtgttatactcgataacaaagctgattgtttcaccactttagagattgtccatcacttgtggcctagaattcctggcaaattcaaagactacatcaacagccccaaacccaatgggtaagactctgaaaactaatactattatgcaaaaaaaagagtaagtcaccgtgataactgtatgcttgctaacttgtaggtatcaatccctgcacacggttgttctcagtgaagaaacactgccattggagatccaaattcgtacgagggacatgcatttacaggcagaatttggaattgctgcacattggagatacaaggaagctgttcgaaattgttgttcatctgttcctgaaatggtggaatgggttagatgggttgttacatggcagtgcgaaactctgcacatagatcacccttcctctcttacacatggagctccaccaagggcaatatgcagttgttcttctcagtctgatgactgtcctttttcgtattcaaaacgatgtgaccacagtggaccaatcctagtaatattactggagaatgaaaaggttggtaaccttttaaattatttgtatgttccaatgtttttttttacctgttgcctacctggtattgttgttgagcaaggaaactaaatttctgaatggtgctttcagatgtcagtgcaagaattccctcaaaattcaactgtactggacctactgaagaggacttctagctatgacatgcagttgaggttaagactgaactgccatgtcgtgcacaacttgaaccaagagcttaaaatgggtgacgtggtcgaactgatccctttggctcaatgcaatcctggagctggaggttatgcgagggagttccaccaaatgtatgaccaccggctcacagtttcgcagtcgtgacaactctaggataccaaaaactatgtacatatatatacatgacagattgacagcccatcaagatcgtcggaagtttaggtttccctttactgacaaatagaagcactactcgggaatcatctgaaaaagatcaaggaatcgtttccctgtgccaaatgcgcgcgcgtgtgtgacatatcttttacatttgtgtttgtttatatgttaactaaagaggagtagagtgtcaatacgtgaaacatttctggagttttagtccaagaaatgatccctgtttgggacagtgtatcattgtaagcttctatggctgtgcaatgtgtgacgtttcttcaactgaaatatatgaaaatatatgggtttcctgcctgcatctgcttgctctgactgatatagcatactacttactaacccagatttgaagtgcagctgagtttaaccacttactgtcacatggaacaaacgaaaagtgtatcattgtaagcttctatggctgtgcaatgtgtgacgtttcctcaactgaaatatatgaaattatatggctttcctgcctgcatctgctattctgcttgctctgactgataaagcatagtactacttactaacctagatttgaagtgcagctgagtttaaccacttactgtcacatggaacaaacgaaaaataagtatagggagaatagatagggagaaaggagaaaaaaaatataagtaaagggagaaatagatagggataaaggagaaaaaaaaaagtgaaacgacgcctgagagattcgaactctcgcggggaaaccccatgtacttagcaggcacacgccttaaccactcggccaaagcgtcgtgtgtgcttgcttgcacagcaatactttctatagcatgttcaaacaaacactaactcactaaatagctctggattagcacttaacgcattctcaattctggttgtttgctttacaattggtttgcacttggcagattctcaagacattaatctgacgatctcagaacatgctccaagagcgtcaggcggggaggaggaggcgacgataacagttgaagacattgctttgcttctcccatttattaaaccccattggtttggattcagaggttaggacggagatggatagagattagggaaatcgcagcaaggtgaggaggaagaatagggctaaagatcatggagacaacaaagctgaacctagaagaagagatgaagcgagcaacaggtacgcgagcacaattcatcgctggactttgcgcttttggcacttacatttgaggttgctgctggtgctccagactgtcagcaatgtgtagtacgctggtgtgttcttcgtccagagggtagacttcgagtggttaatggacggcacatttcagattttcactcagcaaatcctcttgatcgcacgaagtacgaaccactattctgcattccggacatctcctgtttggctgtctccatggcattagcggttcttcctcctcaccttgctgcgattatctccgtcccagcctctgaatgattgttaatccaaaccgataggtttaaatggcagaagcaatgctttgtcttcaactgttatcgtcgcctattgacgcttctggagcatgttctgtagttctaggatattaaggtcaccttaaatactaaaaaatggtttgcaaaattaaatgtgccaatgaatcgtagaacaaacaattaaaactgctacatgactgtggagtaccattgtttttaaggtggttttagaagatacaattatagctaatttgcgaacagaagcaaaaaagacgctttggccgagtggttaaggcgtgtgcctgctaagtacatggggtctccccgcgagagttcgaatctctcaggcgtcgttaattttttttcctttttttattttctcctgtttatatttttgtgttagccttttcctgtttgcattttttttggggtgagatttcagaggttaatgctcgtctagacgtctactctgtcgatgtgagactgacttgtgatcatctgttaaattgttgatccttgtgggatgtcaatgtgacgattttttgtgatcatctattaaactgtcaatccttgtgggatgtctgctatttctgtgaagtgctcccgaccccaatagatgattgatcggtgttcggtggtgggggttgggaatcatcacccacgcacgaaaaatggagtgatttattagcgcgtggttaattaagtattagctattttttttttaaaaaaattgatcaatatactccatccattccaaattaatctacatatttcataggtataccaagaccaagaaaagctaataactctctcatactatatttactctagcaacaaactcaatgcatgcaccatccccaatatttcctagccaataataaatcaaggtattgtatatgtgttataaatacttgtgtgcatggaatgcatgcatcaatgtccatttactccaatgcacaaataacgaatagactctaataaataaacacaaatgtgtagatcatttaggaataacctcaaaaaaaactatatgtagatcgatggaatggagggagtaatattttaagcaactttcgtatataattttttttgcaaaacacacgacatttagtagtttgaaaagcgtgcgcacgaaaaacgagaggggagttgggaacggctggtatcgaaaacagcgagtcatttatcgtaactcacgaacttaaatcaaacggttaagattttcctttaaaacatctctagcacttctcacttcatatggttctcacagaagaagaaacaaagagtagaaaataaaagagtcatttatcgtaactcccacgaacttaaatcaaacggttaagattttcctttaaagcatctctagcacttctcacttcatatggttctcacagaagaagaaacaaagagtagaaaataaaaaaagaaaacaaaaattaacgacgcctgagagattcgaactctcgcggggaaaccccatgtacttagcaggcacacgccttaaccactcggccaaagcgtcgcttgtgaatgcggaaagcaacaaattttacttgtttccatccaaccatgcatatacccgagcctcgaatttcatttttacctctcccgctcaaggggacgggagtttgatccgtcactctagatcctgacctaatggacaccggcgccgaccaggcaccacctcctcctcctcctccccctgtggcggccgcctccgccgccgccgacgagccgcgggacctgcgcgtggtgcgggagatcctccactcgctggggctccgggagggggactacgaggaggcggccgtgcacaagctcctgctcttcgcccaccgctacgccggcgacgtgctcggcgaggcgaaggcgtacgccggccacgccgggagggagtcgctccaggccgacgacgtccgcctcgccatccaggccaggggcatgtcctccgccgcgccgccgagccgcgaggtaattgatttgagcccgaagcccctcttcgcttttgtggaattttttttcgccggtgttgtttgctgcggaggacatcgaattttccatcgtcggttgcgaaatcgtcaggactgcgtggtttttggggttggatcttgcggttttgtgtccaaatcggagccttttagtcttaggaataggtgaatttctgcaaaaacggaatccttttgccttcggatcaggggatttgtgctatcaaggcagctcactaaccctttagcctttggatcagtgtatgttatacagatacgccatttgtagactaagacccctttaattctaaggatttattgagaaacttcataacatttgaaaaaaaaaacatgttacaaaagcagacactcattcacccctatgaacacaaaacctatccttatgaacaccccctaaaagactgaaccggcatgtgttgtgattcatgaagtcaccacaaagatgtctcgctatcaatggatatgttgcctatcaatgaaagaataattaatcataaatgcaagcacatgtaagtctagaacttgaacctgggtaggctgattccaccacaagaacctaaccagttgagctacgctcactttgctcctatttggccctttgatataaaggattggagctttttaaatcctataaaattcctatggaatgacttattacatatagattttgaaaaaaattagcaagatctcatatctcttggaaaattttcttcgagtctatttctctcttctgatacatgcatttttttcttgtggtttataaatcaaatgactattcctgtctgttttcctgtgctttatactttcattcctatcaaatttcgtgcttttcctattctccgttttttaatccaatgtttcaaaggagctttaataggtgtggatggtatacttttttggcaagaagatgatataactaaattaatgctgacaagattttttctttaaaatacttgagcttctaaccctacttaattgtcgagtgctctccaaaattcacaaagccgcaataccaaattggaaaccgctctttagcagttttcttggtttttgtgaaaaattgataaagaaatgatgaaattcagatatatttcatttaaaattggaaattcacttggttttctatttgactggttaacaaagctgttttgttaactcaagccagttcaaaacctcaaaattgcatgaaaatcaagcagtttttgttggttttgtaaaccgtgttggtcccttttattaaattttaatgtttctttactcactaggaagctcttcttttgagagcgtaggctagttcctctaaggttagttacaaggtggtgataggcatgtgaatattggataagcaagtcgatggcattgtctaaggaggaaatggtgtataaggcgacccaatggagaggaggatgaggttggaatgtggtagaggaggtcgggatacaaagaagtaggtaatagttccaactgaggatatgatgaatgggttttatggtggtgaagaagtatgcggcggaatctttgggcagcaggatgtgggagataggatcacacttgggttggaggaggttgatgtttgtggcaaaaaaaaggagcattgaatgtggctctggtagcaaaagaagaagatcaatcacaagcataggtaatttgatggcatcaatcaatgtaaaaaaaagataaaatagcatatgagagggcaaaataaggaagtgaagctagaaaataagtgcaacaaaaggagaggcaattttttacaatggaaaataaggggcacggtcaattatagaggaaaaaataactctatattacttatcttttttttaattcataaacttcataagtagagctaaaaatatgatatgatgttttgggggttatatatgatgttttttagccaaccatacattgtcatgtcaatcctagaagtctcttatctattcttgttcaaattgaattattttgcaacgtagaaatgctcggttgggcctatacaaggtcgagaaagtgacctaaactagccaccctaacatttctattatattatgcaacaaaatcatcttaagacaagttgtttttttcccaataagccagcccattaagggctttttgtgggtctattcttaaggaattttataagatcctatgttcaatcattatttaattggttgctataacgtccatatacacatgaaaaaattgtcgtaacatgacggatatcttcactttggacaggagatgcttgatatagcacataaatgcaatgaaattccaatacccaagccttgtgttccttctggatcaatctctcttccacattatgaggatatgctattgaacaaaaaacacatatttgttcctcgagtcgagccaacaccccatcaaattgaggaaactgaagatgattataatgatgatggttccaatgctaatgttgcctctcccaattccaattatgaccaagatctttttggatcgatctctcttccacactatcaagacatgttattgaaccaaaaccacctatctgttcatcgagtggagccggcacatgatcaacttgagaaaatcaaagatgatggttccaatgacaatgctgactcttctcattccaattatgtccaagattcttctggatcagtgtctcttcaacatcatcaggatatgtcattgaaccaaaaccacctatttgttcatcaagtagagctgacgcttgatcaaattgaggaaattaaagatgatggttctaatgacaatgttgactctcctaatttcaattgtgtccaagatccttctcgatcggtgtcttttccacattatcaggttatgccattgaaccaaaaccatctatcttttcatcaagtagagccgatgcttgatcaagttgaggaaattaaagatgatagttctaatgataatgtcgcctctcttgattccaattgtatccaagatccacattatcaggacatgttattgaaccaagaccacctatctgtccgtggggtagaaccgacacttgatcaagttgaggaaattgaagatgattgttccagtgacaatgttgcctctcctgattctaattatgacaaagagaagaatgacagtaacaaacagaagccttctaagaaggtttctcaactcaatactttggttgctgcaggtaaagacaaagtagattgctcaactgaactttcttagatgatcgtccaatggatgaaccattccttttcttttgaaacatgcacaatttttaatcttgcatttttattgccttttattaaacataccatgtgcctaattttagaatttaatattctcatcatagcctgaaacattgttgtaaagattttaatgcaaaacatgcatgtcttggtattgggtctatgtttgaattaaatattgtattacatggttactatagttatcataagtagtcatatatatggtcccctatgcccttggggggttgattttggtttccattaaaatctacatatgatgaaaacttgctgagctttttagcttgttttcatatcttatttaattatcacatgagcataatacatattgaataaaaaaaagcaaaatatttattggtaatgagtcgcatgtctttttgtgaagtaccacagttgttccatttgaatattagaatctacaagtttcatgaaaactgtgttgaggtgagcaaaaatactcaaaataaaagtgttgccttttgggttgagttaatgcactaataacttcaaagtaaggatgtgtagactggtcaataaccggctactagtgttgtgtttaggatggagcgttcatcatgttataaccaatacatagtttgtctagttacttaagaaggttctaaacatgaggttaaaggtgatcttagcaacttatgcaatttggtctagatattgaatgattttgagtggtttggatgagcattcatacaaacttggctgagaaagtgctattataggggagggttaatgcaagtaatgttgcatttcgacaagcgaaccaaagagacgatattctaaaatctaggaagccaatatgaggaaatgttgagtagtggcgtacaagcaaccaactagaaaagaaagatatcttgaaagtagagtgatcagggtcgacattgtgtaggaaagattataatgaaatggaaaacatacgaagaaaaactaggtagatcacgagggtgaaaaggtatgaaaaaatggagagagatagagggaaatgtgctaatagtagatgaattgttgtgacatgaccttgtcacatagaattgctagggcacactatatttacatgccaatatatttatattgcattttcctacatctaagtaattagatttctcgtacaattcatacttgggtatgatattctcatggatagttggggatgtcagcaatctatagcttacacggtcccttatgaaagactctattggtcttattgtgctccttgtgagcacatttggatacacattcaaatagattaagataactcgatggaatgtataccctcaaattctttttcgataatgtaatcaatattaccctattatttttctagcatgaaaatctcagatcaatccaaaaccatgtccaactcaatagttatatatcataataatttacaactcgtccactcataaattatatttttttaaagaaccactcaccatcccttccctcctctttttcatatttgtatccaataaacaccttgcccattctcttgctcatccttctgtctgtttgacagattggaccaatttatcactcgtagttgaaaggaacaagagcgatttaatgatatcttatcacttgtaattggacttcaagcctctttttttagaactacttcaagcctaccatcatcgagttatgcctggtgtcgtggcagctcggtagagccatgatatcgactgcgcagcattgtcacgtgtgtcatggatctagctagcctgcctttggtgtgttggtaaggcttgaggccatggggctgcgggttcagctttgtggtgttcttgaattggtggttatgtctggcacatagggtggttgtgtgtgaggatttgattgtggaatgacgaaagctttgtcaaattcttgcaagctttgatgacggcaacaatcttgagcgtcgtcacgacatcccatttctccacacaagtttccatattagaatcttggtccgatttcccaaacaagcaacggcgacgtgagcgtccccatggaattgttgctttggagaatcttcttcctatgacagtggccattattaggaacttagtggcatcttggaccatcttgtggctagggttcaccttttcgtatcggaaattatacccgcttatcaacggtttatagaaacccgataaaaaccaacaactttcggtcaacacggtatgaaaaccagctaaaactgaccggttttgaaaacatagcagtgtgcacgtgttttccgtgtaacagacaaaacaaattaggtctaatgtctagtttcacgtaaaaccgttttgttctatcttcttgatgaaaaggctatcttttgctatttaactttggaaattgctatgcatatgacccaactgtccgactcacgtacgattgaatttgatcaacggttgtaaacggctgcagtgtatatgaatatgctatcatttgattgatctataattgcttgtctctagttgtacatgagttgtacaactggatctcatgagcaattttacggttcttaaggaggtaccaaaaatttagtataaaatttggtaccttatagtacccaggtatcaaaaggtattaaatttacaatagaaaaagtgatacctcatggtacctcctcaagaaccgtaaaattactcggatctcatacatatagcagtactcttttactttcctccctgtttatccctaattaactttacactgttaggcctaattaattttctctacattcgtcccgactggattctcaagtagacgacatgcgtacgtagcatccaaatacacgactcgtgcgcccgtaagacaccaaactcccctcttaaaacgacgcgacaatcacaagccgccgcgcccctgcactgcaccaccctctcgccgccatgccgtcgcttgggatcgcgccgctgctcgacgcctacttccgccgccgcttcgccgcggcgggcctcgtccaggcgtccgttccgctggacggcggcgccacgacggtgcaatgctggcgcttcccgccgggggcgagcgaggagctccccgtgctcgtcctcctccacggcttcgggccaccggcgacgtggcagtggcggcggcaggtgggcccgctctcccgccggttccgcctcgtcgtgcctgacctcctcttcttcggcggctccggcacagcggccgccgacgcgcgctcggaggcgcaccaggccgaggcggtggcgaagctcgtcgccgcggtcgtgggggcggcggcggcgcgcgtgtccgtggcgggcaccagctacggcggcttcgtggcgtaccacgtggcgaggctgctcggccccgcggccgtggcgcgggtggtgatcgcgagctccgacctgctcaaggccgacgccgacgaccgcgccctgctccgccgtggcggcgccgagcgcgtcgaggacgtgatgctcccgcgcacgccggagcggatgcgccggctgctcggcctcgcctaccaccgtccccgccgcttcagcttcaccccggccttcgtgctccgggacctcgcccaggtaacaccaccaatccaatccaccatacattgctgcctacatttgctgaacaaactcgaacaagttcttgtgcttgccatgatgccatctgacatcgagatcaagtagttcttggatcatctggatgatccgtgatgtcacctcatggaagtgtgacgtagcactgtagtatcatacaacaactgattgatcactgaatcgtcgaaagagatatggtccctgaattcccaaccgccttcgtagctagctagcactagcagtcactcacctgtcaccaactcaccaaccaatcatccctggatggagatgtctccctcaatttcccaaccgtttcgccgttcttccaatcaattcagagtttcagaccgccgttcgatccagcctagcttttccagttagagacatcctactgtttttgtgtagttgacaagcacagaggcactcacactgtgtgaatgtaattgccatctttgccaggctaataatcttccaatcaaggtgagactgaatgaactctgcgttttcctatctgaatttcaacaaacaacaggcctacctgtcacctttccccaacctatccgagctggattctcaaattaactcgtcgtcctttttcacttttttaagataaaatgccttattcattaattgttcctgagagtcattatctttgctgacagcctcttgactttagtaccagtaacttgttctctaaaagaatataagaaatagtaacatttaacactgttgcagtatctctacaccgacaaaatagaagaaaagaaagagctgatcaaggggataacactgggggacaaagaaaaattccagctcactccacttcctcaggtatgcatagcatttagcagctgacaaataattacagaagtgctttacttgccaagtttacctttatcaaatgtctctgtctgtctaatctttcaggaagttcttgtattatggggagagcatgatcagatatttcccatagagaaggcatttgaagtagcaaggtcagtacttattccttctaatataattgcattattaatacatatgaagcaaaacttttgccctctttttgtttaaaaaaaaaacagtagaattacatgttgaagttgcaccttgtaatgttacttacacaagatgaattaacgcaaatgcaggcaacttggtgcaaatgctaggttggaaatcataaagaacaccggccatatgccacaggaggaggacccgaaacggttcaatgaggccctcctgaacttcttgttaccagctccaaattcgtcgttgtgatggggatatcaatgccaacttcttgagcggctatctgtggagagtacttgatctaagttgtacattgtcttatggcacagggtaaaacttgtaccttttgagataaaagtgggaaatatgatatagagtatatgcattgtttttcttctcatatacaaaattgggttgaatcctctgcacttgctagtttctacagtaaaataaggggggaaaatgaagttccctggatttaataaggggaaaaaagccgcctctaagaatgaggggttacatacattaaaccaagcactggtaaaaaaattctattctgcgctaacttatgcgacgcctgatttgtcggacccagccaacctttacctcctgaagtaagaggagtttcgctttgatatcttgtgctaaggctccataagctgatctgttgagatccctcccctcaagcattctcactacatctggattgtctgtctgtccgactgtccctaggtaacactctgacttccttggcctgtttcaattgctctcttgcatgcaattagctcagcaaagcaagcatcctcagccgggatgatggaagaagttgtcctgcaccggatcggatcgacaagcgctcttggcgcgggtggtgatcgaatacgctctgctcgggtgcggcggcgtcaagagacgcgatgcttttgctgacatgatatgtaaacgatgcaaaatcgtattagtgtgatcattagggaatgaagacaaaagtgcaattaaaatgcttgtcagcatcacctctttctttctttctgactagctgctttttgtctgcaactcggcttgacgcattgctttgtcacgcattgagaatagttcccttctcctctgttctcatccaaagaatgatgaaaattacattatgttccccccaaaaatatggtgcagcttgttggaaagatttatgcatgaagctaagccttcatccacactatcttatgaggattgctaccgtccagcaggttgtaccgggcggtactggtaccgcgcggtaccaagacacatctaaccgttgaatccgggatgggtaggatcgggagagaaaagatgagcaagggtggatgagggagtacctgtttcgagtcgtcgttcccggcggcggcggcgtccaagtcattgtcattcccggcggcggcgcagagcaacaagggaacgctggcagcgcgggagaggataaagtctggcggcggcgcgagagagaaaaaagggaacggcggcggcgcgggagaggaaacaagtccggcggcggaagaggaacaagtccggcggcggaagaggaacacggcggtggtggcgaggaagaggaacacggcggcagcggcgaaaatcatccagcttcgctagggttcaagccgctcgatctcgatccagacccatctattgcacgcgaaattacaatactgcccttccaccgattatcatcactcggtaccgcttcggggacaaaactggtaccccgcggtaccgatctacgccagccgttcgatctgcctcgatccaacggtcaataatcggtaccgcaaggtaccgttggactgtaaaaatcctcctatcttataccacttgcattggagctaagcttcagcgagttcggtttaggattagactatggtactacaaagagtgactgagtgaagcaaaatccaaacagcaaaagtatttttcatatgtactagttacacagaggtaaaattaatgcatctcacagtttccttgaaaaatgcatcttgaagctaatgctaaagcattaaacactcagggttttaatgttcatgcatgatacagcttttctttttatcatatgcagttaatattaaacaagaacaacaaataataactaacaagaacagatagtgtcacacagtattgcaatgcacatttctggagttactttgtatttctctttttgaaactaaagagtcagtgcttatatatttgtataaaaaaaggattgcacaaataattttaggaagacagctagaaaaaaaacaaagagatatgtgcgaagaaagaattgttagctgccagttccaaatggctaatagagcaactgataactaattagactgaagaaaagagcagataacattgcctacagtgctcctacggtgcagtttctactttgctacgactgctgtgcaatggcttacgactagccaggagagatcatatcaaactagaacaactttcatcaattggaaatcgaaaagccaattcgctaattataaagcggcatatatcatgcgaacttatagataaatatatgattgcaggcttccaaattaaacaagatctgatactccttctagtggccatactgaatgaacaacaatacttgcgcagataattagggatagacattgagtaccttcttcacggcctcgcaggcattctcattatggcgaatatcgttaccccgagcaatcatagtgtggacgtgatcgagatacccctcccagtgtgattcatcagccagagtacccagtccgtccaactcttcttggctgtagtccgcgagttcgttaggggctaaaggggcaagtaaagagcttcgcgttccgcgctcggcgttgaacttgtcaagggccttgacaaccttcttgaaattctcataccgatgagccttctcctcctcggttctgtatctccggccgtgctcgctcatccccagtcctcaaattttgccttcatggtcacctcatccaccacattgtcctcctcggcggcatcatcgacgacggcctcctccttgtcggaacacttcttgtcatagagtggtttccccccatggttcatttgggagttgaggtaatcgatgtagtcaagataggcaaatgtgccatctttcctggtgaaccttgccatgacggatggctcgatcacgtccctccaattaacagtcacctcctcctcctccttcctggtctcctccccggctgctacaggtaggaaacaaattgaagctagcaacgacgaggaaccgaatctaatctaatctaatggcgctttctttcaagaacaaggcatagatagatacctgagtcatctctatcttgcttgaaatagaggaatccgagcagcaatccagccaacgaactcgtcaaggcaagaacacctttcactgcgccacggccgacgccgagatccctctgcgcggagatggacgggagcgtgagccgctgcgcgcgagtgaagaaaattttgatctgagatctgggggaaacgggagagcgtggtgctggactactccccgccgtcgccgccgccgccgatcgctgcgcctgcgcgctgcgtgcggagaacctccgggtgaggaggggagcaagggcccggaggaacatggacatggcctcgatcgatcgatggaatcgctcacctccgccgcgcgtcgccgcgatttctagggtttagtgtttgacggacttcgccgcggatgcgcacggtgtcgaacggaattccgacaaaatccgatcaaattttgtcacagtttaaaactcgatcagtttgaactttgaagaggtcgcatgggccttgcgcacgcgcaaaattgggggccgggccaagctctaggggttacaaccatccttatttgatgggccaatatgggcttctaccttttgtctgactgccaactaaatgatattgggccgagatgttctcctactagaggcagcccaacagatttatctcgaccgaacaaattcgatccgacggttgaacagatttatctcgtccgctgttacattgttttttttaatggaaaaacctgtcacattgttcagctcatttggatattacatggaaattttctggcagtgatgagtacaatcatgtaatcaactgcactaattgttcttgagagtcattatctttgattacagcttcttgactttagtatcagtaacttatttatcaaaaagaatgagtaacagtaacaggtaacactgtgttgcagtatctctacaccgacaaaatagaagagaagagctcatcatcaaggggacaacactgggggacaaagacaaattccatctcgctccatttccccaggtattccatagcgattagcagctgatgaataattacaagagtgctttacttcccaagtttacctttatcaaatggtctttgtctgactgtctcacctttcagcaagttcttgtattgtgggggagagcatgatcagatatttcccatggagaaggcatttaaagtagcgaggtcggtacttattccttctaatataattagagtaatacatactctctccggtttcacaattctttaagatttgaaccacataatcttcaaaatacatatttaactataattttctattataatatttataataaataaatatattttacttttattataatactttgtaatgttgttttactgactttgaactaagtacttttaatgttattgttcgttaatgatataaaagtttgaatttaaccctgtccaaaacatcgagtattatggaacatgatagagtatgaagcaaagcttttgctctctttttcaaaaaaaaaatattaaaataattgcaggggaattacatgctgaggctgcaccttgtaatttcacttacacaagatgaattaatgcaaatgcagaacactttcgtgcgaatgctaggttggaaaatcataaagaacaccggccatatgccccacaggaggacccgaaacggttcaatgaggccctcctgaactcttactaccagctccaaattcattgttgtgatgggatatcaatgccagcttcttgagcggctataagcacttgatcaaaatcatatattgtctaatgatacagggtaaagtttgtaccttctgagataaaaatgggaaatataatatagagtatatgcactgtttttgttctgatatacaaaattaggttgaaatcctagacttgctagttgatacagtaaaacaaaggggaaaaatgttctctggatttaattttgagaaacagctgcaccctttattagtggttgtaggcacaataaaagactaagaacgagggggtaaattaaaccaaatactggtaagaattttctatgcagctattctgccgtaatttatcgctgcctgatttgtcatttgtcagaccaacccaacctttacctcctgaagtaagaggagtttcgctttgataccttatgctaaagctccatacacttatctgttgagatccctctccagaagcattcacgtactacatctgcaattatgcattgtctgtctgtctctacgataaaccttgacactccggacttccttggcaagttcaattgctctcgtcaagggacacgatgattttgctgacatgatctgtaaaagaagcaaagtcgtatcagtttgatgatcattaaggaatgaagacaaaagtacaaattcaaatgcctgtcagcatcacctctttctttccgactagctgctgtttgtctgcaactcggtctgacgctttgctttgtcatgcattgcgagtagttcccttttcttctgttctcatccaaagaatgatcaaaattacacgatgctccaaaaataaatatggtgcagcttgttggaaagatataagtatgctttaagctaagccatcattcacagtaaaagtagatcatttgcatttggagctgcagtttaggattttagactatggtactacaaagactgaggcaaaatccaaacagcacaagtgttattcacatctactaattactgtacagtttctacttcgctatgagcctatgattgctgtgcaatgatgacttacaactagccagaatatcagatcaaactagttggtatctgcttctcgaatataacgaccaatagccagaacaattttcaccaattggatatcgaaaggctaattcgctaattctaaagcagcatttatcacgggaacacatagattaaaatataattgctggcttccaaaacaaaagatctgatcctctttatagtagccatataccgagcaatcgcagtgtggatgtgatcaaggtactcatcccagtctgaatcatcagccatagtgataccaagtcgctcaacctcttcatcggtgtagtccgctaattcggtaggggcagctaaagggcttcgcattccgcgcttgatgtttaactcgttgatgcccttcatagccttcttgaaattctcataccgatgagccttctctttcttggttatgtatatccggccatgctccttcatccagtcttcgaattttgccttcatggctggctcatccaccgcgttgttgccatcctcgtctgtgtcggcggcatcagcatcgacgatggcctcctccaccttgtcggaacatttctggtcatagtttggtttccccccgttcatctgaacgcggaggtaaccgtagtactcaggataggcgaaggtgccatctttccttgtgaaccttgccatgacggatggctcgatcacgtccctccactttacggtctcctcctccttcctggtatactcccaagctgccacaggtacaaacaggtagggaacgaaacaaatcagtgtattgaatagtaggctaagacatttaacggtaacctctctcaaacagtttgttggcggatggcatgagtcccttcgaccgaatctgccgaaacccatggcgaagaccacgagccaaggatgatgcgaggcgaagggtcgcacgagtgcacgccgaagaaggacgacttcgccatgccgaagaaggacgacttcgccaggaccggttcgccccggcatccagcccagagaaggacggcttcgccaggtccagttcgcccccgcgagggccgaagtagccttctcggcccaccaagcttagagaccatagggccggcgatcgcccgatggcccatcaagagcccatgagcccccctttacgttatgtaaccctgtaaacgtccctttcataagggcaactatgtaaattcctcagtacaacctagaccctagaagtgagaatctgtaacggggctataaatagccccctagggccatgtaatacaggggagaaaattcaagaaatcaatatacttcgtttctttccaaccactgttaagtaaccacgtctttcgacgtatgcggttgtcgtttcgataacagctggcgccgaccgtggggacctccgagcgaaaccactgagagcgaatgccaccgaagaaggtcgtgaaggagaaggttacaaggcgaaaggaaagcgacgccggggcggacatggccgccgaagaaggagcggaaccttcggcatcaatcgccgaagtgggaggagccccgtccgcttcggcaccggcaccgtctgcttcggcgctgatcacagcattgctgccttcggcccctgccacctctgagcaggcgccaagggtggatgaagtggcgaaggcggctgcagcggcaagggcgcttcagaccagggcggagatcctttcggcaggacagctgctggtgccccctgccgctccgtcgcagccaacagtggcccaagccgcactccctgccgtgcaagttcaagtcaactccgaccctgaaacacaagccgaagccgatatggaaactattaggcagaacatggcacgactccaagacatgcttcgccaaatgcaagaacagcaacaagcgtacgaggcggcgaggcggtccagggtcccttcggcaccaatcctccaatattcggcagggtatgtcccgcctcaagtctgtccacaagtgcagtcccagcccgttccgccgcaagtctcacaggcatcggtgcacttcgccgggcagccggcagccgcagcagtgcaccaggccccctatggacaagctcagcagatcgcggcccaagtgtagcctcaaccacttggccaggtgtcgcaaaccgtagcggaaggggcttcggctctgcaggcgcaattccaagctttccttcagcaactcaatcagccccacaacatttcgagtacagctccctcgactcgtccagaggggagtacaggtcaaggtgcacctagttggttgccgccgaaccagccgaatctgggggcttcgccatggagtcagacacctcagtacgacttcgtcaatgccgcccaggcgcaaactgttcggccgcaaggaccgacaccaggctttggaacaagccaagcaccagcccaagtcgccatgacatggtcgcagccagttttcgacccatccatggcgacccagcaagtattaccaatcgcaaccgggcagccgagcaccatggctcaaactcacgcgcaagccgtaatttcacctttcgccacgccgtacccgcagcaaggtgcagcaaacagagcggggggcgagaaggggctgccgctgagtgggggaattaagaaccgcccaattccaccccagttcaaattcccacccgtcccacgctactcgggcgaaactgacccgaaggagttcctatccatctatgagtccgcgatcgaggcggctcatggcgacgaaaataccaaggcaaaggtaattcacctcgctctggacggcatcgcccgttcttggtatttcaatctgccagccaatagcatttactcatgggagcaattgcgcgatgtttttgttcttaactttcgaggcacttatgaggagccgaagacgcagcagcatctgctcggcattcgccaaaggccgggagaatcgataagagaatacatgcgtcgcttctcgcaagcccggtgtcaagttcaagacataactgaggcgttagtcataaatgctgcttcggccggtttgctcgaaggcgaactcacaaggaaaatcgccaataaggaaccacaaacacttgagcatttgcttcgcatcattgacggttttgcaaggggtgaagaggattccaagcgacggcaagccatacaagctgagtacgataaagcttctattgccgccgcccaagctcaagcacaagttcaagttgccgaaccacctcccctcgcggttcgtcagcctcaaacggcgatccaagggcagccgccaagacaaggtcaagctcccataacctggaaaaagttcaggaccgaccgcgcgggcaaggctgtgatggccgtcgaagaagtgcaagccctccgcaaggagttcgacgcccagcaagcaagcaaccatcagccggtccgtaagaaggtccgaaaagacctttactgcgctttccatggacgctcttcgcataccacagagcaatgccgaaacatcaggcaacgtggcaacacgcaagatactagaccacagcaaggagcaaccgtcgaagcacctcgtgaagcagcccaagaacaacccccggtcgaacaacgtcaagatgcacagcgaagagtaatccaagtgattacgagggccgacccggtcggccatttgtccaaaaggcaaaaaaagatgcagatccgagcggtccacagcatcacttcgacgggggagggggcgccgcagtatatgaaccagccaatttctttcgggccagaagacgccgaagaagtcatgttcccacatcaagatccactggtaatatcagctgagatagccggctttgaagtccggcgaatcctgttcgacggagggagttcggctgatgtcatcttcgccgaggcgtatgctaagatggggttgcccacccaggctcttacaccagcaccaacgtcactccgggggttcggcggagaggcagttcaagttctcggccaggcacttctgctgatagctttcggctcgggagaaaacagacgcgaagagcaagtactgttcgatgtcgtcgacatcccgtacaactacaatgccatcctcggccgtgcgaccctgaacaagttcgaagccatttcccaccacaactatctcaaactcaagatgcccggcccagcgggagtgatagtggtcaaggggcttcagccttcgcctgcgtcgaaaggcgatcaagccgtagtcaacagggccatgcacaatgtcgaagccgaactccacagccggccaaaacacgcgccaaaacccacacctcacggcaagatagtaaaagtgcaggttgacgatgccgaccccacaaagctcgtatcgctgggagacggcatgggcaaacaagaagctgagagcatcctagcggtgctaaagaagaacattgatatcttcgcctggggccctgacgaagtggggggggggggtttcggcagacctcatcatgtatcacctagcagtcaagccggatgccaagccaagagagcagaaactgcgtaagatgtccgcagatcgtcaagaggcggcgaaagccgaagtccaaaagctgctcaaggctggggtcattcaggagatcgtccacccagaatggttggcgaatccagtactggtgcggaagtcaaacggcaaatggcgaatgtgtgtagacttcacggacctgaataaggcatgtccaaaagacgatttccctttgccgcggattgatcagctcgtggattcgacagccggctgcgaactcatgagtttcctggacgcatattccggctatcatcagatccatatgaacccaccggacatcccgaaaactgctttatcaccccgtttggcactttctgtcacctcaggatgcctttcggcttgaggaatgctggggcaaccttcgccagattggtgtacaaggtcctttgtaatcagttagggcgaaatgtggaagcttatgttgacgacattgtcgtaaaaagccgtaaggaagttttcgatcatgcgtccgatctgcaggagacttttgacaacttgcgcacagcgggcataaaattgaatcctgagaagtgcgtcttcggagttc

SEQ ID NO: 81811 - DNA, 28859 bp, Oryza sativa
cgccggcggcctccgccgcctgctcggcgggcaccatcgaccagagccgctccacgttcaccgccggggagtagaacttgttgcggagcctgtggaagtagcgcatgccgaccttgccaaagtagcccgggtggtacttgtcgaagaggatgcggtggtggtgcatgcctccggcgttgccccggcctcccgggtgcttccggtgcttcccgatgcggccgtggccggcggacacgtggccgcgcttcttgcggttcttcctcaggctcgtcgtcatcgccgccgccgccggcttaccttggggacgtgttcgggaatgggagggatggaggcggcgaggcggagttggtggattggataggaggaaaccctaggaggcgaggaatggtgagcttgatgggctattgggctgggccttgcttcttttaggcttgtttctctcttggtttgttatgctgggatgttgggctgtggtttggggttttatcgccattttggtccaagaaggaaggagattttttttggaagctaaaaagaaattagatttttgtttcttgatgtgttgtcctggtgtttttgttgtggaatctccatgtagatgaactatgcaaatgcatcacaaggggattttactattttaagagtcccatgtcacaccggacacacggttggagccctaaaggaatcacgtgacatagatgaaataggagaaagttgtctttcaaaccactatagtaagccagacaagtgtcgataaatatttttttcttgttaaaaaacatcattggttttatctttaacattttggcagtaagattgccacatcccaatggatagaaagttagataagagacaacaaagaaaggggaaaataagagaagagaagcgtcttttgaaccattgtaagaactcggaagtggaatgtgttaatcacttgacatggttcttttctcgtcgagtaatatcactactattagtttatcttttcaacacatgtgtttgatgagaacaataagataatatggtaataccgttacctataataaagaataactgttagggatactggtaggtcgaccccaaggcttgacccaccatcagggtttcttaaaccgccggggccggggttaccgcgccccggcggtaagcacggttaccgcggtaaccgtgaaaaaccatgaaaaaccgtgcaaaatttatcaaaaattcaaattattttttaaatttatttgaatttaaggaggttaccgcggtatttatattaccgtaccccgcgataagtccggtaaccgccggtaagggaaaccctgcccaccacgccccccgtgctagattatgggtcatgggtcatcttgcccccgcaacgttcctaggcagttgacccatgggtcgacccataacccaaaagttgaataagcatatgcatgagtactggcactgcaaaaggttcgatctcgtctagttacatggctttcatagtggcgatattgtccaacttgtcgcccacaacgccgatgcccctgatcctctggagcaacatcttgattttgtcatagtctatgccttgttggatctctagcagaaagacgatgctagcaatgaggaacacgatgaggacactgggccgtcaagcaagcactactaagagcctctagcctcagcctcccgtgatcttctctatggtgaaattcacaaacatggtgaccggagctccaagagacacatgttgaattggatgccgagcccgacgtcgagcacaaggggtgagcagaggtggagatatagatgatgaggtaatgagcatgagaagtaggctaccgattttgctgtagtgttgacgcagatgcacgccgtcgtcgcctccacccaccaacatctactggagcctgtgagtgcgtaaacgtggtgtaagatatgggtcaaccccatgcgtggtccgtgcgtcacgaggccaccaacccatgttagcctaggtgaaattgtgggttgacccatatggtttttgccccatagatcgtgggttgggtcactgggtaaatgggttgacccagcccatctacatccctactaattgtgtcatgtatcaataatgatatgcacaaacaaggaatctctgaccgtccaaaaatatgatttaaccaacaccaaaataaatacatgtcaaatcttgaatgttttcatagaaacgataggtttggtatgttgtaattaaggaaacacgtaacttctataccccgagcaataattattccatgcacataacgtcccaaccagctgaggagtcgaaaccctaaggattgcaattgtcaacttggagcctgcataaaaacttcaaaactcatattatatatgtaatgcgcaaaaaatacttgcataataatgtctgagagtgacacatgatcaattcatatgtatacgacattgttatttttttcaagtattgctaatattcctttaatatttcttttagagctagatatttctcaaaggacaatgcaaaataatttatttttagattaaaaaaatatcaaaagaccctcccctccctagtcctaaacctaaaaacccaaacccaaacccaaaaccaaaaccgtccataaacccacgaaatccggcaaaaacggaagattagacaggaagaaagaagggaagggaaagaaaagcaccgcagtggagaggaagaggagcaaaccctctcctctcctatatcaaccccaactccgccttccctttggccccctcttcctttcccccctccgccccgccccagattcctccgccaccaccgccaccgccatggacgacctcgagcaggccatcctgctcgcctcggattcccccgccgcggccgccgcctccccggccgtgcgcgccgaggcgctcgcctactgcgcgcgcgcccgcgacgagaccccgccgtcgtcgctcctccacctctgcctctacggcctcgcctcctccccgcacgcccacgtccacttctggtgcctccagaccatccacgacgcgctcctcttccgccgccgcctcgccctccccgacgacctcgccctcctccgctcctcgctgctctccctcgccgtctcctccaacgccgcctcccctcccttcctccgcaacaagctcgcccagctcctcgccctcctcgtccgcttcgagtacccccatgtctacccttcctacttcctcgatctcatcccgccctcgccgccgctgccgggacccaccgacatgttcgcccgcgtcctcgtctccctcgacgatgacctgctctcccaggactacccgcgcaacgccgaggaggcctccgatgccgggagggtcaaggacgccatgcgcgcgcagtgcgtgccccagatcgcccgccactggcacgaggccgccgtgtccctccgcgccgccgaccccgccgtcgccgcagtagccctcgatgcggcgcggaggtgcatctcctggatcgatgtctccctggtcgcgaatgacgtgtttgttcccttgctctttgacattgcgctgtccccggggagcgtggctcctcttgctgccgcggcggtggggtgcctctctgctgtggcaacaaagaggatggacgcgagggcaaaggtggcgttgctgaggtcgctcatgtctgcccagaaggggtttggtagccctgacagcggtttgaaaaatggcacatttggtgacggcatacgctgtcgaggctctcgagtgttatcgcaagcttggctctagtgatgctgatggagccgcggcattggaaatgctggaagaggtgctgccagctgtatttgcggccgcagagagcggcgatgatgatgaggttgattcgggctcggtgcttgagtttttatctgggtatgtgagtacgatgaaggcaccgacagagaagcaacttggacacttgggacagatactggaggtggtgcggatgcagatgtcatatgatccagtttataggggtcatcttgatgtccttgacaagatagggaaggaggaggaagacctgatggcagagcagcggaaggatttaattgcactatttcggagcatttgtcgtgtggcaccaggtgccactcagctgttcataagagggttgcttgtgacggccctttcatctgcagaagttagtgttgaggatgttgaggtcgcgcttactctgttttaccggcttggggaaatagtgggtgaggaagagatccggactggagctgggttaattagggagcttgtcccaatgctcctttcagcgagattctcatgccacacacaccgcctagttgcattagtgtacctagacacaattagccgctatatcaagttcatgcaggagaatgaccaatatgtgccacatctgcttactgtgttcttggatgagcgtggcatacaccatcagaatgcccacgtgagctgccatgcaggatacttgctcatgagagctatcaggctgttgaaggctaagctagtgccttacttggataccattttgcaggtatttcctctatctcttttaataggtttaagccagtctagttttctattatagatctgagttatgtgtgtctatgagttaacagagcttgcaagatgccctagtgcaattcactgctacggactgggcaaacaaagatattaagttctccagctcagaggatggcagccaaatattcgaggtacaatgttctcacctttgtctagctgttgttttacactgggaacactaatcttggatcaatgacgcttgttatgattttaggctgtgggactgttgatcggcattgaagaggtgtcaccagataagcaggttcagtgcttgacagctttacttaatcctctctgtcaacaggtgatcatcgatctctttctccccctgtttatgctggccttaggtcctatgggtttaagaatcttacattcatcggtgaaaatcaatccagatcgagtcacttgttatggatgccaaagcacaaggacttgaagaatcatctccaagagctataggtcttcaacagattattgttgcattgactatgatcagcaaggtatgctgttcatcctcacacatcacgaggagttggcaatatcacattccgtgaacgtagtatatcattttatttctaaaaaaacgttctgattcgctcatatgccaaatctttggttctgtatatggcaagtgcctcaagtattaatgcttgatcttactgtgtctggatgctgtccttttttagggatttaatgaacggcttgtgatgggaagcaggccgacacttggcgttatgttcaagaaggtacattctgtcattctccattccacgtatatatatgctttttaattatcatatatgtgcataatttccatttttcgtatgtgatttttttttcgtattgttctcagacccttgatgtagttttgcaagtcctcatctcatttcctaatgtgaagcccctgcgatctaaggtaagtaactgttatcaacatcttttgcaatttactgcttggatgattaaccaatttgtaacttatgcaatgctgaaatacagatcatatcatttctccaccgtatggttgagatattaggcatttcggtgcttccatgtattccaattgcactgcgacagttgctcgttgataatgaggtatttcatgtccctgtttcctggttattggttttgcaagctattgcgatctctaatagtaactgtagcacctgtgttccctttttcggtaactgtcctgttttagctgtatttctctgaggaataataacggcaggactttggaaactatcgtactttgtaatgtttcttttatatacttatacaacaaaaaggtgcctctgttgttaatcataccatcaaaattatttcagccattggatcatagtattaaccattaaattagatcgatgttctgttctacaaggaccgctttagggccatacagtggattggcccagttagactccacatctcacttttccccctctttggcccatccctttgagcggacaatgtccactttatggactctaataataatttagtagttctacaactattttgtttacagttaatattatttctccatcttattgtttcatcacagttctgcagcttattttcattcattcgtactgcagcaatgcaaggggtatcatatagttcttaaaatagcaatatacaaaggaaaggattgtgtagactgtcaatccaaacaacaatggaaatcaatgaatatatgattgtccacagaaatccattaaacattcttttgtgcaattgtgttaatttcttgtgtcttagccttaatgtttttctagtacctgttgaactgcatattactatttgatgcaacatcaaattagtaccttattatttctctaaaaacaatattgtcgtacatataattctattttgcggcccttgctgacatcatctttttacaggcaaaagatatgtcggaatttctgtacttaataaaccaaataatatgcaagtttaaatcttcagcaaatgccttattggaggatgtgtttcctgccatcgcaagtcatttatctgtgatactatcacacgatgccttttcaaatggttttgcaagcaatactgaggtaaattgaattggtaaataagacccactatattactgcattaatttgtgtgttaaccaattagtttaatgttgttttctctaagcattttgttttgttgttagtcactaaatatcatggctgttaaggcgtcgctatggcatcgctatagtgctagggcaccctgagggggtcaaggcatccctccgccttagggcttaatgcagagagggagagggagaggtgaaggcggcagcaactacacccttttcccttttctctgctccatgtcatcaccattttgctcccccttagctctggtttccactctcttctctcccctgcgccagattcatcttgactcaagggagcagccgccagatccatccaagggaaggagcacatacagagagaagcacttgattcattctgaatcagggggaagggagcacagatagaggaatagagctagcatgattaagaagagccggtgcgaggaagaagcgatagagccgtgaggaagaaacgacatcgggggcggcgctgtgagaggagagacacacctggtgcgggtgttagggttatttctttgtctttgggctggtatgaaggatattgggcttttgtgggctggcctgctaggctggttttcttctgatcgctgctaaccacataggttatggcatcgccatgccttagcgttttactgctatagccttaccgccttaacaaccatgctacatatatggcaatcatcttgatatgataatgttcttggcttattgcatagttagtcacacactattgtttgtagctggcttggttcttcatcagctagtaggccccatctgaattgctaccttttgtctactttgttcatgccaatttggctaatctatgtagccaggcttttacaggtatttcatggattgcgtagttccttgtatactgtattcatgccaattttgttcattgcaggaaatgcgtgagctgcaagagctggaaaagagattttacgcattcttgcttcatatagcaacacatgatctgtctacagttctcctaactcctagttgtaggcattatctagagaacataatgcagttgcttttgattacttcatgcagccataaagagatatcacatcggaaggtggggtttaattgatcttgaatttcttatttccacttcaagcgagttacattctccatctccactttaaatagaattgtctattttatactcggttattgttttgtagacatgcgtacagacttttgtcaaccttatcaaagactggtgtagtagctctgaaattgaagataaggtattgttgtgttcagttcttcttatgtcatgttttgaagagtctatctagtacttgggcagttgcattactcataatgtcatgtatttcttgttttcctcagcttcctggcttccgagtgtttatgattgagaagttcgctactggttgctgtttgcagagtgtccttgacaagtcatttaacttccgtgatggaatttcggtaggacctgtcaaccatacaatctatatctatctaaatttctcgtacctgttttactgtgttaaatgtataccatcaagtagttattatactgtttgtctattgcttcattaaattcttggtaattttattaatgtccgtcctgatagggtttataggcatttgattgtgacctccagcctataggtgtccgattggaggtgaaactgcagtttgtagtctaatatgtgatctcttatcacttcctaaacatcagatttacttggatcaaatggcaatctaaatctccactctatataaactattcaggtgattatgtagcttgttgggcacactgatttcttaaaaattcttagaatatttaacttgagcgataaatttctttgtactttgacaatgtatatgttttctgtaaccaacctttcatatattattctcatgatgtttaaagtgccactaggtagtgtttgaattctattgccataaatgccttttaattgttctcaagcagactgggttgcgacatttgaatcttattggtcacaacctcttttgacattcccaagccccacagtttcatgttggtccctagaagcgagaatacactctactttctcttaaatttgaaatacaatctgcaaatatttctatatgccccactactatgtaagggagcgtcaaactaatctgttccctttgctgatggaatgttaatatgacaattgaaaattcagttggccaatgggatgcaatgagctatgtcttggtgctttcattacttctcaaggagggcataaatgattagaggctcagtggccaaagtaggcatgtagcaatgcaattctcggtgacagtcttgctaggttatcatttagttaattactaatctaaaagcaaatagaacatgagttattttcttcctttaaatgattgttgtctcacaacttattgtcttgtcattttacttcattactatagttgaaatggacatgacttttgcgtggtgatggatgtatttctttacattcaagagcttagtctaatctgcttctttcttagattgccctgtttggtgaaatcatgatggctcaaaaggttatgtatgaaagatttggcgagaactttgttgtaaattttgtaacaaaacttcgagaagcacactgcccaccagaccttgctgaacagtactaccaaaagttacaggtatgcttgttcttttgattccactgtgtttgaggttgctaactgcacaaaagctagaacatagctatcattgcaattttaaaaagttgaaccgttcccttaatttacgaagttaaatgtaagtacattgtgttgctgtctcgttgataactggttgacttgccatcaaaatgccatcgaggtttgggaagttgttagtaccatgatggagctctagtttatttgttgtggcttatatgagagagcaagtatttagcatttaccttcagacttgagtaatgattcaatgggtaattatcatttgtttgtcgtattactaaagcaatggtgtttgttctatggttttattacaaacaaagtaataagatgctgacataattcaggaatttgtaatctgatctcttatctgctgtatcaaatttaaatttttcacttttacttttctccatcacagggaaatgatatcaaggcattcaagtcattttatgaatcacttgtcatgaaaataagacaacagcagaatgggagtcttgtcttcagatagcgtcattcaattattttaaatctgtttgccagtgaaagattcctcagttctacaatttgaatataggtagttatttcattcttttcttggcttatcaacaatatgcttattcctgcatgacttgcttgtattattgccttcacatctttgtgttaacttgctataatttgcagggtagttgtatcatctatgtacataaagctctaccatttctgagatcagaaggtattcccttgattttgatacacttcttttttgcatctttgacccatctgttattaaaatatctctccccatggagcattattttgctgtatacatggtgtgcatcttcgttgggcactcccttgttgtcctcaccaccattagggtggtaatatagttgatgtaaagcttctggtttagcctatattctgtaatgatggagcatccgaagctctattcatacacctttcaatatcagtaatcatacctcgcattattgtgaaatctgacctcaatgcatgtttcagtgtagtttatgccagtggcacataactgatgaaaaattacccttgtatgcttgcagatgtatactgcgggaatatttttaccgagcctggctaccgtggcaaagttccttgatcaaggcatgttagtgagatgcaggggatacatccccagagtttctgctgtgagcatacagggtttcattatgtttgttttgatatttctctggaagtgatcattgttctgctccgagcttgaaattttttgtaaggcgattcgggtgaagctaaacagatgggataggcaaaagagtgatgtgtgggccgtgtttttcctgacagaaactgtcacaccgcctgttgtcgtgttaccaaattttggcagtggtttttcacccctttgttagctggggtgctgtacagattctttaatatagttgcgtcgttcgcattaataagtttccgtggtcaccttctcgttaccctgattatccagtgacagaagaggcatgctatgctgactgcaatgtaagagttcaactttgatctcttctccttttgaggtagtggaaattttctttttacccatagaggtcggtatttttgaacggtcgaaatctttcatccttgtttttgcccattctgtgactttcgtgcttgttcggcttcctttcagaatttggataaatttgctttggattagaccacgtaacagagtctagtcactgttacttgttaggcaggatggatatggctgtgaagtgaaggccaggccatcaaagttgggtttgatcatatcttctgttcttgttcttgtgatccaactatccaaggacttggccaggagcacatcagcgtgctagagacggacataacgatattgattgtctagcttatatgactgcacatagaggcccatatttgtaggttgacaagatgtttatggctttatggccatatgacttttgttgaaaatttgcttgcctgctgttggtgcatattatcaaatttgtcatcgaattctttcgcacgtcattggaatcatctgcaaaaaaatgttgttccctatggtggtggctccatgtatcttgcgagacccatccacgtagtcattttttatcatcttctgaaagtcaatgctaatccaatcatgcacattccgcaccgcacgaggaaatatggggttttaatttggaactttggagccaattttcgccctgcccatatttggtagtgtaacagtattggcaaacattgttatcaaactaaatattttttgtgatattattttagttaccaaaaaatttgggtgagcaaaagttgactctaatctaaaccatggtctgcttcctttcatcaagaatccccacattacagaagttctaaaatactcgtatactaatttggaggtgcagcaaagagcatgaaaagtgatttcactgttctcacaattttttgataatttctggagcttctacacattgaagcactaacttggtagtgaaagggagtgaagacctcccaaaaaagggaagggaattgaagcactggaattggattgttcatctgcactgcacagctagaaagggatcctgacaaaggaaaatgccacacaaaagaatgggacagttgcaaagtccaatagagaatgtagcaaaacaaagaacacaaatgccaaaagagttgacaaaaaaaaaaaaccctgcatcatccaaaatacacaagagacaaaagaagcactcaccaagatgagctaaccatgctcatcaactttttcataccactttagctgtttttcttggagggggcacttggaggttggaaccaagtgctctcacccaagagtagtaaaatatggccagctaatcagtttgagaagactagatatttgaagacagattaactttcttgtctatttggacagtagtttaatttgtctatgccttcaaaccctgttttaatcacacctaccatgagagtttgttgatcagcacacatgcctgctgctggtctaatgtccattgaaaatgtgtgaagacaaaccacttacttagaaagttaacaatgctagttaaagtaatgactacatatatgctgattgatgttgctattggagcaaggctggttaaaatgcctatattaaaagaaaagctatctgcttttgacaaagataatcaatttgattgcattatcaagtataagatagttatttacgactagcctggtgacttggttttctgtagcggcatagacctgttttttcttcatttcaaatgtcaggtaatgtgtccattgaggaaggcagcattcgtattcaaaaggtgtggttagtattcagttcagtgtacagaatgggttgactaaatcaagctaaagatcgtctctaattaagaagtaatcaagctagtagctagatgttctctaattaaaaaatgattaagctagctactgcataacatttgcttgcttgtagccgacaagttgtgataaattaactaaatcctgcaccaatcaacaggcctgtgaagaatgcattactccaactaagattgatgtgcacaccaacagcactgcaaatccatatggatatatacggaagaaacatcagcagaacatcatcttaaagaattctgattgggaatatgtgctcacgtaggggagcaagaatgaacaaaaccagtagctaatgcccatcctgaaccaaatcaagaacccctgacactgaatttttccccctatcttcttgtttctctgatcaaaccaagaaaccatgcaatgcatttatgcatgtatctagagcattagcttgtttagtagatgataatgatagatgctttaggggtcaaaatcattatcttaaggctgcggttgtacctgccgaagtgtttatcttcaggtacagagaagaggagaaactagtaacagtcaggaagcaagaagtgcatattgcataggaaagtaagttcagaaagtatgcatatgacgtagaggtcgatgcttagcagtttggtgaggagtctcgtgacatttgatctcttcatggaaagagattgcaaacctaccccgtatctcacgaagttaacctgtccttcacaagtgtttctagaacgtgtcaatttcatcaagctgattaatttcaggtttattgtcattgaggagaaaactaattctaattagatatacggaagatcatgtacggactaatcacattttctttccgaggaaagaaacttacagattgtttttaaaaacgaacttattatgttttttaatagataaataaagctttattgaactcaatgagaactaaggttgttaaaatcatgatcctaaatcagaggtctctgagtaggatcgcaaataaaaaatagtatatgtaggaattgtaaaatcgtggattctatctactagaatcgtagaatcaggttctttaattaggattgtaaagtcgtagaagtgtagagctgaatcaagatttttacaatcttcctgaaaatacttagtaagattgttttgtatcaccttattgtaattggttgaattcaataattatctcattatctaaaaataagtgtctcgattaactgatcacgtggtacatagccaagttgtttctctgaatcattttggctgacagagatcagcatccactgcaaaagtcaaagtggatggaaggattttatattgtatctctgcacacgcattgcaagcattccaaagcatatgcatggaacagttgactgtcatttctgaagcgatggacttctgctacgcttcaccagctaccggagaaaaacaagaaagtaacacaatctatacacaaaaacggcttcttaattagttgcatggctaatctctctttgatcatcgtgtgtacaagagccgccattaattagacgtcaaaactcaaaaccgagttttttttttcaaagatcctgaaattaagaaggtcgtcactgcagagttggtgcagatgattgatttcagaaacaatatagtacatatttgcattcgaagctcttcagttcttttgttttttcttcaccttgcaaagcacgtaggcacttggtttgatggtttccagaatgatgtttcttggaagcaagtagtccttggcaaataatctgttattatcatcaaatgcagattacaggattacccttaacctaaccccagttctgacttaatcagttcctactcctagtgtttgacaacctactgcagcaaagaggattacactaattaaacatttgatccttgcctgaattcatgcagcatgcatgcgtgcttgcacggccgtctcatcaggtcatgtactaatcaattaacagccattgacccattgtgcatatggttttcccactggacatatgtaactaaccagtaattaatttcctgattagttcttgattgggcaccaagaattagctaagtagctaaccaagaaccaggcttcaaaatttcagttttgaccatttctattgggggcaccgatggtaccgaaatttctaaatattttgatccgaaataatttaaaacttgaatagcttcttatcggatgaattcttttttgataagatatatactcgattacatggttagagtgtccctatcttcccatggccattattcagaggagcaactcgtggtacatgcatggcaattcctgcgccacatgatcagtggcacgattagtaaatcataccgacatcagatccatacatgagaagcctctttctctgtcaccgagcacacgtactttacaatatatactttccctctagaaggaaaaggaattgaaaatgaaacgagctttggttatgttctcacttggcttgtttggggccacatggtttgtttttaattactgtaacttcagttaaaaatgttaacagatcaatattgtttgaccctctttgacgaatttaatttcagtgtaccaagtgcgtgttctatttacatatgcttgaaagttactgaggcatacacatacccattgaaacacaactctgattgttgagctatagttggtatgcctaaaaaactgaacaagcaaactaaaaaaaaatacaggtaaaacatttatatttgtatcattaatggttctagaaccaatgctaaaaaaatagaccatggctatggctcggctaataagccaacaatctcctaaacttgctgggcaccaactgtaaggttttgagagtagaagatagagatgaaaaaatatctcgttttttacgtgcacgtttcccgaactactaaacacagtacgtttttctttcaaaagaattctatatgaaagttgaataaaaatcaaattattctaaattttaaatttaaaataattaatactctcaaatactgtactatctaactctgcatttgctacatttggaacttcataaccatgttgatgtcgtgaactcagattcccagcaaggtgttctcatctggatggtgcatgcagatgcagtcgcaggtcgcagctggatgcccggattccagtggtggcaacgatgaccaatcgacaacgacctgcacacacagacaaacgtcgttttggccgccatttgccaccattaagagcatgtccaatagcatactataaaccagctgtaaatatattttaaaaagataaatgaggagaaagaagaacagcgggctacagatttgtagccagctgtagcatggactccaagacttagtgtgtgtatgccatgtgggaccagatattaatagtgtagtatatatgtaactattatatgaataagctattagattgcctatagatgaattgaagctagtagtgggctatgctattaaacttgctctaagtacatcacatcgatgctgggcagcagcttgcacgcactgactgatcgacgaatagtgatcaaaatattcagtcagatcgaccaagaaacctccaaaccgacgagaatattggcatctcttctcgcgattgggactcttgcaaacacctctcgatccatccatcgtcggctcatttcctcttcctcctcctttgcttgttccgagtcaaaaacgcgtatgcatggactggaatcaagcgacctcctttacggcgcatttcttttttttctctgaaagtctgatgcgtttgcttgcattgcaacagacggtggtgttgcttttctttctttaatttgggggcagttaatagtttgagttggtgatcactggatttttctttctctctttctgatgaattggtcttaatttggctgcattgcctgaagctgggttgatgcgttcctttgttcgcgttggtcggctcgtatacgtacgtacacacagggacacggtcaccaatttggtactccatccgtttcacaatgtaagtcattttaacatgggactagctaaaaaactgtcgagtgttttttgaggggaaaactttcaaatctaactatagtatataatttcactagaactatattataataataataacttatatatatgtattaaaataatatatgcaactttatatgtaatttatatagagataacaatatagttatagtgtagttacactataattacaatgtaattacaatgtaattacagtgtaactacaatgtaactagaatgtaactggaatgtaacttagatataactttgaacaaatctaccgtaaacatacaatgatgggactagcttgtgaaaaaagggtttagatttaatagcaaaatatctcagcacaaatcttaaagcggaatcaacgactaagaaatttgacagttttcactcaagaaaattgtcgacagtcctctagcaattccgttttagcatttcccacattcatattgatgttaacgaatctagacatatatatctatctagattcattaacatcaatatatatgtaggaaatgctagaatgacttacaccgtaaaacggagtaagtacttctttgcatgcagctgaatggatgaattaacgatgaataatttggttctatgataatattcgagaatataaacgaatgaattgaataaaacaaagtcaaaaggttgttctaaaaaaagcattcttataaattttaaatttatacacgcaaagtttcttttataaagatttgcaccatttcgagacatgaaaaatgtaatacttaaacatgttttggtcgaattttctatatgatgagaaaaatctaatacgaagtatgaaacacactggagtgtatggccatgcttgcttccatccatccatttccacgatacaaaaatgaacaagaaaaagatggacacaattaattagcacgctagtctttgcatgtcgcaatacaaggtaggtaaaggccgggggaagcacatcgcaccatcaccacatataaaaatcgtcacatcaacctcatccaaatttcgcatcatcacaaaaacaaatcaaatcccctccaaatttataacccattaatcaaaattaaaaatatcccccaatggtcaacacacacacaaaaacacacacgagatgatcaaaggccattccatcccgccctgacaggtgggccccacctgcagcctctcgccttcgcctatatatccactcgtgacacacacagccccctctcgcttgccacgcacaccaccaaatcgccaaccaaaaagcaaacccccgcgtcttctccgatcagctccgctcgctcgccgccgacgagctcgccccgccgccgacggcgacggcgcatgctagctgcgtatagcccgcggcggagatgaggtcatccagcgattgcaaggttgtggcggcggcggcgaggaagaaggagaaggaggcggcggcgtggccgtggtcgctgtgggggttcctcctgaccggctgcctcggcggcggcggcggcggagggaagaagaagagcggggggaagaaggtgcgtccccgcggcggcggcggcggcggcctgcggcggctgtcgttcacggacctgacgggggcggcggaccaggacctgtcggtgtcgctggtggggtccaacctccacgtcttcaccgtcgccgagctccgcgacgccacccgcgggttcgtctccggcaacttcctcggcgagggcggcttcgggccggtctacaagggcctcgtcggcgacggcgtcaagccgggcctccgcccgcaggccatcgccgtcaagctctgggatcccgagggcgcccagggccacaaggaatggctggtacttcacccctccacgtgtcccttttccacttaatcatcaaaaaaatagaataaaaaagtgatatgatttcatttgattaattagacatgcacgcgttaatcactttagttagttaatcatttaatgcgataattaaatcagattgatcgattatgtttgtataagattaacaattaagcttggagtaattaatctgagatagtgtagtgccagcttccttggaagagtccctaaatctaatgcttgggggaaacaacattttctcacatggtttcttatagtaaaagagtggccatcaaatatagcttaattggtagagtagtagttgccttgcaaggatcactcaaatatatgtatcccagtatatgaatatcctagggcattgagtaaccctctagataactgaaatttgcaggtgaggaacagtattttttttttctttttgagggtgagagatatgagatatcgttgattttgttttttaaattaatattattgtttttctttgggaaagtgtcgattttccttttatttattgcatagaagcaaagttgtgtcgtttctcctgtagcaacagggaatgttcagtcaaattacccaatcgtttctttcctaatgctatttagtttcccatcaaacagagactgatcagcggtaattagtttggttatcggtcgactagaggttaccacctaaaagactgtattattcaaattttatatttgaaaattttgaacttttacgacttatgactagttaactaccaattattcattaaaaaaattgaatctgaaattttatctggtaaaattcagtaactgtcaggggccagtagcttcggaaacccggtttctgaaacgcttggcctaaacaattaattacagattgtttaatttcagatcaactaatactactactactcacacgatcatctagaacataatcaaacaggtttaaaaatatcttaagcagcacgattaggacgtgcgaggcaaagaacaagggaggggtagttggacgatgtgacggttccggcgacggtcggataagtttccagtgatctaatcatgctgcccaatgcaacagtgccactgaaatggacgtgatcatgctgctgattcgctgctactactactactacctgatttctgatgattctgacgtcgttgcttgcaggcagaggtgatcttccttggccagcttcggcatcccaacctggtgaagctggtcggctactgctgcgaggacgagaaccgcctcctcgtctacgagtacatggagcatggcagcctcgagaaccacctcttcaaacgtaagcactgaactgatccttcgctaattgattttcagcttaagtttgtactactgttccattgatctatagcactagttgccaacttgccattgtgctaattttttatctgacgagatgtctctttaccatgtcatgggtgtgtgtcaaattgaagctttagttcgagtaggactacctaattaactgatggttaatgagtggtttggtacggtcgtgaagtggagatttaaaacagaagttggcttgaccattctcacacaaacgcaatgacctggcacggcatggtgccatggtctgatggtcattgagaaaatgaggttatattccaacttaataatggattatagatatcacaaaatgagagagaagcaaagccattattcagaagtctacttcaaatgggtagctttgctactcaaaaaacttggttgcgtctttgaggctttcagcttggatgatggatatgttttccttcgtttggctagccaacttctttagcttattagagttcagagttctgaccaaactgaatttgactggccttctctgctcacttatgagcttgcaaaacccatggaaaatagtatttcattaggtaagggtcaattatacattcactcacccttgcgagacaagctatagattatgctactagacgttttctaatgctagattacagacgtcagatgaaagtgaggtcacctgtagttgttggatcaatttcaggttgacatagtaatctagtgtgctgcaatcttcccagctgcctcactggctcaagctgattgatttgttcttggtcatgacgaaatctcctaactcgttgactggatatcgaatccctccaaattacaataataacatttcttgaaaattcagaaggcagaaagaacaagaaaccaaaattccacaaaggcgacaacacgcatggccggctagccagtactgttcatcgtcttttttttctcctctgctgcaacaatacgcataaactgctttgtttttccttttccagctttcttattcgattgatgtgtatacataacatggctatcagctatcgattaattaattataatgatgacatgcgcggctttagctgacgttgatcctgctgagatttctgaagatattttcttttcttttcttctttttctgcagagattcctgcagtgctgccgtggtcgacccgattaaacatcgcggttggcgccgcgaagggtttggcgttcctccacgacgcagagaagccggtcatctaccgtgacttcaaggcctccaacatcctgctcgattcggtgagtgccctgtagcttttcctaggtagattgacacctctcatatgcatgcatctcagttagctaggagtttttgatgcacacatcacatatgatatactatatatatagtatcatcctaatgaccttttcatcatcatcagtgaaaaggtagagtaatgactaggaaattgtacttggcacagtttggattttgaagcattttatgacatgattatgtcagagaaacttagtatcatactgtacttatgctgttatagtgttatgcatcacttcatacttaactagtactagttaatggttattatcatattgtacttctctaccaaagaaaaggaaaggaaagcttagtgatgtgggctatggttcataggttgggccgtaagtgagttctgctcaagattgggctaaaaggaggcccaaattttagtttcaccactgaaaagcgtcactgaaaataattttatcgggtcatataatcaaatctttattatctaaaaaatataatcaaatctttacatttttttccatgaccgtgtcaatgttcttttttttgaaagaaaaagcaaatgttaagtttgggcctttaatgggttactactcaagatgggccaaaatcaggcccaacttgaatttcccccactttaaagcccattcattagtaataagcccaagtaagagaatcgcatcaaatgggctaatggtttttgggcctgtgaattttgtccctccctccaggattacaaggcgaagctgtcggacttcgggctggccaaggacgggccggagggggacgacacccacgtgtcgacgcgcgtgatgggcacccatggctacgccgcgccggagtacatcatgaccggccacctgacggcgaagagcgacgtgtacagcttcggcgtggtgctcctggagatcctgacggggcggcgcgccgtcgacaagacgcggccgaacagggagcagagcctcgtggagtacgcgcggccgtgcctgcgcgacccgctccggctcatccggatcatggacccggcgctggaggggcgctactcgccggcggcggcgagggaaggcggccgccgtcgcctaccggtgcctcagcgggagccccaagaaccgccccgacatgtccgccgtcgtcgacgcgctcgagccgctgctcgtcgccaccgacgacgtccccctcggccccgtcgtgctgttcgtcgcgccggatcaggaggccgacgccgccgccgccgccgacgacgacgaggacgacaaggcccggcggcggcagcggcggacgcggaaggacgagcagcaccgccgccgcagccgcctccggacgtcgcccaagggcagcccgaggaagcccgccgtcgccgctgcttgccggaacgaggagttctgggtgtggcacgtccccgccgaccacaaggcgtgagcgagtgacacgtggcgcgttgcatcgcacgccatgtcagccgccgctttgctttgctccacgtgtgcgacgaacattgtgtgtgtgtgtgatgaggtctagtagtaacactggtgatttgattaggatttgcatgcatccctgtactctgtttgtttcagtgagatgcagagtgagagagcgatcaattcataattcacagcacaacgaagatcagatcagaaaatatcttatcaggtctcgtcttctttaatccaacccttgtttgatttgattggttgatcccttcgaaagtcaatttgcatttgacaatggcagatacggatgaacagatcgatctcgacgatcacatcaacctggattatttttcttattaccggccgttgacaaggcattggtatctgacgaggtctcttgccgtgtagttagttttagaggttactgtcgccgtcgtgccctcgcatgcaacgtgttcgtccgacgacacgacccggcacgggcggcggcgccgacttcgcgacgccacgctgtctttgaccggctccgacgagcgcccgccgtataaagaaagaaagggtcgcgtagctgataaaagcacggtgtccatagctagctagatcgtcgtcgtcgtcttcttgcaggagaaagatggagctcccactgcggtgttttcatggcgctaaggtggcggcggtggcggcggcgggtgatggcggagtcgccggccgtgcggctgttccggcgaagggcggcggcggcggcgttgcgcggggggtgaaggtggtggtaagagggctcgtcggcaaggccggcaaggtgttcggccggtcgatcccggcggcaaggttcggccacctcgcctacataaggtgaaggcgcagctgcgtcctgaaacgtcagtgatctgatcttcttctcctctctcactctctgccatcgagggaggtgtgctttgtactagcttttttcttcttcttcttcttcttcttcttcttcttcttctttttttttgtttttgggccaatgatactttgtgctagctaggtgctcgacaaaatgcgtccttgattgatgcttggtgattttcactagatctgttcatacgacttgtaaatagtagaacatgctaggtacaaggtacttttcagattacactgttcttcagttcttgtacttagtacgttttcttttttttttcttcttctgtatgaaatacgctcgtaataacatcgatcttattaaggttgtttaactttttggtgttctgttagatctgcagttccttcttttttttatatatatggacaatttgatggtcagatgaacagaaggcctttaccaagtagtttctgaacttctgatgctagatctatacgaaggttaggatggatgcacagctgctggtttctacaaacatcagtacatcatatcccgttgcgtatgtggttgccatgagtcttttctgttttaaaaaagaggcagattagaatgttcgatacagctatgaatcattgatttgcttctgcattattcatgcatgcagccatacagctcaagtattcgttgttttgtctaatacggtgtactctgtatctgggtttctttcagaccacagtctgcgtcagatatttttcttctctaatccatttgtgtatttgtgttgttcaccagtagtgcacgtctggtatgtacttgctacttccatcttctgaaaacaacgagggaaaaattatctttggcttgtaatactaattaactccttacatattcttgaattcctcttcggtgttccagacactcttgtatgaaagtatagagctattttctcgtagtacaaaatgaggataaaatccctctcattacaaaacaaagagggaggttatgtgtcttatggaagaggccggggatgtaaaacatttctgttgtctttaaaaaaaaagataaaagagggatttgaagaattgtatttgaaattctgaattatacataaccaaaattgatatggattcgggattgagtcggtctggtaattgcagatagtccaacattaccaataaatcatgttggctttcaaagttttaacttaaattggtcgacatggagtactagtattgcacttgtttggctgcttgctgaagtttgcggcacttgagttaggagtacaagtgtttttttaaacggaaaacggtacaagagtgcgccttttcattaaatatagaaagaggttaggagtacaagttacgaccatccataacaaatgtttgattcattgctaaaattgaagcatattaacccttaacctcacatgttattatagccaaaacttgccacaaaatctatggtcaccgtctaaatctctatcttcggtcctgccagattagtaccaatactcctactgtgatggcgatgtcatcgtttcgttacgctgacatgcgagcgtacaccgctagtagtacaagtgtaattcaagttgaacgatggatcatttctgtcgtaacttcacatccagcggatagatgagatgactgatgatcacaagcaagacagggaaggtccctcgtttcgcttatatagggaataagacaaacggtataattgcaaatgaaaaataattttttcatatacgtgttcctacgatctaaaagtaaaggctaaaaaataaacttcgataaaaaaaaccctaaaatcaactctaaatttaaggttgaaaatttaaattttagttgataaacataagcataagtgaaaagatgaggctggaagttgtatatacagtactttattctcatcttttgtttatcggcttaccggtcgtggccaaatttaatcgttaaagttctctttaaacattggggctgtgtttagatccaaactttgaattcaaacttcaaactttttccatcacatcaacctgtcatacacacacaacttttcagtcacatggtatcaatttcaacccaaacttctaactttggaaggaactaaacacagcctggatttcaaatcgcaaataatacacatacaacaaatggaaaactcccacaattttttgttgcttcgttcacgggacttcggcttgtcacttcacttcatctacaactacaagttctcacttgagcatcctgcaatcctacctatgtttcgtcttgttcttttgtccctcttttgccatgcataccgctgttgcttttccagttttccatgacccatccagtcaaaccaatactccctccatcgcaaaaacaaacaacctatgagtaaatttgacactatacaatgaatttgaataggagtattctctccgtcccataaaaaaccaacatagtactggatgtgccacgtcctaatatatcacatcagttctagattcatattttttggaacggaacgagtatatcatgattagttgtactagttagtatcaaattcacttctaggttatttttatttttgataaaaaggagtacatatgatagcatgataggaatacgatgccactaccctttaacaaaaggagtattcttgagcaagagaagcaagcagccattcgttcacaaactctggtgattgatcgtgatggccattttccttgtcttccagagacaaaatggctctgattccctcgcctcgggagagcacgcaagattgagatagcctcctccaattattgggtcactcacacacacacacacatctacactgtactactctactggtcactctcgaggtcttcttggcccatgcagaagatggaaacagggaaagcaacagagaattgacagggttggtctcgtcctgctactcctgtttgccgtatctgaatcctgccaagctttcagcagttcagaccttttctttttcttttgcggaggaagttcagagaaattttcctgtggttacaacagcagccagcaatcagtgagaactggctggctgtttatatccaaagacaagtccgttgtttggtccaaagacaagtctggaagaggcccctccaataattggtgtggatcactactcatcccataaaaaaacaaaactaagacatgatgcaacattttttagtacctggttcagaggatttgatcagcgtagagactgcatttacgttaggttacggtcagataacagtaattctacagttcatcagtgtttaactggagccaagggtgtgtttagttccacgccaaaattgaaagtttgactaaaattaaaaatttgaagaaaaaagttgaaaatttatgtgtgtaggaaagttctgatgtgatggaaaagttgaaattttaaaaaaaagttgggaactaaaccaggcccaaatgtgcctttcggacggtcagtgccaccaaaacgagcgaccgaaaaccaccgaattttttttatttataattttttttattaaaagttttacaaaaataattttccattttgaaaattgacggaagtagtcgcctaccgcccaatcgccctctcagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctccgcgagggcgattttgtactgtgcggggggccgcctgcaaatgggcggcgagggggcatggaattttgcaggcggcccccttgccgccctgggggagggcgattttgtactgtgctctatatttttgtataaatatcaatagttatcaaatctttttatattgaaaactatacaagattaaaatctccaagactgataaaatacaattttattattttttagggcatatttggattgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgttttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatttgggctgaactgtaccgtgcgaaaccggtgctgtaggtcgcactgctccgaagctaggggcgctcgaaggcaaacgaggtcctgcgaggatggaacatcaagttacgacggggtgatgttttcgtccaaaaacagaaacaaaacttaagaaacctctgggctgagcagtaccgtgcgaaatag

SEQ ID NO: 81812 - DNA, 43718 bp, Oryza sativa
  unsure (1)..(43718): unsure at all n locations
gcctgcagcaacaagacatatagagaaactattcagtgaaaaaacagaagcaaagacatccaaggttagcatgccatcaaaaaaaaaaaacaaagagtcacatacccacaagtccaatgataagaactctccacctcattacgcttgactttaagaatatcatttatatattatatatttgcataaaagttttggatgaagtgaatggtgaaacactcatttaaaagtcaatggcgtcatctattaaaaaactgagggaatatattctaccgatctctcataaaaaaataatctcataaaatgcatggccatttgcaccatatttcaccatactttcagaatcgacaagattcagttctaggctaataagccctgaacaaaacaaaccatagataaaaccaaaaaaaaaaaattgtagacacacatatagcaaatcccaacttttatgcgtgttactagtgatttaaaactaagggtagaagaagataaattatgatggaaaaacttcagaatatattaaaactgaactaatttcaaaacttaaattttagctgcgataattagtcaacaagaaggcaatgaaagttatgaaacttagtgataatacacatgcattccaggagagtacacatgcaatatatagctgctcagttgattcttaacactctgtgtagcatatatgttgttttttcaggaaaaatagaatttgaaacctatttaattactaccaaaacctaccaccatacccacaaatgcccgatcaaaatgtgccgataatctggtgaagggaagtgtaggtgccaacgatggtgacgcacactccaatgaccagtatcccaacaatcgccgccacctcgaagcggacaactcttcctcggggcatgtagatcttgaggtagctcaggcacgggaacaacatggcaacgacgacgttcagtgagaacccgatgaacaacatgaggtagccgaagaagggcaaagtgcacgccagcaccgtcatgttgacaacgacggctgctggtgagcaccctggttagcccgttgttcctattgtcagccaccgccgccatcattgccgacagcttgtcctctatcgccattgtgatgggctggatcacgagcgcgtacttcgccagcggggtgatcagtgtcgtcaagatggcgatcttggtgtacacnttccccgtgggtaagttcagtgtcaccttcacctgcacatcctcaccatagctcagatatcccaacactgttgtcactgtagagttgagactgcacatcaccgaagagattagcaaaacctgcacattaattggagaggaatagaacattattggagaggaatagaacattattggagtactgttccattatcatcatcgtcatggtttcataaaccaaattatgataactggaactgataatccaatgatcaattatcaattggttgccaaatctctctaagtgaaaggtaaaacttaaaatgcaacatcattgagctacatcatctgaagatatgtaccattgaatgcaacggttgatataatatccactgttagatcctggataagtatcagcaaaagaatggtaaaaggtccaagattgttcaagaaacttccatgagttaattgtgcaatagtcaatgccctaccacttttgcatcttatacctaacaattctcatagctgttggctgagtcaaaacttagtacaagaatatatacaacacaacacaatagatctatcttttaactcggcattaaaaattttatgatgcaacagatcttccaaatttagatacgctaccttttaatttatctaaaattgtattggactacgcattaaattacttaaaatttttttcataaactatgtattcaaatggctaatataattatttcattttaagtgctagacgcatcttccaactttaggttttagcatataaattaaaccgtattaggcggctcttgattagctttatctttaagctacattgcttttacctgggtggatgagaggtaaccaaatcccaacttgagaggcagccctaatcgctaccattcaccagtttattccgctggggtaataggctttaatatagcatagtacgcctccacgctagttaccagtttattccactggtgtgataggttgtattgtagcacagtacgcctccacatcaccgcacacgtcaaactagtcgaaaggctaacgcgacattaccctaaatttacatcattatgcaaaaaaatatattaatgctaaattgtgaatattgcacttgccattccatatatctgaaattaacattacaaaatttataagtagtacaacatcattttttagcgatagtacaacttattttaataaatgattttaatgttgatttcgtatgatcctaattcttattagacgaccaaaataaacttattagctcgaattttatctacatgatgtatatgtagacctgctatatgatgggagcgccaacaaagtatatgagagccatgcaatgctgagtatgatgagaacatagcagcgatgatgattaagaggtgtgcatgattagtgatgtacgagttctaaaaataattatgagtgtgcgcgtcttccatgcatacatgtaataaaaaagtaatttgtttgtattcttactaaacctggtgctaatttaataccaccattgacttttaaattttcattaaccataattctaaatttacattcttaattgttatcacaaattttagcaaacttactatcaagtacaacacataaatacattttaaaagtgtataggaaaatccttcttagacttcattgagcagtaaacggtcgggaagacgccatagccggcgaagcagacgaagtagaggctgagggcagtgggcaacccgctcagcgcaaccgacaaggccagcccgaccgccgagataggcaagcacgctgaggttcttgagccacgtcgtcgggaggatgacagtggccgccgcgagcacgaatagctgcttcccatgcacctggtaccctaggatctccaccaccgtgccggggaggagcttgtcgaggttgtcgcccaagaggatgacgaagctgatggcgacaagctagagctcgacgtacatgatgaggccgatggccgtcaggccatagccgctgaaggtgaggtggccgatgtccagtagctcagcgatcgacgcgcatgcagcggtccatgaggttgatggtgtagaagcatatagcttggtgaagagcgccaggctaagccacctgccctgcgagggtagatcagcgatcgacgcgcatgcagcggtccatgaggttgccggtgtagaagcagatggcttggtgaagccacctgccctgcgataccagcatggagagccacatgccctgagatagcgcgtacagcacggagagcatccttacgcttgagggagcatgttccttacgctggagggagcacgtgcgctgtacgcgatcgtccctagatcttcttgctcatgtttaccatagaagggagcctcgtcgatagggctcttatccgccgccataatctcatgttccagacggttgacgtttgaccgcacggaaaaaattgtttctctactagtgtactaacggcttctataattagtttttttctactagtgtacgaacggcttctataattagtttttttattagtgcccaaacaactcatgcaataccctatataatatccgatgtgacgtgccaaagctttatacccatggatctaaacaccccctatgaactgtaaatatgggatggatgtgctatttatttatagcctagctattatttgtaattttttccgacatgacgtgggtcagttcgaatggaacacgtcctttttgataaaaaagaaatctctctgcactcctcatacactacacaattgattttcgaaacgatttccacatcagccttctgttatgttacattactactaggttccatcaaaatttgaacaattttatatgttcttgtacagctctttcaaagagggccaattgatcttcatgatcactttagcttacgctgctttctactactcgactcccctggctgcacgttgcacctgtgcttagtgtaggggctctcctgatctccggtgggctcgaagtagagcttccggtgcagcctcgccgtggggctctcctcttcctcttcctgctcgcgtgggtcgtagtagaggtcgccgacgttgatgctccggtggcggcgctcctcgaactgcacgctcgccgccgcctccagcttcagtttggagaggttctccatggccgccatcctgatgccgtctatggagttcgccgtgttgcggttgcggtgcaggtgcttcgtctccaacttgtagtggagcttgtactcctggttcttgtagaacacgtcgaaaccatgcttgggtatgtcgttggggatctccttgccgatggccaccgccgtctgcatccatccacagaaattcatcacaacgcgggatcagcattgccatcaaatttggataaatttcgtaagaaacataaaaaaataaaattctaatatctcgagtggataactcatcgtgtagcttttacttccaaattcaatacatatggttgtaagaaattctgaaagaaattgaccgtgttgagtataatagcatctatcactctaaaaatcaagttgaaattcgacttaagctttgattaacaaatgataaattcgggtgcgaatagtattcatacaataaattagtcccttttttttatatctcaatgtgtgatttgattttgtacctaagttttttccttttggagtgggatatgtatatatgttgtatatatgaatattgctacgtttttttaataaaaaatcataaactaaactatttgaaagggttttaaacaaatgagggacgaggtatcaaaatagttaatttctcgtacaaacagttgagagtgagtttggcagaaattaaattgagtgagttttgtaaaatttagttacctcattgcaccagcaggaggcgacgtggttgatggtgtagccgccgccgccgaggaggaggagcggcaggttgaagctgcggatgaagctgacgcactgggcgtggccgcgcgtggtcaggttcagctcgccgagccggtcgccggcgagggagtcggcgccgcactgcagcacgacggcctccggctggaacacctccatcaccctcgccatgatcggctcgaacagccggtggtactcctcgtcgccgatgcccacgctcaccggcacgttcagcgcgcagtagcggccggggcccttcttgccgacgtcggcgacggcgccggagcccgggaagaagccgccgccgtgctggtggaacgacaccgtcatcacccggttcgacgcctcgaaggcggcctggacgccgtcgccgtggtggacgtcgatgtccacgtagagcacgcggcggaagtgggcgagcagctcgcggatggcgagcacgatgtcgttcacgtagcagaagcccctcgcgccgccgcggcacgcgtggtgcatcccgcccgaccagttgatggcgatgtcggcggtgccgctcccaagggtgcgcgccgcggcgagcgacccgccggagtagcggaggcagtaatcccagaggcggtcgaacaccgggttgtcgacgccgcggccgccgcccttgccctcgacggcgtagatgcccctggcgcgcgccatgtcgccgaccccgtcgtcgcctccgcagccgtccggggtgaggtcctggaggagggcgaggtagccctcgtcgtggaagtcggcgagctccgccgccgtggcgggcgccgtgcggaggcggcgcatgtcgccgagcatgccgtaggcggcgacgaggttgtgcgccatggtgacgcggtgcggcaccatgacgtggccctcgccgtagtcgacggtggagatccccgggtcgtagtagtagcacacccgccgcttcttgtcgtcgccgcacgacggcgaaggcagcgaattgccgccgccgccggccatggccatgtttaacctagctacaccggcgagatgcagacgtcacggtggcgcatgcaccggacgtacacacgcacatatataggctaaacatatgtaaggctgatcgaagcccagttcgtgccggagttggattgttaattgacttttaaattattaattaatccgaaaacaacttccaaattaacttccaactacctgatcggaagtttggaacggaactcgtatatatatcctcttaactttcttcccgtgcaacggcgtctcctccccgcacgcgcgcttcctaaccctacctttcctttttttttcttttaaccttcttccatatatagatctaatcctctctcgctattttcttttaaccttcttccataaccccggccggtgagagctctcgtccacagctcgtcacatcatcgttgtcacgcgcgtctccaccggtatatctcctccgggcgtgcggcagcggtgtaggcggtgcgcacgccgcggccgacatcgatctacaaattggtgggagaggtgagaaattagctacgttcctataatttcttctcttttttcccaatttttgttattaggctagttaccctgcatgttctgctatatctttctatacatgcttccttcgtaatttccttgcttggatgggactagaaaatcgatgcgcccgttggcgcgctcaatatttatagcctattatattattatttaatgggttttaaaatttaggtttaaaactagaatagtgcccgtgcgttgcaacggataaaaaaatacaataataaatggatgacaacgatttaattatatcttcaggatattatctaaataacattatatatttttttatgaaaccttatatgtttgatattgtgcattagagtggccatgatggtaaataacattccaggaaaatatatttgttaaaccagccgtatcatttagagttttatagaattgaaagaaaaataagtactcccttcatcaaaaaaaaactcaacctagaagtggatgtgacccctcctagattgatgtatgttgttctaggaggtttttgttagacggaggaagtatttgttgaatcgtcatggccagttcattagttatactaggtaaaaccccgtgcgttgctgcgggagttcagtataataacaataagtaaaaataatgtgtaaaatagctaaacaatataaacttacataagttgatatggtttatgataatttaaatttaaatagatatatataataatgattcaaatgtaaaagtaagatgatgtggctttatgagagaagaaagggagtgagatactttggaccgtagattaatcgtgtaaggcaaaaaaaacaattgatatgatatgatttaatgggagaagagaaaaataatactaactaagtgaggatgaatcatataggtatatacgatattataaaaaatgatgaagatatatattgaaatattatgtgaattatgtgggatgatgatttaacatgcttacattttaaaactctaaaatgtaataaattataaaattatagataatataacatgtttgcatgatgtttaaatgcaataattgttagtggatgatgatgtggcatctttgcatgttgagctttgggatctagtgggttataactttataataagaaaagattatatataaccctatttttgctcatattacaaccctgataattgatagcaaaatttctgaaataattttgatgccaaattttgtgaatttaattttgaaataatttgattgatagcaaaataattatgtctgaatttaaatatgcatcaatgcaaaataatgttgtatgagcaaacaatacaaaatgatgtgtgagcaaatgtttgcccagagataagattgccttttcatacaacttaacggagaggagttaacaatagtttggctgtgatggaatttctgggagaaatatgcttgtacgatggcattttcaggaagttgtgtttgtcgatggcatttctgggattagggtgtttgttaatggtatttcatggattttctcttgattatatggatgagtatatgttaaatattataaaaataatgaatatatatgtgtgttaaaaatattgtgaataataatgtgaaggaagatgattggatgttgtttcgtagaattaaatgaattgtagatgatgttgcatgcttgcataagttttctatttaattattgctagtgaatgatgaggtggtatatttgcatgttgagttttagaattagtgggggttataattttatagtaagataggattagcttctccctaagacactctcgctgtcaattttgtcctcattcacctaatcgctcttcttcttcaggtagaagctaatttctgctattactacttgattattgatacaattaggccgtcacaaaatcacattggttagggtgggtttacttcgtgaaaagaaaaattttaggtatcagatcggacgtttgaccggacgtcggaaagggattttcggatacgaatgaaaaaactaatttcatcactcggctagaaattgcgaaacgagtttattaagcctaattaatctgtcattagcacatgtggttattgtagcactatggctaatcatagactaattaggctcaaaagattcatctcgcgatttccatacaaactgtacaattaatttttttaatctatatttaattttctatgtatgtgtctaaagattcgatgtgatgttttttaagaaaaagttttgagaactaaacaaggcctaacgaggccttgttacaaattatgtaatactctgatcaaattaattaggcgtacatcgacgtgtgccgcctgcggccggcatgcgcgcgggagttcacgttctacaagggcgccataaaccaaggctgcatgcatgccgtcaacgtgcatcgttggctaccacgagggcttcggctgcgacagtactgtgcatgcttaatcaatcgcgttggcccgtgtggaaagtaaaatagaaatggaaagcgtgagtggaacgcgggcgaatttttttgcgcgggcatatgcctgctgttcggacgacggaagaaaaaaaaaatccaaatcctattgccccgtggatcggcggattagataattacggagtaaaccgatgacgtccaacatttgttaacaaaaatatcttcaatttttataatagtagcgaaatacacgatgaacaaaataataacatatgtgttgctttataatacaagcatattatttatggtccttttcaagtaaaaatatacataagattttacatgaataaattcaattcttgttaggatgtgctacctgtctaccggctgaaaaatttcttgctttcagccgcttattttagcgctggataaatgtatcggacgatccaacgatttcctgcggcgctatcagcctatcacacattccgtcagaatttaaaagttgtcctttttgcaaaatagccatcaattttgtgagaattttagatacacccttcttaggcctaagctgttacaactttttcgcataactacctatagtttttttttataataaaaccaatgaaggaaaacttcctttctccttcgcatataatacttaagtagttttgtatacaagattttaaaaatactgttttgtatacaatctttgtgtgcaaagtactcggtatgctagttttttttgctaatttttgccatatgtgttcattcacttttctaacatgtatatagactggtcaggatcacgtctttactaccgattcaccattctctgtttgttttgttacgaccttcacgaaagtgaaacgagacgagaattgtaggcttctttcctaaactaaaagcggtggttcttgcctccctgtgcctaaagcgcggtgggcgactgcggtttgagtctttatcgatcgggtagatccatatgttcttgggggagacgaggtgtagcgcagtctggtcagcgcatctgttttgggatagtcatctcattgatatttttagtacaacatctaatctagcttaatcaacgtgcgtctagcttaatcaacgtgcgtctactttagttatctcattatttttttgtcaccttttgtattaatttactaataaatgtttcttgtttgtttgtaattttgttagcaaatttttaggtgtaatgagtagttgtctagtatctctcttatttctattttgtttcactaaatgtaagttgcactttatttttaactataaggttatcattaataatgaattctatgttatgatacgtatgataagttatacacgctattttcatatgtgtatcatgtaagtattaaaaatctatcaggtgattttggtttaacaggtgcacacacagacacggggattatggcggcggataagagtcctatcgatgaggctcttctccataggcaagaagatctacgagatgaggtggattacgacatggagcatctcctcctccctaccggcagcaacatggagcagcatctcctcctccctaccggcagcaacatggagcagcatctcctcctccctaccggcggcggctcattttgtatgaccggcgcttcctttgggaggagctgcctaaaccttagcaacatcatatccggcatcgggatgctctctgtgccgtacgcgctatcccagggcgggtggctcagcttgacactcttcaccatggtcggcgccatctgcttctacactggcaacctaattgaccggtgcatgcgcgtcgaccgctgtgtacggagctacccagacatcggctacctcgccttcggcagctacggccggatggccatcggcctcgtcatatacgtcgagctctacctcgtcgccatcagcttcctcatcctcgagggcgacaacctcgacaagctcctccctggcatagtggtggagatcctagggtaccaggttcacgggaagcaactgttcgtgctcgcggcggccgccgtcatccttccgacaacgtggctcaagaacctcagcatgcttgcgtacgtctcggcggttgggctcgtctcgtcggtggcgctgacggcatcgctggtctgggccggcgtggccggcaagggcttccacatggagggcagcagcctcttgaatctgagcgagctgcccaccgcccttagcctctatttcgtctgcttcgctggacatggcgttttcccgactgtgtactcctcaatgaactctaagaaggattttcctaaggtacactttttaaaatgtatttatgtgttttactttatagtgaatttgctaaaatttatgataacaattaacaatgtaaatttagaattatggttaatgaaaattgaatagtcaatggtggaattaaattagcaacaggttcagtaagaatataaacatattgttttttattacatgtatgcatagaagatgcgcacactcataattagtttttagaactcgtacatcactaatcatgcacactatactcgcacatctcttaatcatcatcgctgctacattctcatcatactcatcattgcatgcttctcatatattttgttggcgttggcgctccattcatacattaggtctatatacatcatgcaaataaaatttaagctaataagtttattttgaccatccaattaaaagtaagaattaggatcagacgaaatcaacattaaaatgatttattgaaataagttgtaccatccctaaaaaaatgttgtactagttatcaatttcgtaatgttaatttacactgataaggaatggcgagtgcaatataaaattaatggcaagtgcaatatacacaatttagtattgatatacttttttttgtataatgacataaattaagggtactgttgggatagcctttcgaccagtttaacgtgtgaagtgacgtggaggtgtactgtgctacaaaacagcctatcactccagtggaataaataggttcctggaggcgattagggtcgcctctcaactatatttggttacctctcatccacccatgtaaaagcaatgtagcttaaatataaagctaatcatgagccgcctaatatgatttaatttatatgttaaacctaaagatagaagatgtgtctagcacttaaaatgaaagaattatattagtcatttgaatacaaagtttacgaaatttgtttttaactaattttatgtgtagtccaatacaattttggataaattaaaatgcagcgtatctaaatttggaagatgtgttgcatcataaacttttctttgccaagttaaaatagagatatattgtattgtatatattcttgtactaagtttagaccaaccaataggtatgagaattgttagggataagatgcaaaagtggtaggacattgactattgctccattaactcatggaagtttcttgaacaatcttcgacctttcaccattcgtttactgatatttatccatgaatattgacaaatattgtatcaaccgttgcattcaatggtccttattttcatatgatatagctcaataatgttgcattttaagttttacctttcaattagagagatttggcaaccaatgataattgattacgaattatcagttccaattatcataatttggtttatgaaaccatgatggtgatgataatggatcagtactccaataatgttctattcctctccaattaatgtgcaggttttgctgatctctttggtgctgtgcagtctcaactacgcagtgacagcggtgttgggatatctgatctatggtgaggatgtgcaggcgcaagtgacactgagcttacccacggggaagctgtacactaggatcgccatcctgacgacactaatcaccccgctagcgaagtacgcgctcgtgatccagccagtcacaatagcgatagaggagaagctgtcagcgacgacggacgccgagatcaacaggctgactagggtgctcaccagcacagccgtcgttatcagcacggtggtgctggcatgcacggtgcccttcttcggctacctcatatcattcatcgggtcctcgctgaacgtcaccgttgctgtgttgttcccgtgcttgagctacctcaagatctacatgtcccgaggaggagttggctgcttcgagatggcggcgatcatcgggatactggtcatcggagtgtgtgtcgccattgttggcacctacacctcccttcagcagattataggcacattttgatcgtgcatttgtggttatggtggtaggttttggtagtaattatataggtttcaaattcttttttattttttttctgaaaaaaaacatacattatacacagtgttaagaatcaactgagcgccttgtttgtatcataatttggcttttagttagtccatttatgcaagccaaattatttagaaaagtgttgagtggtttgctcgagagtcagttaaataaatatatatgtgcagagaagagaagtatcggttatttgcaagttactagcaaagaactatagcatgcagttcggtatatttctgtatctgatcagattttgggctaagtgctgtaaaaggtgcagatggtacagctgatgagattatcgtgttctttgatggttttggatggacaacatcaaggaggcacagtgaatagcttgacaacatgaagacatgatatggattcttgtatttttcattgctgtcaaagccttatggtgttaatctagaaaaaagcataagcaggagccaggtctgtgctggtgttaagggaggtgaccgagatgaatttggattgtatctcgtctatacatactgattggtcacgtgaagtgagatttggtgttggtttgcatgtgctgaggacgattagcgcatgcagtggccagccagctgaggattgagatatatttttatcactttgtttccttctaagatcagagaatagcattatacgcatacatatccatggtactactttatgtgccatatcctgctatggatattaagcactattattagtacaatatatgggctgttgcacttgccctttggctctgtttgtgcatgtcttgttttttattcctctatgatacaagagattctctttttattgggtgttttattttttaagtggtttatttatacttcatgaagggttaaattgaaccatattatctaaaaaaatcctcactagagcattaatcattggaataatcaataaattacttgagccacaattgatggataaaatattcttaaccactacttcttgctattgcccaaaatttgatattggcaaagaacaaaacagatcctacatctgtgaactgagcaaccggggtggcatcactagcacgttgcgcacgtacttacacttgcacagttttatcttccacaacaagagtgaatagccaatgcggtctcttaattttttttatgttagtttaatccctgattttatattgtccaaactccaaataaacctcttaatttatcatgtgacttgatatagtctctaatccaccgaaaccgttatacagacatgccacgtcatcctagcatacatagttaaaatcaaaatattcattctaccttgtatataccatagaaaataagaaagaagaaaggaaacgacaaaacataatgattatcatatctttgtgtctttatttactacatttttatttgtcctttttctctcctttcctctttatttctctttttcttaaaaaaaatggcataggtgaggataaaatcaaagttggatggaagtaagtcaatggatctcaatccgaggaaggcacataatctcattttgttataacgtcacacaaatataactttggataaaagcatatctaacaccctaacctaaacgcttcaacttactacataatattgttcatataacttctaaggttgttttgaacatgctgatttccgtatacagatactaaataaggttttggttaacaaagatgacaaatttcaggactaatcctcgattattgtgattgtatcgatcctcagttattggtgtaaaaaagagtgcatgggagaatttgacatatatcttgaatatatctactcctcagtccgaagataacttcatttctaacatgaacagtttattctaaaataagttcatttctagcctattataaattgtatttcttttataccttttattctaaaacactcgtaatactatttctttatgaaaaataagttcacttttatcctgttataagttttattccttcaatacctttatctatctacctactcatcaatactattttaaggattattccttcaatgtcctttatctatctatccattcatcagaatggaatgctattttttttttcttttgataaggagactttggtcttttctctcaaccttagtttgaagtttgaacaccaaagactaaaaatagagttatttttgaatagcgggagtgtggcgtcactaaaatcatctattgtacatgtaaaattagataaaaccgaataaaataattagataaaaagcactttagcggttatacgaacagtattatgaagttgatagagttggttatccgacttcaaagtatgaggtgttagatggacttttactgagggtatattgacttctccctatatagtaatttagtaacaccaagcaaactacattaagagaccatggagcaacagcatcactcttgttctacacactttcactgcagcaacaccacaaattaaacctgaatacatcagagttgctactgctccctaattcagtctgttattttggtgttcgcgttacagaaaaaggctcaacttgtgtccacagaacctgcacctttctcctcaagcttatccatggctgatgccaaatagttgtcacagtaaccaggtggctcatagataaagcaagagatcacgtctcgcagtgtcacgacaccaacaacctcgaagtcaccgtccacgacgtatatccggtgggttattcttgatgcaatgctgtcaatcacgctgccaagagaagcgtcaggcgaacaggtgagaggtggcttcaccaggccgttccctgaatcagaaacggtggaacctatggtcttcatgaactccatgacagtaagttgcctgtatggaagatttatcattaggaacatggaaatgcaaaattttgaaaatgactcacgcggtaacaaatagccggatggtttgatacctgaaattcgaaaacaagtcaggcctaagtaacaaaaagcgaatatcccttatgctcacactgccaacaagttttttgttgggaccttctactacaggcacaccaccaattttgttgtccttcatgcacttaaaagcttccaagattagatcaccactgttaacagtgataacctgaagaaagcacaaaattgttcaactaccagtttattgcaaagtgaagagaaaaaaaattacattgtagcatgtttcagcttgagatataacttttatcttgataatgtaggcagacatgatttctcattagtaaagaattggattagggagacacaattacctcatcaagtgacataaatggaagtcccaagtccgagagagggagcgctgaaatataatcaaaccaatcccttcctttgcactgctgaagtcctttaacaacaccagtctgagtaatgaagttcttaataattggcttatcaggctcaatcactgggacattccttaacctgtacttggatagcaacagtaatacagtaagcattgaagtgtccagtgtaatggggacaaaaggagaccagcggtaggattctacaattgatcgaacctataataatgagaaaaaaatatgaaggttagcaggatttacatcagaagatcatcatgcaatattcaaatgaggcaaagaggacagatatccaaactattattagcaacaataagttgcagctaagaaatcacaggaagttttcaatcacgccaagctgcggcatatattgtaactaggatagccaaacttcggtgtagccacacagcagaacagtggttcaaggtaaaatatataccaaataatttgagactgactggactctataaatgatcgacatttaacaaaaaggaaaaaaaaatccaaatatgcataataattcatcatagagtaaaatgcatactgtagttgatttgaaaggttcttgctgaagcagaactttgtagaaatcttctcctaaatgatcagcagcagttagtccatcctttgccacacccttttctgctgttaacccaccagcaacagcagcccctactgcagcggcagtcaagccagcaacagctgcaggaccagttgcacccaatgctgccactcccactgcaccgacagcacccattccaactcctgctgcggttgctgacccagctgatagagcaacggcggcaatctcagcattttctagaacccagaggatgatagccgagtaatcaatgatgccaaggtacctccctttccaatcagccggagctccacattccggatttagcactggcgctgccctaatgttgtgtttggagagaattctcacagcgtcaagaacggaagtgtctcctggaatttcaatcactgcaatgcaatgtgagggatcaaaaaaatacatggcgcggacaactagttagttaattttgtcttgcagacgtgtgtacctcggccattaggaacatcaggaaaagacgagacaggaatctgagcaaaggcagcagtgagcgattcttgcaaagagaggggcagcttcttcttggactgtatagtgtcaaaatacgcatcacagcttgggaatttcacggtttcatcaggtcgatccatttctacacaaaaaacaaaaaaaacaaaactcactcaaacattaatcccagtagatggcagcaatctggacacgcatctaatctaatcatggcacagtagatactcataactaacccaatcacgacaagccactttggcatatattagcaaagttcatcacaagttcaacggaggtacactattaatctactcctgtcaactaatcaggggctaacactcccaatccaatcctaacaaactgctactcttactctggttaggtccaattcaagaaaattgcttgcggatctggaagagaagctaaggctaacgaaatccgagaagaaaaaagaaaagggggttaggcgtagtgggtagtaaagaccgcaaagagagatgaggaagaggatgagcgtgagtacggatgcttcaccgggcgaagtggcggaagcagctgggacttccgccggcgtcggttgctcgcgggaggggaaggggatcgatcggggcgctgctccgctcggcggcggcggcgcgaaccgcggcgattgctggaaaccgtgggcggcggcggcaatccaggaggaggaggaggagggagatggattcgattgctagctagtactagtactacggtgcctcgcggccatgggggcgcggtgccacgtatgcgcttgggtggggccacgtcgcgcgaggggtggcgttttcgttattatattatattatattactatctccgttttttaatagatgacgccgttaactttttattacacgtttgaccattcgtcttattcaaaaaatttacgtaattataatttattttgttgtgagttgttttatcactcaaagtattttaagcatgatttatatctatacatttacataaaattttttgaataagatgatgatcaaacgtacatttaaaaatcaaaggcgtcatctattaaaaaacagagagagtatataattttattcttttttactaggccgcctacataatatggcccacggttgaaatagtccgccacatataccaggacacatataaaagtggaatatatttattggagttcccttaactttacaccaaatctgattttcatccttaaaccaaaaactagatatcatcggtccctgaacggtcaaaactggtacaaacgaggtccctcggcggttttggctgacgtggctggtttgacttgatcttcgtctcatgtggcatttgacgtggcgcttacgtggcaattttatcccaaaaaataataaaagccaggccccacatgttagctacacacaaaaaataattaaaaatagtggggcccccacgggtcccacatgtcagcctcacctcccttcttccctctctcttctttctcatcctcactccttttcttctctctccctctcttctttcctctcccctctcttcatcttctcttcccgcgggcgagccaggcaggcagcgggcggcgacctcggcgagacggtgccctcggcgaccttggcgaggtgacgacctcgcgtgccactattgcactccacctccaagccaccgccttcctctcccctcctccccccgccctcgccgccaccgatcccgggggttcaagggtaaacgtgtgagaaatgaacgagtaaacgtgtttttatgcgggtagtgagataggccacttacatcactacataaaagtaggtcaaccgctttgcagtgtaaaatacatcagagcttcagaaaaaaaatgatgaaaggctaaagtttgcaaatttaacttaacaaatttaaccaattcaacataatttgtttaacctagttacaaataataaattgaatttacataagaagttgagccaatctgctcatctggattcgagtctaagacttaaaaaaacaaacaaacaaatggaatgtcgttattcttgtatgtcaatgtcagcaattggaatttggatcaaaactaaggactggtatgatttgtgacctaaattggtcttaccaatttttaaaatgccaaattttggtaagttttgacatgactaattttgggaaggtaaagttgtgtttggattaaaggtaaaatagtctaagttaactattgaaatgacatattttcttaggcatgccaaaatttggtttcaaaccaaatagacactaaacactattgaaattgtcaaatattggtaagccaaatttaacccacgaaccaaaccagccctaaaaatttttttgttgtttaccacctgtgcattagtggtagataatttgtatatttatggatgctagtacagggtgtttgtcactcgtcagcatggaggagccaagttgaagagctctccggcacccttcccaccggcaacgcgcgcgctctgctcacggtcacggacgtagctcgcgacggcggccgccaccgtcgcctggaacttggggtcccagatcgccttcgccacgacatctgcctgaatagggtagtttctctggctccatgacgactgcgccgccggcatcgcgcgctgaagctccgaccacgtcgaagacgacgaggaggaggcgagcatggctaccgccgccgatgaggaggacgacgacgacggagggagcgcggcggcgtagggcgtgatggggtggttgtggacgccatcgtaggtggtgacgaggacggaggtgtcgtggttgcagcgctgcacctgcttcttcacggggcaccccggcgcgccggtgcaccggtagtagccccgcggccacgggttgcccttcgccgtcttctgcccgtacttgcgccattgacaaccgtccttcacctgtgagataaaattcaaaaataaatcagctcatctataccattgtactccctccttctctaaatgtctgacgccgttgacttttttaaacatatttgaccgttcgtcttattcaaaaacttttatgaaatgtgtaaaactatatgtatacataaaaatatatttaagaataaatcaaatgataggaaaaaaataataattacttaaaatttttgaataagacgaacggtcaaacatttttaaaaaagtcaacggcgtcaaacattttgggatggagggagtatttgcataattttttttacataaggctgtatattatgtctcaagttaatggtgacgtatgtatttctttttttaaaaaaaagagggaatatacaataatgaagcgtgcatatatgtctcaacttatacaatacttctttcattttatattataagtcgtttgatttttttcttagtcaaagttctttaagtttgactaagtttatagaaaaatatattaacattttcaatacaaaataagaatatcatcaaaatatatgcaatgttaaatttaatgaaactaacttggtgttgtaaattttactaattttctctataaatttaatttgttcaaacagaaaaactttgactgagaaaacttataatatgaaatatattaattggtcactatctatatgcgtgtgctacgtgcgtaccgtgggtgcgctgcatcgtgttctgagtacgacccggccaggccgattcgccgtcgacgcagccgtgatcatgcaagaccggtcgtcgtcgtcgtggcccgccggcacggcggcggcggcggcgccgcccccgtattcgccgcagatgctgctgctactgctgctgttggtggtggccctctgcctcttgggatgcaccattggctcgccggcggcgggggcgcaacgcagcgcgagggcgaggtacccgtcgccgccgccgttgccggcgtccgcttcgtctttcttgctggcgtggcactggcacgcatcaggagacgatccgaggctaagcccaagtgacaggaataacccggcctcgtcgtcgttcgcgtgatgccgatgaacctacagcaaaatcagcaatcgattaacctccagagatgtttaaagctactaaacagcatgtaactgtaataggttgacataattatcatcatatcatgcatgcatatgggcgttctctcggtcttaaatccaccaaatcaatgtaagtatgtaactgatgcttttcagaatagtttgttcattagtttctggtatatattgattacagagatctttgtcaaggtaacattcaaacattcatgcatgctaccaattaaatgtaaaatacacatgtaagagcataaacaaaatttcacaaaaagatgttcttctaataattattggtcaaattaatctgaaactatagggggcatatcctgtgaaaatatggcgaacagtaatagctcattatcttttatccttcaaaactcgttgttggagtttgatcttcagacaatacatagacagtaaaagtgtacgatatatgcctttccggcaacatgttgaaaatggaatttgcacaagaagtgcagaggtgtgtcacagagtcactggacatgttaatctccctagtagcaaccgatttgcagtaaaacatgtagtcccaacaaaagaattatatcatcttaatttctgaagctctgaagcatagaaaaaatcatctctgaatcaatgaaataattactgcatatatataccttctctgaagctttctgcacctcatccctgaaaagtgtaaaagtgttcatctcgatcaatctctgaattcagacagaatccaaaaccctttctttctcccactccctagtttttgctcctttctgcaataagccaataactaagcatatccctgcagcgagttctatctgaatatatagagggagcagcacctgaaaatgtcaaaagctgaccaaaatatccaacgaactgccgaattcaatctctgacagagccgccaagatgccgagggcaagcaacacatgcgtcaaaaacgagaataaactcggttgaatttcgtttagaattcgagacgtgaccgctttggtcatttcaatttgacggtttctcgctttgccgcacatccactcccacgccggaaagatgtaaattcgatctaatcctcgtgaattccatgtgcacgtgcgtgtccggccgtggtctcgtcaaaattcggtcagaattctgaactaaattaaactggttggtcgggtgttttttcttagccacaagctgggaggattatccctcgtgatggctacttgttaacgataaatcccgtgtgattattttgtagttttatcttttatatgctggtttggttagaaaaggagacaaatttgagacatttcgaagaagagtattcgctgtaccgtgttcaaagggaggaagtaggtttgagaataattctcggattgttgtgacatcagtcagctgcacgcgtaattaagggcttttgtttagaggctttcacgttatcaactcatcatcgtctgacataaagacggcatagaaaactcttcggaaggcacgagacagacggaacagcatagaaagagttttctactagtatgaattaattcagattgactaggcccatatacaaatacaaaggattattagttcgacaagactattgagtcttgtttttttcgcaccatggttatctccattgagagaagacaggttgtttttttttctttttctatatatcctctatatcatgagaggcatgtcgtggtgctaataaagataatatatactctttacatataagtcgttttgattttttagtcaatattgtttaagtttgactaaatttataaaaaaaatagtaacatctaaaataccaaattagttttattgaatatattttgataatatgtttattttgtgttgaaaatattactatatttttttctataaacttgatcaaacttaaagcgttttttctttttgcggggaaacttaaaagaagtttgactagaaaaaagtcaaaacaatttataatataaaatggagggaatatctatctatctatctatctatctatctgtgtgtatatctatcaatttagcaatcttctatactaactgggtactttgatggacctcctatgttaaagaaaaatatagatgttgattagatcgagtgcacaattatgttgtaccgcagattgtatttagaatgtgtcaatttaaacataaaactattgtggactcttcaaatttacttaacatattagataaaaccagactttctatctattacaaaataataattattaattatgtaattattataacatataaaagactaattatatatcatataaagtctaaacgtagtacaactttatttaataagagcggattgtatttttgggctccattttataaattttactttggaccaccatttagctaatattttcaattgaataaattgtgctttgagttattttttattatcaaagtatcacttttagatcaccctttatcttatccttttactttggactaaataattgtctttgttgcaatttaaaccacccccaaaccttctttttttttcaagtataccactgcaggggaagtccctacagcatcaccccagaccattttcttcagtacataaaaaaccttgagcacattgactacaactcaccgataaactccctcatccatacgcaagatatatctttgttggaggagcggttagtcatagctggagaaaatacttggggttgatccaaagtgcaaaaaaaaaagagtaaagttaactagtcctaagtgaaaaagaaaaatatagtcaaaaggtagtctaaagtgaaaccttgataataaaaggttagcctaaagcacaattcactcttccacttaacttggttattttgcttatgttgcactttggaacatcccaactctctgctcgagcacatcaattacttcatgcacatcggtgcccacacattagggatcttccccacttgcgtgtatgccaccctttgttggaggagaggctaatgtggctaaaaaagagagttataatggtctacaacaaatgcaaatttgcgtagtccaaagtgaaaaaattaaataaaatatggtccaaagtgaaacttagataataaaacatgacgtagattgcaattcattcaaaaataaataaatttgctatgaacatgacctaagttatgaagcatactaaatttaaactttaacacaaatacaattaaacactaattaattcaaaaatatttaaataaaacataaaacaatagaagatacattaggttggatttcgaattcagtattttattcaattctaaaaatttaaaattaataattagcaagtaataattgatgtgaactattattttaatctaatcatctataatttgaaaattttaattattgtattcgacatatgattaaattttaatattgatattactaacactaatatataactcatgcagcacattagttgacaatcacttattgtataggcctattgtatataccctaagaaagacacataagagcatgtgtagtgcggaacaccaacccgtctccccagaacctgccgtcctatcgccgtgagtttttccttaggagggagagatataaagttcttttttctatttctatggccattatttggtccaacattatagtgttgaagcttgtttcattttgccaatctataatgttcaatttttcataaaagcaaccatccagttatttctcaagctaacatttattttaacatcaaagtgaatgaaatggttgacttcaagcaattgaaggatgcacgtgcatatttgtgataaactggctgagtaatgaaccctgtgacatgagagtactcttggtttctatttgttacctttaataagttgacaaatgtagaatgaaccagagaacagaggggctggattgattagcatttaattaagctagggatttgtttgctataaacaaaacaaatgataatttggtatcgaccacgtgaaaattgcatcattggtccattggacatatacatgaatggctggtccttttcgcaaggtagcagtagtgtattagaaaaacatactatagataatgcgcattcaatttaaactgtttagtcaccaagctttggcccttccttaaaataaaatcaaaccagaactgtttcgatatatgagatgacacatctgcaacggtagcttgcgtacactcaactatatagtaatagagtaaattaaatgtcaaaaaagtcgtctggtattagttctctcggtgcaaagacacatataatattctttgatgcgtacctttatgtgttcctgttggttatctctcaccttgaaggaattaatttattgaatcttgtagaccatggatttttttccttaattaatttatacatagtatatatgttttatattgtactagctgaaaacacattgtaacatcctcaaattttaaactaaaatttgactgcatcatgctggcttttgattaaatttgtttggttcaaaaatctatttgatttttatttaaaattggttcaagtattagagcccaaccaatttactctaacttattccctttattctaaaccctagtgaatttgagcaaattctctcaaattcaaaccatagattatttctttagcttattctaatattagtggagatttgctatactctaaaccctagtaaaacctttccaaactcctagtttgaattcaaatcttttctagggaaatattcaaaaattttgatttttcctgttcattgcacacaagctgctcgataaaatgcttagcccaactagagcagcccaccttcaacttaatcttgcacaaagtctaggtttggtcctaggggaccacatcccactcaaaaccgtggctttctttgcctcttactccccttcatgcgcgccgcccgggcatccaactttgccgcgcgccgtgtcgctgcgcgtcggcctcggggcctcttgcgcatgcccgaccgccttggcgcgccatcacccgtccgacgccctccgcccaccgccgccgcaccaatctcgacgacgacaaagccgggacgacgaccgccgcacgaaatcaccgctcgacgccgtgcgctcccatccaagccaccgccgaatgtgattttgcttctacccggggtgaatcgcgccaattcttgccgcacggttggattgaagatagacggtggtatcccctctcacaattcaaaccattcaccccctagccggccgttttcaccctcgccgccgccgcgcgtcgcgcccagattggcgccaacacgtcgccagccgattccaaccgcggtcaagtcaatccttcgccggtaagtattcgaacgtggcctcccgccactcaaatagatcttgcccgccctctctcagcctctgccacctttgcctcatccaaatctcgagctcctccatggcgatgacggtgcccgagctcatccgctcctcctagccctataaataggaccccaatcccttccttgtccatcatcgatcatcaacaaccatagccccacaaccccgaagctctgcttcaccaatccatctcatcaaccaccctcgcctgtcggtcgaacaccttgtgcgcgatcgactccacccctctccatccatcttccgccctaaataacccttagaacacctatattctaccatgttctagcgtattaggccctaaccgaagctctgcgtcgagttttacctcgccgcaccaagccaagcaccgccgcccctgcgctactctgttcttctccgccgcgaagtttttccggccgcaatccgtcgtttcaatcgatctcggtgagttcttccgtttcaaccatctacatactacctagagtccatttttgcaatcggtttgcactatcttgccaccctctgagctgccgacgtgagcacggccgccgcctatggaggcgctagtcggcaactatgctccgcgccttgccaaaggttggcaagctgccggaatccctctagacacctcgtagatgctctagaacccctcccctagccatgtctaactctcatcactctggtcgccatcacagcctaaccgtgccaccgccgctctagccgctaggccgtccacacaccaaattagttccatcgccgccgctcgccgtcgccggagatccctagctccctcccctcctcggccgcaaccactttctccctctagtgccgccgcaatcctaaaccctagcgccgccggcccgatttggggaacggccggaggtagaagaagaaaagagagagagagactgacaggtgggacccacatagtgccatttcacatttatttgattttcaaactttagaagaccatatcttttaaaatatagatccaatttcattaaaacttggaccaatattcttctaaaatcatcctctatctactagacccctttttgctatttttacattttattttatttactctatttttcttatttttggattttatttaaactcctttttgaatttgaattttatatgtctaaccctaggtcttgaggattcctctgacactctagataatatcaatcaatctcaggacatcgagcaaggcaagttaccatatacatgttgatcatttcagcctatattttacaaattatttatttatagccttctattcaatattctattttctatgcataaattaatcatagaaacccagataatttagtattgcttattttgtttacaatctggttaaaataccctatacttagattgggacaatacgtaagatttggatgatttccgggtggctagtattgtctcaatcgatataagttttaccaggtacttatgtcgaatgaacgagtacgaccgcagtttctagaatggggatagacctagttattaggttaattggcaatatggcacctctgtatagtggttcttatttttaagtcctcgcgcaggaggcaactatagccgcgaagggcaactttaaccattaccatgtacaggtaaatggcttgtgatactcgagtataaactatatggtatatttataaaccctgatcgagatgacgtggtgtcatacgatcagttccccttaaatacctcgggaacgccagaactcctcttgctgctgttaacattatgttcagagcatatgaggatataagttcatggaacaggtgccataattgttaatgacttaatgttgggctatgactaaagccgataattatcagcaagtcgtggactgcgggtaaagcgtacatctgctgcagtagaatatctttgaaactattcgaatagctgtactcgtggagttgagtaccgggactcatatggtaccctggttagaaatctaaagtttatatgttttataaattctgctataacttttccagattgtctaatactgctttttgcaaagaaccctattatatgtcaatgcataacatattttcattataacttgctgagtattgtgaatactcatccttgctcttataacccctttttcagatctgggtcaagaggaggacccatatgactattactacgaagaccccgataacttagaaaatccctgagggttttacctcactagtcagaatgtatagaaacttccgctgtgtactaattagataggtgagtacctattattgtaaaacccttagtattgtaagactttaacatatgcaatgaaaaaccagttatattgtatgtatcaatttttaatgatccagggattgatacattaatctcagtcggatccaagttattagttttgggctccgacacacatgtatgatgtgacaaacactacaagaaaattggtgctctaatgaaggtaagtcttaaatttgctgttcatataggccgtctgaaaatgaattgttttattgatctgtacgtgctgcctttctatatatacagctgcctactagtttattttgagcaattttacggtccttaagtagataccaggaggtaaaaaaaaattagtataaaatttaggtatacctcgtagtaactagatactaagaggtaccaattttacaatagaaaaagttatatcttatattatctcctcaagaaaccgtaaaattgctcgcttaccttgtgtagtcctaacaaattaatatatgtattatctatctatccatatatctgtctactagtagtgtatctattagctagttttatgtgttctacacttttatgtagtcttaaaatcaaaaatatgtattatctatctatatatgtatttgcatgttagtttatctattattagtcagtgtacatactttatatagtattaataaaattaaatatatgtatcgtctaccttactatatgtctactggtgtatctattactagtttatgtgttttacacttttttgtactcttagaaagcatatgtgttttatctatctatatatctgcctgttagtttgtctattagctactgtacacgtcctacacttttatgtacgtagtcttatttttttagatacctactatctttttttttagataatgacatacctactatctatctctatatctttcttgaatatctattagctaagtatagatacatgtattacaattttcggtagtaaaaaagatcttgccaattatatgtttgctctccttatggtgcatgctccgatcatccgtctttctctggcacgagcgctgcatgaaggcctctcataatgagaaaaattgggaggccaaacaaaatgaacaaaacccttcgaggttactctataaacacttatacgttcaaacatgcacaataatctcaccaactcaaaaggtgggaccacctctagtctaaattctttgttggtaaggaatcaaatactggataattcatttcaaatagatactcaaatggaaaatttcgataccaaagtagatgctactccctcgttggatatttagcaaaagcccaattttgtataggattagggtatcttattagtaaccaatttggacctatttatcatatttggatattcttgattggtttggtggttattacatttttttttgcgagtgacatacttgtagagataagaatatcataattttggtagagatgttgagggcgctcacaatgcgtcaccaatttttgccgttcctcatataccacatagacgaataacctcataagcttcatactccacggtgcaagtaccagtagtgggtcccactaatacatcttttcacttttcatctcccaatctctcaccttcgtttcttttctcacccagtactctctctcaagtactagtagtggagcgaccggcggggcggcccgagcggcgacgaccggcggggtggtcgagcagcggctcgagctgcgcggcaccaggcggcgaagcggtcaagaggacggcgtggcgggagcaacggaaggaatcggcgcacgagctggggaaggcgatcgaggtcggcggcgggggccgactaggtcggcaacatggacttggcgcgggagtgaggacggcgaggtcaggagcgacggcctctggtagcgggagcgaaggagggcgagctcagcggcgtggaatcggcccgggagagagggacagcgggcggtgcggatctggcgcaggagcagccggggccgcgacctgccccacgacagcgccggtcctctgcccccgtcggtggctctcccctctcccttctccggcatcgtcgggcgaaggaagccggcaagcttcttcagccccaccaccttccccatcgacccagcgagcatccagcggccctcctcccctggccgacgagctcggcgggcgtggagcgcaacgatggacaacgaggtctctctcctccctctcccatccttgacgtgacggtgcggagcacgagcgtgggtcccacctgcgacgaggaacccgtggccaaggtttcctacgtgttcttgaggaggccgcgcggatagaggacatgacaacgaatattcgcctttttggttgaggccgaacgccacgaagacgcactgtgaatggcctgagaatatgcgtttttgcagggggcatagataggagaggcgagcggtggtttagcctcccccatgtcttgaatttttcactagctaaagttactgtcactttagcaaaatttgaaaaaattaacattattgatcccctcaattataaactttttaagttctagctccacggctgctttttttttttgtgtcaatcttttcgaggaacacttctacgtcatcgccaacgtcgaatttttgcttctatacatgcatagtatgcaccactgggcacgcatcaggcagtttcaattcgcctctaggcttgacttgtcacaaatgaacccaaaaaaaaaagaaagattgagcataatcttcaggtgtcagagctgacgagacgacagaaggaagttttcaaagaaagagtggaagaccaaacgattgaaatgcttagctagcagatgcagtgcttctatcttctggttctgcccttctcctgcagtaaaacatggatgctttcgtgctgctaaatgataaattattggtcaaggtagtatttggattcttgattgccacgaaattaactatgacttcgtctgacggtcaggatttcttccagggatctattctacggatatgtattctagtattctacggttgtatagaagagaagaatcttttttgcagaatagcatgtatcttggtatagaggttttactggtcaattttattgatcattttactgtttcaattcagagtccacaatttggagatttcctttcggtctttatttaccctttgaaatcagttacacagatttaagaatcttaaatcgtataatttattatattaccaagaggtcgaaagggacttaaatagattggatggtgggtctaaattataacggtcgcgtagatcagttgaatagttgatataattataatggatgtgaggtcgaaaatatatgtttgaatcaaaacattcacttgaaaaactaacataggaaaaaaatagagttgtcgataaacaggacacatagtttcaccacaaaagattattcaaggaaaaaaaataatgcttggtacacaaatcttgctagcttcttaactcacatcctttgatcactctccctatctctttctacgactatgcatatctctataccaggcaaagaatatccaaatttctgatggaagatttgcatgccctcaacataaaaaggggatcaagtcattgtacttggcttcacaagcacagcgttcatattgaaagtgcaacgttcttttctcaaccaatcagatagttcatcagtaatccgcctgcttactccacctacggttaaaaaaaagtcacacaaattagcaactaacatttagtgttcaaatattacataaacttagctaatacaaagaatttggttgtgtatcttatggcagatatcgggggtataaaatatttataatgccaaaataactagtaataaatagaacaaattggaaaattttagagcttacgtggcgaaggacacactccatagtatgagcagtcccttccttcaactgaggaatatggtgggcccatgacatcaagcactgcacaagcagtttctgcagtgaagcaatgaaggtttcctccactctctgggtatagaaccgttgtcttagatgaatcatcgtagatggtgttagttctcaccttagcaaaatgagcacctgtattttagaagactggatattagaaaaaaaaacttgtgaaaaaatgtggtgtaaatgggaacatgtgagagagaaaaaagagtgaatatgttagcgagaaaagcactcaaactaaccatctatttccctgcagatacgatttttaccattgggagttttaacccagtcatacgactttatgtgcattgagccatgaagaatcttgctaaagacagtcatccctagatggtcatggagtggaatgacagccgattgtggtagacaaaacacaccaaactacaaaaaaatgtgtaaaatgtgtcatctaagtggagtttacactaaatagacacattttccatgattcaatgtcaacaaaatgtgaagtactaaattaccgagaagttaagactatcatcaccaaagtgcacatatgttactttaggatgcccttgaggatcagctctaaaatacggcatgcttgcatcaagcccaaaatcctctagcttcaaggtatctgcatcaatggtttaatgtgttgatttgtgtgaataccacaagtgcatgtagctaaaaattatgaattggatttcttgaaaacaattatcaattggaagcaaaacgtttccattacattcccaacaaattctcatatttatgcagcatccacaagaacaaaaaatatatatgtaacttcctatatcagatcacataattagatacacttttagctagcatatttcaatatgtgcgatgaaaacattgcatagtaggcaattacaacaaccattgctatcgcaggaaaatgtccatatgaaaagagacgcagtggacaatgcaaccaccaataaaagatcatgcctgagatttatggattaaaatcttgtaagaatacgtgtatgaaataaaaaccactaaatcaaactaacctccataaaagctcagagtatagtcatgctcatgcaaagctcaaagtgacgggcatttctagatataagatggtatgcgcatgatatagatgcaaagacaagaagatgactgctaaccgagcaacttggtgaggtttgcctcggctaacgatgatggaacaaagcctggcgtggctgcaaagaacacatccctagcgatgtcatgcacttcttggatcttgttcatcgccgagtttggcagttctagttcttcaagagaggaagtaggcggtttcttctgacggcgggtggtcttcttggatgatgagaaggatgactccaaaacacccttgctccctgcccgtttcatcgcgtaacagacctagaaaaaaattaaatcctacaattccaatatagaaatgaccttttcaatcaccaaaactataaacaaaatcaccaaaagaatcaacaagaacatgaatacgattaattaaaacctaccccaaaaggaacccaatgattgagattgtataagcggcgaggaaatgaggcaattagagtaggcacaaaggtgaggaacggccgattgggtatatatgagcgaagggtcgcatatggtgggtttggaggaaggagaaaactaggggcgggctgtataggggacaaaggcgagattgccttgcttcctctagaagattccattttctgtgggctataagaacttggaatccaaaccgctggtttttgtaaacttacaattaaccattcaactatatcaacattttagggaaatgacctacttaagcattaatcaataaactccaatatgtcacatcaaggtaaatcccaaacctcacttaacactaccccgaagtatcacaaatttctagttcacggccgatttgcaaaggtagcccttcctcaccatactctggttgttattcatttgagaatttcattattcaattaatttcacaacactacatactttgacaaaattatcaccaaaactgtaaatttaaatcatcatatcacaaaaccacacatttaatgtcaaacctacctcaaaactataggttgaaggcataaaactataaaatttagcatatgatttatctactatagtaaaaaaacggagtccatccgcccacgcaatgggtaacccactactacataaaaaccatccctagagaaaaaaaaagaatttgatccaatcctacatgaaaacgaactcagaagcaaatcaacccttcacatccacatgtaaccaactaggctagagttacttataaaggtgtgtaaattttggatttttgtttcaaggaatgaccaattaactaggatggagcttttaaaattcatagttctgtgataaaaactaacactaaatctgtaattttacgactctatgacttaaatatatagtttcttggtaagttcagcaccaagtttgtagttttgtgatgcaatgggttaaatatgatacggcttaaatatgcaatattgtggtagttttatcaaagtatccatagtttttctaaattttactcttcaactttattggactgaattttggacaaaaaatattggactaatagttggtggaaacaaagtggtggatctacagtaataccactggtgtcaggcgacaccgacgacttttggcaaaagctatgcttaaactgactatccatatattataacactatattctaaatgtaattagcatgctatgacaccgataaacacgttatgacaccaacgaactaaatttctggatccgccagtaaaacaaacacttccggtagtgaacacaggaagcaactccaagttcgtaacaagtgcagcaaatcaggaaacacttgctatagttgagtctcatgtacattgttaggtccatgattagcttacatatttgacgttctagataagaatagcagcatttgaggtggtcagtggtagcggtggtagtgcatgtaatgactactgctaacagcatcaaatggaggaaaggttcatgttttgtatgttatttttttgtgcgtgtgtgtgggatcaaggaggccgactagaggggggtgactaggcggtttttcaaacttttggctaaaaccgagttttgtatgtggaagcgtaaatcaaaatggttttgcacaattcaaaacctaaatcaactagtctcaagtaagtgcacaaagaagctagcctatgttgaggtttgcaagcctagggtgataatagcacaaataaactctagtatgtaaacttgctcaaagtaaatttgcacaaaataaaggagacaagagacaaggaattttcaccgaggttcggaaactcgccggtttcctaatccccgttgaggcgagcccaactccaccgctcaaccacgaagccaccgcacggccccttcgtcaaggggtgggcaaggcgggagccggcccacggagaggactaccaaagcctcgatcactgggaaagttctatcttcactccgaaggtggtgaactcaaaaccactctcaactggcgccgggcctcctccacaatctcctcggagaggtcaccgggcaacacctccacaagccgtctaggaggcagcaaccttcaagagtaacaagtctaggatgcttgccaaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttgcccttgctgctggggagtgggtatatatacccccaaccaccaaaactagccgttggagtcgaaatccccaactctatgctctgccagtcagaccgccatagagtggacggtcagaccggactactttgtaacggctagaaaactagtagttacagggcaatcattgagcccactcaacctggccggtctgatcgcagtgaagcggccggtcagaccgtccacggctgggtcagaccgccatcggctcggtctgaccggttgcggctctggcggctctgtatcgccaccaaaaaccagaccagtgcaacagaccagtaggaccagtcagaccggccttaccacgccggtcagaccggctaacagccccggtcagaccgacctaaggcccacggtcagaccgctggtcacttttcaacacaactaaccgttagtaagacggcgatatctcttgactcggatctcggaatttggcgttctctgactctatggaaagcttattcaaagggctatccaacccatgaacaatccatccaagaaacacaacttttctcagggagaaatggctcacactccaaaggatactccaccggacataaccacgtgaggctacccaaacctataggatgtgcccacttctctctttgtttgggacttgataaaactcaccacacttggctagacaagcccacaaaatgcatctatatgcatatgaactaatatggcacaaaatcatccgcatgctcgcttcatagacccctcttgatagtacggcacctatctagtaaatccggtctacaccaaacaccaagaccggcaaaaagactaagaaaatattcttagctccattatacctttgccttgtgccatccaacttggggtcaatgcttgagccaacatcaacacttgtgaccattcggttgaaccatgtttatgccgaggtctttgccatcctttgtcaagacttaattctcatcacaagcttgacttcattcttgccaacatgacgatgtccttggcttggtgaccattaacccatggtgtcattcattagcctcatcgcaattagatctattcctttgcacggctcaaaggaaaacgttagtcccaacaaatcggttggcatcctccacttggtgaccaaccggttgcatatgaaagatatggatatgtttgttgagtattcattaacatcataagtgtcatatactcgtatgcaagctcaagtgcaaagatccgatatatataataggtgaacaacatggatctaaaacatgaacaataaatgtataggatttgctcccctaagtatatgcatacaaagaaatatacaagagagacaagtgtatgcataagtaaagaagaaccaatgggggtttatcctatacatatagagaaggcatatgtagtaatgatgaagataaacaaaaaaaacacatatcttcatgatctccatgttctcaatgcaaaggagactaaataagataagactcaagtaaacattagtctcacacttatataacaataacatggaaatcatatatatatgaacctatcaaaaagtaggagataagaagtgatacatatcgctttatctccatgaatttcatccttgtcatgattaatgtccatcaccaaagaatgcatatctaccacatctcattatcgggaaataaccttgttgaaaacttatgtaaaagagaggttaatcccataaacataggtttatcatctatcaccaaagtaacaattacacaaattgtttaatccaagatctttcaatcttttctctcttttgtgatagataataatccgatataaacaatacaaagagatgagatgaaagataatttcaaatcaaggttgagatcttataatgaacaaaatatagaataagctccaccttaagatgtgcatacatatggatatgaaggaatgcatatgcacataatcaatcaagatcaatgagggagctcacactgtattttggatccacaagagagaccaagttagaatatgtgaagtttaatacatacctcccatcatttttactttcatatccaaataagactagtcaaagaaaggctcataaaaacgttagtctcatataattagatttgtcattaatcaccgaaaccaaattaaggcacttgaacttacaatctccccctttttggtgatcgatgacaaatccattaataataaccacatttggatatgaaggatataaaccaacattatattgaagcttgacaattgaattatatccatacatgtcaatgagtaaatagaagtgaaatatatgccaatgacatgcttatgcatatgatgcatatgtaatggtatgatgtgggatcctagaatatttcccccttttgtagctatgatcataaggagatcataaatattctctccctttaagatcaaatgtgggatcctcaaatattctcccccttttggcattaatcacccaaaaatgaaaagggctagaaaataggcaattacaaaagcccaaaaaggaataaagactaacaaggccaaataatatttttgtgcaagcacaaagcaacaagtttagaaatgacccatttaggaaaactcccccttactcatagagtcttgtctttgaatatggaatttggaatagatttcatatgtagaaggggttagtttgagcacttgaactttcacttgagatattctcatcaaaggttttctcaagaatgtcaaaaattgagaagagcttggtcaaggctatttggaagaattttacaagtgcacaatatcggcaaagaatgaaaatgatgagatagtgccgtgttcaagatgatcaagataaactaccatttatttagagaccacttgtgtataggaattcgaattctctatgtgtataggaattcgaatttgggatcaaggaacggtatttggctttagtagcaaggattaacttgtattttggtggaaatgattggaatttggagtctatccttggaggcttggttttgaaaagtccaaaaataacttttgagtttaggtggtttcatatatcatgggcatttcaaaaaccaaaagagttcaaataaggaacatatccaaaagagctcaaggatcatgaagttttcaaaataacaaagagctcattacttgaaacttcttatatttcaccaccatgctcaaataatcaacaagtgatatgcactttgaaatccatgtttagctgaaaaagcacatagcaatggtggcatcttttagcaatagaaacttgtggaaccaagatcggaaaaataatccataaatcctggagatagttcatgtaaaaatgcaaaaatttcattttggggtcctttcccagctctcaaccgaattgaagaaacaaatctcacaagctttcagccaactgaaaatttcagactttttcagatttttggagactgaaaatgaggttgaaaagacatacaaatgaccacttaaaattctgagtaaatttggaagtaaacttcaactattgaggatcaaaattcatattgtgatcttcttcaaatttgcaacccatttggagatacaaaaatcacaaatcagcccaaaaacatggttgttctgaaaatttcagcaagctgagcaaaacgagaaaaagtcaaaatctttgcaaatcaaatagaaatgagttgaaaccttgcagatttgatctttatacttgtgaggaacttttccaaaaagaatttcttaaaaatcatttttctatcaaaagataagacaaaaagagcattgtaggcctttagggtgagtaaatttgagttgagagctcaaatcacattcaaatttgaaatcgatggattttgacatttgtaaagccttaggagggttatagatacacttccaagccaagattcacaaagaactttggctctaaaggcttaacacaccataagcaagtttaggcgaaaacggtcaagtcaagatttttgctgaaattcaaatggttgtagagtttgaatggttggtattttggaaaaactttgaactagagaaatgtttgaaatgactaactctaaaagttttgtatagaaagattttccaaaaactcaatagattttgattgagaaataaaacattttcaacaaaaacaagatcctaaaagatcctattgagaccaattttgctattttgcttcacaaataaaaatttttacaccaaaagccttgcaaaacatttgaaatacatattaggatacttttgaaaggattttcacaaatttgggccatttaaataagaattttgacttttgaccaaaataggctcttttgaaaggctataaatgtaatcttttggaaaattcatgtttaggagcaaagggaatatgggtttgattcagattgctcccccttgatgcaactctcctttttgcttcatgaattcaagatttgatactaaaggccaagtttgagaaaaaggctacacaagctctcttttcaaatacattccttcaaaagtgcaaaaggaagcaaatgagatgatatttgagagaaactaatatgcatgaagttcaaatatgatttgagccaaaaagatgcaattattcaggtttaagaaaataactcaaccaagtgctagaaagtgaccatatatggtctagttaaaatttttgggagttttgacatcaaatttcttttaatagattggtcttttggataaggttcaaaaaccaaaaacatttgaaatcaccaactctatctaacttgttttgggctctttttcaaattccctttagaaatccttgtagagagaaaaatagttttgctccaaaataagatcctagaaactagaattttggccaaaaatgcattttcactttacaaatactttttcttgcaaactaaagtttggaaaacatattagagaccttttgaaacattttccaagtaatagttttcaagaattatagtttttttctcaaaaaattgacttttggtcaaaatgggccttttgaaaacctttctaccacttggattactttgttcacattctaagggttgtagtgcatacgtaagaaatgcaatactttcccttaatgtgatattcccttcaacccaacaaagataagcaaatagacacaagatccaataaatatcaaataagattgacaataagcacaagatgataaatatgttgcattaatatgatcgagcctatagcttcatatgccactactcattatgctcaacatgcatttatgatgactttcataagagaaggaaatttaattttggaactatgagtatgcaatgcaacatacacaaggctatataaaaaaaattacaaaccaaaagcatgttaccgagatggcattggtccttgatgtgaattctccatcctcattattggctccaattcttgaacttggtgagaatcacattttctcgcataggccaaaactctaatgcctctcatgtacttatattctcattttggtgcattttggtccccaacaaaattgggtccatcaatgttagttaccaaaatacgaggcacccaaatggtcctccttctagatgcaagtctaggtaaaccaacatatctagcaaacacattgccttgcctattttttctaagcacataatcatcaaaaataatattaggcttaggagtattacctatgggacaatttttaccaatatgtccctttttgcagcaattgtagcaagttaggttttggcctctatgacttgtctttttgtcttgcttcttgccggtttgcctcaatttgaagttgcacttctcatccttcatgtttgtgcacacggagacaaagtgtcccttctcatgacaaccaaaacatgtaatgtgaggatggttcttacttacatttttctttccatcctttcttaagtatgcatgcttccttgcatatttaggcatgtgccttgtcttcttagcattctccttgcgatgaaagctaagtccacacttgtcatttgagctcttttgcttgcttaggatttcgtcaagtgagttcttccctttgtagcttctatccaagtcttcttttaaatctttgacttgggcttgtgattgcttgttttcctctacaaggttagcaacaacatacatagaggaggaagaacaagaattttcatctatgtttgagctacaaggtacatctaacaagtcatcacaagaggtggacacactagccttagatgtactacatgagctagctacacatggcatatcatcatcaattaaattacatgtgatgcctatgtccacctttagcttactaaatgcattgccaatgagaagagactcataagcttcttttatcttcttataagaatcacaaagttccttataagaatttattagctccacatttgagtctttcaaagagagaagagttttctctaaaatttgatttttcttcttctctttggcaatgtatttactagcctccctaagcatgtcaaaaagatcatcatatgaaggttcatcatcatcaccatcatcatcaacaacacaagtattttcaatagtactatcgagagaatcattgtttacctcattcttaccatttgtcattaagcaatgag

SEQ ID NO: 81813 - DNA, 21108 bp, Oryza sativa
aaagaactgaacttgttgagcatgttcttaatgactgtgacattgttggtaaaattcttgccgcggaaaaactttcttctttgtcaacagagtctactggggtaagttgttaacagtctgtggtaattttggatgtaataatccccttacatcatttttgtcttgtgtgtagcctactataccttcagatggtaaatcgattcccaaaattgggaatattggtcacatgacaagaataaccaacaagcttattcagttgggaagcagtaacggcacaatccagattcacttgcaggtgatatttcctttctttccattgactcaacagtctttaattttttgaactatgaagtacctgagttctctgctcactgtctcgaattattttttaacaataggaaaatagtgagtgggttgactggcaaacagatgttctagtcaagcgtaatgaggtggagaatgtttatcattgggcttgtgggtatgtgactgtttctttttttgattgcatgctaaacttgcatgtcttgcttctgttttttcactgaatagtttatctatatgtcttgttgctgcaggcgcccaacatcacttcatgaccgtggtagggatagtgatgatgatgacttccgagacagggattatgatgtggcagctcttgctaataacttgagccaggcattccgatatgggatatatagcaatgatgatatggaagaggtgtgtgttttgaatgattttgtttctcttgctttgatggtttgcgtcagtcaacatgtttctctgccagcacattttgttaggtttaatttgagaggattctatggtggataaaatatcattctgttactcgtgctatatattatctacttgagtgactcaccagctctaaccatgttccagttttgcagttccttaaagccttactataccagatactaatgatacttgtttgtttcttgaatgcagaatcaagggacacttgaacgggatgatgaggtatatttaaggatgctagtttacccccatttattgcttttttgttcttttcacctggtattaagttcaatttgattaaaattcagtatagttcctaaatgcttgcttcaatcaaccatgtaaaaagaacagaatgttgcatgcggataatatagtgtctagaaccatatttgttgaagctgtacttttgagtgagtggatttccattgttttctcctttcaggatgtctattttgatgatgaatcagcagaggtcgtaatatcttcactgcgactgggagatgatcaggatgggtaatttgtgatcttaaaacatactttggtatctttggtttttttgtccttgggctaattatgtgtttatgtatttaaaagcagttccctctttacaaattcgaattggtttacatttgatggagagagaggtattactgaccgtttggctgcggttccttcgtcttcacctaattcagaggagatttccccagacactgaggaaactgatgatggtgaagtcgtcattggtactgaggatcatatggatactgtcaatcttgggaatggtcctatcgaggaggcagaagatgcagcggaatttactaaacacccggctactagcacggaggatgagcaactacaaaacgctgaagggattgagcgacacctggatgtttcaaatggtgatgctgaagctagtacagaagctgcagaggcagcaccagtatcttcagccccatcttctgatgaggtgcagacagagagaactgcagatgaacccactggctcatctgattcgggtaattctgtctcagaagttttgccagatcctgaagatagtagcattgatccagccaacacagcagtatcgtctgaacaaactgtggataacgaagacgtggagttaccaactaaggaagttccgtctgtggatgttgaaactaaaaccgatgaaatcaaagcaaatgagtgaaggggcaggaaatctcatgggctaaaatggcatagttgaccagaacagttgttagtcagatcggtcagaaagacaagcaagcctcacctgctcatcaggcatggacatgtccgaagcaaactgctgtacaataaaaagagtgtactatttttgccatccattgtggtctatccctgtacaaaaatgatcaccatcatctaaccgcacgctcgtcatcgcaacatctgaaactggtcaaaatttgtttcaagttcgcctccagttcatgggaaaaataggttggtgccaaacgtcatttgtcagttagtctctgtgtcgtgtcttgatatatggaaaagaacattctttggatggcagctagttttgtcaacgtggtcttttgtttccttttaggtttaacactttgaactgtaatatgggatgtgctatttatttatagcctagctattatttgtaattttttccaacatgacgtgggtcagttcaaatggaacacgtcctttttgataaaaacaaaatttctctgcactcttacccatttggttttcgaaacgatttccacatcagccttttgttatgttactacatcactatactagctttcatcaaaatttggacaattttatatgttcttgtacagcccttttaaagagggccaattgatcttcacttgagcttacgctgctttctactactcgactccccgggctgcacattgcacctgtgctgtgtagttcctctccatgaggcgctcttcctgctcgcgtggatcgtagttgagggcgccgacgtcgatgctccggtggcggcgctcctcgaactgcttgctcgccgccggctccggcttcaggttggagaggttctccatggcagccatccttatgccgtctttggaattcgccgtgttgcggttgcggtgcttcgtttccaacgtgtaatggagcttgtactcctggctcttgtagagcacgtccaaccgccaatttccttgtagttctcttgtagaacgtgtaatggtgcttcggtatgtcgttgggaatttccttgccgatggccaccgccatcttcatccatccacggaatttcacaaactggatcagcattgccatcaagtttggatcaatttcgcaagaaacatgaaaacatatctaatctctcgagagaacattcttctgtaatctctttctcgataatctctcactcgttatttttttaacattcttctatgtatcggtttgatacctctctcgctaagcgctcggaattacccgcatgtgtgccggtgcatgcgcatgtgcgcccggccataaccccggctggcaagaggtgaaaaattagctacgttcctataatttcctctctttttatccttgttgttattaggccggtttcttgcatgttctgctacatccttatagacttgtttttttagtaatttccttgctcctctaatttggatgggattattattttgtttgcgctctcagtctagcagtatgctacccgcatgttaaaagaattattaatcggttttgctataattgtggtaacacattttttatggaatcagagtcaaattttagacagttagatttatgtaagatttgtgcatgcgtacgagggccactgacttggttttttggcgtcattaaacaatgcagtcagtagaagaagcagaagaagcagttgtattctatcaaacaaaataacgataatctgtctggataattaattaaggtttgatttaatatttttttcatctcgatttgtcctcacacttttgcatgaagagaagcaaatccaaacctgagtcattaaatatgtgctttgctttctccttacccgagctaatgttgctcatcttccggcacattacctagtagtagcaaacattgtccaaggctacacatcagtggaagaatgaaaatagagaacaaaagagaatgaaaagtagagaagttacgatgtgcatataatgttcaacactataattatataattatattgtacttacaacacacttatatgatataattacactatacttacactacatttacattgtacactacatttacattgtacttacactacacttacacacttaaatagtacttacgttggacttacataataattatgttgtacttacattttaattattatgtaattcctatattaagcatactgtaatagtgtcaatcggttaattaattagcttgctagcttcaggggtgcaaatattatttgttttttcacggtttccacaaattcccgatgctgttcttgttcctttttctttggctaaaatttaagttccaaaaaaagctgtgtttatgctaattttgatcggaagtcaaaaaaggtcatcttttttaccaagggactactagatggatatcccaataacttccacaggctctacggtttgagataattaaatatgcaacttcttcccaagggctgctctactatttggaaataatttaacatgaacttcccaaggacgctacggttttaagataattcattaaattgataactgcattgcattctatagtttgatatgcgtacatgtaatgcgtacatgtaatcctcaagatatctctacgtataactaatctcgcatatcatgcccattcacaattagatctcatctcaactcacaataataatcgactatgctaaaattccatcgacaatttttttcattaagatttgtcgaattttcagccgttaatctaaccatgagattcgtgccctctttgtgtcggcactcccatgaaacgtaactcgtgagcacttgaccacctggtggtactgtacatccatgcacacggctgattatctttgtcgctcactaattaaatagtttaaagttgttgttaatcatctagtgtacggtttcctgtcaaattcatgttacccaaaagcgtagagaggattaaagcatggtaatgatatgagagagagagagaggaggtaagttgaggaaaaaaattacagtgtaaatatagtacttttagagtgtaatttgttgtaattacattgtgactcgttgtaaattacaatgtaattctattagacttgtatgtaatttattttttttctatttttcactaagtgtaagttacactttatttttaactataaggttatatttaataatgaattctgtgttatgatacgtatgattatataagtattaaaaatctgagtgattttatgtcgggtgatctagatactacattaatataacatgtgcacaaacaaatacgaagattatggtggcggataagagccctatcgacaaggctgtcctccatggcaaacacgagcaagatgatctacgggacgataaggtggtttacgacgtggagtagaagcaactcctccttcccacatgtcggcggtgccgtacgcgctatcgcagggcgggtggctcagcctggtgctcttcaccatggtcggtgccaactgcttctacaccggcaaactcatcgaccactgcatgcgcgccaatcgctgaatatggagctacctagacattggccaccgccttcggcggctatggccggatggctatcagcctcgtcatgtacgtcgagctctactttgtcgccatcagcttcctcattctcgagggcgacaacttgacaagcttctccccagcacggtggtggagattctatggtacagctgcacgggaagcagctgttcgtgctcacggtggccattgtcatcctctcgacgacgtggctcaagaacctcgctggtttgggccggcgtggccgacaagtgcttccacatggcgggaagcaacctctagaatctgagcaggttgcccaccacctgcccaccaccctcagcctctacttcttcatctatttcatcggccatggcgtcttcccgaccgtgcactccttgatgaagtctaagaaggattttcctaaggtacactttttaaaatgtatttatatgttttacttgatagtaagtttgctaaattttgtgataacaatcaacaatgtaaatttagaattatggttaatgaaaattgaaaagtcaatggtggaattaaattagcaacaggtttagtaagaatacaaacaaattgttttttattacatgtatgcatggaagacacgcacactcataaatatttttgagaactcgtacatcactaatcatgcacacctcttaatcatcatcgctgctacgttctcatcatactcaccattgcaggtctatatatacatcatgtagataaaatttaagctaataagtttatttgatcgtccaataagaattaggatcagacgaaatgaacactaaaatcatttattaaaataagttgtactatcctaaaaaaagatgtaatgttaatttacagtgatacggaatggcgagtgcattactggcaagtgcaatattcacaatttagcattaatatatatttttgcataatgatgtaaatttagcgtaatgtcagattggcctttagactaatttgacgtgtgcggtgacatggaggcgtactgtgctatattatagcctatcaccccagtggaataaactggtgaatggaggcaattagggtcgcctctcaactatatttggttacctctcatccacccatgtaaaagcaatgtagcttaaagataaagctaatcatgagccgtctaatatggtttaatttatttgctaaaacttgaacttagaatatgcgtctagcacttcaaatgaaataattgtattagccatttgaatacatagtttacgaaattttgtttttaagtaatttaatgcgtagtccaaaacaattttaggtaaattaaaaggtagcatatctaaagttggaagatgtgttgcatcataaacttttcaatgccaagttaaaatagatatctattatgtcgtatatattcttgtactaagtttagactcaaccaacagctatgagaattgttagggataagatgcaaaagttgtagggcactgactattgctcaattaactcatggaagtttcttaaacaatcttggaccttttaccattcttttactgatacttatccatgatctaacggcatatattgtatcaaccgttgcattcaatggtccatatcttcagatgatgtagctcaatgatgttgcattttaagttttacctttcacttggagagatttggcaaacaatgataattgatcattggattatcaattccaattatcgtaatttggtttatgaaaccacgatgatgatgataatggatcagtactccaataatgttctattcctctccaattaatatgcaggttttgctgatctcttcggtgctgtgcagtctcaattacgcagtgacaacattattgagatatctgatctatggtgaggatgtgcaggcgcaggtgacgctgaacttaccctcggggaagctatacaccaggatcaccatcctgacgacactgatctccctgctagagaagtacggactcgagatccagctcattgcaacggtgataaaggagaagctgtcgttgacgacggcagcggcgacggacgccgagaacaacaggcagaccagggtgctcaccagcacagccgtcgttgtcagcacggtggtgctggcgtgcacggtacccttcttcagctacctcatgtcgttcaacggatcttcgctgaacgtcaccattgccgtgttgttcccatgcctgagctacctcaagatctacatgccctgaggaggagttggccacttcgaggtggcggcgatcgtcgggatactggtcatcggagtgtgcgtcgtcgtcgttggcacctacacctcccttcaccagattataggcacatttttgtaacatcccggcctagggcttaataggattaatagaatactcatatcaacaagttgcaacttcttttccggaagccgatctccaaagaactccagggttaagcatgcttggcctggagcaatttgggatgggtgaccgatcgggaaattctttccgggtgcacacgagtgaggacaaagtgtgcagaaaagacatgtgttggtccgtgagggcagtctatgacttatgaaagctgccagatgtaagtgggctcgacctgggagaggcaggtcgttacaaaatggtatcagagccgactctcgcggtttcacgggcgcgtgtgtcgcagttgcgcaggcatggtgcgcatggctggtgtagacctggagtggtcacacagcatggcacatgcgctagcactggacacacggacgtggccaagagaggacgttcctggcctggggttgatcgacgggggcgtcgatctctcttaagggggtgagggtgtaacatcccggcctagggcttaataggattaatagaatactcatatcaacaagttgcaacttcttttccggaagccgttctctaaataacttcagggttaagcgtgcttggcctggagcaatttgggatgggtgactgaccgggaaattcggatttcccgggtgcacacaagtgaggacaaagtgtgcagaaaagacatgtgccccctctctatgacctatgaaagctgccagatgtaagtggccttggcctgggagagggtgcagaaaagacatgtgccccctctctatgacctatgaaagctgccagatgtaagtggccttggcctgggagaggcaggtcgttacaattttagtaattaaataagtttcaaattctttttttactttgtcctaaaaaaacaacagatatgttatacagagtgttaagaatcaactgagcggctatatattacatgtgtactctcctggaatgcctacgtgtattatcactaaggaagtttgtcacgcccagaaattcacaagtaatttccgaactaatttgtacattaagacccttgttcaggaatcagccgaggtacacaaactgacaatttaatatacagattcatcagaataactaaaacaataaatacttacataagaggcacttagtcctcaccatgaagaaaactgcagcgaaaaataaaatctagcgaagcttatgctccactcccacagtcagctcaactgggatctaagccaaaggtcttctccttctggatcctttttcttcaactgaggttcgatgattattgcaagaatgagcatatgacatactcaacaagccacacagtaaatatgcaagtgcacaaggataccaaaggatggcataatataggctcatttgcaaaagcagcatttagcaaagatactcaacaagccacacagtaaatatgcaagtgcacaaggataccaaaggatggcataatataggctcatttgcaaaagcagcatttagcaaagatactcaacaagccacacagtaaatatgcaagtgcacaaggataccaaaggatggcataatataggctcatttgcaaaagcagcatttagcaaagatttaagagtagtaaaacagtagagtaattaatcatcaatattaatcaacactgaacagcacaccaatgctgctcaggcccaatcaaacctgaacaaccaatcccggtcgtacagatcaaacctccaaaccaggaattaaccattccaaaccaggagtcaaattaattatcacattgttatcattaatcagtagtgtgggactaatcatgaaaaacattgctcaactcgcccataaccgcaggcatggctattcgaatagttttactctggccagaggtgtaccactgtacctacaagacacgattccacacatgttgccatgccccgaagtaccactacggcactgcaaagggggaaatcgtgacaatacccttcgcacaacacaactcaccacagtgcaccattcctggatcataatcaccccctctataaatataaccagaggcatggactccccagcgacccccacggacttcttgccgcttctcagtctggtgccccgtaatgaatcatgctatacaaaaggtaaagccgttgcccacgctagcttgtggttggcacggttaatgtctcacaacagtagctcgcgaaccggtccttaattgccatgagcacgaccttcaaaaccatgtgctcacaacccaccattaaccaggttttaattattaattaattaacataacatgattaaccatcgtgatctaccattaaatataaccataattaataataataatataatataatttatatttaatcctctttaattagctaatgtttctaagcatgactaagcaaacatacatatggcatttagctgaaccaatccaatatataaggttcatgctaatcaaattataacccataggaaaataaagtcatcttcagccgttaattaattgggaaagactcaccacccgatggcattcgaaaataattcataagttgaaataaaacattaactttaaacgggttcaacatgctcaaagtgttgtttgggatttgtgtgacttgccttgcaaacaagcgtcttcaattcatcttcaggaacttctccaacgaacgaatgatcctccgaaacaacggaaaactaaacctagaatgcaaaacgagaaaaacactaataaaaaccaaataaatagtacaattaaagttcataaatagatagagcttgaatttagatgaattatgagacttgaacgacctccttccgagttcgtatgaattagatatgaattttacaagatttaattccaattaaacctattaaagaaaagactattccaaattgattaaacaatttacaaatgatttatagctgagacaaaagattaaaacatcctccggaaaagattagatcatatttggtagatgacatttattaaaaaggaataatatgtcattgaaaagagatgacaaatttatattaattttggatggccaagatggcgcggttgtcagcgatgacatggctgccacgcaggatcgacactggcgagcccgggaacggcggttaccagcgaaccacggtacaatgacgcaaacggagggcaccggaagagaggagatcaaggcaacccttaccaccacttacgcaacgacaaacggcgagggagatggccggcgacgagctccaaagggcggcaaccttgggttgacaatggcgacggctttccggcgatgggcggcggcaacggaggggtggacgagcttctcctcacagctacgaatccaatggaagcaacggcgaccgaaggcgacgatagacgacgacgaacagcgcggccggagatagattagatcggcttcacggtgacgaccacttccagcgggggtttggcgcaaaggaacgggtggccggggtagctctcacccttgcgaagccgagggaggtgacggggctgaccggcgacgggcggggcgacggcgcacgacggctggagaggcgaccggaggtggagagagagggagctcgcggggaggcggctagggttagggaaaaaattcgggaaagagggggaaacggaagaggaggtcgaggggctgctatttataggattcgtgcgaagagattggatcaaaaacaacgggatttggcgagagaaaaacgagggtttatccgagttcgccggaaaaacggagctcgaaaccgcgtcgaattcacgcgatatacaacgatattcaaaggggtttcttagggataaggtagaggagatcgaggggaatccgtttttgcaaccaattttggaaacggagcacaggatgcgacggattttgcgaaggaagcggcggcgcacgcacacggctcggctctgtacggctcggctggaggaggaagaaggtactgtagcgagggtagataaagtagacttttcctgggcttccttttccttacttgcttggcccgattgctagagggaagaaaactggacttcggctaagagagagggagaggagtgggctgaattcggcccaaacaaagaagaggaattttaattaactttttaatttaaataatttctgaaatgatctttcatttattaaaaatacttccaatgctcaaataattctggtaaaaatacagaaaatacttgggaatacaaagtatttaataaaattttatctagctcaagtttatgttcaaatttttcatagattttattcacacacttgctttaattattaaataaattctaaaaattcctttttcacaacaatttataatttagcgattttcagggtgtgacaaagtttcataactttcattgtcttcttgttgactaactatcacagctaaaatttaaattttcgagttagttaagtttttagttgttatgaagttttttcatcatagtttatcttcttccacccttagttttaaatcactagtaacacatataaaagttgggatttgctatatatgtgtctacattttttttggttttatctataaattatttttggtttgtttcttttagggcttattagcctacaactgaatcttgtcgattatgaaagtatggtgaaatatggcgcaaatggccatgcattttatgagattatttttttatgagagatcggtagaatatattcccttcgtttttttaatagatgacgttgttgacttttaaatgagtgtttgaccattcgtcttatccaaaatttttatgcaaatgtataagatataaatcaatgcttaaagtcaagcataatgaggtggagaattcgtatcattgggcttgtgggcatgtgactctttgttttttttgattgtatgctaaacttggatgtctttacttctgttttttcactgaatagtttctctatatgtcttgctgctacaggcgcccaacatcacttcatgactgtggtagggatagtgatgatgacgacttccgagacatggattatgatgtggtagctcttactaataacttgagccaggcattgcgatatgggatatatagcaatgatgatatggaagaggtgtgtgtgtgaatgattttgtttctatcgctttgatggtttgcgtcggtcaacatgtttctctgccagcacattttgttaggtttaatttgagaggattctatggtggataaaatatcatcctgttactcgtgctattgcattatctacttgagtgactcagcagctctaccatattccagatttgcagttccttacagccttactatactagatactaatgatgcttgtttcttgaatgcagaatcaagggacacttgaacatgatgatgaggtatatttaaggattctagtttacccccatttattgcttttttgttcttttcacctggttttatgttcaatttgattaaattttcagtacaactccttaacgtttgcttcaatcagccatgtaaaaagaacggaatgttgcatgcggaaaatagtgtctataaccatatttgttgaagctgtacttctgacagagtggatttccattgttttctcctttcaggatgtctattttgatgatgaatcagcagaggtcgtaatatgttctctgcgactgggagatgaccaagatgggtaatttgtgatcttataatatactttggtatgcttgtttttttttttgcccttgggctaattatgcatgtatgtatttaatagcagataggctaacctttggaatcctattttcagaaagaaatacatataccaatatgaattcattctaggattaactagatacacacaattcgtgagagcacttttctaatgtatatatgctaacctttaccataggcttaagacatagttatactaatcttggtttatttaataattgaaaattacatatgtactcgtagtatgtgctatgaattactcatataaatttaaattcagtacttaattttaaaattgttttatctatttttaatacttataggcactttttaataacggataaagttaaatactactcaggatttcagcgcatgcctatattttaaacctattaagaggtcagcgtaatgtatagtgacgctgagttccttttacatggctaatttgtgccaagtcgggtagtgctgagacgttttagttcagcgtcatcagggttagcgctgaggtcacggtctatttttttaaattagtttgacatggtttatttttaaaatttttatagaaggattaatttgtcaaaattacagtgtaaacagaagtatccaaatcaatacgtatagtgatagaccaatcttttcctcttttctttcttcccacgtgggcctacttagtccattcaatcgtgcatggaaccttgcccatgatgctgcatgagccatgcacaactgtgtataggcgggttgcatagcatcgtacacgcgtcagaaaagcattatgccacctagaccaacaggcagctggcaaaacaaccatcatgagaataatagatagattattattttgtttgctctccgtccagcagtatgctacctgcgtattagagggattattaattgagtacctatatttatgtcgccatatttttcatgaaaaaatagtcaacatgtatttacattgtaagtctttaaattacatatgtaattttagtgtatttacaatgtaagtcccaaaattacatatcaagtctctaaattacatatgtaattttctaattttacaatgtaatttaactttgcaaccggttgtagacataatggaggaccgtgtacacaatataggagaagaaaaagcaaatttattatcaattgtacgagtccacgaaatgcaaatgcaaatgagcacataagagttggagcttgataaggtgtcccaagttagttacgctttcggatagctttgatctgacacaaaaaaatatctgactgtagtcaggccccaaatatgtcgccacacgtgaagcaaaaccttattaattttgttgacataaatgaacgaacaactaataagcatactgtaatagtgtcaatcggttaattaattagcttgctagcttcaggggtgcaaatattatttgttttttcacggtttccacaaattcccgatgttgttcttgttcctttttctttggctaaaatttaagttccaaaaaaagctgtgtctatgctaattttgatcagaagtcaaaaaaggtcatcttttttaccaagggactactagatggatatcccaataacttccaaaggctctacgatttgagataattcaatatgcaacttcttcccaagggctgctctactatttggaaataatttaacatgaacttcgcaagggcgctacggttttaagataattcattaaattgataactgcattatgtagtttgatatgcgtacatgtaatcctcaagatatctctacgtataactaatctcgcatatcctgcccattcaaaattagatctcattttaactctcaattaataatcgattaagctaaaaataccttgacaaatttttctgttaagatttgttgaattttcagccgttaatctaacctttagatccgtgacctctttgtgtcagcgctcccacaaaacgcttaacctgcgagtgctggacctggactacctggtactgtacatccatgcatacgactgattatctttgtcactcactaattaaatagtttaaagttgttgttaaacgtctggtgtactgtttcctgtcaacttcactttgcccaaaagcgtacaggggatgaaagcctggtaatgatgagagagagagagaggaggtaagttgaggaaaaaatacagtgtaaatatagtacttttagggtgtaatttgttgtaattacattgtgactcgttgtaaattacaatgtaatttcttttagatttgtatgtaatttatttttttccctatttttcactattacactttaataataaattatgtgttatgatacatatgataagttatacatgctatttccatatgtgtattaggtaattattaaaaatctgaggtgtttggtttaaaagtctgtcgggtgatctataaattcattattactaataacaggtacacacacaaacacaaatattatagcggtggataagagctctatcgatgaggctctcctccatggcaaacatgagcaagaagatctatgggatgatgaggtggtttatgacgtggagcagcagtagatcctcggctcgttctgcatgactggcgcttccttcaggagaagctgcctcaacctcagcaacgtgatctgcagcatcgggatgctctacgtgtcgtacgtgctatcgcagggcaggtggcccagcctagtgctcttcaccatggtcggcgccatctgtttccacaccggcaacctcaacgaccgctgcatgtgctgatcgcggcgtacggagatactccttcggcggctatggccggacggccatcggcctcgtcatgtacgttgagctctacctcgttgccatcagctttctcatcctcgaggccgacaacctcaacaagctccttccggcacggtggtggagatcctagtgtactaggtgcacgggaagcaattgttcgtactcgcgacggccactatcatcctcccgacgacgtggctcaagaacctcagcatgctcgcctatgtctagcggctgggctcgtctcgtcggtggcgctgacagtgtcgctgctctgggccggcgtggtcgacaagggcttccacgtggctcttgagtctgagcgggttgcccactgccctcagcctctacttcctctgcttcgcaggccatggtttcttcccaaccgtctaattctcgatgaagtccaagaaagattttcctaaggtatactttttaaaatgtatttatgtgttgtacttgataataagtttgctaaaatttatgataacaattagcaatctaaatttagaattatggttaatgaaaatttaaaagtcaatggtggaataaaattagcaataggtttaagaacatgaacattttgtttttttattacatgcatgcatggaagacatgcacactcataattgtttttgagaactcgtacatcactaatcatgcacacctcttaatcatcatcgttgctacattatcatcatactcaccattgcatggccctcatatattttgttggccctcatataagtttattttgatcatccaattaaaagtaagaattaggatatgacgaaatcaacattaaaatcatttattaaaataagttgtactatcccaaattaaaagatgttgtactacttataaattttgtaatgttaatttatagtgataaggaatggcgaatgcaatacggaattaatggcaagtgcaatattaacaatttagcatatatatatatatatatatatatatatatatatatatatatatatatattgcataatgccataaatttagggtaatgttgggttggcctttcgaccagtttagcatgtgcagtgatgtggaggcatactgtgctacattacagcatatcaccccagcggaataaattggtgactagcgtggaggtgtattgttctatattacagcctatcaccccagcagaataaactggtgacttggaggcgattagagtcgtctctcaactatatttggttacctctcatccacccatgtaaaggcaatgtagcttaaagataaagctaatcatgagccgcctaatatggtttcatttatatgttaaaacctgaagttagaagatgcgtctagcacttaaaataaaagaattatattaaccatttgaattagagtttacgaaatttttttaaagtaattttatgcgtagtccaatacaattttagataaatcaaaaggtagcgtatctaaatttggaagatgtgttggatcataaacttttatatgccaagttaaaatagagatctattatgttgtatatcttcttgtactaagtttagactcaaccaacgtgtataagaattgttagggataagatgcaaaagtggtaggacattgactattgctcaattaactcatggaagtttcttgaacaatcttggaccattctccattcttttactgatacttatccatgatctaacggcatatattatatctactgttgcattcaattgtccatatatttagagatttgacaacaatgataattgatcattggattatcagttcgaattatcataatttggtttatgaaaccatggcgataatgagaatggatcagtactccaataatgttctattcctctccaattaatgtgcaggttttggtgatctcttcagtgctgtgcagtctcaactacgcagtgacaacaatgttgggttatctgatctatggtgaagttgtgcaggcgccggtgacactgaacttacccacggggaagctgtacaccaggatcgccatcctgacgacgctgatcaccccgctagcgaagtacgtgctcgtgatctagcccatcacaacagtgaatgaggagaaattgtcgacgacaacggtggcggcagcggacgtcgagcacaacgggcttaccagggtgctcaccagcacagccgtcgttgtcagcacggtggtgctggcgtgcacggtacccttcttcagctacctcatgccgttcaacgtatcttcgctgaacttcaccattgtcgtgttgttcccatgcctgagctacctcaagatctacatgcctcgatttggagttggccgcttcgaggtggcggcgatcgtcggaatactagtcatcggagtatgcatcgccttcgttggcacctacacctcccttcaccagattatatgcacagtttgattgtgcatttgtgggtaaggttgtaggttttggtagtgattaaatatgtttcaaattctttttttacttttttttcctgaaaaaacaacagatatgttatacagagtgttaagaatcaactgagtggctatatattgcatgagtactcctggaatgcatttgtgtattatcactaaggaagtttcataactttcattgtcttcttgttgactaactatcgcagctaaaaattaaattttgagattagtaaagttttcagttattctcaaatttttccatcattgtttatctttttctacccttagttttaaatcactagtaatacatgtaaaagttgggatttgctatatatctgtctacaattttttttggttttatctataaattatttttggtttgttttgttcaaggcttattagcctagaactaaatcttatcggttctgaaagtatggtgaaatatgacgcaaatgtccatgcattttatgagattatttttttacgagagatcggtagaatatattcccttcattttttaatagatgacgtcgttgacttttaaataagtgtttgaccattcgttttatccagaacatttatgcaaatgtataagatataaatcatgctcctcttatttggatgggattattattttgtttgcgctgtcagtagcagtatgctacccacacattagaagaattattaatcggttttgctataattgtggtgacacattttttatgaaatcacagccaaattttagatagttagatttatgtaagttttgtgcatgcgtacgagggctactgacttggtatagtgtcgttaaacaacgcagtcactagaagaagcagttattgtcaaacaaaacaacgataatctacctaggtaattaattaaggtttgaactaatatttttttatctcaatttgcccacacacttttgcatgaagagaagcaaatccaaacatgagtcattaaatatgtgctttgctttctccttacccgagctaatgttgctcatcttccagcacattacctagtagtagcaaacattagccaaggctacatattgatgaacataagaaaatagagaacaaaagagaatgaaaagttgagaagttacgatgtgcatataatgttcaacactataactatatagttatattgtacttatactatacacactttacagtacacttatatgataattacactatatttaaactacacttacattgtacttacactacacttgcacacttaaatagtacttaagctggacttacatgataattatatttatattgtgcttgcattttaattattatgtaattcctaatttattaaactgtaattttgtgatcactagttttctagatgaaatttaatttatgttgtgtattttaatcgacttacttatttttaaatggctgtaatctagtctaaaattgaaccaactattataggctcaattttgtggcgcctgagctatagatagtcctcaatgagcgatgtaaataatatatttacaaatagctaataagcaaactgtaaccgtgtaaatcggttaattaattagcttgatagcttcaggggtgccaatattagttgttctctcatggattctacaaattcctgatgatgatcttgtgcctttttctttggctaaaattaaaagtttcagaaaaagctgtgtcatgctattttttatcagtagtcaaaaaatttcatcttttttgccaagggaccagattactagatggatatcccaataacttctaaacgctctatggtttgagataatttaatatgcaacttcttcctaagggttgctctactatttggaaataattcaacatgaacatcccaaggccgctatggtttttagataatacattgaattgataattgcattttgtaatttgatttgcgtatgcgtaatcctcaaggtatctccacgtataactaatctatcatccccattcacaattagatctcatctcaactctcaataataatcgactatgctaaaaatccgtcgacaaattcttttgttaagatttgtcgaattttcagccgttaatctaaccttgagatccgtgccctctttgtgtcagtgctcccatgaaacataactcgcgagtgttcgactacctggtggtactgtacatccatgcatacgactgattatctttgtcgctcactaattaaatagttcaaagttgttgttaattgcctagtgtattgtcaaattcactttacccaaaagcgtacaggggatgaaagcttggtaatgacaagagagagagagagagagtgagagaggaggtaagttgtggaaaaaattacagagtaaatatagggcttttagagtgttagttgttgtaattacattgtgactcgttgcaaattacaatgtgattt

SEQ ID NO: 81814 - DNA, 4836 bp, Oryza sativa
  unsure (1)..(4836): unsure at all n locations
cgttcgtactctatccaagcatgaatgaactgtatggtcggttcaggttgcgttatcggcccgccacttgaagtaactctgactgtgtcaatccattgtacgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacagccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccgacgtgagacgaagaggccccagtaacgaagatcccggctgcaaatcctgctggacaaggaccatcagtttcatacatgtatttaatagtattaataaaaagtaaagtaccgtgtgggcgagggatcgacgctccgtgagaggaagagctagcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatgtctgggctgaactgtaccatgcgaaaccggtgctgtaggtcgcactgctccgaagctagggacgctcgaaggcaaacgaggtcctgcgaggatggaacatcaagttacgacggggtgatgttttcgtacaaaaacataaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgttgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgttgtacacgtggagcccaaagtgcgcctgctagctgtccccgtcgagtcaacctgtgaagagaggtaaattatatggctcgatgaagtaagtatcataaaaatttagaaatgaacaatccgaactcacaagtggtcggcagggaggacggtcggctgcacgttgcccggaaacacctgcctaagtccgaactgtctcatcacacgctgcgggcagtgaggctcaacgaaaatgtcgaacaccatcggtaggatggtgagccagtaagcttggtcgcgtgtgcacaaggacgaaagtcctagcggtgctctcacagcgacagcctattatgtgaaccgctcccagatgacgtcgctaggctggagaccgacaagctggaccacgaaatccagatgagctcctttgagatggacgtgagcgctaacacgctgcattaaacatgatcggaattagacatgttatgtgaagaaaaaaaagaagacgactgataaacttataatgcagcgaagttgcactaaccccacgtgacaccagtaagtccccatcgtgggaccgtcctctggccactgcgcgctgcgtccaaccccgtagggtgcgctgtccaccactagtcgacctatggcaaacctctcggctgcccaaagctgaagcaacatagggcagccagcgatgatcgctcccgcgtcagtcttcgtgcacgcctcacagagggcacggtacgtggctgctagcacagcagaaccccagctccattgcagcacgtcctgtggctgagcatccgcgatggaccgtgcgtagtggaccagccggaagtccacagcgtgcccgtgggtgctagtgaacatcacccacccgaacaaccacaacatgtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaacaacaccgtccacgggaccaactggtgctcccgccagcagtagcccgagcaggtacgacacgtcctgcagtgtcggagccatctcccccagggaaggtggaacgtgtgcgtctcaggtctccagcggtctaccagagcggcaaggagtgaccggtctgcatcccaccgcttcgctgggtcacggtcaatacttctcctacccaccgttctccaagtgagcaatanccagcgacatacccagctgacgatcatgtctaacgcaaacgttgggcctcatacgcatcactgcaatgtgcactctctctaagaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttcctttatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccttgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaagaaccttctgttgcacgactcactacaactgatactgacattgtgtagacttcttggtatattctaaatcctctcaacaaccaactataaattgactgaaatgttttctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtatgttacattctccagatcaaactaaactacatcttacaattaacactactgtctatgtctcaattcatacaattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagtagggcttcgccgctccccttctgctgccctctcctctctctctttcattttttttggatttttagtgaatataatgaaatttcagagaggggggactgggctttataggggggaggc

SEQ ID NO: 81815 - DNA, 9196 bp, Oryza sativa
  unsure (1)..(9196): unsure at all n locations
tttatctattgtcgtcatttttccttttttacgttgaggtattttttttatcggtgtcagtcttctcattatgcgcgagaaatccccttccggacgcgcgagtcccccccccggccccctctcttggcactctcttcgattgtcctctttttatttaaaaaaaaataaataaacaatctaaattcataatcacaaaaagataaaagatctaatctgactatatatatatacataggtttccggtagtatttttagttcgcttccgcttgcgttaaaatattttccatgtgcgtcgaaaaaaaattatgtatatcgttgctcagaaatccatgcacatgttatcgcatgggtcatttggggatgactagggatcggtcgcccgatccaaatctttaaaaatcggcatgacgtcaacgccgatttacgtgtaaaacaaattcaaactgatttttctcttaaattatttatccaaatcatgatccgattgcaccattaaattcgttgcaattaaatcttctaaataagaccacacatggatatattctgatgaaatattttttagcttattattgattttttttaatgttgcacgatgttccaccaggtatatcggaattgtttcaataagtagatcgaaaatgtttcactcgtttaaatcgggtgttgtttcaccttatataaaaacaatgtttcagcaaatagcgaaagaatgttttagttcactgcaacatttgatccatacatagtgaaacattgtgagtatactaaacgaaacattttttaatggaacaaaaaaataaaacgaattcccttaataaagggtttccaaaatatgtgggttttttgttgcaatagagtatctcagatcactgtaactttagatctataaatagtgaaacatcatgagtacactaggtgaaacatttttggttgaacaaaaaataaaacgaattcccttaatagcgggtttccaaaatacgtgggtttttatgttgtaacagcgcgttccataatatcaaaatccaatgcaacatttgatccgtacatagtaaaacattatgagtagactagctgaaacattgtaaaactactggttgaaacatcaaaagagaccatatgcaacattaaaaaaaatcaataaaaaactaaaatattttttttatcaaaatataatcatgtgtggtcttgttgtaaagatttaattgtaacgaatttagtgatgcaatcagatcgtacattagctaaatagtttatgagaaaaaatcttttgaagaaatgagagatgaaagcacgtagggaaagattctttgcatgcaaatggcagaccatgcagcgtctgatttttcttccctcccatcggacgcccgacaactagcattctccgggtcattaccgcagaaagattgagaaattaacccaatcctaccctattgtactattgtactgcttccttgccagcttgaactgaatcgaaactataattccacgagcgtaatttctactccctccgtcccaaaaagactcaattcctaagtttccgtatccaacgtttaattatccgttttatatgaaatttttttataattagtatttttatcgttgttaaatgataaaacatgaataatactttatacgtgatttatctttttaattttttttataatttttttaaataagatgaacggttaaaggtcgtaactatcgatctgagacacgtccccatgatcgtccatccgtgcgctcgtgcgtacgagattggaagtgcttttgtttttttattatctataccttttttttataagaattacacagtacaacgcagacattgacaacatacgtgcactcacccctataaatgcacgcacgcaaaccgtacccctagcatcttcgaagactgggccggcaagtccttgagagacaacgcacgcacactcacccctatgaacgcacgcacgcaaacactacccctagcatcttcgaaaagactgggccggcaaatccttgagagtttgacgaagtcatcataggcacctcgctatcgaggggtacgtcgcccaccactgaaagcacaacgccgttaaatcctggaaaattcgctcccattgggagtcgaacccaggacctcaagtgctaataaggctcttgtaaccactaggctacatgccatttcgcttttattatctatatctaataaaaaatacctaagactttcggtttaatttcggtaaatctgtttttttttgttttttttccgattagtttttctcttacgtggaagttttttttttgggctttcggtttttttttctgactgaaaaaatacccgtgcgttgcaacgggtaaaaatatttttggatcgttatatattttactctttggttttggaccaaaagctcatttcattccttgtcaagtggagttgtatgtcctgctcgcatagctgactgtcctcttcaatcttcaaagacaatgttgtgtccgtacatgccaaaaccgatacccgtcaaatccggtccaatcttttacgatctttcaaaattggttgagggtttttgatacacttttttttataacaggcattcataatacccggcttttaaacaaagccaaagataacagaggtcttacacaacagaacgagaaaaaaaatccgacttaaaagaacaagttaacactggagcataggatcactgcagaggcccatcaatcagataaaaaacacacccacgaaacaccctaaaacaagacacctaacatgctaaaccaaaacccaaccccttagccaagatccagatcatccggcaacctccctagcgggcgtagttgtttttgatacacttgatctcctctatccgtttttattaaaatcgaagtgataaaactcgggataaaaacggtgattttttaaatagagattaaattcagtggattagagcagagttaaaagggaaaatcgtagaaaaaatgatgaggggtagcggggaattgatttttggcaatcaattggaggagggaacgcatgggaaggcagatcgacctagtgtttagccgggcgataaaaaaacatggtacataaaaaaacaaatccttaccgcgtgcgagaaaatacaactaaaaaacagcagcaaacatatgaaaaaacccggtaaaaagacctaaaaaaagtaaaaaacagcatagggtaaaaagcgaaaaaaaggtgaagagaaaaaaccagatggaaaaaaaagcgaaaaaaaaacaaacggaaaaaactgtgaaaaaaaagaaaaagagtgaaaaggacggaaagaaagaaaaaaaatatacggataaaaaaagaaaaaggaatcggacagaaagaaggaaaagaaacgggcggagaaaaaaaaaggaaaacggactggaaaaaaggaaaaaagggtgaaaaataaaaaaagacggacgaaattttttacggaaatagatccaatccccagcatcgtcacgacatagatatgcctcgccgtgtatttctactctaattgattgaaaaaagcaattccctgttcatccttcatttattgctcagcttctaatgctattcccaatccaataactaggatggtgtctatagcattaaataagctgccaactaaaatgaaaaatgatgtggtaagtgaataaatgaggaaagagaagaaaccatatcttgcatgagacatagtttctacacaatatcgaagacatcacatgagataagtagtattaaatttaagtattgagtagtggtgtatgcattggaagagtagcatctttagtactattttctcgatgacgtgaagtttatagaaactatgtctagtgtcttgggctgggaatggcctaatagctgttttatcaatgagaaaatatttttacccgttgcaacgtacgtgtattttttctagtttcataaaaagtacagaaactacataaaactaaggcaataattataaaactgcatatttagtggaaactaaaaaaactatatatttaattaaagcatattgtagagtttaaatctctatcaatattattattagggagaattggtcattcgactctattctgaagtctaattaacaatctgaccctacgtttttgtttccccaaaaaaaaaaaaattttttttgcccttaatttagaatccttgttttttcaaaattggagttgccattagacccttgtttctattataccattctggtttcatttaacaaaagaaaaaaaatgtgttctaatagaccaaaatacccctgattacacacattaaccctatccccaaatttatcacttcccattccttttcctctccctctcccctctctccctctctctccagaggagctctcctcgccgtgcagaagcaggcacgcgacggaggaacagtggcggcggggcccgggtggcggaccttggactgcggtggtgttgatgtaaaaaacacgaggccggagagatctgcttaactctagtgcaggtccaaaaatcttgccttttaggttcgtgagcgtgccaattgatttgatcctgcaatcaacaagaaataaagacaaagaaatcgtggttaaatccataaatgatagccgatcggctagttgacgatgacatattatttatctctgagccgatgtcatatgtgaatcgatcggcaaccatgaataaataagaaaagactaaatctactcgatcggctgtagatattaacaatatataatccttatgtcgatataaacttaaatcaagtaattgggatagatcggtcgtcataccgagacagtataaatcacttagatcgaagtatatactaacaatgagattatagatgttcatagcatagccgatccaatagatctagcatgtatcggctaataatccgatatcactctatactaagatattaaaacaagtaaaatatatcaaacaaaagcctaatatactttattgtaataagatcttaatataaagggaagatctagcatatctgaaagtgtaaattaggcctagaggggggagggtgaataggctaattcaaaaattcaattaaaagcggaagcactaattttcggatatttctgaaatttttggatatatccgaaaattttcggagtcagcacaaacagcaaagtaaatcctagatctagttgcctacaacaagaatatgctagcacaaacagcaactagacctgtagcggctcaaacaagcaaagctagtggagagggaggaagtaaagtcaccaaagatgaagctcacgaggttgttcccgaagttcgaatccttgaggggattctactctccgttgaggagctcactaagagtcgggtcttagctaaccctttcctcaagaggttgcactaagcactcctccttccactaagggtatctcttcccttttggaggtgagatccgaccttcacaaacttctcccggccaaccataagtagatcggtggctcgggagcgacacctagccgcctaggagtcctcaacctccaagagtaacaaatgaagcaaagaactcccggagatgatgaaagtgctcacaaatcttcacgaagtcaacaacaagcactcccacaaactcgaatccacaactctcacacacacaccaaatccaaatcgaacacgggtgagagggaaaacaagaaaacaaggctcaaaagtgctagagaaagagcaagccaagggcacaaatgattggaatggaaccagcagccctcacaagtgaggggagggggctatttatagccacagcccagattctgtccgttatgcacaataattcagattttcggatattccgaaagattttcggacatgtccgaaaattccagctcagcaccaacaacaaagttaacgaaggatttttcggacattccgaaaacttttcggacaagtccgaaaatttctagtaccaacaacatcgttctggatgttctcggaaaagtccaaaaataactttcggacaagtccaaaaatatacagaagcgaaattgactctactgatgattttcggaaaatccaaaaatcagattcggacaagtccgaaaatatacaaaaccacttttgctttcgcagtctttttcggaaagtccgaaaatcactttcggacatatccgaaaatttccagaagcgaaaatctggttctgtgtgttttcggaaagtccgaaaatgagtttcggaaaactccgaaaaaatccagaacacaccaaactgaggagaaacactttttaaaaatagattttgagcactttgatcactcctcgtatgtcaatgcatcatccctcttaatagtgcggctttcctattaactcaaggaaacgaaaacgtacaaaataccatttgctcatttgccgcattacatcacatcaacgtattcggcgggatatgtattacgctaactcattgaggacaaaacaaccttcacatttgcttaaataaaaatgttagtcctctctaatcgcattgtaattaatcaccaaaatcattaggggcctagatgcactttcaatatcaatcaaatacatgaaatataaagctaaatcaggtaagatcggttgaaaccccgatactaccctaatcggcaaccaaaagcaggctagagattgagattctaagacaacttataagatcaaactcaactgatgcagctataagtatgaaaagaaggacaatatctagacaatcaagccgttggatatttcatagagcggtagatatcctatataatctaagtcaacaatagtatttaacctgatcggctgccttttagcaacagatgttagccgatttgagggttagataacaatattgcctgagattatatagaatatctgataactcaacgaactacataaacaagattagagtatcataaagatggaagcactaatcccgaaaacgcaagccgccataacaagttttacctctagttgaagatcgaaaccgatgcagctcaatccgaaagcaagaactcgtcgaaacaaaaccaaagtaaaagggtggcgatgcgtcgagattgtattgaacgtgtgttgttgtattacatggggctcggggtctatttatacctgagattacaaaatatgtccgtgtcggacacgactcttatttctaacaaacttttaagataccataagtctttgcggcagacttttgcccaaacatatctttaaggaaattacatgaaatatcataattaatagatacaattgccttctcaggactctatccgtgcatggcaatccatatgaagcacattaactcaacccgacaacatgcattacgtcatattgtcggtatcggctcaatcggccaacctagtccgactcgaactctgctgatcctgatcatagccgattcggactttagccgattctcgctatgtttccgtaacgatctccatcttgaattccgcttcgattctatcttcatctccgatacttggattaccaaatttggttgttaacaggcgggcgaatcaaacgaggaggggcggcagaggcccgacaataacaaggacaaccaggggtggcaaggcccaggcagcgaacctctggctacggtggtggatccggcagggcttaggcattttgggcctacgggaattccgaacaattttttgggttttccaaggtgtgccggttgcggatccggtggcaacggaacaacaacagtggcacggcggtagcagctcaggctgtaattttgccccggcggccccgaggtgtatagccggggnatntgnnnnnnnnnnntnnnnnnnnnnnngcccanggcaccaaatttgcnttggcagtggatgtaaaggtgactggccatgcgggctgcaaatccggcggtcctgaggtgtaccggtggcggttcantgatgggggcacaccattgccggaaatcaccggtctgcgacaatgcatgacttggcgaggatgatggagtctaaaattttattgaagtttattcatatttttatcaaatctatgttaaatttgtcaaacatctatcaaattgaagtccattttgtcaaactgaagtcaaatttgaaaaatttaatataacaaatataggtcaaatttgaccaaagtctgagtcaaacttgtcacaaatcggtgaaacttacactaagtgcacaaatcattctcattattgccaccatacaaaactatgctaaactaactaaatgctttggtaaaatagggtcaaaagagcaagggcagaagagaaattttatgctccttttaagaccgttacatgcctttgatagaatagggtcctaccgtatcttcagttttgaaatgaagggtcaaatgagcaaacttgatataagatggttaaattggtagttagctttcaaaagagggtcagatatgtaattgccccttattattatgttggaactattaggcgttgtagttttgtacttaaattgatgcaaaacttgtagttattaaatttgctaatcaatctttatttttgggatattatattttaaatctctagttctatgaaaatttccatgctaaatttgtagttttgtaatacaagattataaatatgaagttttacgataatttggttgtagttttctgaaatttacttgaaaatatatcattactatttacctatttaaattagtgtacagtatggtatgaatccaattttcatattattgtagtggtaccatttcagttatacgaataatggtagtattctttaaaactgtcaaatttataatgatatgatctaactaaccctttaaggtatatcattttagttcatatattttttttaacagggtaactataatttatagctactccctccgggctgataatacatgtcgttttggacaaggctgaagtcaaactttagaatctttgattatgaatcatttttaaaatatttgtctttcaaatatggtgactacatgtatagattagtcttaaaagtactttaataagatcatatatttgctaacaattttatacatattataatgaaacataatggtcaaaattgttttttttggagaccgtgtccttatccaaaacgacaagtattatcaaccggaaggagtataagcgatgtcactttttatattataccagtaaatattttcttttagcccctgtcctttttcttcctcttccttctcttttttcctctatgaccaaattgcaatgtattctaccaatca

SEQ ID NO: 81816 - DNA, 3673 bp, Oryza sativa
  unsure (1)..(3673): unsure at all n locations
ttaccgagtgcagggtagtcattaatggtgcagaacaatagaactcttagcttgaagttctcctgaccatatgcatcccaagtttccacaccttctttccaaagaatctccagatcgtcgataacaggctccaggaatacatcgatatcattgccgggttgccttggaccttggattaacaagcacaacataatatatttccgtttaaagcataaccatcgtgggaggttatagttcgcaataagaactggccaagtgctgtgagtactactcatgtcattgaaaggattcatgccatccgtacaaagacatatcctcatgtttctagggtcggcagcaaagtctttgtgttttcgatctatagtcctccattcaatcgaatccgctgggtgtctaagcataccatcattccttctttccgtggcgtgccaacgtactaacttcgcttcgttcgggttggcaaagattctcttgaaatgatcaataataggtagataccacacaacctttgcaggaccacccctctttgacttatttccttcgtcagcacttttctttcgcttgtaacgagaagccttgcagacaggacaagcatccaagtccgcatattgcttgtggtacaatatgcagtcgttgggacaagcgtgaattctacgaacctctaaccccagtggacacagaacctgctttgcttcgtatgtcgtctcgggcaatgtgttctcaacaggaagcatagccttcaaaattcctaaaagatctgtgaaactcttgtctgtccatccactacttgccttcagcttcattaggtccaaggtaactgacaacttagtgtgttttgctttgcatccagcgtacaaaggcgtctcggaatcacttaccaacctgctgaatttcattccatctctctcattttgggctaggtcctcaacgtcacgtaacatgtcttgtagtagatcgtgatccacatcaaccatttcaccgcccaatggagaaggtataaacatgtcatgctcattttcatcttcctaattatgcgcaccacttctgtctgctgctgctccacttctgattcttgctctccatgcttcacccaacatgtatagccctccatgaatcctcgttgtatcagatgaccgtgtacgtcctctccgctatcaaacatattctcgttcttgcaatctgcacatggacaacacatgtaatcactgtttcttcttatccgatcctcctccgcggcgttcataaaatttattacgccctttcggtactccgtagaatgacgtttcaaatttttggcatacatccaacttcgatcaattgctacaaaaaaaaacaaattagaggcacatattataagatcagtattgcaaaagtaagacgtgatgaaattgctcaattaatgatttatattactcacttgattgatccattttgatcacttttgggaatttaatttctgttttccttggaaaaaggacaaaaaatcgccccctacagcctcccaccaaaatagtgaacagtgggatacagttacactaggtggtggggggtatttatactgtgcaacaaatatctgtaacggccctaanacaatcaaccgtgacgggcatacaagttatctctatcgggccgtaataaaagaccgtcaaaaaagagtgtcatctgtgacgggcaataaacttatctcaatcgggcctctagttggagcccgtcacagatgaccctcatctggacgggcttcttttagggcccgattgagatatggaaccctcatctcaatcgggcctcaactatagcccgtcacagataagtgtcatccgtgacgggctttagttttgtgccgatataccatggctgtgcgaccatatctcaatcgggcgaaactttggcccgattgagattacttccttgtgacggcccgcaaattccagtcttgttatgggccgtcacagatggaaggatctgtattagtgactcctatatactactgttactatactaaacagtatatacctactgactaaataaaaaacggtacatacttcctaacctatcaatatattatatattagatacttgaaaaaacagtacataatccttaactaattgatttaatataatattggatacttgaaaattttagtatatactggattaaaaaatcagtatatactggaaaaacaatcagtacatgcatactccttataccagtatatataccattcttaagaaaaagtagtacatacttctacaagaaagtatatacttctaaaaaaagaaaaataataaaagtagtataaacttctacaagaaaaagtatatcattccctagctaaagatattatacatatagtggttacaaagcagtatttatacgtactactactatgtaaacacaactactggagtacgtagtatacaatgctactgctattaaaaaattagtacgtatacactagtactaatccacgtgtttggatcagttctgtgcatttaaaatttgtaatgcatgcactcgatcagttagttgtgcattaaaactaaagaaaagaaaatgcattgttttaaaacagatcagattcaccatggccctattagatgctattggatcatccattaacaaaggggagtatatacacttgggtgtacagaagagtcgtcctatatatatatatatatatatatatatatatatatatatatatatatatatataaaacacaactcttctctttccatctgtgtttccaactcttatcttcacaaacctccaccacttattatcaattatgccagaagtaccccccccaaaaaatgccagaagtacactattaccacttatcacccatacgttttgaaacaaccacaacgttaatcaaatagggatatgttaatgagacatctctgggggaacagggaatttaagatcaacatgggagcgtggagtaggttgggtccaaaagggggaactccaacatattcagcatggctttcaagggggacatgattagaaatccaaatacccaatagttgcaagtctgaaattgattgatactttattcaatggttcttatttctagtgtttgcacacgatagtatgcaacaccttattactagagtacatgtaaccaacgtttgatcaacaacaaccacaagaagagagttggaagttgacaggggccatgttgcacatgtatggcatctgcatcgccatgttcatcatcatctgctgctgcccgagtccagcacaaataacttgttgcatgctctgcatcatctggtaactggtgtcacagttgcactgaggcatcatgccttgcagctgcatgcaacattgctgctgcaggggagccattggctgtgatatgaacatggctgtggagctacccatgcccaacgtttgcatcatgtactgcctatacggatccgtggtgcccatggctaatgttgctgggaaatactgcatagtggtgattgcagtagtggcacttgcagaaagagcaattaaggcaaacagggcaaatatcttggtggtgtatgctgccattgctgattctacagtactagtgttaaacaagatcctagatggtgtagacaatattgttgagggtgatggaatgatggttgcctttgcctaggggcctatttatacatgctagtagctatagctgtg

SEQ ID NO: 81817 - DNA, 946 bp, Oryza sativa
tcctgcagccccacaagcgcgtatgaagcactttgctgatatgaatcgcactgaacgagtcctgactgtcggcgatatggtttatctcaaaatgcagccttaccgtcacaattccttggggttacattcttccttgaaattgcattctaaatactatggcccgtttcgtgttttggaacgcattggctcagtggcttacaaattgctgttaccggcatcctcccaaatccatccagtctttcatgtgagccaactgaagaaacacatcggtccaaaagtggttcctgaacctggcctcccactcactgatgataacggtaacattctttcccagccaacggctgttttggaacgcaggctgattcctcaaaacaatgcacctgtggttcaatggaaagtccaatgggcgaatctacctctttctgctgcaacttgggaagatgctgctttcatatccaaagtgtttcctgcttttaacccatgaggacatgggtgcttaagggggggggcattgtgagaactctgacgaactgaagccatgattgaacgctggaagggaaggcaagttcagttacccaatggctgggattattcgataacgcttgggctggagattatgaagatcggacgatggagatgagcttggaccgtctacagcacacccctgttgccgtactgttgacatcatctcttttgtcttgtattagcgagtccctttataagctagtgccgccgcaatgtctgtatcgaacaattgaaccctaatttactttactcttgtcttgcggcgcccatctatttccttgtactgtgtactcttcaattcagtgcaaatccttcaatttaatcccattaggatagctacttaagcctcttttctctgaaattgttcttgtcaagctctgaatctggccggggcttgacaggtgggcgtgtgcaccgtggg

SEQ ID NO: 81818 - DNA, 731 bp, Oryza sativa
  unsure (1)..(731): unsure at all n locations
tcctgcagccccaagttatcagctgtgagaaggatattggatcgaggagcagtaatatcaggaaaggttagtgactgcagcccattgtgatgtattgtcaatgctctagtcttaagatcaatggtgattgggctatgctgagagatccagtcacagccaaagatgatatcaaagcctttaagatccaacaatctgaagtctgagataaaagagacattatgaatagaataaggaacctgagagcaaacggtccctgtattcaaaatactgccattagccactctgactggtataggtgcatgattaaccatatgtaacccagctttacttgctatcttcggagagatgaatgtagtggtactaccactatcaactaaggctgtggcctgtatggtacccaatagaacatgtagtgtaaaggtagtagcagcaggagtgatgccctccagggagtgtaataacagatgtgtatcctgctgatctgtcttctgtggactatcaggaggagtagagtaagctgcatcatctaggatttcagactcatcctccattgtgaccaaatagacttgcttggtagctttacagactctgccgtgtcctggaacccagggttcgttgcaacggaaacacttgccagaaaattttgtatgagtgacagtggactgcttgtcatccttggtaggatgctntggtggaattttgggagtctctctgttggaaggaatagaaga

SEQ ID NO: 81819 - DNA, 1097 bp, Oryza sativa
ctttcttcttttcttctttttttttttgcattgatttgactggctgactgatgacaactcagaatggtaaaccataagagaataccttgtagaaaattgggcattttgcctgatcttcgcttaaattagattctggaattgacaaagttcagctacagcatgaaatgaaaagaaaaggcaacgaacactggcagaccacacaacaaatggtgccatccattctgtgtgatccctagcgcatagttcatttcaaagatatgaaccattttcttagtggttttctgaagtttagcaatggagatttatatgttttagaatgaagtgactgatttgtcaaccatccttaattgacattctcccctgttggaatatgttattgattgtcaaaccattctctgttggtaatatttccctgttgaactatgggactgctgggcatagtattaattcgtcttgtacttgccatatagatggcattaaccatttaattatccctctgattttcagtatctcccaccaaatgatatgttctggtactttccgtgctatttgtgctggtgctaacacaacagcaatattatcgtgtctaacacatgtgttgtgtctagttcatttgctatttgaaatattctgttctgttttcagcttctttattcttttgctgctcctgaccttacattttagggaaattcagttcgtgcaacattggtgtttttgtgcacatcacaatttggcaatctttgtcttaataaatattctctgcatcatgtgacaatcctgctgttgacaaataattgtgtgcacagggaaatgtgtgccgatcacacgaggtgctggaatttatcaggatcatatgactgaagcccttgaagtgcttagcactggagactgggtatgcacattttcttcattttatcaccgaccattctatcattgacagttcttgtatctctactcataattttggcctttatttaatttcaaatctcgtcatgacatattcaaacagttgcattcattccctgaaggaaaaatagctcaagatgatcagccaatcagacgtctgaagtggggaactgccagtcttatcgtccgag

SEQ ID NO: 81820 - DNA, 1478 bp, Oryza sativa
tttgattgcaacgtttgatcactcgtcttattcaaattctttttgcaaattaaaaaataaaaagttgtgcttaaaatactgtagataataaagtaaatcataaataaaataaataataattttaaaaatttttaaataagacgagtggtcaaatgttacaaataaaaactcaaaatcccttatattatgagattgggggagtatacggcaagggagtgtgctgtgtgtggtctgagatgatgtgtactgctgctagcctctcgccgtgtcggcattcgttggaacggcgcgagacttgttgtcatggaaacagaacttgcatgatgcattgttctacgtgaagtttgactccttttgatatattatcgttttaaatataattaacaaacaaaattcagaatgatcaaactggctaaccagtaaccagcatctgcatcaccgaagaaggacatgagcgtatgcaatttccgtttgaagttggcctcaacaggatcatttccaatacacggcccgcagattgcaagaagaattccgcttcggccgcttgggaatctgcagcccatgccgcgatggatcaggccgaatctattgcttaccacaagcctatggttatccgtaccattagtccagcccataatccccctctcaccatgggcggcccacagcacgaggaggagctcgccggcgtccggtgcgcggtggccggcgaaacaccggcgactcgccgccgccgccgcctccggatcgcccaagtcaagaaggcgagttttttccatacatattttacatttaccaaaaaaaaattaaagaaagcgaccgctaatacgcgacttcagtaactgacagggtggccccactgtcacagtgtccctaccaaccagagggacagggaggctgggaagaacgcgcgtcgagaaagggaagagagtgggtgagaccgtgagagagggggatggagatggaggcgtccgccgccgagggcggagccgcggcggcggcgcggacgctgcggtgggcggggcgcgcggggcacctcgggggattcccgcgcgccgcggtgatcgccgccgtcggggcggtcgccaaggcgtacgcgtcgctgctcaacaccaccaccgtccacaacgccgatgccctcctccgcctcgtctcctcgcggccccccggcacgccgctcctcaccgtcagcaaccacatgtcaacgtacgtttttccctaacatccccattccctggtcatatgttaccccccatgtccgattgctatttccccttgttgatgtgagacctgagaggagagagactggagattccgtgttgctgagttgcgcttgatctgtcgctgatccggttcctgtacgcaaaatctcagtggtttttttgggtaacccgcctgataactaaatgggatcacagcctgataacatttgactccataattggtgctagcatgttatatatagtcaattagtcatactt

SEQ ID NO: 81821 - DNA, 1901 bp, Oryza sativa
atctcatttggcagtttgaagaattctgaagcagcttcaatagcaccatccatgactgattgactgatcccatgacttataacctgcaaaatggcagaattagtagagacttgggtgcacaagtaagctttctttgttcccttactgcctgctagttagtgatgatgtaggaaaagaatgctttggtacttatcttatgaagtagcaacttaatcaggaaaaatagcatttgaatggtccttctctatatgcacaaattgcacttttatatacatggtccgttcttgtcattactgaaaggtttataaaacaccccagtgatagtgctggcagccttgatatgtccacatggacggaaaaagaaaaaaaaattgcagtggtttagaacccaaagctaaaatatcgattaggtgtagagtcagtttcagacttgtgaacttgaaatgttaaccaatcttgtaaaaagtagatgatcatatagaggttttacatatgtcttttttaacctagaaagagatactttggcatatcttttcaaattttgtgaatactaatttacagttcatcattgaaatatttattgttacaaagaactaaggtctcaattcaaagtatcaagtcattcattgcattgcaatgatacggtactttgcatatgtcatgtatttgtgtaccttcggtttggcaagctaatcaagtctagcatgctcacagcacaaggtttgcttccgcttcatcatttgtgggtttccacataacaaactgataaagtttagttgttttttttccttatctagtttttcccattttcatgaaagagctgtttagcccatacatagagttggtgcagtgaattgtactatatgtacagttttcctagacttgcacagatcaaactctccattttggtgggagcaaaaataggatgcagctcatcaaacatgtagttcagtagatacagactgcccatatcaccacttccagaaaaaggaggcgcataccatattcttcaccgttagcgaacaatattatgctgccattgctacctgcaggatttcaaagaagggtcccgatctgatagctcctagggttcaattacttgctctttgatttggagttttctgccagatagaaatgtggctgggacacaaggataagcttccttggttgactaccccataccattctagcacatgtcaaaatggcgtcaacgtaaactgtcttcagtgtttggacataggaaaagaccaagtctagagagtaagaacatgacaaaaaggctgtgtcactacgttgcgttaaaggaaatttacctggaagtatcccagatcacggcatgctttggcgatatcgttgaccacccgggaccgcaccgtgggatcatcaagactgaggtggccaaggttgatcactggcattggcggcgggtggagctcctgtgatggcagctgctcttgagggatacccttcgacgtgtcagacattgttgatcagcgaagaagccacacgcagctcaggtacgccaattggttatgcagaattagaactgtacgcagtgtgagagctgtggctgcatctcttcttataggaagccgaggctgatggttcattctctccttcagctgcaggttggtgcaaaaaaaaaccgccgttcttctctgttgtctgtgcagaagcagaacgcatacatgtgcataatacacctgatggatcctcctcacctggacagggggctccaaaggagaagtcaagttaggcgacgcatttccatccattcatgcactttgcagcgtctcgaaatggactacatggatcctgtatctggtccaggagaggagaagccgctgggcataggcagcgtacctacctacgtacgctgggaacgcgtggtgtgcgatgtt

SEQ ID NO: 81822 - DNA, 993 bp, Oryza sativa
acataaagggttatttcctttggaagatttaagagtagatttcagagggcaatgcattgattagtccaccatgaattgattatttcacaatgcatttcatccaagtgtgcaactatatggatgtcagtgttactactacttatgcatttcctcacctctgagcatcttattgtgcaggtttcttcaccgtttctactagcttcagggtggatcaatcatttgtacatgctccttcaccctttccaccagtgtcttcatcatcccgcagtttctcttcagctcaaatttcaaatggaccgatagacgctaagaaagccaagaaatcagatataaaagtaagactcttctagagcatgttgatatattctgggttcacatgagcagtcctgacatgagatttctacaggatcaaccaattgttttaagaagaagtgatacggagagtgaaaaaaatgatgaactagatcaaactccggctagtgagccttcaagcatgagtcataacagtgcaaattcgactattgtaagtaacatgatgccttggtgatgatggcatccatatatcctgaatactactattctctatttggtacataaataaatgcattttgtaacttgataacttaattgttccattgatagattaaaagttgcaggaacaatttcattattatttttaattaggataatggcaactattccgcaattttccaactaactgcaatcattagtaccatagtttagtagtcagatctgaaccacctatacaatcattgttgactgcagtttacattgacttcaatcaatttgttctgcatgtatcttgttaattagactgctcttgtgagagccttgctctgtatatgtaaattttgcttctatcataatagaacagaggacttctcccacacccactttggaagggacattaacttcaaactgaactaactctgcattttctagcagagattcaactgtagagaataccgtgtt

SEQ ID NO: 81823 - DNA, 2466 bp, Oryza sativa
acacctactagaggtgcagtacagcagacgatttgccctgggtgatgtgaggtcactcgccatttcgccatggtgattggtagtagatcggtgcatgctgcatgggcatcatggccgacgaggcaggaagcatctagaacacctgctgctccgctaagggcacccacaatggttatctataggctctctataagagatccatgtcagcatattttcctacttagaagagattaaatgaagagagagagcaaagctatctactaacctggagatagtctatagagaaaaacgagacaatgtattagagagctatagatacccatgtagacatactattgagatggtttactattattctagtctattgctgagatgtacatgttttatagataggaccttactttaccattgcgggtgctctaataagatcaagtataatagtaggttataagccggctaaatgctaagttggaggaaagaagagaggagagagaggagaagcgggctataaacttatagccggcttggacacaagaaccaagaaactctatgagagagacaagtgggccctgtattaattgtgaagagctaactattatataggtaggctgagagaagactataaagaaccttatagccagcaggtcggctgtattattagccttgctctaacctacagagattagcttgctgcaaaccaacaaatcgctagctgctgcttcgcttttcccgaaaaggcaaaagcggaggaaactctactctgtccaccacccacatatcctactaatatctcatcatgcatctcatgtctggataagtcattgctaatttgatactgtactagtaaatccaaggaaatttgttcatcagttcatgtgatggttgagcaggtaaatcgtaatttattcacttattaatgtgatatagtcctaacggttaggttaaagacaggccaggtgtattgcgtttcatcattttctgtttctaactgctctgcctgttcacttgtgtcctggaataattaactttggccattgaccaacgaccctcatattagcattggatcgttaggttgatctggatcgaccggtacggtgatccaagaataggtgttgtttaattggagaagttgacttttctgacagcccttgtgtgtacactacatcctcccatacttcctgtagtcaaatcggggaactcaagcttctgcaatttagttgattgatcgaattaatcagatcgatgaactttcaagaaaaaattaatgagatcgattgttcgttgcaatgtcagcaggtaacaacagtgccagtgccgacagctggttaatctgtcttgcaaattactactacctccgtcccaaaataattgcatttctatgatttaaaatttattctaaaataattgtaattctagagtactaattgccccatcaatcatatctcattcaaatttctccctattttaccctcaactatcttcccactctcacataaacaacatttaatgagagacaccatagtcttttttctcaaaccttaatatatgctaaataacataaaattgtaattattttgggacggaggtagtactaattggcaatttaaatggttgcaagatgcacatgattatcttaagaaacaaatttgatttgatttaggtccaacaatggatgcaatcaccactgcccccatacatgatccatcactttccttcacttcattatcacaaggggaccctcaccctaccaaagaatcaccattaatacagtagtaatagtatcctgttatttaaaaaaaatgattgaaatcggggcgcaaattattgcgattattattggtttcgaattaaaatccccccgaattttgaattccaacttggcaatggcaaccactctccccccaataaatagccgcgcacccgctccccctcacccgctcgctgcccatcacttcgccatcctcgccgacgccgacgccgacgagaccaaccaccatgtcgtacagctacgcctcgcggcgacgtggcgggggcggcggtggagggatggccgcgacggtgcttgcggctaaggtggcgttcgcggcggcggcggtcgccggggctggctccttcgcgcgcctcgccgtgccgcagctcgtgtccgtggccggcgccgtgttcccgcgggtgtgggcggcggcgagggtgtggctcgtgccgccgtacctgttcgtcaccgtgcacctcatcatcctcgtcatctggaagctctccgaccacaagcacttccaggcgcagcagcagcagctcaaggatccatggccgcacccgcatccggctgttccagtggccgcggcagaggatgcgccatcgcttgttgtcaagcccaaggaggagttcaacgccgcggcggccgtgtacggcggcggctgctgctgctgcatgccggagcactaatcctccccggagatctccccggactcc

SEQ ID NO: 81824 - DNA, 664 bp, Oryza sativa
cctgcacccctgacgtggcttgtgagtcagcgtaggacccacgtgggccctacatgtcaaactatccatgttagcctcctctcccttcctcctctcttcctctctcctacacacacccagatgagtcgtcggctctgtcgacggcggtggcggaagcgcgtctgcccaggagcgttccgtcggcggcgacgactgtagcgcatcggcagcagcggcagtagcgcgtccgcgcgtcggcggcggcggcggtagcacgtctgcccaggagcggcttcgtcagcggcgacagcggatgtagcgcgttggtgcgtcttcgtcgtcgttgccgccaccgccgtcggcgacaacctcctagggccggtaccgtcatcgcgggcaccatcaaaggagcagcgggagcggatgaggacagcggcggcgaaaaatcccgcatgcaaagtaattaagatcgatcgacaaccacatatttacaacagccaccacgcacatcatctcttcatcatgcatatatatacgcccgcatgcggagtaattaagatcgatcgataacaaggacaatggagaccaccggcggaggaggatctcctaaggaggcggtggtgccgtccgctgcctccggcgacaccacactcggccgccacttggcacaccgcctcgtgcaggt

SEQ ID NO: 81825 - DNA, 546 bp, Oryza sativa
  unsure (1)..(546): unsure at all n locations
gtggtcgaccggtcgccgtctcgtgcaccgnatgcggtgtttggtaaggtggggggcggtgctttacgagcggtaggtgggtggtgctggtaagccacgaccacgaaggtgtgggtggccaggtcggctgcagggagctgcgcgtcacggtgaccgttggatcgagaacctacggatcggatcaacctatgggagagtcatcacgaaccaagaaaattggggcgtgtgtttcgttgcggtcgggttactcaaacgtgcggtaacagggtcagtgggagggtcgggctttcgttgaaatttgacattttttgtggttgcccgtggctgcaagctatatccatccccgcatttcaacgagagaataaaaatgattctcctagtagaaaagataataaaaatgataggtgggtatattcttccgtttatctctgcttttataccggataatttttttggaattgaatctctttaagagatacttcctccgtccttaaaaaaagataaaccctgagtttccgtgtccaacgtttgaccgtccgtcttatt

SEQ ID NO: 81826 - DNA, 552 bp, Oryza sativa
atttagtaaaattgataattatgtgcctatgtttagtttgtcaccaaatattggtaatgcatatagaattttggcaacattattaagccaatcctacaaaaaatttggcaatgttgccaattcgccaaaatttggtaaggttcattttagcatcaatccgaatagccacttcatatctaccccattagcagtttaaaagccaatagccaatgctaaaagtgccctatgataaaaagaaccaaaatcaaatcaaaaattaacttttgaaatctaaattttggctaatgagacatggaagcaccaatagatattgaaagaaaaactattgatcggtattattgctgtagttatttgttcctttcgtcgatgaaagtacaaccacccattttccacactttttcatattgacttaagtcagcgaattactcgcggcgaggaggagtttagctttgagagttggaaaggaaatagggcggtgggtaaggcctatttcaaaattttattggtgggtggtactatatgtgtgactgaggtccatcaaaactgtaggtg

SEQ ID NO: 81827 - DNA, 857 bp, Oryza sativa
tgtttacattacgattgatgaccatgttgtgcctttagtggtttacaagagcgtacactttagagctgaggcattgttttgctgaacaattgcaacagttgattgtttgagacggaagatgcccatcataattatcaccatgcaataaatttgacgagatcctgtaacaactaagaattgatgttttctctataaatggatggtgacatattgagagaaaggataagtattcatatagctatgcattttgcactattctaacttgaataaataggcttgtctacctcgttgtcattagtccttttgtccttaacattagtatttgcaagtaggaaacttaccaggctgaagaattgggaaaggctcctcacaatcttctcattggttgtaaactggatcatacttgaatcttggatttaacttagttcgttagagttctgtgtttatttgtaaattttgtccctgcgttcagtacctgtagactgcagtgattcaataggagcatggaaatatttcaatagaatcgattattagtgtcagtacgcatgcataatgaattaatatgactgccatgttaatcgtagtactgaaatatgagtatatgacaggtagagggctttctgaaggcaatgcaaaaacagatccattcagctggaaaacgtggttttttttcgaagaaatctgtgggaccacatgttcgtgaaaagttcaccttggaagatatgttgtgcttccaaaaggtgatgccatcaatccccacattatctgttaggttgcattttgagcaatttgtttatgttttcaaatcctttgcaaaagtataagattatgataaaaatggcgatgcttctattatt

SEQ ID NO: 81828 - DNA, 3017 bp, Oryza sativa
tgccagcagcttgctgtagtggacgccagttacaaattggctccaaatccaaaaggctcagggcgtcccattccgagcacgcggagagtggcttgcaacggataatcaatcctaaatttctaatcccaagttgatctgttctttttactatttagagcaggtacaatagcaggctataagccaactgcaaatatattttaagtggataaataaggagagagaagagtagcggactacagatttatagccagctgtagcacagactccaagacgcagtgtgtgtatgacaggttggaccaggtattaatagtgtagtatgtaactattgtatgaataagctatggctatagatgaattagagctagtagttggctatactattaaacttgctcttagatgcatgtttgaatatcaaagacgtttgtctagcttgcatgtacaaagtcctaatcatgccgccgagcaggccgcgcgtgctccgggcgccgccaccgccgccgagcttgtcttctaccgtgaccacttgtccgcagaggccatgtgcctgcaaaagattcgacaccattgccagccacgccgcgatgcctcagcagccaaccctgccgcgttcttgccgcaaagtgccgcaaagcgcgcttatgggagcatctcgacaaccacagcactcaccggtcagccaacatgccgacaacctcaccggagaagagagaaaggagggagagagaggaagagaaagataaaggaggagcaatttggtcaaatcatgtaaaaaagtggatcccctctcatccagtcagcatgaaaatattaatttaatggatggagtgttccctagcaaataaccacatttacatagtgtgtctcacaaaagtcacttcgtgcagtgtcctacagctaaaaccacgaagtcgtgatgtcttatagcaaaatttgccaaaaaataacgctagaattagcaagctgttggcacatcagcctcaagatgaccgatgactgttgggcttgtgggctaattgtgctaggcgtgcagcactagcagcaaccttgggctttggcccatccaacgagtacgagagcaagcagcagcagcagtttgcaagtctgtagggaaagaatgatcctacctcgagaatttgaggcgaaatgttatttataaggatgctttgccctgagcaattataacaccgagtttatttttacatgagtgtgtcagtacagcgtaggagtggtgaattgggcctatgagacgatgggtcggaaaagaattctccgaaccccagtattcgtcacgatcgccgtgcatacatatgttcaaccgaacaccaaagcaagcactgcacgatatataacacaccacggagtagtattcaatggtcgagggtgaagtacatgtcgaagacgacgacgatggcggtgtccgtggagctgagaagcttgctggtcatgtacccgcgcgcgaaccggagcttgcccgtgccgccgacgatgctccgctccgacgggcccgtcgtgatgaagtggccctgcgtggccagcgtgctgccgctgtacgcgccgtagtcggagaagacgaagttgatggccgtgaggccgcccgtctcgtccagcgacgcgtgcaccgcgaggccgtgcgccctcccgatcagccgcgacgccgggtccggcccctcccgcagcgcgttgtccaacacgttcacgtcgccgaacgtcgacgagttcctgcagtacatgttgtacgtacgccatcacgcaggtggtacatactctaattaagagctattcagattatagccaaaataacccttacaaatgtcaaaattttaacaagcttataatattattaaaattttaacatgatcttttatgtatttagtaaaatttgacaacaaactaaatacaggtactttttaacaattttataaaaaaaaagatacggttgaaaatagcattaatctgaacacgccctaattaagcttccatggactcatggtcaggtacgtaccggtgaaggctggcgacgttgacgacggtggcgttgggcgtgccggcgtcgacctcgtggaagtagaagtggagatgggtcagctccgcgtccacgacgctgcagacgatgatcggcaggaggcagaggacaaggagaggaaaccgagcagcggccatggagtgagctaattatctcctcgatctgtgcgtggtgtcagtgattgctgagccaattttatggtgaggaaataggaataagaggctgtgtggtctattacattgtactcacaaaaatgacccttcgatgcgcctcgtcttgtttggttgcgtgacttccgcacctcgcgcgagaggaactagtgtattcttccgctgccaaacgttggatagtcccaatctgatgtagccgcaaggttgttgcatggaacagttgtactttatttatttcaagtaacacgcatcttatttagaataagacgcctgtgttcgttagtgatagtttggaaattttttccctccgtatgaaaactagatagttcattagcacatttataattaagtttaaagaatttaaaaatagattaatataatgttttacaacctttttatatatttcttttaaaaaaagtattgtttagcaattcaaaaaaacatactataaacgagagcagaagctgagaaatgagttcagaacgcagaggctagctcacgtaatttctactatatcctaggtcaacttgaaaggattgatgtcacactaataattagcaactgataggaacattttatcgaacgataacgtggaaatcaccatccgctagtccatctgatgccacaaacatttgctacactgctatagaagtgagcagaagcagtagtcgtggcacaccaatgttcaggggacaaaaaggagcttagttctaataactcttccaccatctgattctcctatgaatgtgtgctacggttccctttgtacaagaggcatcattgccataatataatctgttactatacaattggtgtacaacatt

SEQ ID NO: 81829 - DNA, 18815 bp, Oryza sativa
tactgaaaaagtaaagttggggtttgttacacaactcatttgcgttattattataggattgctaaaactgtagggccacatttttttttcacttaaattcggttattttttttccttacgtgattgctctctctctctctcgtataatgataaggttagctaagttttctcattcggagatggattttcatccctcgagaagacatctctcgtttcttacgtgtcacctattaaatcatctttttttaaaaaaaaaacaagatacaaggtcaaatttatttttttccaagttataataaaagaaccaattaaactgaaactagttaacatacatttaccgttatatttttttacgacttgtagagattgaatttaaacttgcatacttatggagtgatatatttcacatgtatctatcttatcatttttttaaaaaaaaatctaataactatttaggtgatatatgggaaacgagaaatgtcctcacaaggataaaaatattttcccgtctcattctactttatattactacaatagatggatgaaagagttttatcattatattttattgaccttgcaagagatctagtcttcggcccaagattaattttctcttgcaatttgattcaaacctgtcattcaacttggaatcgattgcacgttctaccatgcacgaagtataccgtattgaagaataagtttaggagaaattttataatcctgaagaaagcatctcaagaaaacctaaactttaataataacacaggtcccggaaggtgttgctgacaagcggtcagcggcgtacaacaaggacaaggtgttcgtgcacggggcctcgcaagcgacgggcgcggcctaccggcggcagttccagtccgacatggcgcgcttcttgcggtgccgcgccacggagctgaaggccggcggcgtcatgttcctcgtctgcctcggccgcccgtcactgcacgcctgcccaacaaaccaaggccgcgtccagcttctatacggcgccatgttcgaggagtcgtggggtgacctcgtcgaggaggggacgatcgggcgcgagacgatgggcagcttcaacgtccccgtgtacgccgcgacgctggaggagtttggggaggccgtcggcgccgacggattgtttgagatcaaccggctggagctcgtaattacgagccctctcgctgtggacgaccccatcagagaccgccgcgcggttgcgaactacgtgcgctcgctcctcgggccgctcgtcgacgcgcacgttggcagggcggtggctgacgagattttcgtccggatgcagcgccgcgcggaagcgcgtgccgaggagctcgtggacgagatgcgtttcccccatattgtgtgttccctttcgctggcgtgacggacgggtattacgtgcgtatagacggtgtaatatgaagacgtactggatgtattttacgggaaagttttatagctcttggtcataatgtcctgtttcgttatgaaagaataaaactgtttgggccaacaatgaagtaatttatatttttcgctagtcgttttaagtttttcgagccagccagagtaaattagcagcagtaaacagtttaactgagatgtccgtggaagtgtggagccgcgcgcgaacagcctgccgatcctctgttccgacgggcccaacgcgcggatgcggcccagcagcgtggccagaggcctgccctacatgcgccgtgaagccggcccgactcgtccagcgacgcgtaccgcgtacgtgcaccgcaatgaggtgatcagccacgaccccgggttgagtccatttttgtcgaatacgttcgttcccgtcggtcaacggagatgaattctaattgctcaagtgaacattcacccgtttattatatgtcaattagatggttacgaacaaaatttaaaaaaaatttgacaagataaatcaatatgtaatatatcactctacaagcatgcaagttcaaatttaacttctacaaattgtaacaaaattaacaaatttaattgtatatatacatattgtaatttgagttttgtttgttatttttttatatttgtagaagttgaattttaacttgcatgtcgtggattgatatattacatattgatatatcttatttatattttttttacttttttaaaaataatttagatgatatgtaataaatgggtagacgtccactgctcttaaaacagtttcccgtcggtaaacacatggacgagttccgatcctgcacacatgtacgcccgagtgatgtatgcatgggcacgtcatggtcagctaccggccgtgcatgcagactgggcgtgcggcgtgccgctggagatgatgacgacgtacgtatacggtcgcgttggccgtgacggcgtatgtcgacctcgcggaagtagaaatggaggtacgctcagcgcctcatctgttcgtcaggaagcagctctccgcggcagcgattgccgaggggttcgtggccgaaacgcggttgagtggttcccccacgtcatgtgtgtttgatcaatttttggcacgcgtgacggggggtattttaatttggtgctcgtgaccgaaatggacgtgcgatgcatggtcttttgtagcaccaaattccgcagctatcacgtttttgaaaccgatctatttcttgggcgtacgcaagtgtagtgaggtggctccgtacagagaagaatttgatactcctttcatttcaaaatatagtaatttaaaattaaatgtaacacatcttaatataacgaatccggataaatctctgtctagattcactgtgtattaggatatatacgtgtcatccttggctgtaggttgtaactcgttaagcaaagcccggaattatattctattatctaaagaaaatatatgtcatccaatattgtgttataatattttgggacacgagaagtattagttatcacttgaggagtgtctataactctaaattgggtcaattgaagcacgaatattggattgcctatggccgatttccaaaattttcagaattccggtaacccaatattaattgttaaaccgaaatgttcaaccctgaaacactgtctgatgagactgttcagttgacaaaattaatcaatctttcatgcatgttagattgttaggtagctaggcgtacgtcaaggtgttccgttcaaccgtgcatgtatgcacgcacgctatatatagttaattgatctaccctgcatctcatctcacaaaaaaaaaatcatatcatcacctttctttaaataaaatggttgctggcctaatctggttgcctataaatataatctagtttaatatcccttctctcttacacaaacttatcttcttatgtcaatttttttaaacactattatagatgtaggtgcatatataaacacatgtaaactcacctgtataaacgtaaaagtgtattgtgcccattatttatcacttttttcaatatatagacttaccaacttctttaccttaattatataatccttttcagaattgtgtttcccaagtcttaacttaaattttgagaaaaaaatttcttgcagatatttacttctcaataactctatgcacgtctccgttgtattatgttctagtcttacagtccatttggtaagcgagcaaatattcatcaatctgtttttaaagaaaaaaatcccctaaaatcctttggtgcgcttaaagcactatatttaaaagatgatatttttctcttttccctagtgcctgcttataaaatctcccctttattgtgtccactttcttatgcatactcttggaagtttatagaagcctatggtgtatatttggaaaacttgaatgcaacaacatgtgatgttctcaatcaattagagcctttcacctcttaatttttcacacctacttatcttctcaaccaatcacaatcttttcctatttatttttacctacttttttataataactatgttctaacctaaatttttttgtatttttggatgaatgtagtaagaatttatcaaaaagtcgcctcgccttccccacccccaccaaaaaaaacaaataaaataaaatagatgggtgctttcccaattgtaagaatcaaatctcttccccactttctgaatcacgccatataactactttccaacttttcctgtatcaattgtcatgccgaaataagttataggaaacttcccactttgtagctcagcatatcagccactctttcttctctctttatcaactcttaccacaaaaaccttttttgcagtttcatttcagacaaagcaaattaaagagcagaaatttcaaggccatgaagtttttgtcaatgactttagcaacaaaactgtatcatcagagagacagagacagagacaactatatatattagatatacgcccccatcaactctactcccgcagtgtgcgcacggtggaaccaagataagatgcaagcgcaggacatgaagaacgtcttctgcatgaagggtgggcaaggggagtccagttacctcaaaaacagtaaagttcaggtaacaaatagaactaaattaattacctaaatgctataacaattaattgaagttcaaattctattttttatacgtaaagaattaattgttgaagttcaaattcagcattcaactttagtttttaaaaaatcagcatgcaagtatgcaaccagaggctattatgtttcattagcaagttgcttccctgtgcttgatcgagcgaaaatggcaactaaatgcagtttagaaacctgcaaatgatgctgcgtgccctggaggagacactggacaaggtcgtgctcccacaccacgggccggggaggcttctgctgacggcggctgacctcggctgctcatgcggccgcaacacgctcgtcgtcgccgatgcgatcgtgcagcacatgaccaagctctgtcgtcgtcgcggcaagggcgagcatggtgacgacgccgcggctgatccggagttctgcttctacttctccgacctaccgagcaacgacttcaacaccctcttcggcctcctcccgcaccgcggcgccgcttcctccggcgaaggcggccgtgggcggcggcactacttcgccgccgccgtgcctggctcgttccatgaccgtctgttcccggagcgatctatcgacgtgttcacctccaccttctgcctgcactggctctctcaggtaacgcaccattatagatttcgaggcgtgttcacctaaatgagaatcaaggagcttgattacatatttacataggtgccggaagaagtcgccgacaagtggtcgccggcgtacaacaaggagaaggtgttcgtccacggcggctcggaggaaaccggcgcggcgtacaggcggcagttccagtccgacatggcgcgcttcctgcgctgccgcgccgcggagctgaagcccggtggcgccatgttcctggtcttcctcggccgcccgtcgtccgccggcccgaccgaccaaggccgcagcctgagccagttcggcgccatgttcgaggagtcgtggcgcgacctcgtcggcgaggggttgatcgacggcgagaggatggacagcttcaacgtcccgtcgtacgccgcgacgctggaggagttcagggaggtcgtcgacgccgacggctcgttcgaggtcaaccggctggagctcgtgatgggaagccctctcgccgtggacgacgacgacgacgactcccacgaccgccgcgcggtcgggcgcacggtggcgaacaaccagcgatcggtcttcggtccgctcgtcgaagcgcacatcggcaaggagctcgccgacgagctgttcgtccgggtgcagagccgcgcagaagcgctcgacgacgagctcgtggacgagatgcgggtccacatccacatcgtctgctcgctttcacttgtgtgacgatacttaaatcgtacactgtcctaatgaaaaaagaataatcaaattccgggtacaataatttaattaaggttatatttggcacatctcataattttagataagtttgtatgttaaattatagtggtttaaacttttatatttcaattaaaataaaaacaaatgatgcatccattatcaatgtaatcgcagattcagatccatagatttatggagttatggatattcatctttaagaaatttcggatctagagctataccaaatagcatgtaaatataataattgaatttgttaaataattctatctcatttgttggacatgaaagttgggagtacttggcgatgcaaatagtagacgagcaacatgtttagtttgaccaaatttatagaaatacatagcaatatttttaaaacaaaataaatattgtcgacagggatacccgtagaccggatatagagggtattagggtacgctggtacaaggatctatgtaatacgacatcaagcaggcagaaaacaaagattatactggttcagaccccttggtaggtaatagccctaatccagttgatatggaattatatgatggaaaccacagattacaaagggaatagtggaactcgacggtaccgacgagatcgtaatcgagttgatccgattagatctccgacgacttggctccgataagctccggcttcgtaggctgtggtggatgtgttggctctgagattcgatgccttaggtccttccggggggtcccttttatatcgcaggtcaactgtctccaagtaggactcggagaagccggaccgaacacgacacaatgacaacccagttctgaccaaataggactccttccatctgtgaactccatgatgaatttccttaacgtatgccgagcacgtccgtatactcgtgagcataccatatcgatacgtgacatatatcgaagggtagagggtataccttacccgtaaccctgacactagcccctgacttctgcttatatgaactcgtgaaaccgatcgcgacttctgatgtcgaagttgtcgtcgttcttggcgtgatgaccgagagacgaggagtgatcgacaacgccgggtgaagctcaacggtcatgagtgaatttaaattgaagtccgagaaactgccgcatgtaacggacccagaaatttccggcgaccatctctctcctttccttggaattcgcaccatcggggtttaagggagttttggggatccaatttgaggtccgcatgttaaaaaaaaactctccagcttccaagcatccctcgtcttcaccgctcccgcaagaaccctagctagttcatctcggtcccttctccggtgatccccggcggcgatggatctcgacaagtctacctccaccagcgcgtcgctgaagaagctacaggcggatggcacccttcccggtcacgggaccatggagagagaagcaggaggtattgaaccccagcctgtcctgggtcgcatggttgcgattgaggactacattctctgtggttttcttcctccgccttctgaatttcttcttttggtcttgaatttctacggcctttctttgctccatttgagccccaactctatcgctttcctcagcattttttcgcatctttgtgaggcctatattggggtagagccgtttcttaacctttttcatttctactatgagttgcgctggatggaacccaacagggcatccgggtgtgccggtttcagactccgagatggcctgaagtcgcgctatatccccttccagtgtccttctcatagcaaatggcgtgcgaggtggttctatcttcagatagaaaatttggatccagtctttgttgttcctgaggaacaaccagacaagatttcgtcttggaccgcaaaacccgccttgaccccatccctccaagctttcattgatatcattgatgaccttcgagtacgggggttgtcgaggtatgaagtcgctgccgacttcattggtagacggatccagccactccaggctcgagcccatccaacctttgactattctagaccggaggacgcgacccgggtttctcctcggggtatttttcttgtatttacactgacttgcttatgtgcatgttcctcctgacttatcgaattttggttctcgattcacaggtctgagcagcgaagccgttgagcgccgtgtgggctagttgattatcagcggcccgacaacggcaagccacgtccttgttccccttagcgagaagggggcagccgaacgcgaagctgccatcaatgtaagtgtactcggcagcccttctgcacttttattccaagatcgcattgtgacttcataaagcgtaggctctccctctgactgacatcatcgggccgctcgtggatcatcaggtggcggcatcgctgaaggaggacatcgccaaggaggcgtccgatgttgctgccgctgctgccacaacgagtggcggctacgttccaaaaagggggaggaaattctcctccgtgatcggaaatcgttggaagacacccactccctcggtaagctttcctggtccctcatcgcgtactcggaaaacttccacctcacatcatacccgttatactccaggcctcggacgcgtctcccccgcctccgcgacggcagcggcttgtgacacttggcgagaagtaagtggatgagtttgaggttttgtcacttcgccaaattcttgtagcctgtctcaattgcaacctttcgcggagcggcgcgggcaaaggcgacgcaagatgggtctggaggaacctccagcgcgtctcctgctgtggcctcgacaaatgtcgtggtcgtgcccaggagccgcgaggcgacgcctagtgggccggccagtgatctcacggctagtcggggtccgccggctgccgtccttacctggaaggagctccaggtcgagatggggcgcctcctcgaggctggtgctcgcggcattagccgcgagatcgcggaggcgagggcagcagcggcgtcgtcggcgaatgagcgcgccgatcggctgacgtgtgatttggtggaggttcgcgaggacctccagaagatgagggagttggtggccggcaatgagcgacaacgacaagggctcgagcatcgtatgtcggagcttgagaacaacttgtcggagatccatggctccctacgggtcacctacaccggtctgcaccagctcgccggggagtgtggcgtcaagactaccatcccgacaaatcccgacgagttctcgctgacgtcttcgcttgcagaactggcgacagcgatggagacgtccaacgggatctacaccggggcacaccatgtccacgcgtgtgtgaggctggcacaccctgaactcgatctccagaagatcttggatcagggggcggctagcgacgcgcgcaaggatatgatagaagaagttggcgatctgggagagtctgtcctcccgctttttgaagagtaggatttcggctccctcgtactcattagacatgctgtataaaactctaattggttccaaccgcctttgtgcgtgcagtcatcaccttaattttctttagcattgtgatcttgagtactttgttgtcttctgtagagacgttgatgtcgaggatgtccagcagtgcgggcagcctgagttgccagcgatcgttccagcacttgcgttcgagtcacatgtgctacagggcaatgtagatcgaagttcgcccatggaaacgggcgtggcagcgacttccttaggttggttatttttgttttcatctccttcacccttctgtctggattgactaaatttgttgtattctcgagagagaagagcagtttgacttagtcgtttccatgctgagtagacctcgagagtgcgctagctgaccaggatcgtcgtattcagtattggaagacaaagtttgaggtcgcggaactcgagagggctatgctagaagtgaagaaggaccaggccatggagacactccggagtcgcaaggtgtggttcaactcgtatatgaagagttgctgcatctccatgtcgagagtttgtagagagctccgagtaccccgtggggatcccgaggaatcggcggccggatacatctcgtggctgaatggggcctgcacccagctcgatggcatcggccagcgtatcgacgaggccttgaagcaagagtgtcatcgatcgagccgatatgccggggggcatgtattggcttgtatacgagatcatcgtccgcagctgcaccttgagttcctccacgaagggttttctcgttctcggagaactcctacggagatagacggcctggcgaagtcgatggcgccgctggcggagaaagttttccagtcgatggaccggcattggccttcctagtagtctccgtgtcctgtgacaaatgtcttagggcaaaagtgtaatatagttttggatttttatgggattgtaagaaatacttgtgaaatagaaaagaaatctatctaactaagcttccttactctggatgtagtgtgtatgagtgtcttctcacttcgcgactttgatcagtcatttgagttatacactctccctagcccccagccttgtcatcggagaattcttctcggaagataaggctcttggacctttgacctgcctcggttgaacaagcactgatcctagccccagccgtgaagttggaaagtttatttccgattacacggcttggttaatacgcacggcgagaactcttacatgaccagatcttacatggtctttcgtctctacaggatctatcaaggccttatcggctctgggcgtccccagccgaagttcccttaggttcctcagaggccttgtcaagacggcgtaaagggacatgaggataggtttcaacgcaaggtgtcatctaggtaagggatcctcgggaaggaacacttcgattgtgatctggacctgaaaatatgctttattgaagctgtaagatgtcttacaagtatggatactattgacttatacatagaatttacgtaattgatcaatgttccaggaatttgccaactcgtgaccatcgccgtctgcaattttgaatgcgcctggccacagaacttgtgtgatcgtgtacggtccttcccatttgggtgagagcttgtttcgccctgcttggctttgaacccgtcggaggacgtagtcaccgatcgaaagcgtgcgtgctcggatgcgcttctcgtggtaatgacgaagggcatgttggtagctggctgctcgaatggcaactcgttcgcgatgttcctcgagtagattcacatcgtcgtttcgctgctcctcctgatcctcatcggagtacttatgtactcgtgtactttggtgtcgtagctcggtggggagcatggcctctgagccgtacatgaggaagaagcgtgtctccttgttggatgttgtcggtgtggtacgcacggcccatagtacagatggaatttcttcgacccacttcttgtcatgtgacatgagcctgtcgtagacgcgggtcttgagtccttgtagtactatgccgttttccctctcgacttgtccattgctctgagggtgagaaaccgaggcgaagcagatcttgactcccaacctgatgcagtaatcctggaaatcggcactgatgaactgggagccgttgtccgttatgatacggtggggcaatccaaatctgcagaatatccctttgatgaatttgatggcgttgtcggccttgatttcccccgtgggtgtcgcttcaatccacttagtgaacttgtcgatcgccacgaatagaaacctgtagctgccctgtcctcgtgggaatggcccgagtatatctagcccccagcactagaacggccaagtgagagggatagtctggagtgcttgtgctggtagccttgtgtgtttactgtggaattgacaggcttcacaccggtgaaccatgtcgcaggcgtctttgagggcggttggccagaagaacccttgtcggaaagctcttccgactaatgtctgaccgacagcatgtgacccacagatcccttcatgtatgtcgaggaggaggtgtctgccgtcgtcggacgagacgcattttaggagtaccccgtttggtgccttcttgtatagatcgttgccgatcatacaatagacttttgctttacgggatattttctcggcttctgcgtcgtcctcgggcaactcttcgctgcttatgaatttaatgagtggggtgcgccagtcgtccgtggtctcgatatcggcaacggcgcgctctgcctctatagcccccgagctggtgtcaggggtgaccgggctatcttcgccccttgcctctttcactgatggcctcgtcaggacgtccagaaaggtgccaggttcaagtggttctcgtctggacgcgcgtcgtgctagatcatccggttcgatgttgtctttgcggtatacgtgtcggacctcgatcccatcgaaccttttttccagcttcctgacttctgcgagatacttggataactcggggttagagcacttgtaatctttatgcacctggtttgcgactagttcggaatcccctttcacgatcagtcgcctgactcccaagtagtccttcatattcggctgtgttattggttgccctgaagttgaggtgaattgcatgcttgaattgatctcccgaaggtgatgtcaagatgaatcctgcccctgctccccggctgttgagtgctccgtcgaacgccattgtccatgtatcattgtcgatttggttgtctggcctattatcaggcatggtccaatcggctacgaaatcggcaagtacctgtgacttgatggctgttcgtggtacgaagtggatatcaaattggcttagctcgactacccatttcgcaatgcggccgacaacgtctttgtttctcacaactttgctgagagagaaggaggagacgactgtgaccctgtgggcttgaaagtagtggtgtagctttcttgatgtcatgattactgcgtagagcagtttttggatctgtggatatcttgtctttgcgtcgtggagagcttcgctgacgtagtagactggtcgttgcaccttctctctctcgacaacaatgacagtgctaacggaatatggcatggcggcaatatagagaaataattcttcattacgttggggggcaacaagtacaggtggattggataggtagcgcttgagtgcaataaatgcctcttcggcctcctgtgtccatacaaatttgtcttgcttttttagcagagcgaagaaaggttgtcctcgctctcccatcctaacgacgaacctgtttagtgctgccatgcatccggttagcttctgtacttccttgagtcttgtaggcgacttcatgttctcgattgccttgatcttctcgcgatttgcttctattcctctgccagagacgaggaagccgagtagcttgcccaatggtactccgaacgtgcacttctctggattgagcataaggcgatatcgtcagagattgtcgaacgtttcccacagatcgtcaatcaatgagtcgcttgtcttggtcttgacaacaatgtcatcgacgtaggcctcgacattgtttccgagctggtcgctaagtgcaccttggaccgtgcgctagaaagtgtttcctgcggttattagtccgaacggcatcttaacgtagcagaataccccgaatggcgtgatgaatgttgtcttctactcgtcttcttttgccatgcttatttggtagtaaccggagtaagcgtcgaggaagctcaacaactcgcaaccggctgttgagtccaccagttggtctatttgaggaagaggaaaatgatccttgggacacgccttgttgaggtcggtgaagtcgacacacattctccacttcccgttggccttccgtaccatgactgggttggctagccactctggatggagtacctctctgatgaaaccggctttgagaagcttgtcgagctcttctcgtatggcttgttttcgatctggtgcaaatctccgcagtttttgctttactggcttggcatcgggtcgcaccatgagtttgtgctcaatcacctccctgagtacccccggcatgtcggacggctgccaagcgaacacgtcagttgtcgcggaggaaggtgatgagcgcgagttcctatttctcacctagtgatgccccgatcttgacggtcttgtcgaggttggcactggagagtggaacgatcttgattgcgccgtctggtttcggcgtcttgtttgtcttgctcactttcttgggtggctctattgtggcaggcgggctgggcgtgtgctcgaccatgtcgaggctccgtttgtcgcattgtactgctagcttagcgttcccttgaatagtgattgttcccttcggtcctggcatcttgagcacttgatacgcatagtgagatgcagccatgaacttcgcgagtgcagttctcccaatgatggcattgtatgctgtatcgaattcagcgacatcaaaggtgatctgttccgttcggaagttgtttgcttggccgaaagtcacaggcaacgtaattttgcccaatggtttggacgatgactgaggagtgattccatggaagggttgatcggtgggtgtcaactcacttcgtgggatccccatcgcgtccaaggcgctggcgaagagaaggttgattgagctgccgccgtcgatcagtactcgggcaaccttgatattacgaatagtgggttcgaccacaattggatatcgccctgggatgacagcagtcttggggtggtcctcttctgagaattctatcttctactcggaccacttcatcttgggcacagccccctgccatgtcgaacagacttcacgttccactttcttgtattctcgctttgaggagtatgccgtggaacctccgaagatgtgtgagacatggacatcggagtctgggtatgctgagtccaattcttgagtaggcgcctcagcgtccttctcaaccacgcgtactcgcttgcctttttccgatgccatgtgttttgcgagccactttttgaagacgaggcaatcttctagagaatgtctgtccgtcttgtgtatagagcaccatgctttcttcgtgtcactgccttgtgggtctgggcgcttgggagggtccgcgtattctgttgcgagaatttccgatttagctttccttttcccactcttgcgatttttcttcttgttcgactcaagtgcgtccttggctggtttcttctctactccggtctttggtttgtcgttcttgcgtctcagtgcgtcatccgcatgagcacattgatcgacaatttcgaataatctccgagtagtcgtgatgcgcctcgttgtcaactcctgagtagtgtagcgatctctgacaccggatttgaaagcgcgaattacagaagcatcggtgatctcagggattgtgtttctgcactcgttaaagtgccgaacataatccctcaaggattcgcccgggttctgtgtcaacgcatgtaggtcgtcttcgatcgcgtggcgcttgtaagttccttggaagttggctacgaactgctgccataagtttgcctatgaagagatcgagtaggggggagatgcatcaaccatgaacgtgcagagcctttcagtgcgttggcaagtaattcgccaacgcgttgtcgtccgctccggcggcgtagagtaccgtggagtaaacctgaaggaactcttccgggtcagtgctcccatcatatttctctattgctacaggtcggaatctttcaggccatcggacatcccgaagtgaacgaccgaaagatctacacccagcgctaggggcggtgagttgtcggcgatcatacgttcttcgtggatgtctatctgatgatgaagatgacgaggatgatgatgatgacgatgggtcgcttgtttccggcgtacgattatggggacgtcggccgggttctcgagaatcctgtcgtcatctcccgctgttgtctcggcgccgatctccatcatcgtcgtcattattgcggcgtcctcgaccagtatcgcccagcacccgccgttcgcgatcgtcgtgatcgtggcggttgtggcggttatcacggtctcggtcttcgcttgaacggcctcctcgatcttcgttattgtgacgccgtgaagaaatatgacaccgggaatggttctcgttatctcgtgtgcgtcgcgcctctcgacggccattcaggtgatctcggagatcaccggtgccgcgaggtggaggggtggctcgatgaggcgattcccgctgttcagggttttcaccattagcatcgccagttggtggctgttccgggtgcgctgcagcagcggtctcttcgaacgcattgctgaggttggtcactgattcccgtagtcgttttgtccaacgtgcgagatcgtcgttcagaacgtgatcgtagggggtttccctcagtattgcgttgacggctctgatgagctgggccggagtagtcacttgattctccgcttccgcaccggtgcgcgctgacgtgccgacatcgtcgatagccaatacctcacgcggcgtactcattgtcgatgatccatagtcttcgagtaggtgcaagactgatggttcatggggatcgatgtcgattatcccaacaaatcgatctgaaatcggcatcgctcattgttccttgtcctcatccctgatggggatgcgtgactgctggaccttaggaggtggcgtcttcatggcgctgagaaagaccttgcagctcgagagatcgtgattctttgtcttgtgaataggacaatagacatcacgagttggagaggtacgctgaattccacgctctttacaggcacgaatttcagcatggacgttgagaaagacccagcatgcttgcagggtgtgtttcctggttttgtggataagacaccaggaccttgtcacctcggaagtaatccttgtcggctcgtgattcctgtcgggaagacaaggcttggccgcactaggatccttctcgggttcggacgtcgtcgacgttccgatctccgcttcggcgggtagatccttcgacatggagtcgccccgggttgtagccactgcgttctcattttcggtcattggcggaccagctgagatcggcatagtggtataaaccggaaagacgatttcgccgacttgagtccacaccagtgttgttgaagtaggaactccttagttgaggttggtgttgacgctgttgtcgacgaagctggatgtcatagtagtagaaccttgagcaccaagtccccctacctggcgcgccactgtcgacgggggatacccgtagaccggatatagagggtattggggtacgctggtacaaggatctacgtaatacgacatcaagcaggcataaaacaaagattatactggttcaagccccttggtaggtaatagccctaatccagttgatatgagattatatgatggaaaccacagattacaaagggaatagtggaactcgatggtaccgacgagatcgtaatcgagttgatccgattaaatctccgacgacttggctccgataagctccggcttcgtaggctatggtggatgtgttggctctgagattcgatgccttaggtccttccgaggggtcccttttatatcgcaggtcaactgtctccaagtaggactcggagaagccggaccgaacacgacacaatgatgactcagttctgaccgaataggactccttccatctgtgaactccatgatgaatttccttaacgtatgccgagcacgtccgtatactcgtgagcataccatatcgatacgtgacgtatatcgaagggtagagggtataccttacccgtaaccctgacaaacataatatcaaatatattgaaggttagatttaataaaattatttttttataagagttgttatatttttatataaagtagcacggtggtccacgcaaattatgttgctaacaccgttatattttcacataaataacatatacattttcacattttattattaaattatattaaaatggaaacataattttaaattatattctaacttatcaaactaaccaatatgcaattttcatattgtagtatagacacgtggtagtttgacttagactaaatttactgcgtcttatgagagggggtagctagctagcattgtttgcaagcttaatttggttggctcgattaggaaacccgagcatatattccattcagtatgctacccttcagacgtagggcctgtctgctttattcatatccatctatcctaatagtctcgaatagatcagtgtcgaagctaaaattatttttaacatgagtggagccaactagttaggtaatgactatagaaaaaaacaacataacagtgttggttgcctctgttccaagcttttctatgcgggtcgttgtggaacttatattgatgctctaatattctgaccaagccgtgttctctctaaaatttttagaatataaggatgggaactaatatgtaataacaattattttcctcttcgtgctagaagaattgaagtttgactaaattgaagaattgaagagcatagaaattagatctctgtgttcgaaaaaaaaatgttctcaccggaataacccaacaaaatatctaccttgtaatatcgtaagcaatatgtactgtggcgtcccggaataattgatggagaaaaaaaacataaattttttacaccgcacgaaatcacttttggggaaacacactctataaatatgattatttgtcatgggacactccatccattaaattaatattttcgtgctgactagacgagaagaggcccacttttttacgctccttgaccaaattacccctcctttctccttctcttcctctcttcttccttatctcttcccccccccc

SEQ ID NO: 81830 - DNA, 4648 bp, Oryza sativa
acattgcggcggcactagcttataaagggactcgctaatacaagacaaaagagatgatgtcaacagtacggcaacaggggtgtgctgtagacggtccaagctcatctccatcgtccgatcttcataatctccagcccaagcgttatcgaataatcccagccattgggtaactgaacttgccttcccttccagcgttcaatcatggcttcagttcgtcagagttctcacaccaccggccaccgcgcgaccttgtctgtaccatgcgcgagtcatcttttccttttttttgctctactcctgatttttaccatcaaccatatggccataagggttcgttcaaattctatgtactacggaccctcattaaaatgactttatatcccactgataaaaaatgacttcatattcggggtcaacaaaccaaaaaggaagcgttgaatgttgatgtgttcagtaaaaaaaaaaaaggctaaaggtttcatcgtggcaagttatatatgcgatcgatacagtacagctttgccagctcgatccaactaattactcaagaacaaattatacacatacacggatatacacccccattctcccgtcgtgcggtgaattcgatcaagatagaagagcagcagcaggacatcaagaacgtcttctgcatggagggtggccagggcgagtccagttacatcaacaacagccaatctcaggtaattaacaaattaagctagactaattacctaattaatacaagcataactgtatgcaatcagaggtggctattaattacctagtaagattgctacgcctgatcgagcaaatcaaaactgccggtgcagtcccgaaacctgaaaatgatgctgtacgcccttgaggagacgctggacaagatccagctccctcgtcaccggccggggaaaaagccgctactgacggccgccgacctgggatgctcatgcggccacaatacgctcctcatcgcggacgtgatcgtcgaccacatgaccaagttgtgtggcaccggctcccttaagtggtacgtaaacaataaaataaaagtggcagtgtggcactatagctcagtagggagacgcacgcaggagctgctggtgcatggttgcgagttcgatcgacgcccacctcacgcaatacgctttggtttttaccccaaccaacgtgcacagatcttgaagtccatcggaaatggccaacaatttgatatattaattttctcctaaaatttatgtcaaattacaaatagcaaatcccaaatttaaaatcatgtattgtgtcgtagcaagtttaatggttttaatgagccttctcgaatttcttagccaactgagctgagctcatctttaacccatccaacgtgcacagatcttgaagtccatcggaaatggccaacaatttgatatattaattttctcccaaaatttatgtcaaattacaaatagcaaatcccaaatttaaaatcatgtattgcgtcgtagcaagtttaatggttttaatgagtcttctcgaatttcttacaaactgagctgggctcatctttaacccgttgagtgagtcggctcataacttaaccaatttttggcagttaagctatgggttcgagttagcttgttaaccgcccttaaatgcaaggaactaagtgaagaagtttaaatgatttaattattacacaggtgccagagggagtcgccgacaagcgatcaccggcatacaataaaggtaaggtgttcgtgcatggtgcctctgaggagacgggcgcggcataccggcgacagttccagtctgacatgatgcgctttctacactgtcgcgccgccgagctgaagactggtggtgccattttcatcgtcagccttggccgcctgtcgtccacctgtggccccacggatcaaggctacatctatgaagtgtatggcgtcatgttcgacgactcatggcgtgacctcatcgaagaggggatggtcgacggcgagaagatggacagctttaatgtccccctttatgctcctacagtggaagagttcaaggaggttgtggacgccgacggctcgttcaagatcaacgagttggagatcgtgatggcaagccctcctgtcgtggatgatcccgctgaccgcggcatggccgggcgcatggtggcaaactacgtgcgcgccctcctcgggctactcatcgacacgcacatcggcggggtgatggctgatgagctattcatccgaatgcagcgccacgcggaaatacgtgccgaggagctcatggatgaaatatgcttcccccatattctatgctcactttcactggcgtaatggaatttacgaatgtattattggacggtctttatatgaaaactgagtctattttatgtggaactcttcgtatcttgagcataataaaagttattctggataaaattgttagttgtcttataaaatttaggccccatatattagccgatcttcctggatataaaactcttcattgttttaggcataataaacggccttttgtttgggtacttcaatttacccaagtttgacacatatttttggctaacttgtctaaggcatgactaataaaattagaaccaccctttagctagcgtatatggtctatgtaatgaagaataaatcttaccataaatgtcgttataaactaaacaatcatctacctcaattaaacttgtctaacttaattaagagatatgacaacattaagtaagttgtgggtgccagctaaactgtccctaaaagtcatccaaataaaagtgcttgttctcctataaaattaggcaccttgtaatttatcgaagtgaactagagtagaccgtgaacattatttggccaactaagccgcgaacgtttgaaaaaaacacttaagccgtgaacatttgagtagttgcgatacaaatactgggcgagcttaattgagtcgttaattagtattatttggcatccaaatttgatagcctaattgtgatatatacttaagcgtgaacttggggtgtaaccgcacattaacaggacgggttgatagcggacccaactctttagcctaaaaaaaattaagggctgaatttaaaatgaattaggctcaatttctatatatttttatctaaaaatatttaagtagcgggtagggttgtaaaagaatcggttattaccgttggaatgcaatatactgtaatgttcaattggtcaatcaaatatcacatacaaggacaatacgatgttcagtggtcgacggctgtgttcttctcctttctttcccaactcaccactctctctttttacgcgcacgcttttaaacttgtaaactgtgcattttttacaaaagtttactacagaaaagttgctttaaaagtcatatcaatctatttttaaagttttccttttctttctccctgattcttcccccaccatctgtaaatatttctcatgtacattaactactacttattaatatattgcagtaggggtaatatattacagtaggggagcctctcttgctgttttaaccgtaaaaaaaattaattaatcacacgttaataggtaacaccgttttatattcatggaggtagaactaactccatctcccaaagtcagccccctaggtacatgtgttacatgagattaggcgcccgaagtcagccccctaggtacatgtgttacatgagtttaggtgcccgtgcctggccgtacggtcgcatcaaccagctttccgttgcatgttgattcatgtgcgctcagcccaccggccacccacgtaccgcgcgtcatcgcagatatacgcatcaggtgatcccagctcatcaggtgatgatctatctgagctagccatctacctactgatccaggaactagctatatacgcatacacatatacctccattttcttgttgtgctgccgatccaggaactagctatatacgcatacacatacctcctttttgttgttatgctgtgaattcatcaattcaagatgcaaaaagtgttgatgaaggacgtcttctgcatggagggtggacagggggagtcgagttacatcaaaaacagccaagttcaggtaaaacaacaacaaaaatgctgggttacatacctatttagcacaagtcatagtaagttcaaattcagctgctctggaggttatttagagtatttttttttagttttgttactaaggtgttttcagtttgcctgatcgagccaaattaaactggcaatgtgcagtctcgaaacctgcaaatgatgctgccaaccctcaaggagatactggacaaggtccagctccctcgccggccggggaaacatctcctgacggcggccgaccttggctgctcttgcgggcataacacgctcatcgtcgccgatgcgatcgtcgaacacatgaccagaaagctgcgcagctgcatcttcgacgaccaagatgacggtgacgccgctgatccagaattctgcttctacttctccgatctccccagcaatgacttcaataccctcttccacctcctcccgcaacacgctactgctgctgctggcgcggcagtgagcggcgctacttcgctgccgcggtgcctggatcgttccatgaccgtttgttccccaagcgatccatcaacgtgttcacctccaccttctctttg

SEQ ID NO: 81831 - DNA, 1304 bp, Oryza sativa
aatatataggcttgcaaaatgccaggacaaattaagaatttgagatgggaggaacgggacagaaagcgatgtcatatcctatttgctctcccgtaggacccataatcgctacacgtggaatcgcgggggggggggggggggggacatccgacatgggattcgttcaattccaactcatgcggggtaaatgaatgcattttggtttagtacgcttcacttcattgcacaaataaattgcgtgattcagtacgtactataaaatccaaaaaaaaaagagttaccagtattaccattagcatatcattgcataccagatacgactctatgtttatactaatacgtgaagctgcaaataggcaaatgaaaatcaactcatctactgcctggactagagtacgagaagtaaaaatcttcacgtcaggatgcatgctgtgtgtcacgttgctcatcgcgcggttcacgcttgacggccatgtcatcactgtagagtgggcccaacaggacacctccccccttgcttcttctttttttttttttttttaaaaaaacaacgcaaactgttctcctcaagcgcacctcccccccgaaaaatcaaaatcgaagcgagagcgagtagtaattccctcgctggcgctgctgcgtgatttctttaatcctccgcctccgcctcctcgtcctcgccaccactactcctccctctcgtgagcccctcgcctctccctgtctccctcccacctctctctctctctctctcctctctctctctctctctctctctctctctctctctctctctcctcctcctcctgcaccgccccgcgccgccccttggcttggatctcgtcctgccggccgcgggcggacgcggcggcgacccggtcctctccccacaccccgacacgccgtgcgagtagctgtctgtctatactttcgaggcctgcattggcgggatctgcgtccattcgtcgagctgcacggagcggggaggggcgcggagctctgagctggtgcttctgcttgcgttttttgggtgtcgctggatctgagggccgcgctgctcgcctgctccacgccggctaacgggggcggggttcagggggttcagggggttctggtggtggttggtagcgattgctgcgtggtggatgggagttgaggcttgaggttgaggggttgcgtctctgaggagcggggtggataagggagatggcggccggcggcgtcggtggaagcaacggcgcggctactgccgccacgccgctgcatggctcggcgacctccagcatgaacggtggcggcgccag

SEQ ID NO: 81832 - DNA, 1175 bp, Oryza sativa
aaaaagtttccacccaagcacgagaaatataaaacattgtcaaataatatattggatgaatggaagatctacaagatattcaagtccaacaacttcaaatggacctagcgccttcatgtcaactccggtttggatgatcttgtacttgttggaaagcggtgcgtcgtcaccttttaaatgcttctggtctcatatcaaaattcatctcgagtcaacaggaatttcaaaacaagacagtttgaaactgaatttgggctttgggccttgtaatagattaggcccatctcggaagtgcctctctccacctccacgaaccagcactaatcctagctttattttcctttataaatagctttgtacgccctaaaaagaacaattgggttttgtttagttgaattttgccaagagtcattcaccttgtctctagttctcgttcgattagttgacgactatagattcagagcccccaactgttatgtgttgatttgtcggatcgattagatctatcacttcaatcgcaactatatatttgtgcttaattacctattcgcaatatttagattgcatcttatcttgttcttgtagtgttctctgatttgcattgcagggaacgtcaaccacgcgtcatggttggtacgatatcgtttgtggcatagtgattgcacgatgtcatgaacttgttctggttggtagccatgtcgcaaacatcatattcaatcaaagtgagagttatcccattaccaaaaaatgggccacgggagagagtgagtgtcatcactactgtagcaaactgttaccatggcttaaaaaaaagtaaaattaaggggttgttcagttcattgccagaaaaaagaaaaccttaccatttgttggtaatccaaaatttagtaatgccaaatttttgggaagatcacaatgtggaggtggtgttttgtttgataccttaccaaattttggtatagttttgtgagtagaagtttctagaattataaagtttgtagggattgacaagattgtaacaataaagtctcatttagtttgttgttttggaaacaaagtaaaaaagccctgaattatactcataacattccaaatcggtaaggaataagttcaccgggggtccctcaacttaacagtcagattttttaaggtcccttaaccacaaaatcagaaat

SEQ ID NO: 81833 - DNA, 2280 bp, Oryza sativa
tttagaagtaagttagggatcattaatatttttcagtccttcacattgttaagaacaatatatctgtccttccaaatggaagtgaaggcttttaaaagtgatgtgttacttttgcctggactaatccttcatacttaattgtgctttgatgtagtctaatccagtccttgaagcttttggcaatgcaaagactgttcggaacaataattcaaggtgtttgttttacactctcagttggaatcttggaagataattaattcacaatttattaagtacagcatattactattcctaagcaagaaacaaagctgcttatcctacgtccccccccccccctctctcacggagaaaaaaaaacctgtggaaccaaaaatccattttgttcttctttttttttgcattaataatatttgctcacacatgtacttactattttttataacatggtcaagccggtttggcaaatttgttgaaatccagtttgacaagagtgggaagatatctggtgctgccattagaacatacttacttgaaagatcacgtgtttgtcaaatcaatagtccagagagaaactaccattgcttttacttcctatgtgcagcaccatcggaggtatatttcctaactcaatgtgattaacaagctgggtctgtgttatttattattgaataaacccaaatggcaggaaattagaaagtataatctgggtgacccttcgtcgtttcactatctcaaccaatctacttgcattaaagttgatgggattagtgacaatgaggagtatcttgcaacaagaagtgctatgaatacagttggcataactgagcaggagcaggtctcaagttccaacacctttcaagccactaaataacaatacaattgttattctatgtgcatatgagtaggcattctcacttatttcaagtaacacactgataatgcaggaggctatattccgagttgttgtgctgtgcttcaccttgggaacatcaattttgtgaaagggagagaggtagattcatctgtaataaaggatgagaaagctaggttccatcttaatgcagctgcagagcttttgatgtacgtctaatgcccacctgttctatagtaatcttcaaaatttctgtttcaaatttcactgtttatactgtattactcctcattgtggagttcttactgcaggtgtgatcatgggaagttagagaatgcactgataaagaggaaaataaatacaccagaaggagtgattaccacaacagttgaccctaattctgccacagttagcagagatggcttagccaaacaaatatattctcgactatttgactggtaatctttataactctgtgatttgttcctccctgaattgtaagtgtatgagactgtaatgtgtgcaggcttgtaagcagactaaacgcatcaataggacaagatgagaactctcaatatttgatcggcgtgcttgatatctatggttttgaaagtttcaagactaataggtaattttttaactaaatgctgattcagtttaccattgaagatcatttatggaagtcatatgtttattcatgactgaaacagctttgaacaattatgcatcaatttcaccaacgaaaaactccagcagcattttaaccaggtacattagtaaaacatgtttggatgttcatgatattagactctttttgctttttagataaagactctcttttcttagtgtttggtaaaatgagagcttctattggcagaatgtcttcaaaatggagcaggaagagtataaccgtgagcagatcgattggagttacatagaatttgttgacaaccaagacgtgttggacttgattgaaaaggtatgtagcatttgttttatataatgtgcttagccttgtacttccccaaccttctggtggtcattgtcatttgtcagcaagacagataaatcattttaagaaaaacacatgaagttacttgttgctaacctgtcagtactctggtactggttcacatataggtatctgttctgttgtttgtgaatataatactggtataaacctgtgcttttctcccagatgtcactttacggatcaaatagagtacaatatactcctcccgtcccaaaatatagcaacttctagtgtttgaaatttgtcccaaaatagagcaacttccccacctacttcctcatctcaaccatccctcatttaatttcatctgtcttcttaatctccgtaaaaactccaaagtgcttatattttgggatggagggagtagtatgctttt

SEQ ID NO: 81834 - DNA, 805 bp, Oryza sativa
gaacgtgcttttgagtctgaagttgctttcacatccacggacacattgttgttcttcacctggctctggatttcagagaagatggactcatttttcttcgtgccagcaacagtgattgcctagaaaaagcagggaaaaaacatacctcattataatcttgggaaagtttcatatgcaatgctacagatactaagtttagccaaaggagattgacaacaaaacgtcataacagagatacaggtaaagattatatagacattatgctacgcagttgcagcatgacagagcaattgaaaacactattttcagcatcaccagtacatgataaaggtaagcaccatactaaacctcagtgatctgtcatcgaaagtaccaagtccataaggtcaccaacacatgaccatgagaacagactgaatatacactatacaggagggaaataatgtactaacatgatatatgtaaacaaatgtaaacaacatattaacatgatatatggcacatataggcacctccatactgaggtcacagatgagatacattctgaaaaaacatctaacaacttcatcaacagttccatagtcaagaaagagaaatttaaacacatcctaaattgtcctaaactgcgactgcatattactagcctacatgtagctcaaattcatggcaatagtaaccaataagggaacaaacactgagtccatatgagtagacacagaggactagaaacaaatactccatggatgtagtaattctgtagcaacggtgaaagataagtgactttaaacaaaactaagccatataa

SEQ ID NO: 81835 - DNA, 3978 bp, Oryza sativa
ctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctatgacttcactgccggcctacctccgtcgccgccgactggtgtcctcgcctatacggttggttggtcacaccaccgttcatgggcgtccacgtcttcaccaccggcctgcctccgtcgccgccgagtggtgcctccgcctacacggctggcctatcatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgggtggtgcctccgcctacacggctggcctattatgccgccgctgttgggcgtctacgacttcaccgccggcttgccttcgccgccgccgactggtgtttttgcctatacggttggcggacttcgccgctgttaatgggcttcatcatctacaccactggcttggttccactggcgccgactggtgtttttgtcaccattgatggactgctttattcccacatcggctacttctgctgtcatcgagggaacacgacaaagctaagtcatcatttattttattctttatatgatattttgtcttttcctttgcctcactacatcaactggttcgccgttgactagtgagtcgggggctattgatgttatatcatattttttaaacaatttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataaatttattttctgctcttaataattgcaaaagtacctaagtagtaaattctgatccgtgaaactttgttccattaatgacgaactcatgtcactcatatgcatgtttgggaaatgcctaggccgactcccgatgcttggggactatgactagtcgggcagagtgtttaaacgtacagaatcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaatggattcatggctttaagcttatctcttacgctccaggaatggatcagtcagaacatcaccgccggcctgcctccgtcgccgccgagtggtgcctccgcctacacggctggcctattatgccgccgctgttgggcgtctacgacttcaccgccggcttgcctccgtcgccgccgagtggtgcctccgcctacacggctggcctattatgcgccgctgttgggcgtctacgacttcaccgccggcctgcctccgtcgccgccgagtggtgcctccgcctacacggctggcctattatgccgccgctgttgggcgttacgacttcaccgccggcctgcctccgtcgccgccgactggtgcctccgcctacacggctggcctattatgccgccgctgttgggcgtctacgacttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactagtttcttcacttccatggctgcatgattctgccagtgttgattggcctattatgccgctgttgttgggcatctacatcttcatcgccggtcgtctcgtctgctgctgactagtgcccttacctctacgtctggtttatacagctaccactactgatggacatcatcgtctttcgtcgccgactggttatgctgtcgccgactagtgcttttattttcacaactgcgcgtcttcgctaccagcttgcttctgttgccgccgactcgtgttcacttcatcacggcgatgcaactttgtcatcatggtggagcgacttcatctttattatcttcgtcactggcaaactctattgctgctacttcgcaagttttgcttcttcaccaaccacgacgtctttgtgaacctcgacatctcggcatgcgatgccgtgttattttactacaacaagtggctctccaatattcaagatttctacttggacatcttcaacacatatcttcaatcaagcaatgactattcgatgacaagaagctacagttctcgactctatgtttagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcgcacctctgcttcatcgaccctgacatctctgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgtcgtcaagtattttcttcatcttcatgattggtggatttcgtcatcgtctttgatgcgtgtctacatcttcaccgtcggcttgctttcatcaccaccgactgattatttcgtcgccgccgactgctctgtcgttgttgttgggggccttcatcttcattgctagctgacctgattgctgccgactggtttcttcgcctctgcggctgtgcaacttcatcacttttgattggaatcactatcttccctaccaccaatatttttgccacctctggtgggcaatattctctctatattggttgtcttgtctatatgctaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctgtcacatcctgattttcgtttcaagatttataaattatttaataaattattaatagaatttatattaaatgttctttaagttacaagtgaagttaaatgtgggaaaataaatttcttaaatctaaaacatggatggatttaatttt

SEQ ID NO: 81836 - DNA, 902 bp, Oryza sativa
ccagcacgtaaaggacgacgcggcgaactcaccggtgaccaaaacggcggcggaagaccaacggacggcggcggcgacgaggaggaagcggcgaagctcttcgggtcgacgacggcgacggcgctccgacggtcttcggcggcggcgaagcggtggacggggacggcgatgacttggcgaacccgatggtggcgacggcgaccgacgacggcgactgcaacggcggcgcggcgcggctgaaccgacgacaatgacggcggcgactagggctacgcggaggcggcgctagacgcgacggcaggctaaggcaaaggaggcgacgggtagaggggagctcgggggtccttatataggtgcaaggaggcggcggcaaaggcccacggcggccggcgactagaaggaaagctcgcggcttgaaggaaagaggccgatccgaatcgaactctattccacgaacttccaaaacgatttagccgatgtttccaaaggagaaaaggtagaggagatcccggagattgtttcccctcaatcaattcggccggagaaggaaaggagcggccggatttggaaggaaacggcgacggcggcgcgctagggtttcgggcggcagcggcggctcgaggaagacgaacctgacaggtggggcccacctgtcagcggctgagagagagaggagagcggcggctcggcggactgggccggctgggccgagggaaagagagagaagggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctg

SEQ ID NO: 81837 - DNA, 7465 bp, Oryza sativa
cttcaggatcccgtgtatccctgcagcagcaaggtgagcggcgcgtttcgcaacgatgtcgcagacatccaccacaagccttcttgttttaagggaggtgttttggacctgcaattttgtattgatatgcttcggtgaatcgattggaaaaaagatatgcctgagaaactttgacaaaaggttaaggtgagtacccccaggatatctttcagtttcgctccaactgttctgagatcaggtgatctgtcgcagtgcatcattgacatgtatggagtcctggagatgaaagccttaatctgtttagttaaagataatctttcgggggaggacaatgatgatggggactgcaggcattctttggttcaacttcttcaaagaatggagtgaacaacacaatacccaggctctagattgtaaaaggaatgaaattcatatataaattattaaaatttgaattcgtctaccagcttattcaaagatcaatatacatcactaccactaccactgctctgtataggatgccatggttacggttttgtgtggctaccttttacaaggtaaacacaggctacacagcaatcaagcaatatgatatttttctcttatgtatgtgcatgttcggctgtgatttttgaagcaacgcatattcatgatggaagattagaagctggcaaatgaacccaaaactaagattacctgataataaatggaatcttgagttttggtggtacttcatcaccaaaaagagaagcttcttcagccatctttaataggactctacgaacaatttctcccaaatacatgccagagatcaacttttcgtaaacctacaaaataatgaatgaaatgcttcgtcctagttggcaatgaaatacgagatggatctttttatgttacctgttcaccaggattcaaactttcagcatctaatgcttgatcaaattcagtcaaaggaagatgggatgacctgaagttcccccattccatatttattacctgtgacagcacaaacgctgatgagaaccctgaaaaccatctaaagcttatggatgaactaaacatgcacaagtgactcatgctaacagtacagacaatgtttctctccttttgcagcgtcatttgtatatcatgtcttagtaacccgaatcacatgaccccagatattataaacagatttcatgatttttcgcaacatatctattatctaatgagtaatgcctcatcaccaataagctaggtagaagcaaaagcactcaccatatctcctgacttcggcaggaggtcatgccatttaggaattgcattggcacgttccacgtatgctgcattagtacctgttcccagtataacagcagcaatgacatcattatcatcatatctcccaccagccaatgtccctatagtatcatttatctgcataagaaaaggagttgtgtttggatttcaggttacaagcatatcttcatacacagggtatttaacaaagttctatcataatttgtcaaatcaaaagaagctcaccaatgctgtgactttcatatcaagcccctggcgttcaagagccttggttaattcagtcacaacatcttcaccaacctgactttacagcaataagcaaataattcttacatcccagaggaatatgtaacaatcatgagcgagaaggttttccagtaaagaattaaatagtttccaatgggaaaaggaaactcttgtctatcctttgtaagagtatattgctacctatatgcatatacttgttaagatcataataataagatctaaccgtttcatcaatcgaaaaacccttagtccaattaataagagtgccagatgcaattgaagtttgctttactgggaaagagaacgtaaagccaagttctctctgcctcccctcagcaagatgaaagtcttcaccctctgaagcaacaaattttgctaaagaagaagcaataaaatcaaatagttcctgaaacaaaaaatatatgacaacagtcatacttagcatttaattgaatacggaatgaatgaaccagataggatacatggagcaattcttacatttgaaccaccagtcatcagatgcggaggaattgaaatctcgtcatgttcttgcttgataactctcccttccttgccacctaattgaacccgtaaaacacggaaatttgtacctccaaggtcaagcgcataaaacacccccttctcttccctgcaaatgcagcctttgacatatcagaagtcaatccaaagtacaactaagagcaatagttcaataatttgatcgagggtgcgcctcggcaataagtttgaactgcctgtggtacacgttagaacaatagaccccttcttttattcagtcttcggacaattactatgacaccctttctgtaatctaaaatatctatagataccagaattatttctgatgtatatgtgaagtgatacagtaattgcaaggttatagtaaccacatcagatgcaacctaaaagtgcatagaagttggctttacaccaacagacttaggagagactcatgatattcaataaggttggtttcttatctaatgccataacagctgaattcacattttgttcatttttatctaaagagaagtaatatatacacaagaaagaaacgtactttcctgagtagtaatcagtagcaaattagcaaagacatatatgacttggtttgtcaagttcacatctttcagaccaaatcaacattactgcgagtttccgacatcaaaattatcaacaagaccatgtccattacacaaaatcagacgcccgccactgcaaccaacctagcagcatcacattaccgtgacatcaatgcgcaaccattcaacgttttgcaggcgctgctagaccgcaacaccgttcaccgcaatcaaattaaaagaaaacattaaccacctaacgtttcaactttgaagcagatctgtgggacttcacactgttccctcgcagcagccattatccaaacgaatcaggcgaagaaaccaactcttcagactacgcctccccatacaacacaatgatacatgcaaatcgcgcgagaagggggcgagccattttacccggaagggagggcgtcgacgtagctgatgatcatcttgagtttgctcccgccctcggaggcgagcccggcgtgcatctcgacggccatcgcgtccgccacctgccgcagccgccccggcggcgccgcgcaccgctcctccagctcccgcagcaccgcgtcggcccggccccaccgcttcgcctcccgcagctgccggcgcaccagcagcgccacgccgaccgccgccgctgccgcgaccgccgccgccgccgccttcctcatcgcggtcgcccagcctctcctcggcgagatggggcccttacgtacatatgtgggcctcagccaccatcccgtaaaggccgcgcggcgctgcagtgccgttccagcccagcccaactaaaagacgtcatgtggctagagttggaaaaggtccactctacatccctcagctgtggattaattttcaacccaaaactacacgaaatgagcccagagagtccccaacttgtaaaaccactacaaatcgagtccttaacagtatagagggcggtttttgactaacattgcgcctacataacttgttgatttggccttctttcacatatgttgcgcttacattatgttctagtctgcaaaaaatgagaaaataattcaaatgaaaacgtggtgtttgaatctcctgaagatgaagataaaaatttaagtgtttcacgtaaaacgaggtggtaataatatgtgattaattgagttttaattattacaaacttgaaaaatggattaatcttatattttagaacaactttcatatagaaattttcgcacgaaacgcactgtttagcagtttgaaaaacataccacgagtatccaaaagttaatccaacctttgttggagaaaaaaacaggccctcaatgggctccacatctcagtgacaatcttcatccccttacctgcctgagttgagcttgagctcaaccatccatgtgggctagtcccctccctccatctgcctcccgttccatgttcctgcccgccgcgggtgcctctccgtctagctctaaatcggctgtgggaaaagaggaagggaaattggtctgaaggggacccccacaactgatatgtaggtcctatcgagtttattattatttttattttttttccttacaatgatatgtaagcactacatgggacaaagataagtcaacacatcacgtatgaggaaaccaccattaaaattgtcgagagacttgatttatactgattttgattctcgaacgatactatatatatttatatatttggttttatggttaaggatacaaatgaaacttgtcgaaacatggattcggcaataataaaagggggtagcgcacgagacctaaaagtggatggatgcggagacaaaggatttagacaggttcaggccctctcaatgagaggtaataccctactcctgtttggggatttgaatccgccgggtgtgtattgatttgatgatcaggttgtctcctgcccctagagggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacagtagcccctgagaccttcacagtcggaaagataaccttctctcgaactagattactccaaagccgagtgcttcaatcatcttcgccatggtctcccgagtacttttaccaaatctgaagactgtggagggctgaaaaatatagtcaggtgcatcgactagatgcacctaataggtgtaaacccccgactatgtggttaatcgaacaaaccaaacatatagtcaaggaataaataatccaaccaaccgagtggttttgataattatagtcaaccaagtgacttgatatcaatatatagcatatgcggtgtgaatcctccaaataacatgatccgagtgatataccaattgctttgtaaaatatgatgagtgatatagcaaaatagctataaagaagcttgtatattgtgaataaaaaaatttccacagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagacaatgaccacaatatataatcagcctaagccataatattggtcaataaaaatgcacacttacgtggcgaaaagcaatgatattgtatccaatcaattgcttaaaaacccaaacagcaccttgacttatataaaaaagtcagcgggacagctatataaagcttttgtcacgcccggaaattcaccagtaatttccgaacttatttgtgcataaaatcctcgtccaggaatcagccgaggtacacaaactgacaatttaatatacagattcatcaataactaaagcgaataaatacttacttaagaggcacttagtcctcaacatgaagaaaactgcagcggaaaaataaaatctagcgaagctccggctccactcccacaggcagctcaactggggtataagccaaacgtcttctccttctggatcctttttcttcaactgaggttgattgattattgcaaggtgagcatatatcatattcatcaaccacgacatcaaataagcaagtgcccaagtataccaaaggatggcgtaatattggctcatttgcaaaaacagcatttagcaaaacatttaagagaagtaaaatagtggagtaattaatcaggaattttaatcaacactgaacagcacacccatgctgcacaggcccaaccatcctgaacaaccatacccggctgtacagatctaatctccaaaccaggagctaagcaaattattaccaggtataacatccataactattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaattgtgtgctaatgtttctaagcatggctaagcaattatatctaatatctagttgaaccaatatatataaagctcaactagtccaattataataacccaaggtatcaaggaatagaataatcaatgcaaacaggccataacaaaggaataggttcacaccacccagtgacattcgaaaataaatgcacagttgaaataaatagagaatttaaatataggatcaatatgctcaaaggattgtgtttaggatctgtgtgacttgccttgcaataatcggtcttcaattaatcttcttgaatacttccggcgcactcgcgaacctttgcaacgacggaaacgacaagctatcacgcaaaacgaggaaaaagactaataaaaaccaaataaacaatacataaaaagtaaacaaacatgtagatcataattttagatgaattatgagacttgaacggcctcattctgacttcaaatgaatttattataaattttacaagattaaatctaattaaagcccatttaaaaagaattaaataaatttattcaatttatggacaattttaatatgtagatctttattttacacaacttttgcaacttgaaccacattaaactgagctaagatgaattagatatgaatttttaaagattaaatcggattaaaacctttatatggattttaattgaattatgacgcaataatgaattatttttgaaaaggaaaagaaggattattgcgtcagcggctaggg

SEQ ID NO: 81838 - DNA, 10434 bp, Oryza sativa
gcttcagcgtcggcctaatcaagaatcaatactgcgaaaataaaagatgtagccatattaagcgtcgaaccgggaaaaatagcgaaacaaagaagcgcatagcgaaagcggagtctcaccgttcgtcccctcaggaggaaccagcttcagcaaaccgtcgacctcttcgtcttggtcaaccgcgacttgccacgaccgggagaggggaaaaaagcgaagcatgcagaactcctccaccaagtcgcggcagctgaggcgggagcagaccttgcgcagcaaggcgaaccgtgcctccatggcgccgtccacggtgatcttgggtttccggttcggcgcaatcgccctgcgccgacaccggagggccttcgccgactcggacctagcctcgaaggggatggtgtgatagaaccacctcgccatccagtggtgatcctacttccacatggcggcattcaccggccaaagatcggagcgctcggggcgaacgttgaagttcatgctcctgaacaccgtcttcttcgttccgaccggggtaaccatcgtcttcgaattcatggtgcaaaaaatatggcaccgaagagttcggtgctaggttcaaacccggaggtccggcacgcccagtcgaagatggcgaaggatctccgacaacaacacgttgcacggaaaccgaagccccgcctcaaaaaagacggcgaacaccaccgtccggttgtcgacgagcttcggtaccacggccttccccggggcgaaagcctgcccctcaaccaacgccccagagctgaccaacttcgccagctcgccgtcatccatgagagaaatccccaaaaaggtggtggtgtcgtcgtcaatccggccgggatcgggccctttcgccgaagcggggtttggcttgcgaggagccatggtgaagggtgtgtgcagtggcgaacaaaaagaaccgacggaagatctaaggggtcaaggggcaccatgaaaggaaagaacggcggaagaaagcgcgcgcggtgaaaatgacaagtgtggcggtgaaaagggaaaagaggggagaatatatagcccacccaggcaacggttcgcctacccaccagtaataaagcgcaacgtcgcgagggtaggcgaaatggtaaattcccatcgacttagccgcacagtaataagcccatgtagggaaagcccattactgttcctttcggcccggggaaaataaaaagtaactctaccatccgcaagaggcgaaagctacaaaacaataccaaccgaaaagacacaacacactttatttgcaggaataatataggtttcggcaggagcatcggtcgaaagggggcgccacataccataccacatggcttgcacggtctcggccgaagctcctatctcacccttgcccgtgaggggcttgttggcggtatggcatgaggcccttcgaccaaacctgccgaaaccatgcgaccagtgaggattcaagcctgagacgtcaagattagtcagggcgaagcccccatggcgaagactatggaacaaggacggcgaggggcggagaatcgcgcgggtacctcgccaagccaaaggcctcttgggcgaagaatgtgaggcgaagagtgtatgtcgaaggaagacgacttcgccatagcaagttcggcctcacgaaggccgatgaggccatcctagcatatcaagcctagcggccattgggccaacaatcgcctgacggcccattaagagcccatgtacctcaattacacagtatacccatgtaaatgtccctttcataagggcaaccatgtaaattcccctgtataacctaaaccctagtagtaagaacctgtaatgaggctataaatagtctcatagggccatgtaatggggggatcccaagaaaaattctcaattcaatacactttactttctttccaaccactgttgagtaaccacgtcttccgacgtaggcagttgtcatttcgacaacaacttatataggggaggattggattaggaaaggtggagtcgtagtgggagtaggactaggagggaggggagggagaccgactcgggcaaggggagggggaggcgcgcgcgggaaggagagggggagggcgcggctggctagggagacggggaggaaaaaggaaacaagggggctaggactttcccaaaaagaaaaaaaacaatgcggtgccgttttaggaaaggaatgaaaacggtcccgtgaactgacactgatacggttcgtcatgcaaaacgaaactgcggactgagaggggagagaattaggcacaattcacaaccaaaggcaaaggaagaaaaaatctaacttgacacttttaacttagcaacattgcctctggtgatctaatatttactctttaagtcctgttagtgattttcagagcaaagagaatttggaaaaaaagtttctacctgacaattccgattattaaatgcatggttaacaggggttttctcctggttaaccaaagcaaattcttgaagtcataaaactccgggtgtgacactgtactaccatttaaaagtttactcaatatttgctgctgacaatatgtttgatttaatttatattagctgctgccatgattgtaaatgctgctaagcatttgttgctggccagctaagggcctgattagatcccttggtaaaattttttaccctgtcacatcgaacgtttgaacatatgtattaagtattaaataaaaacaaaaaaataactaattacacagcttgtatgtaaaattgcgagacaaattttctaagcctaattagtccatgatttgacaatgtggtgctaacatttgctaatgacggattaattaggcttaataaatttgtatcatagcttatagccaaaatctataatttgttgtgttattagtctatgtttaatacttcaaattagtatccgtatattcgatgtgacgcgtcaaaacttttcacccctgcatctaaaaacagcctaactctatggtgctaggcaaaagaaaataatcacgtaggttccggggcaaggaaaatcgaacttgtgatattttccttacaagataattttaccaaacaacattgtaccacaaatttttatacctcgagatactttttagtataaatttgatatctctaatataaaatttagtgccccaatatatttagtatctggaggtaaaaagaatttttgtgtgcaaaatatggtgttgatggtaaaacacgcgactgtgtactactgtaccagctcgcttttttgccatatacacacaagttgcatataagtatacaattacaatctattatattattaagacagctcgaaaagaaggcaccacgttcactgtgggggctagaaattcccacattaatcgaagaaaaagaaaaaaaataaaaaggagagttcaagtagaagtacaatttaaaaatagctgaaattcggaattaaaaataagcaatattgaaagaagtttctatataagaacccaatacgagattaatcaaaattcgaaataaaaataaaatctattatattattaagacagctcgaaaggaaccacgttcgctgtgggggctagaaattcccacattaatcagagaaaaagaaaaaaaaagaaaaaggagagtccaagtagaagtacaatttaaaaatagctgaaattcggaattaaaaataagcaatattgaaagaagttttgtcacgcccagaaattcactagtaatttccgaacttatttgtgcataaaatcctcgtctaggaatcagccgaggtacacaaactgacaatttaatatacaaatccatcataataataacgtttcacacttacaaaagaaaagaaaacagcagcggaataacggtctagcgatggcttcagctccactcccacaggcagctcaactggagtataagccaaacgtcttctccttctggatcttttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacaggcccaaccatcctgaacaaccatacccggttgtacagatctaactccaaaccaggagctaaacaaattattaccagttatagcatcaataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgcacaacacaactcaccacagtgcaccattcctggatcataatcacccccttataaaacaaggcatggactccccagcgacccccgtgggcttatctccgccacttctcagtctggtgctccgcaatgaaccatgctgtacaaaaggtaaagccgttgcccacgctggcttgtggttggcacggttaatgtttcacaacagtagctcgcgaaccggtccttaattgccatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcattgctaagcaattatatctaacatctagttgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatttcttgaatacttccagcgcactcacgaaccttcgcaacgacgaaaacgacaagctaacacgcaaaacaaagaaaaagactaataaaaaccaaataaatagtacatataaagtaaacaaacatgtagatcataattttagatgaattatgagacttgaacggcctcattctgacttcatatgaattaaatatgaattttacaagatttaatctaattaaagcccatttaaaaagaattaaataaatttaattctatttatggataattttaatatgtagatctttattttatacaactttagagacttgaaccaactaaacccgagctaagatgaattagttatgaatttttaaagattaaatcggattaaaacacttatatggattttaattgaattatgacgcaataaagaattatttttgaaaaggaaaagaggattattgcgtcagcggctagggtttgcggtggaccgggtgcacagcggcggtctacggaacggacggccgagatctaccctatccaaaacgaacggccgagatcgatcggtccacggccggaccacgagagacgacgacgatgacgtcagcgacgacgtcaccaccagcggcggctcgggcgcgcatgctcgccggcgaacgacggcgcggcggcgcgaacggagagcacccacaggtagcggacggcacggctacctcaccggtgaccaaaacggcggtggaagatcaacggacggcgacggcgtcgaggaagaagcggcggcgaccttcggcttgacgacgacggcggtgttccggcggtcgacagcgacggcggaggggcggacgaggacggcgacgcgacggcgaccacgatggcggccttcccgagcgacggcgacgactggagcgacggcggcgcacggctggagcggcggtgacgacggcggcgcgaggtctcacggggctagggcgctaccgacggcgagaggcgaaggcaagagtggcgacgggtagcggcgggcttgggggtccttttataggggcaaggaggcggcggcgaaggcccacggcgactggcgacgagaaggaaagattagggttcggaggagagagatcgatccgaatcgaactcgaatccacggatttccaaacgaaattagccgacgattccataagagaaaagatagagtggatcgcgaggatcatttcccctctatcgattcggccggagatggaaaggagcgacggaatttggaaggagacggcggcggcacggcgctacgtttcgggcggcgggcggccggaggttgacgacgaccctgacaggtggggcccacctgtcagcgggagagagaggagagcggcggctcggttccggcccggcttgggccgaggagagagagaaaaagagagaggttttgggccgactttcggcccaaagccaaaagagacttttaaaaacctttttcaatttaaattattcatgaaatgcaattccatttattaaaaatactttcttggctcaaataaatcccggaaaaatctaggaactaaagattcaagagaagtatttaacaaaattttatctagcccaattttatattgagatttagcaaattaaaattagatcttctcttttaggcttttaagatcatttctaataattccttttaaacaacaatttataatttaaggatttttaaacaagaaaagctcttaacaattataattagatcattaatgatcaaataattactaaactgttctttgtatcatttaggaattgagctccgaaaaatccgagaaaatttcagagagtatacttaatcatggagaatttaataaaaattagatccatccatgctttaaatttaggaaattttatttcccacatttaacttcacttgtaaattaatgaacatttaatataaattctaataataatttattaaataatttataaatcctgaaacaaaaatcaggatgtgacaagtttccacataagaacccaatacgagaataatcaaaattcaaaataaaaataaaataaaatccaaaattagaaaaggaaaggagagtgcaagtagaaatacaatttaaaaatagctgaaatttgtaattaaaaataaggaatattgaaataagtttccatataagaacccaatacgagattaataaaaaactgaaataaaaataaaataaaatccaaaattataaaagtaaatgagagttcaagtaggaatacaatttaaaaatagctaaaattcggaattaaaaataaggaatattaaaagaagagtccatataagaaccaaatacgagattaattaaaattcagaataaaaataaataaatccgaaattagcaaaagaaaataaaataagagttcaagtaggaatacaatttaaaattagctgaaatttggaattaaaaataagcaatattaaaagaagaatccatataagaacccaatacgagattaattaaaatttagaataaaaataaaataatatctaaaattagaaaaattaaaagagagttcaagtaggaatacaattttgaaacaactgaaattgaaaaaaaaaataaaaacattaaaataacacaatacgatattaactaaatttttttaaaaaaattttgaaattagaaaaagaaaattaagatttcaattaggaataaaatttagaaataactaaaatttgtgataaaaataaagattattgaaagaaaagaccatctaaaacacatgatgagataaattaagtaacatgcctataaaggagtagagtggtggtggttgatacgagatataaaaattgttaataaaacaccaaatagaatcctactgatgattaaaaggagggacttcaggcaggccatgaagcaaacgtgtaaggcggttgtcgggacttctagaaagtaaaaaaaaacaaaccccaatgataataatatttaattttaaaaatctcaatgacaataaaaaggagaagcagtgggcggggtgtataagagtatagttgcagagccgccgacggttgatgggacttctagaaaataaaaaatgaattcctacgatagttatgttcgatggttagaatcacaatgacaataaagagttggcggcggacgggctgtagaggggcatagtggcatcgacgggatttctagaaaataaaaaatgaattccaacgatagttatgtttgatttttagaatcacaatgacaataaagagttggcggcggacaggctgtagaggggcatagtggcatcgtttgatgggacttctaaaaattataaaaaattaaactgcaagtccaatttttaaaggtttggaacttctaaaaagtaaaaaaaacaaatgataatcatatttgattttaaaatctcaatgacaataaagaagggaggcagcgggcgagctgtaaaggagtacaatggcaaagccactgacggtttggcgggacttctagaaagtaaaaatgaacccaaacgataattatgttcgatttttaaaatctcaatgacaacaaagagaagagacatctagaaattacaatggcaacgtttaacgggacatctagaaattataaaaataaaatccaacgtgacaataaactctaaaaattataaaatccaatttttaaagattccgagaagaatgaatagaaatagtggtagattgagcaagcaaataaagaaggagataacataaggggtagcaactggtgtgacttttgaaaactatataattagaaacacgaggatgataaggtttggtcttagcaactggtgtgacttttgaaaactatataattagaaacacgagtatgataaggtttggtcttttaaaatcttaagacgatgagatagctagatagctatttaataaattttaagtaaaatcatactaaaaaatatatgattttgtttgggtgctagccgcgcaattgcacgcgccacccaactagttacaatacaaataagctccaattaaatgttgcacagatactcctttatttttctgtaaacattaaatcagacgggccaacaatgtcagaggaaagggagtggagtaggaatcttggtgatcataatttcacaggctcttatttctctctttccttgactctctctcccggtctcctctctctcccccacacggcttcaccggcgacgcgagctcggctccggcgactcgagcttgactctggcggcagtggcgggcggcgtggccttgcgatttggcggcgggtgcaggctggtttgatcgtcggcgtcagcgcgggctcgatttcaactgtgcaagctcgagatcgccggtgtagtgggctccacatcggccgcgcgcgggcgcgagcttggacttcggcggcactgctaacgtacagttcctaactcctaagatcaatttgttgctctctctttagtatgcctggtcaatttttcattttccatgaattttggggtaattcattttttttaaaaaaaaaagagaaaatttgggtaactagggtgagttcaaatataaaaaacatgatatgttgacctcttattctaattcacaatgtaagttaactttccgttattgattccagagtttcatactaattgttgcaacagtagtgctgctgccattgaattagtttggtctaaaactaaatgtagttgctccttttgcaattccattcacaggggttaggcaagatactttgaaatatgagtggaatggaagctgctgtagcatctgggctgttgaaggtcgcaggacacaagttagtttcactgataggcagcgagtttgctgccatagcgcgcgtggccgaagacctatctgagctccatggtatacatggtgaaattactagctggctgtccacagttcgtgatggatcaatagagtgtgatccacagttccgttgggtgattaaattgaaggatgttgcttatgatattgatgatctactccatgaagtccaactagaatatgagaaacacaagatacacagcaatggtgacaagcatgctatatttgacacgttacgtgaaaaaccaaagtgatttatgttccgtcgcaagatggcccgtaagatcaaggatatcaaggtgaaatataatgagattgtgcgacaaagaagggatgccaatactatacgcagtagtttacaagtggatcaacctattcctagcagtaacatgataatcggggagttgtccttgttgagtaatgttgaagaatcaaaaatacctatcagggaccaggagatggatacaattgtatctatgcttgtagactctaatgagggagagaattgttggatagtttccgttgttgggctaggcgggtccggca

SEQ ID NO: 81839 - DNA, 16445 bp, Oryza sativa
  unsure (1)..(16445): unsure at all n locations
aatcggagttgtgagcgtatcagtttgtcgctgaaattgctcttttgctctggatttgtcaagccctaacaaaaaaaaactaacccttatgtcttttttgtgtgatggaactctcaagccgtaagaagcatgttggttatctagcttacaccacgcttaattagttaaagtttgaactaactgagatccatagggaaaaataatcagaactattattagtgcttgaaaatttgttgtgtgtttaattttttagaagcattatgtgcttttttactttcggtttacaatgcataggtaaaataacataaagaaataactaccatatgtggttctatgccatttatataacaagccacctaaatggcatataacaagccacctaaatgagactgaatataggttttcttctctacatgttcatgctagactaatggatttggtatgcaaggaacaaggtaaacctctatatgtcctcagggacattacactattgttttctttttttgcaggcttttcatggagctcttgatattagattttgcatggcaatttatcctatgttttgattgctagaatcttagtttgagttgaaccgctaaaataacatgtttggaatgttttatatgagtaagattttcaaattttgatacctttgatttggttctcttttcctcagagacctctaggagttcttatattggcatgcttttatctgattgcatacaatattttctctaacaaaatgttgtaaagactgtttttctcttggaggttggagctgctatattacatattttatagtgccacattccatccaaggttttcaaatttgttaggcacactaatatgctatcagcaattatagcatataaggaccaatttttgcgaagcacgtgatctgttagctacatgaaacaaagtatggtaattttcatatccttaattttctgttagtgtttatgaactccatttccagtggctgggatcttggggtttcaagatggcgatgatactccccatcctcccccggcatgacgactatggtgctctccgtcctccctcactacgaccccaggctagaggaggagcagtaggacactcaccggcgatgaggaaacaatagggcaggtgtcgaaggaagcaacagaacaggcggcgcatggaaaacggtgaagaattgtgtgggcagagaagagcgcaggacacttgttttttttttggcgcaatatctcatccctatggcattccattgtgtaaattttcggattattagatgtagtgcttttcctatggcatcccattgcgcaatatctcattcctatggtctcccattgtgtaaactcttttccacaaatgagttttttttttctagaagttgtatttttcaatgtctccagttcactatagttgtttagctgtgggcgtggtgccatgctacgccctatgttctagtgtttacaatcgctagcttatataccttatatacccaaatgtgcacatgttgtgggctagttgttactaatatcctgatgatcgatgtagcctaacaatataggcaaaatgtactgtatagaaaacacaaacaaacccatacttgaaagatatgatagaaatcctcaatcctgatatagatacaacatatatatgccttgtacgaacacacattatgaatccattgtatcaacacaaacgtatggagtctccctctaattaaggtacactaccaagttttcatcatcacatccttctatataacacaagaatcaattcaatttcaacatgatggtgatagacggatgttgatatgcttggtgtcgtcgctatgggccagcgagaaggttccctcggcagtgaggttgagataggtgaccgagagcttgtattctcccaagaaggcagaaaagttgaaggagccgcggtcattggtggttcccagggtctccttggtttgccactcccccagcagcttgtccaccacatctcccgcaggaaggttggtgaagttctggttggtcaggcacatctggtagcagctagcattggtgtccattgccgtccacagcattatgccatccacggatggatgggcaaacccttctcggagcacctcttccaagtatgcagcctgcaacatcatatcatcgtatagtacattaacaatgagatatataggttatatactacctccttctcatgtagctacctagtattggatttgacactatctacacatgtccagattagtagttttaggtagtgttaaatccggtactagatagctacgttttgagatagagaaagtatttcttatggtctgtcactcgagttttacatctagtagatatatatttgtgagtatgtaactacgtacctgcgttttggggtcgaaggagctactgatgtcgatctcggtaagccaaatggggagacgcagggtgccgagcttatcgagcacggcgcggacgtaggggatgttgggcttgccgaagtgtccctcaaggccgatgccttcgaaggtgacgccgccatcggcgagttggcggaggcgggagacgtaggagtcggcactggagctgaggtcatcgcagacctcgacgacgttgaagtcgttgaggaagagcgtggctagcgggtcggcgcgcttggctgtgtcgaagaagtcgacggtggcgttgccgccaaggcggttctcatagaagtcgaagtgcagcatctcgttgctgacgtcccaatgcacaaagtcgcccttgtaccgagagaggaggctctcgatgcggccagagacggcagcacgtagctgtgaccccgtcagattcttcacccatgctggcgtgtactttgggtcctcccagaagatattatgcccgcgcgccactgcgtcgttggcctgcacaaactgcaacagctggtccgccaccgtatagtcctccttccccgggtatggctccgttgcataccacttgagctcgttctcgaacaccgccgcattgaacctcttgttgaaccattcctacaaattcattaattaagtacattattattactaaattgtcatatattatatatcttaacaccaaaacaactaaataacatttaatgtctatcgctaccgattggatatagcgagctgtaacctagcagccgctatatgagctgagttagcgatccgtggtagcagtcactgtatgatataacaactaaaggcgtcgatggtgccaactccgacgcttgctccacgaattacgaatcaacacattataaactctttaatctatgttatgtatcgaaatatcactaatttatttctcagtttctttgttaatgtattataaaatcattattaatgatacacatactcaaatttatgtgtgattattaaatttcgttattggaacttagcttcagttatccgtggttcgctacatagacacctgcaatccgctacgaacctactgtccactatttgttttgttgcttaacacacggtttaatttcataaatcaatgctaaagttcgtcatatatctcagaaaaaaattaaggaaagaatcatgaaaacaataacctgataaagtttgttcccaaggattgtcctgctgatggcagagccgaatgggaaatccctggtgatctgatgcaccgcgaccttggcaccaaccacgcgactcccgttgctgtccgccacgtggacattgacaaagcgcttccggttctgttcgtgaaaaagaattacatgctggcatcatcatttgctccacacttcctcacaattaagttggattttttttaaattatccatcgtgtgacagtttttttataatggattaaaccggtctctatacccaaaagagttacacagcctaagagtcgacgaaacagtataagtacattttattaccagctgaatacggtcctccctgtgctgattccattgttcaggtgaaaatggttgcaaagaggcacttctgatcgagatcgttgaagcatttgggcttgcagtctgcagtgaataaattgcaaactgcatgacgattaattaattcaccaagtcaagatctaaactaggttcagctaaatttgtatgccaatatattactgtgctctctgtgacttaaccgtgaggaattaaattaagtatatcacctggaaatagaggacggaggtttctgaagcggagttgagggtgaaaccacccttgaggaaggaccaacagtcgtttcgcaccagagccgtgccaaggcattgagatgcagcgtttgctagcgtcaatatcttggctttcacatgagcagttgttggcccatcgattttcacccagcgtagagaaaatcaagcaagcaattccacaaggttaattttactcccaggaaatgacaaaattaagccagtagaattgcaggtccatcagaaatctgaataccaataacaaaatcaaattaaatgaaaagggaaacaattatctatttcacttgaatatttgctagtccaataatttttaattcacctaaaaaataacgattgcttgaagaaaactttcaagaaaatgctcaacagaccagtaccaaatagtaaagtcataaaatcagtaccatgccaaaaaagcaggggagcatgcatgaaaatgtgcgtgccaaacagtagaaaacagggcaggaaaattcgcatcgctggttcaatatggcagcatatatatgcacgatacgatgtttgggactccccgttttctttcgtttgtacgcgggcaatctgcacgaatctttggccgccccgcgcccaacatatgcatatgcgcatgcgcggccagggttgagacttgagagaggacgatgcgatgccggcgagatccggctatatgcgtgcggcgtgcccatctcatcatcattctccctagtttcctccgtgtgtcttgtagctcttcttggcttgttctcttctatggtgggggcctgctcacgctcacgtggtttctttttgctcatttctggctgggatacattgggtcagggacccctactgcagccacagtccttttggttccaaatgttagggtgtgtttgattgggtggatgtgactggatgggagatggctgtccgattatatgagttgtttgattggagggcagggtggatgggatggtaaaaaaaagtaaatattctctcaatatttttaaattatttttcgtttttgctagaattgtggcgtacgcctaggggtcttaggttagctccacaagctaggtggtgtactagacgacctggattcgaaacatcatcaattctaattatttgatattaggtaattcccaatattttgctcttttttgataaacgcctagggaatttccgaatagctccacaaggtggttggctaaacgacttggattcgaagtctcaccccttctaattatttgatatttggtcattccctaatattcgcgcacatcggttggattacaatccatggctgtttgcatatgtcaccaagtgacttgacactttttcctgagccattaaaaacaatcagcccacttaggatcagttatattttgccaaagctaatcaactggaacctactcctccattttaaaagagtgtagttttagtcgaagaatttgtctataggatgttatatatcatagctatatacgctactacagaatcccattaagttctagcttgctcctttatatttaacctatctagatgtgggggaaatatccggtgaaaaccatcaaataagtaaaaacccgtgaaaaccatatctaaaatttttataaatttatgaaaaaaaaatactagagataggtatatgcataaaatacatagctttttttttcttccaaatggagttgattttggactcgagatttggtataaatgtatttcatgcatatacctatctctagtaattttttcataaatttacaaaacttttagatatggttttcacgggtttttacttattcgatggttttcgccggatacgtccccctagatgtgaacgtgtatgtatttgttttcttcatttttatatattttttacgttttcaaaagaaatttagagaggtcaaatatttatcatggaactcgtcgtctctgacatgtattaggggattccatttaggctagcctgcaagctaatgcatagttcgataacaatgcaagcatgcatgctttatccatttttttcttttacgcgtacaatatgatcgaacgagtggccggggaaattttagccttttctacagttaaattagcaattactagcttttatactttagaattaaatggcggtctctgagagagctagtacaaacaaacaaaaagaaaaggataacggctggaaacataccatgcttagagcaggtataatagggtacagtcagtagacggtagaactgttcatctaaaagtaaatcctacatggaagagtgagaaaacatcagaaagagagtagccggcccttaatctatcgccaggctagccattaaaaaaacagcacgaccaatcggtcatccatgcatgcttcagctgcaagatttttccactaattacacgcttcccaatggcctcaatgagagagaatagagattgtaagagaataatttttgctgagctggactttttatagcccgctgctagctatatactattatgttttgtgttggtgggggacgggacgtaacaattagtaataaatattttctataaaaaaatattacattacatgatgggtgcatcagacataaagagcattgtgtgcgcaaatgaatgcctaaggcaccaaaaatattttggagcatgcacatgtgaatattcagtgaacttgtcctcattcgtgtcatattacgtagagaatctattctatgtaaatgaatttactatagttaaatgacttaccattgactttggctctctttaatatgccactaactttactatttttttctacaatatatcattaggatggagtacttttaaaaatacctaaaatacaattcgagttacacaaggggttaacaaattgattgaccccactacaagtttcgaaaaaatataattttttcatgtagcctccttccaaaatatagaagtgtatgtatatttcaagattttgaatttacatgtattaactgttttgagaatataaatatattttatatgctaatagaatactctttttattgatgttcttttatgtaaattatctttcatatgatataaaatattttttatccggataccttttgtgtatgtgattccgctttcataggctatataaaagtagttttccaaacaaaaaaaaggaaatcacaaaatatacacaaaaacttctatattatataaaagacaacacaaaaacttttatattttttcgaaacttctagtggatcaatcagttataacctcttaggacttgaagggtattttagacttttttgaaaaatatccattcaatcacacagtagaaaaagttgacaaagttagtagcatattatagagagagaaaaacgttaatggcaagtcatagtaaactcgatggtatataataattctctccatattataacataagtgttgcatgcatgcacaacgctagccatatcaaaaagccaacaaccctcaaaattattagaacaagtttttgtcgagttactaatgcttgaagtttgacaaatatcttcttttttgagtcccatagttattttttggaaaaattggttatatagcatcgaaagttcatgtttttggttttatagcaccgaaagataccgattcactttaatagcacccaaagttcaccatgttcccatttttagcacttccatcaattctcgatcgttttccgtccgtcgtgatccagccacacacacgatatgacgtttctacccctcacaacgtttctacccctcacaagtacaagtagaatgcatgtcaatgaggggtagaaacgtcatatcgtgtgcgtagctgggtcaataacgatcaagacggacggaaaaattganggaagtgntaaaaatgggaacagggtaaannnngggngntgnnaaagtgannngganntnnnnggngnnatnnnnccnnnnnngnngncnnncgatgctatataaccaattttgccttttttatcattttattttagggtgttgatacctctttcatacagagtttatgcttcacaacctcctataatatggttcaggcaattgttcgccaagataccctttgccgtcattcacttcaacataaaattactacgtactcattcaattcaattcgttatctctagaatttgttttcaagataatccatttggtaattaatatttaatgtttaagactatcaattgttgtactgaaataaaattataaataaatctaataaatttgtgatagtatttttcaaggtaaatatatgtatagctttttaactaagcattttagaaactactagtcaaatttaaagggtttgatcatatctttttttctaaacatcaaatacttcctactagagggagtacaagataagcaagaaattctgcatttgtggatagcaccaacacactgcaaagttgcaccagctccatgtaaaattttcagatcaactagtcaaatactcattctttgaaaaaaaaagagagaagaaaatcagtttcactagttttgaaaacacgagcacaaattagaagacagaggaacaaaaacagaagtgacgaacaaaaaatgaagtgtgatatatatactcacaggagaagctgtatactgttgccgcggacatattatacagcacaaatgccggcgaatagttgccatcgtcctctgttctgaagtccgtcactttgttcgcccagcgcaggatgccaccgttgtacagtgcaggttcaggatgcgatttgcactgaaaaagaaggcgggggttcagagctcagacgcatacaggcccatagttttgtttatgcttatacttataagctaaaataaattttcgtcatataacatttgatttttaatcgtgaagttcgtttataaaaattttacacataattcttttttttacaaatgtgtaagtataagtataggcgaaacgacgaggctggtaaatcgatcagcataggagatgaggtagagaggaagagatctagacgatgcgttgcgtacctcagtgtaagctctgtaatcatagcgcactccatctgcaaaacagcaaatttgttttccttttctgtcaggcgaaatccataaagtcgggtgccaaaatgagcaggattaattcctcccatggatcgattggttaactcaccggaggatgcagcagggcgagctagcaagacgatgagcagcagcagcagcaagagcaaagccttccgatctgcagggagaagaggcgatgatgatgacgacagtgcagcagcctccttgtgcttcttgccaatcgccatagttcccgtcgtgagtgagggtaacacgagcacacagagactagctctctctgttgtctctcgtgatttcttcttggatcgacgtgttgatgtgtgctcacacggtatttataggaagccaagcaactgtacagctagctctagctagtgtctagataagttgaaaagaaacgcaaattttactacaagatattatggttttagttctgaacacgataaaagttaacttttttttcagaaaacagttttaaagtttgtgaaaatttgctactttacattgcacacattaaaatatttatttctagttagataggagagaaaaatgatgtgagaggttaaaaatacccattgcttccacatctcagctctcttattcctcttttcgataagtttgaactttcatattttgactaccaataatttgttaatgcttacttttactatggtaaccctattaaattttataaacttattgtaattgaagttaaagttctacagttttgaccgaacgagcagggcactaagtttaaaatatttttaaaatgactatattttgtagcttatttcacatggcatcaaaagttcaaaacccatataatcccactgataaacgataacccataaataacatgtagccatgtaggtttgtaacgtgtcagccctacatatgttggagcgcgctatcaagctgcatgtagctgcactaaaacttgtgcattttgtaagaggtaaagcagaggagcaactatttttttttctccaagcatgaattttagattgaaccctcttttcttaccaaaagtttacgttaaacccctgaaacacatatttttgctttgacaactttgtatttgaatcttttttttcaataccattcttatctttgggtagacgcaggcagagacgccgagggtgtcaacgcagacacgcagtggtgaaaagatcttagtggggtacactgaggcctagttgccgttccggcttaactgatcgcgtgaaaaaatccgctaatgattaattaagtactccatctatctcttaatataagagattttaacattttacttgtaatatttgaccattcgtcttattaaaaaactttaaaattattatttattttttattgacttacgttattatccaaagtactttaagcacaacttttcgttttttatgtttgcacaaattttttgaataagacgagtggtcaaaaagtgtaagcaaaatgtcaaaatttcttatattatgggacggagggagtattaggtattataaatttttaaaataaatttatttagctttaaaaataatttcatatataaagtatttcacgaaatatgctgaaatgcacctaagactaaattagtttgatgacaacagtaaaaagatgctataaagtaaaaagaaaaaggaaaacgaaaaaaggaggtccagagtgcaagggtaaaactttggcaaagaacaggtgtcaaactgaaattcactctgaaagctaatgagcatttgactttcttaaaagttttatacagcatcacttactactaggtactatactcctacgtgtcatttttacaaagtactatgtggtcatacatcacgttagccttgacagcattaattcttggcagtttatggacgtggaagcagctgcgctgaatggggcctgcagcatgctagctagccttgctagcttccggctggatagaacgcaatatgcagataatggtgaaagaaagggagtttggaacgtgaagactaacaacatgtgggcgtgaggcaacaacgagagacaggtagggagaagtatactgactagtgcacatgcatgatcatatatcacagttcacatacgactcgcaagtgcatgtatacccaactttcggtgtgacatatattgcgcgtgcagttgtcacgcgtacattgaaattaaactagatgggttctgttggtatgcaccaatttcagctcatatactccctccgttccaaaatgtttgacgccgttgacttttttaaaaatgtttaaccgttcgtcttattcaaaaaatttaagtaattattaattcttttcctatcatttgatttattattaaatatatttttatgtatacatatagttttacacatttcacaaaagtttttaaataagacgaatggtcaaacatgtttaaaaaagtcaacggcgtcaaacatttagagaaggagtaagtactaaatatggtttattaaattataaactaatatattacctcaaatatgatatgtaaaaaaaatacgtaaggattcaggatgtatttgtgtccgtccctcctcacgtcggcccaggtggcgcgactcatccccctctccgcgtgcgcctctacctccacctttgtctccctcccctgatcttccctccctcccggcggcctccatctctccctcgcgatcccaaaaaattatttgatccggcctacctgcacgcgcccccttccccccacggcctctctcctctccctcacagcccctctcctctctctggcgcccctcctccctgtcgctcctttctcccagcgcccctcttctcccttgtgttccctccctcgttcaacgagaccggaacccactcgtctaggaatgagttttgatgcactcacccggctgcgatcaccaccagagctcctcgttgccatttatctctctctcgggaccacatagtcgttgttcccgctattatagttttcttcattgccaactgccaccatctatggacgagtcacattgtgcgacacgtccggccatcttactcactattgtttggttgcaggaggaccggcgcccatcttccctcctcttctctttcttgttttgactaggaagacgatgaatagtgttagtaatttttatctccatctttcgttcttccagcgtgttcaaggaaaattgaaccccttcatctggaacgtattttgatgcactcatctggtcgtgttcaccaccaaagctcgctgttgccgtttctctctctattggtaccacatcattctaaccgtattcatgttgttctgattttcttcgttgccaacctccaccatctgtggatgaagacacaattccttcctggtttagcctgaacatgctcctggatcactcacataatattaagaccataggaactatgaatagagcatgaaaattctaatatgtcaatgaaacgggtactcgttcagaattaatggatcggattttcatttatgggctaaaatatttttttttaatttctagctaatttcagtagtttttccatttacattattaattttagcactatttgatccattcaaaattgttgtaacttataatattgaattatttatagctaaatgaaaaaaagaggatttagttatataattttcattaaatatattaaattatcgttccggccaaagttatttttagtttcatgctgttatttatatgattatatttccttcaatccaatcgtgatatgcggtttaggattttaatttaatcatatttcttcagtttaattgtgatatatggtttagaattttaatttatgtcaatgaatgttatttagaatccgttgcaatgcacgggcatcatgctagtaataataataagaaagaatgttaatgcgaaagcggatggtggaatggggcgcagtgcatactaaggtaggagaagctaaaatgcggatagttgaaagagtaggtaatgaggtaaattatgttataccaaaggtttgggtccattttgtcttttcctcgatgaccctcatttccacaatcatatctatatgatgtaaatttgctatcagattcttttttgtctgtgtacctttttcctgacttcaaagcccttttgacctccatggctatgccaaaacatctaagcctcatctgcgacttttgaattccattccaacatgaggtcccaaacatggcagtggcatatcttcatacataaaaacagtagcaagtatggcactagtgtatacgcatgatgataaaaaaactgaatacacaagcatggagttctattacaaacctatatccttccatcttacgagtatgatggcctagacttgattagcatctgcaatcaaatgtttttttttccatgggaaagggatcgaaaagcttgatcaaaggcaacctaatatgaggaattgaggagtttgatcaattctaagaagccattcatagggatatggtagaagagaggtagatagttaacactaatgatcaaagtgaacaaaagctcttattgtttgccgaccctcagaacaacagctgacaaggattttttttcccctccatctgacagggatggcaccctttttccctccagatgaccgggcggtgaatgggcgcgcggcggccagggcgagcacgaggttgttcatgggctgattttccttgcatgggccgagtgcgagatcgctcgcctgagttgctcactggttcgtgcaacgcaaaagggatgaagcagctacgatcatgcgatgcagatcgagcagtccagcgatgtgcgacatccctctgacatcagttggccaaagtcagacggccgagttccgtactatgggaccttagtgttaacggtttccctctgtatcatattatattataagtcacttgacttaattaaacttttttatgtttggtcaagtttgtaaaaaatatatactaacgctttcaatataaaacaaatatattgtcaaaatatattcaatgttagatttaatgaaactaattttatattatatatgttattatttttttctataaatttggtcaaatctaaataactttaactaagaaaaaagtcaaatgacttgtaatgtgacatagaaggagtactagttaagaaacacatataaacatcacgaaggatataatttaaaaacattaatttggtagcaaatgcagaatcagcagaaacaacatttagtcccaactcccacgagccgcacaaactgaaagaagatcattcgatgagaaggaaataaatagagaaaataagcaagatgtcatggagtgaagaaaaataaattaattgaaatcacagaaattgcaagggaaacgaagaaggatgatttttttttaccatccacttgccctcctcgggtggaggttgtggctaagggagggggctgggatcggcagcggcagtgggggcataaggtcgttggctgcctgacgatgaggtacggcggagtcagggtcagtggtgtcagctaaacacaggacacgtggcagatacatagggatcatcagtgatctatattcctcatttgcgtgacgcgcgcagagtggttgattcaacgatgaggtcctggcaatgatggatcgaggcggaggggctgattcagtgatgggtcccgactgatggatcaacgtggaggggctcgaggcaactacacgatggtgatctaggttgatgcatcagtagcacctgaaacaacggcgacgtggcgcgcttgacgacatcaacgatgatagattgatggtgccactgtttgaagcggagtgaactgaggtggcagcacccacgatgagtgtatggagtgctagggagaccaagatagggaattgggggagatggaggcggaagtgcaggattaagggtgtgggaggtgggagcgatctaggatgttggatttgagtgacaagatcttgactgtttcatggtggatttgaaaatgtaagaatgaaagataagtataataagttggtgaattatagaggagatagatacataattaatacttggtccacctctctcttttatatagcttgttgaaacctgtgttgtaactagctataaatttatggtccgtttttcttctccattctctaacaaagaataaactaatgtggcaatttttatagcctacttacctcatcctattgtactcagcaaacagaacttagatgagtcatgggagtgctctagtcatgctttgggtcaggattctccgcactgaagaacaaactgcagagttacagtacagtgcattagggtatgatttttgctattggatccacatccaacggttcaaaacaaagtgctacaacagatctaaacactaaaccttaatcagtaattgcataacagtaaaacggatactgttcatgtacttttgctatagtgctactgcacttcactgtagcggtagacacaatgcacttttgacaaagtgtccctatgaattacaggggaggatcaggatccatcagtgttacgtgcccccgcccaaagccacggagacctgccgttgggtatggttacccattccgcacacccatacccacttgaaatggtagggtatggtcatgtcgaggacaacttatgttgcccatcatgaatgtgttgggtatgggtaacccgtaacccctaatagaaacattgtaagggagaggtttgtcttttttatctaacataaggatgatttttccccaaattgaatacccaaattgaaatgtgacatgccgagggagatatgacggagtactaagatggcagcgattgtggggtccaacgtttaataaatagcgtatatcgcgtcggtagtagattgttgcctatgtagcggatcgtggatagtgggtgctaagttccaatagagtattacaaataacgactttataaaacattaacaaagcagctaagaaataaattaatgatataacctacaaggataagtagagatttagtagcactcaaaaagttgatgtattatttcaacctaaactaaattaagaagcatacatgatattctattcattagatgttatgactcacaggaatataatgttttggaagacaaaacaactaacaaactcgtcattaatttgttatgggttagtggttatataaaatatgctcacactatagcggcccgttaaatagaattgcagaaatagtgctgctatattccaatatgttacttctagtccagtggcgaagctatgtatgtgtgtttgggggagggggggg

SEQ ID NO: 81840 - DNA, 1687 bp, Oryza sativa
attcctaattcccttaacccatgaacccatgacagatgcgccttgctctaccttctgtggaattacagtcagatactactactgacttcattatggtctactttgttattttctgactgaaaatacatattgaattattgatttttgcgggcagaccaaagatgaagatggcaaagcagataaagagatggacttcaacgatgagtatggacaggacacaggtgatggtgaaacattcgaaggtggttatgattatcctgattacaactatgatggctatggtgatggagcctacggcgattatgatggtgttgatttttaatacccgatatatcaatgctgggtagaattgttacaattttatttgtgtgtgtatggcaacaattatcaattttacatgaatagttctgattagttgacgaaaacggagttaatcagtactcagtagacagtatagcagtgtagctcgttgatttctctggtgatatgttgagaagctgttgtagtaactgtattatttcattcagcgacctatacttgcaagttgtatattaaaacaggcctcgaagaaaaaggaaaattttgaatgcctcatgaggtatcatggtctacacattcgacaggagtggtgtgcatgtcgtcatttgcgtgaaatgttgacttaagctgtcctgattggcgagcacgtctagttttgagttgcagtgcacagttctttttttctttaatgcagcgttgaatgtttgtttgctgttgttgatgtagtctgatggtgatgaaagtagtgtgcacttcgtcgtttgcgtggctgtgttcctttcttcagctttaaactgtaactttcttgttttctagcacgttttgtaaagtgttttttgcaaataactttttatatagaagtttctttcgatgattagggctattaccttactagtggtctgaaccagtataatctatgtcttctatgtgtttgatgtcgtatcgtgtaaatcatcgaatcaacgtacctcaataccttcataatacggtccgtgggtatccctcatcgataactgttcatcgtcttccttagccgaaggcgagaaacaaaagagggaaagtcttcctcagccgaaggcgagaaacaaaagaggggaaagatgggcacggtgctttgggtttacgacttcacgagttgttgtcgccggcaaaatcttggtgagagagaaggggagagtggtggagaacggtcatgtggagtggggttgacgacatcatgagttgtcgtcgctcggtgcagctagatgaggttggttttgctggattcggcctcttcctcctctctactgcttggatttggtcttatttggtccaccttgtagctcccgacctctcgcgcacaaaccatcagtgaggatgctgccacctcaaccggcccactcgtgttggcagccgggcacctcttccatccataaagtttactgagaaattaaagttccccaccttttccagggcgatgcgtgcgaacgaattcgtaggcggaccacggacgtgaacgcgtgggaaccgtaggcggacgaaaacacaaacgcgctcctgaatcggatgtgtgcagtggccaacggtgcaaaagcgaaaactaacgacaagggcaagcatgagagtcagatgacgtacaaagaaataacgcagtttcctttgcatcacc

SEQ ID NO: 81841 - DNA, 6642 bp, Oryza sativa
ttcggcggagaagcagtccaagttctaggccaagcgcaattgctggtagcttttggcacaggcgaaaacagacgcgaagagcaaatattgttcgacattgtcgacatcccgtacaactacaatgccatcttcggccgtgcgaccttgaacaagttcgaagccatttcccaccacaactatctcaaactcaagatgcctggcccgacaggagtgatcgtggtcaaggggcttcagcctttggctgcttcaaagggcgatctggccataatcaacagagcagtgcataatgttgaggccaaaccacatgaccgggcgaagcacgcgccaaagcccgcccctcacaacaaggtaatcaagatacagattgatgatgccgatcccacaaagcttgtatcgctggggggcgacataggcgaagaagaggttgagaacatcctagaggtgatcaagaaaaacattgatatcttcgcctggggccctgatgagatgggaggtgtttcgacagatctcatcatgcatcacccgacagtcaagccggataccaagccaaggaacagaagctacgcaagatgtcagttgatcaccaagaagcagcaaaagccgaagtccaaaagttgctcaaggctagggtcattcaagagatcgaccaccctgaatggctggcgaatccggtaatggtgcggaaatcaaacggcaaatggcgcatgtgtgttgatttcacagacctaaacaaggcatgtccgaaggatgatttccccttgccacagatcgaccaactcgtggactcgacagctggctgcgaactcatgagctttttggatgcgtactccggctaccaccagatccacatgaacccggccgacatccccaagacagccttcatcacaccattcggcaccttttgccacctcaggatgcctttcggcctgaggaatgccggggcaaccttcaccaggttggtgtacaaggtcctttacaagcagttggggcgaaatgtggaagcttatgtcgacgaaatcgttgtaaaaagccgcaaggctttcgaccatgcgtcctacctgcaggagaccatcgacaacttacgcgcggtgggtatgaaactaaatcctgagaagtgtgtttttggtgttcgcgcgggcaagttgttgggtttccttgtttttgaaaggggtatcgaggagaaccccgagaaaatcgatgccattcagcaaatgaagcccccgtcgagcgtacgcgaagtacaaaagctcgcaggccgaattgcggcactcagtcgattcctctcaaaggcagccgaaagaggtttgcccttcttcaaaaccctccggggcgcggaaaagtttacctggacacccgaatgccaagcagcgttcaacgagctgaagcaatatctgcaaagcccgcccgcttagatcagctctgcggcggagctatctcccttcggcttgcattttgtcgcccgcactgctatcaagtcccaagtgctagctgacttcgtggccgaatggacaccggcattcacccctgagcccgagcccgttgaataaccctgggtgatgtattccgacggttcgtggtcgcacaagggggcgggtgttgcggcagtactcacttcgccggggggtgtgccgattcggtatgccgcaaggctgcagttcaacacaaccaacaacgcggcagaatacgaagccattcttctaggcctaaaaaaggcaaaagcattgggggttcggcgcttgctcatccgaaccgacttcaagttggtagcaagtcatgttgataagtcctttgaggcaaaagaagaaggaattaagaggtatttggaggctgtttggtctatggaaaagtgcttcgccggcataacggtcgaacacttacctagaggccagaacgaggaagcagacgccttggcgaaatctgctgcttgtgtggcccacattcgcctggcatcttttttgaagtcctatacgcaccaagtgtgcccgtagagagcctggatattatggcaatcgaccaggcagaactgggcgaagatccaaaagactggcgaaccccattcgtaaggtagctcagaagcggttggcttccggaggacgaagcagaagcaaagcgcctacagctcagagccgcaaagtacaagatggtctcgggccaactatatcgctctggggtgctccaacctttgcttcgctgcatctcttttgccaaaggtgaggaaatggcgaaggaaatacactaggggctctgtggcgcacaccaggccgcaagaacagtagcctccaaagtatttcgacaaggtgtgtactggcccaccgtgctgaaagtctgtgttgagcaagtcaagaaatgtcaaagctgtcagcgccatggccgaagccaaactgcgccccaatacgagctgaagcctatcgcaccaatttggcctttcgccagatgggggttggacatcattgggctattcccggtggcgcgaaatgggtacaagtttgcaattgtggccatcgaatacttctcctgatggattgaggccgaaccacttggcgcgatcacttcggcagcagtacaaaagtttgtatggaaaaacattatttgtcgtttcggagtgccaaaatagttcatcactgacaacggcaagcaattcgactctgacaagttcagagagatgtgcgaggggctaaacctggaaatcaggttcgcgtcggtcgcgcacccacagtcaaatggggcggccgaacgcacaaatggtaagatcctataagcactaaagaaaaggcttgagggggcagcgaagggtaaatggccggatgaaatgctatctgttctctgggtccttcggacgacccccacaaggccaaccaagttcagcccattcatgcttctctatggcgacgaagcaatgaccccaacagagctaggggctaactcaccaagggtgatgttctctaggggcgaagaggggcgcgagttgtcacttgaactcttggagggggtgagagtcgaagcacttgaacacatgcgcaaatacaccacaggcacttcggcaacttacaacaaaaaagttcgaccgacggagctgttacctggccatctcatcctaagaaagaaagcgaacccagtggcggttggcaagcttgaatcgaagtgggaaggaccgtacctcatcaagcacaagtccaggacgggctcctttcgcctggcgacactggaaggtgaagagttcgaccattcctggaacactgcctctctcaagcgtttctatgtgtagaatgggtggcacccaaatcgccaacttgtaaaaatgtacatattgttatgtaagcctttcggcactatgtaagcccttcggcacaaaaatgcaaaaaaaacaggaaaatgaaaaaagacaaaaaaaaactggatgtgggctattatccatcccggaggcccgaaccagtataaaatctttgtgtcttttgccttcttatttgtatgattgataatttgtggaaaaaccctaaggcaaacgcctgatcagcaaaaatgccagggggcgaaacgaatcggccgaagcaccgttcgccgaacgttgaaaccgcaacagcttgtttcgggaaacaactaaccgaacaccgttacattcgatcaaaatgaaagcacaagtgcttccttgaacgtagaataaaacagatcgaaaacggaagccgaaagctaaaaagtcatagacctatttcgctaatacacgcaaaggggccgacacgttccgacctaacgaaagcacgagaagtgacaatgcaaaaaattgtgaaaaggaaataaagcacatctttcttgacttcgaagaaaatatatatcgaagaatacaaaccctacatcatggtacaagtaaagaaaagcgatggctctacagcccagcttacagataaattacatcttcgcccccacaaccgtccttactctctacggaatggtcggacgaactaggttcgtcatcactaccaatatcatacacaaccctgagaggagaagggggcgaaacacagactagactgtaacgacgctgggaaatcgcctcctgccgatcagacttctgatggtttcgccaaaagcaaaccatatcctccaaacattttgaatgaacactatcgtaatcttccaagctttgcccggggtgcgcccgcatccagccagcaaccttaaaaaccttatagctgtggccgttattatcatttcacgataaacgggccgaaacgggcatcgcacctttggcagacccttcaacgccacaaacttctcgtttttgcttcgccaattcccagaggggggccaaatgcacaattttcagcgaacatcctgataaacagtgcagaaagggcaaaaggcaaatttcatagtaagaatgggcgaaaaagagtaaatattaggtaatgcgaaaatggcgcaagcgcatacgccaaaggcatcgaccataaaaagtgactaagaccgagtcatacattccaaatatccaaaaggccattttcggctacaataagaagggtaaggggccatcagccaaatatacattgttcgcctttcgtggcaaacgcaaaaagaaaaactacaaaaatctaaggaaagggcggagggcctcacacctctaggtgatcctgggcatcgcctccaccccctccgaccgccgcatccttgccttcgccctggtctaccacctctgccttcgctagttgctccaaaaggcgtgccttggcagtggatcggacgtccttctgccagaactgtttccgccatgcgcggagcgcgggcgaaacgtcctgcgcactaacctcccagtcccccttcgcatagttagggaactcggcgacgtgctcacagccgaactgttgcagaacgcccatagtgaaggccgccgatacacgtgcacagcaatcactttacgtagtggcgcagtccgaaaccacaccaccagcctgctgcgtccactccgagaagtcaaaggcagaggcatctttggcggggactcctcgcaccctcgcacccatgtcgaaaagggcaaggcggagcgtttggcacgccgttttcgcggactcggtggctttcgccatctcccacaaaaaccgctgccactcctccgcaacgcttgcctcagccttgctggcctccaggcgaagagcctctatcttcggctcagtaagattgtaatagtcggtcagcgcagcggaatgggctttttccttctccagtttggccttaaggcgatcgacctcagctctagcctttcttcccttctccagttcagcttggagtcgcttgttttccccttcgcctccttgagggtgttggagagggcctccatctccaaactcttgcggcctatctcgtcatccttggcccgaatacggctcctaaatccgtcaagatgggcccgcatggttcgctctgtcgaacagtcagccgcaagaatctggatgtaaggtaaagcggacgaagagagcaaatgttagttatgggatctgtaagaagaaaataaagacaaacaaaaagagagagagcgaacagcatacctgaaccgccaagcttttaatagcagaacacccttcgtcgaactcattcagctcggtgaataggctcggggtgccgacaggtgagacaaggttgcttacccccacgacaaagggaataagttccacccaagtctcgaaatcgccaggggtgaagtggggcgccgcgagagaatactccgaggcagatgtttcgacggccgcccccttccccttcgacttgactagaggcgaaacaaccggctgacgcaaggggcttcagaaaaccctagccgcaaccttcatgacacgatcagtggaggctgaggccccggcggcggcactgccacccgctccgccagcgtcgatcgaaagaacgggggcggtcgaaagatctaagctgcgactagcgggcgaagttggggtttcgtcagaagactcatcgtcgctgaaaacacgagcaacatcaacgagtcctttcttcttggcggccttcttaaccggaccccccttcaccaccttgcccgccgaaaacacaactagcgccttcgccccctccaaatcctttcgatgaaggggggagctattcgactccacctcggtctcgttatgccctagacttggagtaggagtgtagccaggggtcttggtgcggttttcgaccgcctcgtccgcagcctttctggccgcagcctccgccccctcttcttcctccccttcctcctcgccgtcacgatcttcgacgtcgtccctgtcgtcggcgtcagaatcggaggaagcagggacccttcgcttcctaggggccagtttcacttgtccgtgcgtccgctttcgcgaaggctctgcatcgtcgtcggccttgttgtgtgagcagctggctgtactcgacgaccgacacgtcgccaatcatcttccgggcttcagcgtcggcctaatcaagaatcaatactgcgaaaataaaagatgtagccatattaagcgtcgaaccgggaaaaatagcgaaacaaagaagcgcatagcgaaagcggagtctcaccgttcgtcccctcaggaggaaccagcttcagcaaaccgtcgacgtgttcgtcttggtacaaccgcgaccttgccacgaccgggagaggggaaa

SEQ ID NO: 81842 - DNA, 609 bp, Oryza sativa
atgcattatccttacattccgaatcttttgctttcttcgagggttgggttgtaatcatatcagcatgaatggcgtcttgattgacctgagtaccacataaaattaacaaggatctatattgtacagggaaattatataacactgaaaagatatagttaatgcacttagtgattaaatttggggaaattcaagaatttattacaataaattgtgtctcaaatctgctaactgttatagaattattacgcaaaatccaactatggtgtttcaaaactatgaagcacgtaaatcagttcggtgttactacttctgtttaaggcaaacctttgttttcaaaaaccaatagatacttatgttgggtcaatcatgagcaaaagattgcaagtccaagcagttgacaaagacacacacaagagcctcttgcatcgcatgcatgctttgaaaagaagattgatcaaatagctagtttaatctacaataccatgtattaatctacagtaccaaacattaatctacagtaccatgcattaaccttagctagctaatgtactgcctgcaataagtagtacaaattgcaagatagcatagagccttagatgtcatggactc

SEQ ID NO: 81843 - DNA, 10391 bp, Oryza sativa
acaccccactatccgtcccccctgttgtctagccttgaagcccatggaccttactaggatccaatgttctgtctgctcgagagaatcaacgagcagagtagcgatgtcgacgtctcggcttcttcgttaaccctcgtcctatcgcttcagcttcgcattgtgcgacagcgactgtcggcaacagtgacacactacgcacgcggtaagcctctctccgcaatctgtgcctctgcccttcgatcaacgatcgcgtgcgtctcaccgtcaagtacgcagcacacctaacatgaccatcggacgcggcctacaagtgaggttttgtccattttccccaatacagcaaaataacctaatcgcttgacttttagttttatgttttcttttacttgtacggtagtcacttgtccataatttagtatatagacatttagtccgttggtgagtactggattttgtgatgtttgaggcttggaggtagttgctactctctccgttttagattataagtcgttttgactttggtccaagtcaaactacttcaaacttaactaaatttgtgataattgaatatatttttataatatatttgtcttgggttgaaaaatgttactttttttttttacaaacttggtcaaacttgaaacagtttgactttgacaaaagtcaaaataacttttaatcttaaatggaaggattacctaataactatatgagcacttgaaccttcttttctatctaaaaaaatatttttgttgattatctaccaacaatgaagccatgaaggctatagtatgtatatgcattgattgtcatggactttggccattttgtcttctggctccctcaatctcagatttggcttcgctcctgtttacagtgcactacatcatataggcactggtagagggccactgtcatgatatttattagctcaagcatcgtataagggctgagtagtaaaaaaatcaaaattgaaaacaggataaacagaaaagccaagaccgagaccgaactaactgattacttttttttgcgacaaatacagggagctttattaaatcatatcaagattacattcttgagcaagaagctcagaaacattccctggagcctgcaggcgccaaacgggtatcgttccatcgatcggtggttacctctgttgcgccaccgccaccaccagccaacccatcagtcgagttctcggcttcacccttccaattcccgagttggcttaacgagtcagctagctcaattcaactcatcgagtcgagccgacctgatagtactatataaaactgattgattcatattactacgacgttttagagcatcaccaagaagttttctaaactgaaaataggaaataaataagttgatctccctaagagaaagcctaaattttatcaaaaaaaaatatttttctggaaatattttttttgataaaatttaggctttctcttaaagtgatcagtttagaaaactgaaacaaattttcggagagattatacgtctgttgatgcttaaggctgtgttcggtagaacaagttcgcatccggaacagaatagtgatcacagaaaacagagcggtctattagcgcgttattaattatgtatttgctatttttttttcaaaaatggattaatttgattttttaagcaaatttcgtatagaaaattttaaaaaaacacacaccgtttagcagtttgaaaagcgtgcacgtaaaaaacgagggagaggggttgggaaaaggggcatcctagctgcagccgaaaaacctacatccagtttgtggaaaacaaaaagaaaaaagaaaaaacccaaaacctaactactgtagcctgtacgcacatctatcccccatccgccgccccctccctttcgtctttcgtcgctcgctactaccgtgccgcgtgccgcctccctcgatctcacgattcgcctccgccgccccgtcctgttccccaacgctagctcccattccccacgcctccctctattctattcccgctttccctatcttccaaagccgccgagccgcgcggccgagtgcaaaaaggaaaaatatcggtccccgcgagctagggtttaccacccccccctcgtccacctctctctctctccgggtgcccacgccggcggcgagctctcctcaactgcgccgccgagagcccccccgccccccctgttcgtgggggaagtacaggttcgcagtgccaccctctgtgtctactagtgaagtttcagttttggactatgattttgttattatgctccattatgttgggagattgggattggggaattgaaacagtcacgtgaatccaattaggcaactaaaaaaacaaaaacaaagagagtacaaaatagggaaaggcgaaaaattgagaggcaccgcactggggatgtttgattgcttataattcaatggctgatctgtaaatgttagccatttcggcttggaaatgagtggaaaaagctaattaatcggaattttttcgcaggctgatcttagttgggggggtatactctgcggtctacttgctactccagcaatgtattgttctcactgtcaagataactgccccgtcgtaaaggaccctgacaaaaactacacgtgaggcctcccttcctgtcttttttctccttccatttcgatgcaaaatcagctagtacaaattgtttataagcatggccttgttggtcactcttaaatttctgtgtaccagctctaacacttttgtgcgcgtgtcattatgtaatttttcatatggtgatcagatgttgtggtttgtgtgggaaggttcttgatgatcaggtttacgatggtgagccaactttccaaaagggcgccgacgggcaggttgatctttcactttgcttctaatttggtttggtttatttatttttcacttctcatgttggttgttttggagctttacaggcccggttggctggtagtattctatcaagcattgagagtggtaattcagtatcccatgaaagaactataaataaaggtacgactttgaggtcattcctctatctcattttgctgccactttgtgggctaatttcatgctttgtttttccaggaagagaggagattaggcagattgtcagcagcttacatgtggctggtggagatactattattagcatggctcatcgctattatacagtatgtatctttgttactactacctccgtcccaaaatataacaacttttagctttgaatctggacacacagttgtccagattcatagctaaaaatgcttatattttgggacggagggagtagtcagtagcttataatttctaaaataatatggtacatggtgatgctgatgtttattcttgttgaagtttagctagctgttgacaagaattttacaaggggccgtcgaacaactcatgttgctgctgcttgcctttatattgcctgccggtatgctaccacctaattactttgttgatttattgaaagtcttctcactcattgtacttgttttttttctcaagcagtacctttcaatagaattatttcttgagcatgattcttttctttgtcattgaacttataaaatgcctaaactataacacagctaagctattccagactatagagcatgcatggtgaacatttgtgatgggtttgtttaatacatatatattttaccaagcacacaatctgaacattgccatgcatggccctcaaatatatcttccatgtggaaaggaatgctgtgtcctaaattttcaagcgcagagtacttaatggcctggttatgctatatctcatttttccctttaggagaacataatactccctgtaattgcaaaacaaatcctaggatttgacaccggccaaactttttaacccttgatcaatggtcatattggaaaaaataacttccatttctctagagaacatataacatccatgattgtctttatccatagaaatacatgagcatgtaggtggttatagaaactagcagtcaatgtggctcattgtagattatgtccatgtcccagatggtgtgctatatttgcaatcataggtcgtacacagtattttcattagttattgctgttcttaagttgtccagcattattttttttcctattagttcccttggatatctgttgtcaagtttcaaacttttgttgatattcattcctgacattcattatacctaatttgtgtgctaggcaaagtaaaaaggcatatcttcttattgatttctcggaccatttgcagataagtgtgtaagtgccccattctcctgcccttatcttgtagcccttagtgacatggctcatctggatttttctttcagttatgtcctaggtgctgtttttctgcagctttgccaagttttgctacttgcggaacatccagttatccaaaagctcatcgaccccagccttttcatacatcgttttacagaacgtaagccacactaaattgtattatttaaatttagcggctgaaaacacatgtgccatttcttgtgtacatctctacatttccatgcactttgaatatgcacatttggtttcttcaatgtggggagggggattgttcatgtcatgcaattataagaggctgggccaggctgttccaatgttggtacctgccacatttgccatggagaacatgttggagtgcaattctgtttggaaattgcaattacaacatgaattctgattcttaaatcataggcgctgtttgattgatttgcagaattggatcgaaattgtggtattcgagtcctgaatcaaattttactcgaaacagtcataggctcttgcatttacaccccagtgagaagtggactgatggatggaccatttgataattcttgcacaaagatttatgtagcttttgactaatttcttcaccttaatttatctaatctattcaacgtgcttttacattcttgtgaaaaaatatataacaattatttaaaatcacatatgatatttattttgaactatttgatagatttgtatatggtagagtcatgtgtagtagtcagactggggcatactatagtcaaactatctcctcgcttgtgttgctcatgtgaaggagttcaattgcaatgcaagctccatccttttatcccccccttttctgagatctttgcaaggcaatgccagaaggcaattgcttgggttagtaaggaaaccaaacatgtttagtctgattatttttgttttttgtgtcactttgttggttttatctgtaggtttactggggaagagggacaatgccgtatcagatacggctttacgcattgtagctagcatgaagcgagactggatgcaggctagcatatttttctccttccttctttaggttcttttttgtgattgtaataacttgacttatgttgcagactgggaggaaaccaagtggattgtgtggtgcagcactatatatcgctgctctctctcatggatatgattataccaaggcagatattgtaagcccaagtacttttgtctgatatacttatttagaattgtattctgaagtcttatgccctccttctgtatcagttagcatgtatcgggcacatgctacattttgtattttttataattggacatgaatatgattctatgctacagcatataatgacataaatttctgttttatgttttttaggttgctgttgtgcatgtttgcgaggcaacactaactaagcgcttgatagagtttgaaaatacagattcgggtagcttaacggtatggattctctctccaggaaattgccaaattcataggcgctgttacttaccgcatacagatgaaaatttgttgcaacgatgtatttgtaataaagatgggaatgacagcgctaagttgattgttggtacaacttttccctctgaaagtcattcttaagctgtctatgctgaaacatattgtaattactatcagtgtatggtgtctgttatggtgcaagtatttgacattactcatgacactaaagcaactattgacctaagcaagtactgattagggcagggcagcccatgtcaactagacatgcattcactttctttaccctgtccatagagctagttttaggtgcttatttttacccgttggttcagcatggtctatctggcaaaaaaattgggtattgccccctttcatgtctgttttttcatgtcatcaattcatcatccacaactgttatctactactccctccgtcccagaatataagaagttttagggttgaacacggttattaagaaagtaggtagaagtgagtggtggagggttgtgattggatgagtagtgaaggtaggtgggaaaagtgaatggtggagggttgtgattggttgggaagagaatgttggtggagaagttgtcatattttgggacggagggagtatatgaatattctttaagcaaatgaaatagtattatgctagattgtaaacgaaaatggtccttgaggtgtaaatgtgtcattgtgaagcccattaggggtccatgcaatgggcgaaggatgctgcctctgcccactactgcctaagcactgttcatggtgccttgtgctagttttatttagtttaaaaataagatgagattgaattatttatcggtttgtttccttagttttagagcaaagggcaaagggtttttgcctctatcatgcacagtacatcaggattaggattagaggtgtcttcatttcatacttaagtgattggacacatttccagctcgcattcaacgtattgtatccatgccaatttgcatttgattaaacattatattttgctgccctcttgctagattgaagaatttttggcaaaggctgatgaacaagtgcttgttactaaaatttcaccaaagtctggagaagtactttgcaagcacaaggataaagctgagcattttgctcatggactctgtgaaaaatgctacaacaaagtaacagacctttaccatgttcataatacatcagttttgggacttcattactcctgacacatgcatgactgttcagtttatgaaactgtctggtggactggagggtggctctgatcctccagctttccaacgagctgaaaaacaaaggttggaggctgctaaaaatgctaaaggaactgctgcatctaaagaggcagcactggaatcagtttgtgaggcacgcgaatctgatgttgagaataacattacgacaccgccaaaggtaatatgttcttaacatagttaagctcatgcttgttcccctatttaccatacattcttcctttgttagccaactaaataatgtgctcttttagttcattaacaagggcagaaaaaggtgacttttgatcatctagatcctgtacaagtacaacagttttgttatatgaatatgttgcattctcatgcaccacgtatatgagtataaatttacacgaaactgtatataggtcccgtttggaagtggcaatcagtaataatccgccctggattatttgttccatgcacctaaattatgattttttgaaaaactctcttatattgccttgcttagacaacttgttcctagctactactccatctgtccacaaatataagggattttgggtttctccatttgtccacaaatataagagattctggagtactttcccaatccattgaaccattgcatttgtttctcactggtagttgcatcattagatgaaatctttcccaatcaaataaagtcccgagagcatcaaagtaattccaccttatgtcacgagctccaggaagagactggattggatatgtgtgggatgtgggcggacgtggtttcgggagattggacgtgcgatgccccgtgatggcgacgctagaagaacgagatgagaaaacagagaaagtagatgagaagagtagattgaattcaagcttgatctttattgaatgaaagattgcttatataagcttatatgcaactgaattgctaattaaaagagataagaactaatgcaacaaaccggaaccaactaaacaaactcgagataagatcctattgccaagccgtactgtagcgcgtccgaatcacgccattcatgctgccgttgcgcgatctgattgatcgccctcatcacgcgccgccgttcccgtgcatcccgcattcatacgcctccgatgatatccaattctgaccatgataccttaaccttaaactctgctaaaaaaaacctagcatacttatatattttcgaactgaaggagtatttgttaagtttatttctcaaaatattaatttaccgtgttaatcaagtagatcatccatttcatttcacccgtgtttcatcactttcaaatggggccttattttgacaaaactatagttttaagacacaataccacaaagctagtatctatttagcattgaatttataaaaagaactacatatttatgttctactataaaaaaaacttcagatttagcatctcatcacaaagctatggatttataagttctattaggacaacagtgtgaggatctaactcataaaatctatatatcttttatggtctatttagttctatgatctgtggtttaatctgcagttttgttataattttgtgaaatttctgaatttgtgattttttttctctatttattaaaacatctgcatttgttatttctgttgtataccatataatgtgtttttgtaatttgaatactcaatttaacttattttgacagaatataattggagataagcattcgacaattccttctgtgaaagttgctggtgattctgtagctacagaagatcctgaaggggaaggtttgtttgttgctgtaccatcaacgatgatactccacaagaaaattcatatttccattttaggtcccttttgataagttcattcctgctgcatgcatatttcatccttaggtaaaaatgataaagcagatgaaggtcctgaaagtctctctgatattgatgatgcggaggtacttcatcctatccatgagatcacttctatatatttcatagagtaacttatttatgtcatctttagatcttgaaagataatcagttaggctctttatgatttactacagtgctactattaatttctaggttgatgggtaccttcacaacgaggaagaaacacagtacaaaaaaattatctgggaggaaatgaataaagagtaccttgaggtagctaagctgattacatagtagcataaggactttcttattttaaccacatagtgtggttctcagctggttgctttacaggaacaagcagcaaaagcagcattagcagctgagctggcagctagaggagtggttgtggaagaggggaagaggaaagtatgaaatgtttctagtgctaccaacctttctatgccgtgtgttcactgtagttcgtgattaagcatggatatttcatatgtagagaagaagacataatgaagatggcaagaacgcaacacccgctcaaacaccagcagaagcaacacagaacatgttgaagcggaaggtactaatggtcaatacaccccgatgctttgtaaggtttttcatttacttttgatggagaataggagaggctccactacatattaatttcatataagggagttatttgtaagcagtaaagaatcagaagatgattagtgcattttaattatacttcgaatcatagtttcacaagatagtttataggataagtgcatggctttattcatatccatagtatgcctactcatgagactgtcatgtggtccctgcgctcagatgttccttggcatgttatagaaaatggttgaaacttgaaactgaatggttttaaattacaatacatcaatacatggttagtccaaacatgaaaaattgcagattttattttaaattagattttttgcttccagcatgacatgctctttaaatggtctaaagagaaatctacattaaacacctacggaatgttcatctccaccttcttttggtgctttccatgttgtattaattagatctaatcatgtgcaacaaaatccaacattggttctccaacaatgaaaaaggaggggcagatgtgccaatgtttgtggtgttggtaggtgaaactaaacacctacggaatgttcatctccaccttcttttggtgctttccatgttgtattaattagatctaatcatgtgcaacaaaatccaacattggttctccaacaatgaaaaaggaggggcagatgtgccaatgtttgtggtgttggtaggtgaaacaaaggcccataagaaaggtatagaaaactgtggacatgtttgcatcatcttaattggcccataagcgaggaatttgctccaataagcccatagcaattaagcagacaccaattgaattgagtagac

SEQ ID NO: 81844 - DNA, 3950 bp, Oryza sativa
gaacttaacaaaaccagaggcatatttcaaggtcgcgtgcataccatccaccatgctcttcaggtgcttgggtttcgccacacaaacattatggtgcttacatgctgttaactttcctttcgatccgatggcatgaaaaattcagcaccagtaatcggtggtaaacagcagtcacaccggcacaagacaggcaagatgaaactcaaaacaatcgccatcctcaatattaattaatttgttcatttccattctgcttgcattacaccataatatggaacaaaatgaacagaaaagtcattggtcagacactcagacctatagtacaattgttgcactcaagaaaacgcctaaaactgctaaccaattaaataagaagaataaaatataacgaactgaaattctacccgggagcgctgatgccttcatgccgctggttttcagacttcatgatgttaagggagcagaaggaaacatagagtagccttgtctgatctataaactgagtgctttggtactttttaattagggctgaaaacgatgcctataaatgtgagttgtgacccaagatatgagatatatagaaaaatattaatacctgaagacgccaactattggaagacccttttgcattgcaatgtcacgtctcattagtaagacagctcgagcaccatcacttacttggctagcgtttcctatgggttaaaacaaacactaatcttgagaggtgaatacaactaatcaacagttgtgcctaacaaactttcattacacattaccagcagtaggggtgccatctttagagaatgcatgtttgagttttgactggactgccaatgaagtgcctggtctagatatattgactcaggactaaagtgtcttcaaatattctcagtaatacgcccagccttcaaattcagtagttttatttatggtgtaacatatatgctaggagtaaaatttttcatggttaaatgcatggtaattgtaatgttaagttggagtggcaatgttgagatcagccaaatggggaaaatgaacatcagtacccttcattggccatttgacattgagaagaatatgtgcaaaatatctggtcatatcaatcacacaaggaaaacagaaataccatatactgctacagtggtcagtcattatatttgtgttagatgtatttttcactaaataactaaatattgcatcttagagatactgcttttgctattgatccgaccactattttgttaatttcattgcattttaggcatggtatctcaattagcagaaaaagaaagatgttataacgcatcaatgagatcttctagagatgatatgatttttaattttgtactgatcatcatcaacatataaaatatattccccatcagttaaaattttccagactgctctattgatagaaccgcttagcaatttttaaatggtacgatacatagcttgcgtacgtagttcatgcacaggtaagtccaggcaatatcaatcaaatgcgcacaggaccaaatcaaggaaatactaagccaaacatcatggtaaaggagccaagaataccttgagctagcaaggtccgagcttcccttcgtgcatccctggcggtggacagtaagccgaggtggacaggtgaaaaaacagccaggagtcccacaggtcaggtgacctctgaaggagacaagggatatgttgattgtttctattattcatatgacaaatgttgaaaaaattcactcaaaggtaatattctaaatttggaggtaccgatgcaagaaaaaccactacttatgtggcataaaataaatttgtagaagctagaaggttaatttcagagcgaacaagatccgttcttgtaaacttgtactgatgcagtgatataaactctacgtccaatcaataatttaagtaacatgatggagaccatgtagatatcactcaaaatacaagacaagtatttcacaatagacaatcatatgcagacattcacgcacgacccaatcatccttttctaactttgcacaacgatagaagaaatgaaaggttttaagccatgataaataatcaaagctgtagaagcttccgttcaatgaagcatccatgtaactcaaaattatttatcatggagctaattagatagatgcatagaaggacagtaaacaagacttaagaaatgatgacatgtcattgcccaatgccctagacaggtctatgcaccttgttagcattttactaaacacatgcttgtattcataagggtactataagtataagtatatacattcatatgggtactataagatgtaatttaaggcatatatgtacattttcataatatatttaagaactccaaggcaagcattccatcaagcaggtcacaagcagtggcgacgtaaagccagttcccgtgtgttggccgggatgataatctattattctattgttcatcatgcctaaagcacaagggatgaagcaagcacaaaaggctaacattgtgctaagtactttacttatgttggtaattgcaagagatgagtagctatttaatgtgtagccatcctcaattagtgcacagattactcatgatgcaccaaaagttcagaaattcagagattactcatgatgcaccacaaattcaaagattactcatggtgcactaaaaattcagaaatggtcgtgagtttgaatgcatttgtgcataccgggtcagcaagccagtgcatccggggcacgaagcccaccatggcagagagcgcactctgccacacggcgaaggcggcgtcggtggtgagcccctggatgggcctgaacctgttgttgaggctgtcctccgcgttgatcgcgaaccgcacccgcgagcaattggtggagggagcaagggggggcgggcgctcaccgtggcgaggcggcggagaggtcagggcggtggagggtgagggcgagggcgaagatggtggtgatggcggcgacggcgagcaggcaggcggtgaatctgccggggggcgacgtgtggtgggtggcggagggggaggtacccgcagcggccggagccgtaccacctcctgtcagcaagttccagccgtggcgtcgcccgcgtctcccgtcggccgtctcccccgccaaacgccgccgtcctcacgccacctgccgccgtcgcccgctccgtcagctcaccggtcagttccggtgatgacgggccggatccagccacggaagggccagatccggcggcggcggatccgcagccacgcgccgcgaggccttcgcggcgcgctgtgccgcctccttgcgccggagacgagccgccgtcgggggttttggccccgccgccgccatcccagcgtccgcgtggtttccggcgccggcgagccggtaaaagaaggggtgggtgccgccgcccgggggctagggttcgcccccggtcgcccgcgcgtggacgacttcttcggtgttccctcatacaagaaggtctcggtcatcttctttgcctgcaggcatcggcgtcagcctccttgttcttcttcttcctcctcgggctcctccttcgcgtcaggcgcaatgagggcgcggtggagagcgatgggcggccagtgacgatggtgggcgctggcgcggcgttttttcgcggtagggagaggcgcgcggcacgatggtggtgcggactgcggaggaggagcgcgtcgattctgtgaaaaatccggcgcacgagtgcacgacggtgagggggcgagagagcgcgaggaggaaatgcgtgggagatgcgggagaaagaggagggaagagcgagacacaggacggtggatgcggcgtgatttcaccatttcaggtgcggggaggagaggagggggagaggtggggtaatctgaggcgttggattggatgattttagaccattggatatgtgatatgatgaatgatgagtgagtaaaaggatttgttgaactaatagg

SEQ ID NO: 81845 - DNA, 1544 bp, Oryza sativa
aattcttctatccatgacgaaggtgctcgtcacagaattgctatccagctggctagtgacaagcatcatccatgccacgtggctgccatacgtggaatccacgttggatgtgacgtggcagatgacgtgtactccacatttgtccaagccacgtggctgccagacgtggaatccacgttggatgtaacgtggcagatgacgtgtactccacatggcggatgacgtgtacgccagtatgctagagccacatggcagtcgtatttaaccccacgtgttggcatttcatatgtccacgtggcgttagcgtgcaacgccacgtggccaaatgtggcaacgccacatgttctcattttgaggcgccacgtgtctttatgacaggtgtccttacctgatacagccacgtgttaatatgttttgatgacacgtgtcaaacacattaaggattcaggtccactcatttgttctggcccaacccatttggccacacattttacatctagttgtggcccagtccactattagttctagaaaatttttagcattggcccatttggagcaacaattagaactttgcacacattacaaataggaccaacataaacattgaacacagataccaacttcattacaaatagccccaacatcaacattaacattgaacacagaaaccaacttcaccgatgatcccaaacttgtgagccagtgttgccatcacctccactggcagcagcagccatggcccgccgagctcgacatcgacgatgttgccgaagtccttgctaacaacatcgatcctctgaaacacctgataatcaaacgaaaccaagtttcagattataccaacaccaaatttctgattctccaaatcagattcagctgaataataattcaggatcaattgtttttctgacctgcccgagggtgatggggaggagcctagcaacctgatagtacataaccatatgttagattattttttttatgcgctagataaacaacaagaaacaatctatagatacgacattagttttttaatgatagggctactttgcaacaccaatctgatgtccccataatatattgcactaacatatctcaatgtccccatccccaacccacctcatttcattggccaagcaaacaagcaaccgaactagaatgcataggagtttagcactaaaatttagacactaaagttatgatacgagtaacttcctatacatgcttcatttctacagactataggcatatagcatgaccgtaaagtgtggtgtaaagttatggacaccatttaaacatgcttcatttctacaaagtacatgcatacaacggttccaaaatttatatcaccagtggaacaatgtagcagcaacatcactaagtactataacactagagtggaacacacagcgcgctgcaccagtggcatcagaagacgaaaatttgtcgttattttggtaaacagagtaaatactaaatcaaaaggtattataacagatgagtaccaattctacaatatacattttaatctcaatggaaaacta

SEQ ID NO: 81846 - DNA, 5526 bp, Oryza sativa
gttggacttcaccggtggtggcaggagcatctccatgaatgtatagaggaattcagcagtggtggcgttgatttctgggagtgaaggaagagaaacggtgtcgatttgtggttgggggggggggtgggtggtgtccttttttttttcttttttcgtgctaggaacatggatatttgggggaagttccgatgcatctggaaggtaggtggagggagggatataatgtcatgtgtggcttacaggtgggccaaggctatgaatgtaaatttttcttatgttagagctattttgcatttttatttaggaaaagtatgttttagcaaaatttatagactggtttaaaaaatacaaagggctaaaattttaaatcatcatatcccatccaaaacaattgtgcattgtagagtagtatccattcctcgtgcctttaggcagcattcttcaccgtctcggagctcatgattacagtgtaaggcattctattgtcaaagattgggttgattagatttgatgtctcgacaagatcatgtatatcccacgcgacgcttagctcatgtcaagttttgatttaaaactatatgccgatttgagacacgtcgtaggacttgattcatcgttttttccatgtttaattctaattgtgttctactcggccctctactcccctcttcctctctctacctaaggtttggaaatgccgcaatatccctccaccattgagcaaccacctcctcttttcttttacgctattgccttactcgaccattttgcccaccttgctagctccatatcttgaatcaactagctcgccttttctttacttctcgatcgcagtcaatgtggcaaaatgacgatgggcaagtgaaaacatgtagataatggatgttacatccaatacgagagaaaattcttccagaaaatcttagtgtgttaaagcatgtagataagaaaaaaaatctattttcgaacaacctatgtgaagaaaatattttcttaaagggcttagatcattgttggtatttcttacgatcacagataagatccgcaagcgcacggatataccgatgtagcacttcccctacagagtattcgaagggtattgaatccaagggaacgtgtgtggtcagatcttcctccgggttatccaaagacactaaacagtgtctacggaaagcttaattttaatcctaacgcaatacttcgggcactggccacccgctcttcctagatgtcgctctactacgtacccggacagggaggacttaagtgctcttgagtgctgtcaccacctctacacctacctcaaacgtactgtgggatgcgcagcaaccactgtagattaattacccagacaccgcgtctacgcaattaataactactctagtgccgatcaaacactaaagcaaccactataaataaataaactatagtgatcaatgatcccgtatgctatttaggaactaaccaagaaataattctcacgagataaatctaaattactcaggaagaatattatattgaattcagagtaataaacagaataaaataaatgagagaagattatcgacaactccagaattcttccgacttcttctactctactctcttcctattctagtatgcaatatagtacaatagagcctcttataattcagctcaagcttggaagtgtgtgtcgaagtgagtaaagtgaagtctttatatagaggtaggtatgacggttagcgaaggggaaatgtccgaactgccccgcaaccgccatcaaggagtgatctcgaatgtccatgccaaaacctgagatcaacggtgatcaccagggttctgccgaacttgggccatgccccccaggcctggcctttggcccatgtcctcccctgatcctcctctatccattcctcggtattttgggctgattctctggtattttgatgaagttcacaacccatccttgtgttgatacaagattctcctcactttagtctagatttcctcccaacttcggggtttatcacctgcatacaaatatacaccaacacttgtggaatatgtgagattaagcacctatcactatgttggatgttttattatctggacttttatgcagatgttggcggtatagaatcaaaatttaacagccgccaacaaaaccccccacacttagttctttgctcatccctgagtaaaggttagtgtagaatgaatttcttcaagatatgaatcaggcatataaaatcatttacaaccatacatgtacctgtgaactttatcaatggctatcttaccatcttgagcaattgataaatggaacgatctcgattcgattccctcttgcttctgtgccagactcatgggatttttatgaattttcgcaaactagctcttttcctcgtattgactttctctcttatctctcaaggatgtatattttctttttggatcctcaccaaggcaaaatgtaccagaatttatccctattctaaggctgatatgtggagctcggtagggacaaattgtgacatacctgcatcatatatattacaaagccaaaaatacggactcaagaagatcatcagtcatactcctagatcaagggtatttatttgtggtagaaaatggaaaagtacatttttttgtggaatggtggaataaagaaatgattctcccttttttcctatactttctcctcctttttgttttcttggcatgaatatggaaggggcatggctatatttcttttcatcatgctcaatgttttgagagcacgctttatttcctctcttttttttttcttttccatagccacgcctttccctccttttctcattttctttttgccaagacccccccttttttttctaggagaagaaagcataatctaatgtaggagtttatttgaatggaatttttgtggaaagccaacttccagtgtagaagcttagcttaattatgtatgtggaaacggaagtggaaatgaccccttgattatgagagtatgtaagatatctagcacgagtcacacaaatttgacaaagctcaatataatgtcaagcagtcatacagataataaggtttatcaaagatatatttgcatatgtccttggtaggtataaaatgaagtcaattggaggaacgagctttttaaaacaattttatttttgaaaacagattcccaagagtcataacaaaagttgcaaaaattcctttcaactttaatcatctcacataaagcaattacttagatgtataagggttcctaaacatggatggttgttcacaagcacaagttcagctgagaataatgaatatacaagaccaaccatatgaagattttcattagttggaaattttatttttttaattatgcttgaaccaattgttttctgaattttcagctctagtactataccatggtggagatatatagataaaagacgtgctcacctacttacctgtaaaaattgagagggattggggccagttttggttcggccgaaccactctggtgcccattccctctgcaattttctgcagagttgtggtggttcggccgaaccactctggtgcccattccctttgcaattttctgcagagttcaatgtcttccaggtgttcagagattcagcaattttcagagtatgcgcacgtcagaagctgggatatcttccccacacttattcaaaacctgaactttattaaatatgaaacaaaaaccaaacttggcatgcattggggttaacaccaatgagccacattatttatagcaagtgcttacatgattggaaaaataaaaaccaagcacctactactactttattcgtgggggagggtacatctaattagcataatacttattctccttccccatctctatgaatgcacgcttgattttagcgcacaaaccacgactaagggtatcaaaattatttctaagttcagcgagttctacccctagctccgcgttgcgatccctaagctctatgttctccttgcggagtttctttacttgcgcggcgagcttatagaccgagggctcctgtgattttacttcatcttcttggaattagccgtccgcccttataattggagggggcgtcaaatgacgcttcaccttcataggtggagggctacgggattccgctgccccctccttctccgatgtcgtcaaaggccggagcaaacccttgccatacccaccgccgggagttaacactccttgaatgcgaaaccgatcctccttcggagtggatggagtagcggtggtgtagtgtacttgtggagcacctcatctcctgcttttgtgaacatggtgcccacatatcgctcggcgggaggcggagcggccttctcatcatcttggaaaaggcgtcacgcctttaaaagaccgagctcgcccgttgtcgtccgtcacacaggcgaatcccctcggattttggtcttcgtaacatggtgaggggagagggatcgcactgccgaacggagccaatgggggttcggccgaacccctggttctgccgaaccagggagctcgccaacgggctccagattcgcaggggagcccggcactgtcgcaaggggctgcgcccacagtgcattcaccctttccatggtgtagtgttccaccgggatcaattgattcgccggtgtcggctctccgtcaaggttgtatgtggagttggaggaagagccgatgaatgggatcaaagatttgccagctattggtgaattggaggtgatggagcaagggaattaagataagatggagaggaagcttgcaaaagtgggggagaaaaggaagaatatgtattctggaatgatacgactgatctaccttcgaatgcgcatcacaacggattaaagacgagagggggagactgaagttcaaaatcgaggctgattgggcgccgccctggttcggctgaaccctagtggttccggttggccaccaattcttttcctagtgtttacacggattttggctcgtgtcctaaatataatttgttaaattataaactgatgtattatctcaaatatagtgcgtacaaaatatatataataagaattttatcgagagacagatggtgaagtaatttaattaaatagcggccacgaaataaatggccatgaaataaaatgtaattcacttatattggacaaaaataatttttggcttaaaataggaatgcatatgcgcgttccacatatgtagcgtgaacaaatattttccatgcgcttttcgtcggaccggcgaacgctaatacttagctttctcgttgtatccgcatacgaaatttggcctgaaacatatggccattaagtgggattttctcactgacccgaaatagtcacgccccgaatattttcagaaaaggcatgcccaccatataaaatagcatacaaaaattaaaatgtaagccaaaatagatgtttatctggctagtgaaaaatcgtgccccaaatagtcgcgacttaaaataaaaatgcatgccacgtgcacgccgctataatggcgtggatatatatacacgc

SEQ ID NO: 81847 - DNA, 600 bp, Oryza sativa
caattaaagaattttttattatttgtgagtaccctatagttcaacaaatccttttacttactcatcattcatcatatcacatatccaatggtctaaaatcattcaatccaacgcctcagattaccccacctttcccctcctctccttcccgcacctgaaatggtgaaatcacgccgcattcaccgacctgtgtctcgctcttccctcctctttctcccgcatctgccacgcatttcctactcgcgctctctcgccccctcaccgtcgtgcactcgtgcgccggatttttcacagaatcgacgcgctcctcctccgcagtccgcaccaccatcgtgccgcgcgcctctccctaccgcgaaaaaacgccgcgccagcgcccaccatcgtcactggccgcccatcgctctccaccgcgcccttattgcgcctgacgcgaaggaggagcccgaggaggaagaagaagaacaaggaggctgacgccgatgcctgcaggcaaagaagatgaccgagaccttcttgtatgagggaacaccgaagaagtcgttcacgcgcgggcgaccgggggcgaaccctaggccccgggccgcggcacccacccct

SEQ ID NO: 81848 - DNA, 17874 bp, Oryza sativa
aaaagtgtttggtaggtttcgagctccagttctgaaaattaaaaaaaaaaaaaaagaaaaaaactccccaatcgcaactgctggccgtcgccgtccccgtgtgtgggcaggccgcctcttgctgcgcgccgcccgcgccgaaagtccgcccgccggccgagcgccactcgcgctgtccccgatgtcgcccgacgactgccgccgtccgtccgccaaccgcatgccgtccccgatgccgcccgccgtcaacctcgccgccaaccgcgcgccgaccgcgcaccaacccaccgcacgccgcccaccacgtgctgctcgccgtgcgccggccgcggtcgaccccgccgcccgccgtgcgccagccgcggtcgacctcgccgccaaccgcgcgccggccgccgtcgagctcgtcggagtggagagtgagggtgacggcctgatgggagggagagagagggggtgagagatgagttaggggtagttgagtggcaattttgtgtaaatatgtaaaaaatttaaagggtagtgggtcttttggtttggagtggagttgtggagcagcaaaaacccagctccacccccgtagtacaaatttgtggagtagctctgccaactcaactcccaaaaatggaggatctggactgtttggcatagctcctgctccaggtaagttggagttaggagcttgagctgtgccaaacggggcctgagtaaaaccatttgttcaactatagggtagattcatcaactcactcttacacctacattactcattcatcaaatccaacggctcatatatctctaccccaattgaacgatcaagatcagctccgcctctcttccgcatgccgatcgctcgtcacggctccgtttcggcgtctcccctgccaaccccccgcgcacttacgccctcacccctccccaccacatcttcaacccccaactcacgcatcgcccccctcctctctcctggactccccatcgtgcgccgttaggtcgccgtcgccgcatgccgctcctctccccactcacgggaggaactctctccaaaccctaaccctaacctcctctctctccacgaatacgcgctgcacgctgttgcgcgctcccctccccactcgccggttcctccgcgtctcacctgatctccacctcgaaatccgccgccggagcagcgttaggtcgtcgccctcggtggctcatgtcgcactgtcgcccaccttcgcgccgccaccggtctcctccgcacggtttgttttttcttccgttgtccagtttcaatctcttctcccttctagttcattatttttctttggcctgattgattttttttaacaaactggccaatttgattttggctgtgatataccagcaaggtatgtttttgaacatgcacatgatgttttctattgaatgctgcagaaacagtccgccaccctgttcgtcaagcaattttgttatcgatggttggaatgtattacgccaatgtgttagtgccaactaatttttgggtttctgcctgaaatgctaacatactattcgatgcattcatgatagtctggggacaaaaggaaaaaaattatctcgtgctttaggggtcaaaataggacatgtgatatttggttgttcacaaacagctagcccagcattaatccactgatggtctgcttgctgaatttatttctaagtaattagcaatctttatttaagcctgaatgatttgtactaaaaatttccccttgtttttcatggtatcacaatagattggaacaggataatcttctgctcaagaaaacaccaatgttggagatgatcacaattgtcctccactgctcttgatcattcaagcaggcatgtactttcttttgcagatgggtacacattattgtgttatgcatttagctaattgattaaaatatcctgtgattttacaggcatgttcttttgaattaccctgtctttcctgtaattaatttatgcagtatgctaactgattagcacgatctcatgaatactacaattgcaggcacatatacatacatatacaaaaagatatgccatggtgtggatggaaatcgtggaggaattctgcatctgcactctattgacagagttctacttatataaacattgcaagggatgcatctttcggtaattcaccattgataggcattgtactaaactactaatactataatctgcaggtaatatatatccatctattttttcccttcaaatctactagacttcaacatacaattttctcaaccccagatatgtgggtatatgcagctgatttgcaatcaccaaccccagatattttaacccttatagcttaactttgaagtccatatgttaggcgcagagtggtaaagtggtttatgtctattttgatcgagcagtttggcgagcggagacgtggaattatacaatggtagttcaggagaattaacataggcataggtactattttttactgatagatgtattttgaaatcttcatggattatggagcggaacagctaaactttgctctgctgtaacttagacccaattgtgcagtgttcatggtatgtccgacgttgcttactttgatatgcttatgctcttagtggaatcactaataaacatcgccggatatgtgtccttttagatatgcttgtgtgtttgcttcctggagatttggttgggttggaacaaaatgttatttatttgctttagaatgcagtgccctatgtattacgaaattatacttcctttaattgagtctaatggcttagaatccctataatattgtttaattgtgtggagaacatgaccaaaaatatataaaatggacatataatatactgctgcttccctgtatttcttgggagattctttttcaagatcatcactgatcagatgctacgagtctaggaatctttaaagtttgattttctttttggcatgtatggatgtatattttggtttaatcttgccataatttatttatttattactactaggtcaggagataaaattctccttcaaagctcattatacaatacaatgttacaataaggataacataaccttatccaaacttgtgattagtcaatgcttaattaattacatcattttgagtcatcgtgggtgaaacatggtacatttgtgttaaacatattattgatagcacttccctttgatgcacatgtaggcagctcttaccctgaattcatataattggattagctgaactcagtgcctccaatgatgattgaataggaagggaactaactagggtagtattgttttgtgcttgagatcctggttgcggaactgagatgtactattgacttgagtcatatttagttttttgctatataatgttgatttttttactcatttttgcagaacgaaggatggcgcttgaccgtggatgaggagcggatgtcctgctcaatgagaactactgtggatgcagtttttctttcagttttggtgacttcagtgctgctattttatgagattttccattgtttgtgatcagtaagcaagcatgtactaatcagttggtggcactgagcatggctctttctttttagatcagactagcaaaactgcccgtgtgctgcaacgggtgaaaaattccaatgacaatatatgtttttcataaataaccatgtgaataataatgtttgtgttgattgttgtagctaagacatatcataaggaaaaatagaacatcttccattctttgcccaaaagaattggattattcatgtgacagcatacatataggccatgtttagattccaacttttttttttaaacttccaacttttccgtcacatcgaacttttctacacacacaagtttccaacttttccgtcacatcattctaatttcaaccaaacttccaattttatcggtggatctaaacacagccataatctaaaatactctttcaatcctattcttgcaataaaaaatatgattaatcaaaatcctacactgccttgcatggtaaagtctaaaaaaaatagagccaccgtgcactcttctctaaatatcaatttaaaacatattttccttttaatattatttccatataatatgttataaagaatagtagctatagtagtatgataatttataggagaatagatgagaaaacaaaagccgtgaaggagatggaaaaaatcgatggatcctatcagacataaacgtccatcaatttgatcttgtgctcataaaaaaaaggcccaaacaagacttgtcttagttccagatgttagaacattcaaccaacgctttgaaaaaaccaaaccgacatggtagattatggacgatacaaatgtcacgaatctttttcatggaatcagatgtattttttctaaattcggacttttttttgcattgcacagtgccgaaccagtttttttcttttaataaacagtggtgtttttctcgcgttgagtcacatggttttttcaaagctgttcttttataaatagtgatgtttttcacgcgtaatcatacggatttctcacgaaaaggtggttttttcctcgcattgagtcggatggttttattatcttttttataaaggtgttttactcatttttataagggcttttttttctcgcgcggtttatataaacttcgacatctttaggtggattttaatatatgataatttgaatgaataaaaaaagtaattcgaaaggagaaaattgaattcgcttttacatttccaaatctactttgacggtttttatggaatcaggcattttttttaacgttgcacaggaactttttttttccattaacctttttttggaggaccggcttatacatactatttttaagaatctaatagaaatatttttttcctttttttaggaagatggaaacccttttttcacacttttttttaatcggacagaaaaaattcgcgcttgcttttttttggcacggacgccgggatattttttttaatcggacggaaatatttttgagggcagctagcccacgggatactttggaaaagtgaagtcacgggacaatttttacgtatgatcaattagcgtacaacatgttatacctaaggtactaggtatcacaagtatcaggtaccaggtgtcgaaggtatcaggtaccaggtatcacatgtaccaagtgccaggtatcacaggtaccaggtgccaggtatcaggtatcacgtgtcacaggtattaggtaccagatgtcacaggtatcaggtaccaggtatcacatgtaccaagtgccagatatcacaggtaccaggtgccaggtattaggtatcatgtgtcacaggtatcaggtaccaggtatcacagatatcaggtagcagctgtcacaggtaccaggtaccatgcaactggtaccatactggtatcagcatagcggcggaaaagcgaacaccagtcaaaaagagaaaaaaaataaaatctatgttacataatatcattgtgtcaattaatttacacgacatactaaatctcaatgtgtctcactcaagaaaagaaacaaagcaagaaaaggagaaaacgaaaaattaaaaatgaccgtggtatatagaagatgtaagtcaagcctacagaggtgcatgcccaaattgattcacatggcctaagtgcccaaccaatatacctagagttcttgtgctgcaggaagaacacatacaagtggatgtgttgtggagtatagacctgccacgtagtaggaaattgtgtcacatgcgtgtacaattattttgatggaaataacgtagaccttttaaggcatcccgttcccgttatctagattttctgatattttttcacactcttttcgcctttttttagcccttgttttttgggtacagaaatctttctttcctttttaatggaaaatggaaatcctttcttgcatttcctctttcaatcggacagaaaaagtttttcgcactttttttttggcgcacatatgacggaaatttctctaattttttaagtagtataatagatagataatagatagatatagatatagataaggatagagatttttttaataggacagaaaaaaattcgcgcttgctttttttttggcacggacgacaggatattttttttaatcggacggaaatattttttcacacttttttcaccctttttttagcccttgttttttccgtacagaaatatttctttatttttttaacggaaaacggaaatccttttttgcacttcctttttcaatcggacagaaaaagtttttcacacttttttcggcgcacggacgacggaaatttctctaattttttaagtagtacagatatggtgtttcctgcatgatccttagctgccaatcccctgttgcggtggctatagatcactgcaacgatcccatttcccaccttcaacagcgacgccgatctagagctccgtcaaccctggccggtcatttccagttatgaactttctcatgccatggctaatcatcaacctatcattgtttgcaatttgctggttgtaaagagatggaagatcatttgtgctggaatatcattttttggctatgaagattcatcatacaccatcaggtgctatgctgactactatttgtgatagaagaagacattgatgtggggggaaacagagaagtcctgaatcaaggaggtaggaggtggagcaaatctattttggagctaggcatgtcttttttttttaatcagatggccaagtcacctaggatgagaggagctcatactatgcgagtttaatgttgactgctcaaatttatctattaccacttttaggattaaaacattagtattgtgaaggaaaacaagaaatgatatttatttcatgccattcttttatatccgtttacaaccttacatgaagctaaaaaaaaacatggtttatattatcaattacactatagcgtttagcacggtgaattgtttggtttgtattatcaattacaccgtagcgtttagcacgggtatattactagttcctgctaaaatgcctctgcacactactacataacgcatcttgtcatgccttattaatccttaactaacatgctatcagtagctttgaatttgctattgtgctattctattttttttcttttttaaaacaatcctgaaacattggttttcacctctgagaaagtccctttcggaagtatataatatttgcttatgttgtcttttatgtaagatgatggctctcctagttgatttgtattagcctgaatatgagtaggctaataattagctatagatattattattttaatatatagttccaacggtatggctttgtgaattcctgcctatgtagctactgtccaggtctcggcggaacccagagcctagtcggtttgtgttggcaacgggtaatactgcccgtgtgcacatatcttaactaattaaaagattggtatttttccaatcgtcacctcaattttcgttcatcccttcgtccgcaagatgcgatagccacgactccgcttcttccgtttattatccgattgtatttaggtagggcaatcggagtgggaaatccgccgcacggccttgcggggaagaagaaaggaattggggaagagggaataaatcagattgaaatttcccccaaaatttccaaaattagtaaccctaattcgattgtatgaccgaatgcatgaaaacccaaatcaaattcaaatcttatcttatcttaatctaatttttcgtccgtcccccagaaaagatcacagttgaaatttcatcacacaaatagacggagaaaggaaaaactgaagcatatatacacaaatatatcccaaaattgccatgcaactagatcgaaggagaaggtgccacagaaccgcagccggctcccttcccgttggatccggcggaggggagggtgccgccgccgctgggacgccggtgggccgccgtcggctcccctccctcctcccgctggatccggcggagggaagggcaccgcccctgtccgccgcctcccctcccgccggaagggagggcgctgccgcccgctacggtcgagccctcccacggccccatggcgagggagagaaggcgagaggcggagagacgccgccgcccgtcgccgctcgcagaaggagcgccgccgacgccgaggagtagcttgccggccgctgctccctagcccgtcgtagaccgctgctcgccaggcagccttggcatggcgtcgcatgtagagggagagggagagaggaggcgccatggtggggtcgtaggtagagggagagcatggctgagccgctggctcggaggaagggcaccgccggctctagggagcggggcatttaactatttgccacttttagatgtggcaattaactatttgctacacctatctcaatgacatgtgggtccacatgtgtctatgatatatgggtccaatggcaaatagttaattgacacatctaaaagtggtatatagttcaatatctcctagggagcggcgcctccgtggggagagaaagggacggagacggagggctgaggagagaagaagaaaaagagaagataagagaaaaggatgagcggtggaggagagaaaaatgaggagattagaatgggtggaagaatcaaggcgcaccgtgcacgacgctctctctcggtctctcctctctctctccccgagcggttattgctaactaagctgtcaacagattttagtggcctgcatcatgcgatttttttggtcgtcacatattctttgagatgtgtgcttggatcggcccaagtgtggcaaggtgacgtgggctctgtaggggcagagtcaattgggctccgcaagactgttcaattttgatttttgtgcgtcccttataaatttaccatttttaaacgttattaaaaaatggcactaaaaaatataaaaataccactagaattatcattcgagtgacatccttgtaaaaattaaaaaaccgatagcaaatttacaaatgcctcttaagaaaaccatttataacttagtactttatttataaaagcggtatatcttatcttaactacttaaaaaaataataatttttcgttcgccacctaattttttcgttcgtaaatccatttttcgaccgtacgcacatttgtgttagcgttcgtccttcgttcctttctcgcaatccgatttgagcgatgcaaccagccaaggtgctactaaaacgaagggaaaaacaaggatggattcgatctggacccagaatcggaccagtaaccacaataaaatcagcttgaatggaaccatgagattgcaatacaataaaatcgatcaatcacctggtactttgcatcggcactgggcactggccacctgctcgtcgccacgccttctccacgatgcctccggcccctatgtcttcgtcgtcgagacgcgccacacacgacatcacgagcagcgtcctcaccatcagagtgcctgcctcagtccccgccgccacgtcgcacgcgtcgtccgctctggggatctggctccagatacccagagcgaaataccccttttacaaaacataattaattattttacctgcactaattaattattttaattagtgtgggttgtcgttgaggcacgccacgcacgacatcacgagcagcacccttgccatcagagcgcctgcctcagtcgccgccgccgccacgtcgcacgtgtcgtccgctctgggtatctggctcccgtctccccgataagctggtctcccacctccttctcttacaccgtggcatcagctaactccgcatggaagctttgccgtcatcactccaccaagtcgccctcacatctctcgcttagaccagtgcaacgtgcaacacgagctagctggcttcgctttggtcgtgggtctccatcgtcgccggggctcactagagacacgaacgacatgagtacgtcgctcatggctgtgttgtgatgtcattgctgttgctccgggtggtcgccatcatggactcatggttcactcacttgaatcagaaaagtaagggctaatgggcctttttttttttgacaacttctttaagggctcatatcatgaaaaactaaaatcctaataacctaatatttttgtatttgttatatttttattttacccgttgcatctatttattaaaatgtttaaataataaaaaaattctcgatcggtcccctcttctctgtttttctctttgttcctgtctgctctttttttttaaaattttttttcccctcactgtctaatcgtctttcattttttttcatgtctactaattaatatttgacttcaaatataatttgtaactcaaaacaatactcactctcacaaaaataaaaagattgatttttacgatttgttaaactccacacattttatttcagataacatacacaggtatattcccatagtttcttgtggtgaaaccagtcaatctggattcaaatctttgatttgacacgtgtgcttgaggcttccgtggtgacttcgtcaatctcaatgctcgtgttgtgagagcgtttatgtgtttcttaaaaaaatatatattctcgaaattcaaagtacatcgagtacaaaaattccactcgtattttatcagacttacctactgtggagattatgggtaccccatacccacacggcatggttatccgactagtaataggggataacatatatgtatggaatatgtaacagatcatgacttgggtattacgttttcttttatattatggagcggcctaaagtcctgatttgataatattgtaaagtagatttaggaagccgataccgtgttggttaaggtttctatcttgtaatcctgccccccaccctatataaggtgggcaggaggccctctagggggcatgagacaacctgatcgtcagatcaatacacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacagttggcgcgccaggtaggggatgcgtcgaattacctgtcgaaaagtgcgatggaatcaacttcagaagaagcccggagatcaatctcatcaatttcgacggctcaaatctttaatcgggtttatcgttccaatctaatttttattagattgatttttaatcgttgtttgatttcctgatattttgatgcatttcatatactcgatgagatcgagacacggccatcatcgtcgcctgctcgggtgcccttgccgtgtccgagtgctcctctcttcctttccttgcagttggacgtgttgctggagtagcacaggccgccaggagcaaattaaacacacgcatctgttgatttattaatcaacacgtatatgcagactggaattaatctactaattgctttctattgcatgtacacatgtgccgttcgattcctgtttccatgtatgacggttgatgtgctccgccggctacctccgataatggcgtcataccgaaagaacatcgagttagcagttagttgccggggcttatacatgttgcatggcgcgtcgccggctatcacccacgatccagcctcactgctcgacttgagtttttcgtttcaatttgttatcaataatcaatatatattagattgatttctaaactcagattaatttcttgctattttttgttgttgttcgcatataattacgcggcactactgaggcgaacgatgttggtcatggactcaaggcatctcagctttccggtcaatcggccgcgagtccactccgccggcttgtcctcgccaccgccattgctgatatcaacaacgacttcaccgccggcttgcctccatcgccgccgactggtgtctccgcctacacggctggcctattatgccgccgttgttgggcgtctacgacttcaccgccggcccgcctccgtcgccgccgagtggtgcctccgcctacacggctggcctattatgccgccgctgttgggcgtctacgacttcaccgccggcttgccaccgtcacggccgactggtgtctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgagccgattcctagcacccgggggctcgttggatggaccgagtaacgcaaggtgctaagtattattcggaataaatcaaaagcatagagataagataaatttattttctgctcttaataattgcaaaagtacctgagtagtaaattctaatccgtgaaactttgttccattaatgacgaactcatgtcactcatatgcatgtttgggaagtgcctaggccgactcccgatgcttggggactatgactagtcgggcagagtgtttaaacgtaaggagtcatctgctcgaggaaatcacaattgacaagagaagaaatacatatttataaacattttaaaatgcttgattttttctcgagtattatatttatatcagatactactcatcctatatgtttgttctgcaggatccagatccagatatgcataaaagagattcatggctttaagcttatctcttacgctccaggaatggatcagtcagaacatcatcaccggctcgcctcgaccgcggcttgccttcgccgctgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgtcgccgccgactggtgtttccgcctgcacggctggcctattatgccgccgttgttgggcgtctacgtcttcaccgaccggcttgccttcgccgccgccgactggtgtttccgcctgcacggctggcctattatgccgccgttgttgggcgtctacatcttcactgaccggcttgccttcgccgccgccgactggtgtttccgcctgcacggctggcctttatgccgccgttgttgggcgtctacgtcttcaccgaccggtttgccttcgccgctgccgactggtgtttccgcctgcacggctggcctttatgccgccgttgttgggcgtctacgtcttcaccgaccggccgcctcgtccgccgccgactggtacttccgcctgcacggctgacttattatgccaccgttgttgggcgtctacgtcttcaccgaccggccgcctcgaccgccgccgactggtgtcaccgcctgcacggctggcctgttataacgccagctgatgctatcttcttcacggctggctacatcgctgtcactactaataggcatcagtatcttcaacacaagctgtctacgtctgctgctgactagtgccctcacctctacgtctggtttagacagctaccactactgatgaacatcatcgtcttccgtcgccgactggttatgctgccgccgactagtgcttttatcttcacaactgcgcgtcttcactaccagtttgcttctgtcacttcatcacggcaacacaactttgtcatcatggtggagcgacttcatctttattatcttcggtaccagcaaactctattgctgctacttcgcaagttttgctacttcaccaaccacgacgtctttgtgagcttcgacatctcggcatgcgatgccatgttattttactacaacaagaggctctccaacattcatgatttctacttggacatcttcaacacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttggacgagttggacaacaacatcaactctcctccaagtgaagcatctacaacagctataacattaatttgctggattattgtcactgacatcatcaccagcacctctgcttcatcgaccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtagtcgtcaactacacaactttatcgctgagcgccttcatattcattgctggctgacttgactgccgccgactggtttcttcgcctccgtggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatctttaatttggatttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcgggagcatgttatatgcgtcatcctttaaagggtgtcgaaggcatatgttttggcctaggcctaatatgtctgcagcccatactttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagatcatggcaaagatgattgaagcactcggctttggaataatctagttcgggagaagattatctttttgactgtgaaggtctcaggggctactgtggagattatgggtaccccatacccacacggcatggttatccgactagtaataggggataacatatatgtatggaatatgtaacagatcatgacttgggtattacgttttcttttatattatggagcggcctaaagtcctgatttgataatattgtaaagtagatttaggaagccgataccgtgttggttaaggtttctatcttgtaatcctgccccccaccctatataaggtgggcaggaggccctctagggggcatgagacaacctgatcgtcagatcaatacacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacacctacctaaaaaataaatatttccgttcgtcatacaaattttcatccgttgccaattgggcaaagacaatcgcattgttcatccatccattttctcccaagctacaaattatccaaactaaacaccatatatattccgcaaatatagagcagattatttatctaaaaacaaataattttttagcagattagttatctaaaccaaacaacactttttgggtcactgtacacatcccgcaatcacccggtgcaacgcacggacacttttgctagtctaacctaacataacctacttacaaaatcttaatcttaactgtaattttctgctcgtcacttgtccatttcgtccgtgtgtaatttcgttcgtctgtccgcgagatcgagagaccacgcgtcgctcccgtcccgcacgcacgtacagaagaacaaatccaatccatatgagccaagaaatatgaacggaaatagagaaactgaatcacaaaatcacaaatacaacaacaatgaatcaaatatccaaaaaactaaatccgaagaactaaatcaccggtgtcactgctcatcggaggccaagcacgcccatgccctgaggctgtggcggcttggcaggcgcaccgccacgtgccgcgaggagggtgctgccacagagccacttctagagaagaggatgatgccaccgagaatagggcgtcgcccgccagggaaggagctccgctagggaaggcgccgtgcgagggcgccatgagtcgtggcagcgggggagggggagcaggagcagtggcgctgccggcaggggtgggacagtgtgaccggaaaagttgccggtgggaaggagctccgctggccgtggggagggcgccgcggctgaagtgcccgctgcaaaggttagtgcgccgctcgccggggaaggcgtcatgcgagggcaccgtgggcccttgcgaaaggggagagggagtgggagcggcggcgcttctagtgtgggtgga

SEQ ID NO: 81849 - DNA, 13983 bp, Oryza sativa
tatttgtgatttttaattttttttaccatggactgctcatttgttgctctatgcaatgaactggacacagagttgctgttgcattttttttttggaacaattcacaaccctgttgtattatccatgtacaactaaatgtggtgttgacctgtagtttaggggttcagagtgaatgcacgtgcttaggccgttcaaagcctcacattataacactcacacaagctgaaaaaaatgggaggcaaaatcacacaaagctgaacaaaatgggggcaaaattacaataaccaccaagggtatatatgtccttttctctacaactaacaccgttagttgtggctgttaggaatgggggtacatggctgcttcagattcaaaaggtgggggtaaaagtgcaaaccctaaaaagtggaggtaaaacagcaattggcttcgaaagtgagggcacggatgcaattgccccaatatatatacctaaagcaatttgatgagtcttaattataaatgtaaatgggaatcaaatctcgggattatttttgataaattatttgaggcttactcagttttgaaggaattttaacgcataggaataggaaaaatgaagaaatagaaatacatgcacactttaactcataggaatttttcaagaagtttgaggggatgaaaaatttcctacgtttacaacttgtagaaaagaaatttttttcctttggttttcctatacttacattcctacaaacagaataatacttataggaatcaattaatccttcagaatccaaatccgcttctcccgttctctgcgactccacctcccgattacctacctcgcatgacagctgtgcgatgcgatcgatcagagaggatcgtagcagccgtgccctcccgggcagctgtccgttcgctcattttctgcaatggaccaatggcgcatccggcaaacacgactctcccctccctgtgcgtgtatgggagcgcagcagcggcggcacgcgggtgcgtcggccggtagggatgcaagtgggtagtcctgctacccgcttgctagttcatttcccacatggtagtacaaaatttagaaaaaaaaagaattagaagtgagataagtgggctaaaataacccgcttgcatccctatcggccggccaacagcgcatcacgcggggctacggcctgttggcaagttacacataagtattagcagggtatttaggtatgttttcaattttctattttaacagtaaattgctgtatcagattgtactgttgtattgtagtgagtgaaaagcattgatgttggtttgatcaatgagttaattcccaacagtaggagatctgacagctagtaaagaaatttgtttgtttccaacaaacaaggaagtatagtgagtggaccatttcagagtgtggagtgagaaaaggagtagttcaatgagttcgttgacaagagtaggagagtgagttgataggtatacaaactcaatactagcaacttgtgtcgtatcgtttgttaccaaagagagatttatgttgtgcagttgactcgagccaatacatacctagcaataagaaagtcaatataccatacctagcaataagaaagtcaatggcggccgtattctgaaatcgttggataagttattgggcttcctcttttgtacatggcgaagcggccgtctaatcgaatttactaggagacttgtatctcatgctaattattcactctttcaatgttgtctttaagacattgagctttcctatgtctgagaagagatgccatactaataggctggccaagcaaagcctaggttaatttaggtgaaataatttttactttgtcactattattttaggagatatgaattttaaaatttatattctagaaagtaccatttattccttaggtagtcgtttgcaatacttttaagagatagttttgtcaaattttactctatagcactaaagagcatagttttctaagatcaacccaactggtctcataatcttttaggcttatacgaatttcttatgcattgtacaaatcgtagtgtacatcaagtgaatggtatgcaatacagaatttcaaatgtgttttctgcacataaggtgccaaattttagtttctagtaatgaagggggtaattttctttgtccattaaaactgcgttcatagtttttggtacttatgtgaatttcctacatatattacaagttatgatccatattacgttgctacataaaattttgaaatgatttatcgtacttcatgtttggctcacccatttcaagacaggattgaaattctatgaattttacagcttatgcagttcattatggtaatatcttaatactaaaaaaaatagtaccattttctgtgcagaaagttgcatgtaaatctactgaaatatggcacacgttagatggatttaatatgaattttctggagggaactacaaatcgggtgcccaattcccttaaaaaaaatatcgggcggtcaaatgtttccgttaactatcgagcgaaacattaagttatataatgtgaaacaaaaaaaatccaattgaaacatttgaaaaaatttgtggaacacagtgaaaacacatgttgaaaaatactgttatcacatatgaaacaatgagttttaacactttgaaacaaatgtatttctttcatgggattatagtcatgcgatatatttttaattacaatagatacgacggtgtgattggatcgtagatcagataatagtttagaagagaagattgctatatgctaattgcatgtatgaatggagtagagaaagcaaatagttttagttcgttagttttatgaaacacattgaaaacacatgctaaaacatatcactatagcttatgaaataatgagttttaacggtttggaacaaatgtttcttttcatcagaacataaccatttgttatcttgttataaaaatttaattataatgaacataatcgtataatcggattgtaatgggattagtttaagagaaaatatattttaaagattgtaaatggaatgaataaagcaagacgatagcttattgttaggttggagctagcggccgataaaattttctccgtcggtctactgatccatagctttctcctattttccgcatatttttgaagtttattctcttttcagttgaacaaataatggtttaacaattttcctcgaattttccagattttaaatctgcggcaacatgtcttcttgcatctaggcccctgggtttccaaagaatagatcccacggtccccacatgtgttaagcaaagttcttgcatgattggccttgagtaaggcctgaaatgggacttgagtgcttacgattgggcttgctttcactcccacttgtacattactagatgtgattaagttaagcttgagtttggtcatgccaagtaattctaaatctcgatgttctctatagaattgccattaatagtaacttttatttagctctagtcattttcgtttttctcctggtcaacaagatttttgatcttaacaaataaaaattgataagattttggtcttgacagagtggcaccacaaaaggagtcctcgcatacgtaatcttacaaaaatgaatgaatccaagatttattacttctcttcagaacattcatcaccggtctgaaaatgtgttaggaactgatgaacatgcatgactaaggtctgcaattatcttttttttttagagaacacaaaccaaaactatctcgacaatagctgtcagactcattctcaaacattcagagttcaggtagactaaacttgtaggctgatttaacaggaaagtctttttcttctcgaggggatgtcccatatgcatttcatcttttttatttttaaaaaatattaatatataatatattactccataaacatataatttcaaattcaatcactacaagttgctttaaaaaataagactgaacatacacgtaccagttatagtttaattcgtctttttacaacttgtagaggttgaaattaatgttacaagtttgtgaagtgatatatttttctatcttactatttttctaaaaaaatcatatgttatttgaatgatatacaagaaatgaggggacattctcttgaggagaaaagtcatctctgcctgaatactgcacctcttgatgtagaggctaaaataatctctattattgaaaaaaagtagactgaaattattttccagaattttccaacatcacattgatcttatttgtagtcttaagaaagaacataatctgcagagtacataaatgcacatggagtctatgcagtggaccttgactggcatggagagtctttaggaaaatgccagaccacttgagtgactcactgcagcaatacacaggcagttatttcctcacctgaaagtaagcatgttgccaatgccactatcctcgagatcacattcaagcctaaccactccgctagaaagacaacctaaaagcaagctaggtaactactactgtctgcacaaatgagaaagatagctgaaccatcaggacagaacacacacacacagagacatacatgtggtgtttggatcagggactaaattttagtccctattacatcggatgtttggacactaattagaagtattaaacgtagactaataataaaactaattgcataaatgagagataattcacgaaacaaatttttaagtctaattaatccataattagtacatgtttactgtagcatcacataggctaatcatggattgattaggctcaatagatccatctcgcaaattagtccagagttatgaatgggttttatcattagtctacgtttaatacttctaattagtgttcaaacattcgatgtgagagggtcatatctacactacaacttattccattcttcaattttgtattttctcggctgtgtttcagaatattctccagtcaccatcttgtatacatgaggccggggactctgttccaatatagtttttttttgtcaattccgaaccttatttcttagcatacatgtagtggtcaccgagtgagatggatggataccagaaccgacatgcatcactatactactcaagtatgtaacttaccatgttttatctctcatgatacataactgggtaaaacacaacgtatgctacactagacctataagatgaatcaggagggaacattgttcatttgtgttggcgtctttttcagccaacaaaaagtcacctaaagatttaaggtgatctagatgatagggaatcaccaaaactggctagcggagccgatttattgattaaaaccggactctaagttgatttagatcgatttgagggtatacacctacaaaatgaacgaattacacccgcaaaatgaacgaattaaaaagtttacgagataaacatataaaggatgtcacactctcgtaaaaaagatgaacgatctaggcgcaaattaacaaagataaactaggattaaaaaactaggtaaaaggtaaagaaagaacggaattggtgttcaccttttaccaaataatttttaatattacagagtcatcttgtttcagccagcaacataagctgcagaggagcaggtggggcatgtgcagtgtgctgcctaattaaaatcacatcttaaagcattgtactaccaagtgtcaaacacaaacatgccgtttatcctaagcgaagcactactgttcactttcaggcctcataactgtgccagtgacgacaacagatgaatttgagcagtgctggttgcaccagatctgaccaccagcgccatttgagccatggaaacaacctcattcctttcaatttggtacacacacgcatacgcgttcagcgttaggggcataagcgtaataagccgatgcgcgtcatcgggccgagcctgacgcctctgggaagataactattgtcagtgacagctggatcattgctcactacacaaagctagcccagatgaaagcagcagcagcagcagcagcagcaggtagcatatctgcagtgtaaagggggagacttgacctgagatcagatgagatgagatgagatgatcttttctctgtgcttaatttatccccccctttggtttgctcttctgtccttccctctcaaagtaagcagcatcagatgcaaggggtgacaccaaaggctggcacacattctcttctctcccctttttttttcctctctgctttctttcttctagcttccttctccaacattccaaatggtgatgctctgatgacctcctggctagcttctacacacactccaagaatcctctccagtgatgtagtatataaacctcatgaggggctaatcccttgtttgcatcaggggatccatctgaataattgatactggctattaagtcagtgattatttctgtactgtgctattactgatcgatgcaaatgcccttctgcccgaagctctggagctcggcggcgccggcgccggtgcagccggggagcgtggtcatcaatggcacggtggtcgtcgccaaccacttcggcctctcggctcccggcaagtccaccaccctccgcctcttcagcggcacggaggtcgatcacggtgagtaagtggcgtatgcaactaatgtctgaaactctgaatccgatcagcgctgaaagtctgaaaagaattgcagagacgaggaaggggaggctgagcgcggaggcggcgttgaggggagggaagaagacgaggcatgggaaggcgagcacgacgatgtaccaggtgacgttcttcgtcgacggcgagttcgggacgccgggcgccgtggccgtcaagaacgggaaccggaacgaccagttcttcctccggcacgtccggctggacctcgccgaggaccggagcatccacttcgactgcaactcctgggtctacccctataagaagaccacctccgaccgcgtcttcttcatcaacacggtaaacacaactaattccctgcaaaccgtaatactccatccgttttatattataatttattttgattttttctataatcaaacttatttaaatttgattaagtttatagaaaaatataatagtaatttcaacataacaaatatattgtcaaaatatttcaatgctaaatttaataaattaatttggtgttttagatgctactaagttttctataagttttgtcaaacttaaaaagtttaattaggaaaaaaaataaaataacttataatatgaaatggagcaagtatactacgatgacagagtctaagttgtttgaccgattttattccctataagatatacggcaaaactcatgcccttctggtttcaaaaaatacaatgagatgtcgcgtacagctaaattgatttttttttcactgaactgataatgatcgaaatgtttttcttttatgatataacgagtttaagttgaactgacctatcattctgcagagctacctgccagataagacgccagaggcgctgcggctgttacgggaggaggagctcagaagcctgagagggaatgggcgcggggagaggaaggactgggagcgcatctatgacttcgactactataacgacctcggcaaccctgacaacgatgaccatgtccgccccgtcctcggtggcaccaagacccacccctaccctcgccgctgccgcaccggccgccccctcagcaagaccggtacttccacacaaaactcatctccaagtctccaaaatttctttcttagctaataaatagtacccgccgatgataatgttgatgagtagtagaatactatcagtagagagtaccatatcagtagagagtatcataaaaggtagtcaactaattgagcatatgaaaatattttgtggaagacggggtgacggagacgcggaagcacaagctgataaacctggactactacatcccgccggacgagcggttcagcccggggaagctggcggaggtgctggcgatgggggtgcaggcggtgacccacttcgtcatcccggaggcccgctccatcttccacggcgacgtcgtcaacttcaagtccacggagcagctgcgcgccgacctctacggcaagccgccgcagccggcggcggacgccagggtcatggacgagctcaagtcctccgtgccgtcgcacaagacgtacaagcaggtttccaggattgtcaaggacaaccccgccaagttccccacccctcaagtcatccactgtacgtactgcgtctgtgccagtacgccatggcattgcagcttcttgatgatctcgcgcgattgaatttttttttttgggggaattttgcagatgacactgaggcgtggaggagcgacgaggagttcgcgagggagatgctggcagggctcaacccggtggtgatcaagcggctggaggtaagaacagctgaaaatgttttgacatgtttgatgagctatgttgatgtgtgattcgtgctttacaagtggatatatgtttttaatcattttttcatagtattaaatatgggttcgtgtctaactcttcgactttcacaaggtgtttcctccaaacaagagcaagataaccacggacgatatcatgacccagattggaggtctgaccattcaacaggtatgtgcatccacgattctagatgaaccgaagatctaccgttccaaaatcatctatagaccgttctttgtaccttttttaagattacaccgtagacacacgcacacacacgcaatgccacactcacacctccgcaaatgaaagcacacctgcatgtatgtaatattcgtgggcatcaggatttgaaccctggtagagtcatacatccacgagtataccaccacaccactagtatgtacgtaatatttgtgggcatcaggatttgaaccctggtagagtcatacacccacgactctaccaccacaccactaatgctgcccctaaaacttagtatcttaacttcttaagtagtagttatttttattagtgtaaaattatattcctcgagatactttctgtcaagtatgtaccgggataccgccaaatttctcttatattatgttctctaatatgtttggtttcatctattttcatttggcaggcgatggagcagaaacggatgtacatcctggaccaccacgactacctgatgccatacctccggcggataaacacggagggggtgtgcgtgtacgcgtcgcgcacgctgctcttcctcagggacgacggcgccctccggcccgtcgccatcgagctcagcttgcccgacggcggcgtcggcggcagcgagatcagcagggtgttcctcccggcgagccagggcaccgatgcgcacctttggcacctcgccaagactcatgtcgccgtcaacgattctgggtaccatcagctcatcagccactggtgagtagggcacacgcctcgatcaatcagttttcagtactgtcggggtgaaatctttgcaaccttatgtcttaaaatttcagttgcaaatttgctatgttatatagactccctcgactttatacagtttgcagttgtgccactaacacgtgggccccactttacaatgacccacgtgttagtggcaaaactataaattgtacgaaatcaggggatttatttccgtggtttatttggttttaaaccattttatgagtttttgagtgcttctgtccaaacatccccttttgtgatcaagttttgcagtgctcggtccaagatttcggccgagtttacttccaaactttttttttttcaaatttttaactttttcatcatattaaaactttcctacacacacaaacttccaacttttcttgtcacatcattccaatttcaaccaaacttccaattttggcgtgaactaaacacacccttcattgtttctgaaagactgaaactccgaattctcatctcaaattcttgttccgaaacaagaaattgctcatctgcaattctttctgtaacaagacatttctctgaatgctgatatggaattattcttgttctgagacgagtcatttgtctgaattctgacatgaaattcttcttgttctgaagcaaggcatttctctgaattctgatatgaaattcttcttgttctgaaacaagacaattctctgaatgcttgctgacatgaaattcttcttgttctgaaaacaaaatatttgacttgaccataaaaatatgcaccgtcttaatccatgaatggaacaggctgttcacgcacgcgacagtggagccgttcatcatcgcgacgaggaggcagctgagcgcgatgcacccgatccacaagctcctggacccgcacttcaaggacaacatgcagatcaacaccttggccaggagcatactgctcaacgccggtggcctcctggagaagaccatgtacccggggaagtactccatggagatgtcctccgatatctatgcccattggaggttcaccgagcagtccctgcctaatgatctcatcaagaggtacaaaatacaatcaattcatcatcccaattcctacattgccaatgaatagaaccacaaattcttaatttactgcatgtctgaatttttagttacttctcggtgagatcaacggctttcgatccgcctagccacttcaattttacaattgcggcgtacacattaatgtcccgtagcaacacacttggtatcatttggtgcattttatgatagccaaatatttgacaacaagattcaaataaaattttaaaaattccatgaatcaactgtatattaataaaaaatcttacataaattctgggaatgttaaaagttcgaatatattgttgttttaaacgtaaaataattttgactagagagagtagaattgatttgagaatttattgttaactaaaacatttccaaccagggggatggcgtccagggaccccaaggcgcgcggcggcgtgtccctccacatcgaggactacccgtacgccgtcgacggcatcgacgtgtggctcgccatcgagggctgggtgcgcagctactgcgaccacttctaccacgccgacgcggcggtggccggcgacgccgagctgcaggcgtggtgggacgacgtccgccgcgtgggccacggcgaccggcagggcgacgccgcgtgctggctggacctcgacaccgtcgcgggcctcgtcgagacgctgtcgacgctcatctggaccgcgtcggcgctgcacgccgccgtcaacttcggccagtacggctacgccgggtacccgccgaaccggccgacgcggtgccggcggttcgtgccgctcccggggtcgccggagatggcgcagctggaggccgacccgggccggttcttcctggagacggtgcccgaccggttcacggcgacgctggggatcgcgctgatcgaggtgctgtccaaccacacctccgacgaggtgtacctcgggcagcgcgcgacgtcgacgtggacggacgacggcgaggtgctgctgctgctggacaggttccgcgacgagctccggcgggtggagaagagggtggaggagaggaacaaggaccccaggctcgtcaaccggaggggccccgtgagggtgccgtacacgctgctctacccggacgccggcgacgtcgccggcaaggagaaggggatcaccgggagagggatacccaacagcgtctccatctgacacgattcatcatccttcttctcttatacttcatctatccgactcgactcgacgcgtgtggaatgtaaagttctctgcttttctttttctttcttttcgtttgagagttttggtgttggggatgtgaaattgagattgattggttggtttggattggagaattgatgagcaaactgtgatgcagaattcaatacatgtaattattgttctaatccaaaagcccggtaaagaaaacacggtcgatggatataggccgatctctcttcagaactgctcagtaaagattctttccaaagtgcttgcaacacggctgcaaagggtactcccgatgatgatacatttagaccaaacgggtttcctcaaagggagatgcatctatgagaatcttatatatgcgacggaattgattcaagcatgctacagaaggaagtgccaaactattattgtaaagcttgatttcgcgaaggcgtttgattccgtcatttggtcaagccttttcaagattcttgctgtcagatgtttcccagaaaactggattagctggattaaggggttgctttcctcctccaagtctgcagtgcttcttaatggagtccctggaagatggattcgctgcaagaagggccttcgacaaggcgaccccctatctccatatttgtttgtcttagttgctgatgtgctacaaagattgcttgaaagaaatactgaaatcagacatgcaatctaccaagacaggctgtgtaccaccatccagtatgcggatgatacattgattatctgttgtgcggaggaggctgatgttcttgctctaaaggagactctgctgcagttctccaaggcaactggactgcaaatcaattttgctaaaagcactatgattactctaaatgtcgatcaaagcaaggaactagttttgtcggattgctacagtgcaagctggagaaatttccgatgtcttatcttggacttcccttatcaattcacaaactgtccgcagctgacttgtagcctctggttaacaaggttgatggtttcttatctggttggtaagcatctctcctattgcaggcggagcgtcttgttctgataaacgcagtcctgagcagcctaccggtgtatgcaatgtgtgccttcaaacttccaccaaaaattatagaagaaattgatagacgaagaagggcttttctctggacaggggatgatgtctgctcgggagcaaaatgtctggtttcttgggaatcagtttgcaagccaaaagaacatgggggacttggtattaagaacttaaagattcagaacgaggcacttcttctcaaacgactccttgctctttacaacttgaagacctcctggactcgatgggtctgggacgaaatttcagattcctcgttactgtgctcaactcgtctagggcatcactgggcatcctttcaaaagttgttgccagaactgcgatctttgacggaagtcgtggtaggaaatggtgagcgaacctccttttggtacgacaaatggttttcgactgaaagcttttcaagtcagttcagcaatctcttctcccatgtgtgtgacagacaaatctaagtaaaggaagctcttcacataggaatttctgaaaatcttgttccacgtttatctgaaactgcatcggcagagctgtgctgcttacaggaattgctgcagaacttctctccgagcgaggagatggatttccgcctcagtgcaaagctaggaaagttgacaactaagaaattctatgaggcaagattacccccaggcatgccatctccgaactgggatcttatttggaagtgcagagcacctctaaaagttaaactcttcgcatggctactggtccgtaatcgcctgtccacaaaagaaaatttgctgaagaaaaccattgttcaggaggcaatctgtgacatctgcaatcaggaagatgaaacagctaatcatatgtgtttctcatgtccgttcgctcaggctttctggacgcagatcaacgttcgaccgcaagctcaagacgtcacgcagttccatcgttcgggtccaactcgcaagtgccggcgctacactggcaggtcttcttccagctttgcatgtgggctatttggaatcatcgacacgatgttgttttccgggggaaaagcccctcactaagagcctgcctacaacgatgcatcaccgaggcagctctctgggcagagaacttaacggaagatgatcgatttgtaatctctgtttggaaacaaatcttctcctcccccttacaatctatcaatcttttgtaatgaacttcttacttctaattgcaatgacaaattcag

SEQ ID NO: 81850 - DNA, 2204 bp, Oryza sativa
ctacgatctgctggctacctatcgggaagagctattgagatcagtgctaggcaaagtatttgaactggacactaaagagtgcaatggtgatgtctgctttaggaggttctttgttgctcttaaaccctgtatcgatgggttttttggaaggatgtaggccttacattgctatggactccactcacttgactggaaggtccagaggccagttggcttcggctgttgcaattgatggtcataacaggctatttccagtggcatatggggtgattgagacagaatctaaggaaagctggacttggtttgttcagaatgtgaagaaagctattggtactccaaaaggtatgtctattcttaaagttgtttcttgcatcctccatcatttcaattcatatttgactaaccacctactatactcgtactgtaggtttggtcattagtacggatgcagacaaaggaatagaaagtgctgtagatgatgtttatccaggagtggaacatagagaatgtatgaggcacctctggaagaccatggaaaagaagttccatggccctctatttgcccaaaatatgtgggcggctgccaaaagcttcacaaatgagaagttcacataccacataggcaagatagaggagaagtgtcttgaagcactttcttggttggatgacaatcatccatacatttggagtagaagcaagttttctaacgagtgcaaggtagattacatcaataataatctttctgaatgtttcaatagttgggtctcaagaaccaaggatcgacggattgtggacatgtatgatgcaataagatagatgatcataaccaagtttgttgcaagaaacaactttgctggtaagatggagggaagaatcattccagctattacaaagtctttgaatgctcaaagcaagaatatcaaggaccatgaggtattgatatgtggagctgggacagctgaagtaactgtgggcaccattaggcatgccgtacatttggagcaacaaacatgttcttgtagggtttggcaagtgactagaatgcctcgcagtcatgctttagcattcattgcaaagcttagcacggatgtccatatggatgattttgtggatgattgcttctccgttgagaagttcaagaaggcatatgcaaggactttcaatccaatgacatcgaaggatagatgggcacatgttgatctaggctacaaaatcaagaagcctagtgtaggatcgagatgtcgactagagggggggtgaataggaaatttaaaactaaataacacctaatcaaatctaacctaagttgctaggcttggtgagggagaactctaactaagcaactaagttatgttttgcaaacctagggtgatagtggctcaaatatatctctaggaaagtaaatcacgctcttatgtcgatgttttgcaatcctagggtgatatgatctcaagtgtgtctctagaaaagtaaatcgcacaaatgtaaatgcgacaatcaaatgagacaatgagacaagagatttttcaccgaggttcggaaactcgccggtttcctactccccgttgaggcgagcccaactccaccgctcaaccacgaagccaccgcacgcccccttcgtcaaggggtgggcaaggcgggagccggcccacggagaggactacccaagcctcgatcactcggggtagttcttccttcactccgaaggtggtgaactccaaaccactcacaaaccggcgccgggcctcctccacaatcttctcggagaggtcaccgggcaactcctccacaagccgtctaggagacggcaacctccaagagtaacaagcaatgacccggtgtggagatgatcaagtgccacactagctctacaatggaagcaaatgcactagactcttggctaaacaaccctctaacacactagatagatgaacacaaagctcaagtgagtgtgagagaggtgcaaggagtgtatgcaattgaattgggtgccaagagagcccccttgctgctggtgggggagtatttatactcccacccaccaaaactagccgttgggggcgaaattccccaactctgtgctctgccggtctgaccggaggtatgcggccggtcagaccgtgctactctgcaacggctagaaaactagccgttgtagccctgtcagagggccccatcggccaggccggtcagaccgacatggg

SEQ ID NO: 81851 - DNA, 8176 bp, Oryza sativa
tcatggtttaaaccaaaattcgaatcacacattttgtcagaatggacacgtgtcaactatccgaatggttgggtctaggaacctcatctgcgtttgtatgcatgcgcaatgaacctccattagcacacgtctcaaaccatttgaatggtttgggcccaggaacctcatgcgtgtttgtctgcgtgcggatgagatcgggatgaatgcttatgagagaaaaatccaacaacattgagaatctaaatgataaaaaatggaatgaaaaggaaacacatatggatatggacctatgaattgctcacctctccttcatagtttgtgatgtcaagttgcaaaatatgtccatgctccgattcataatttgtacatgattattctatcaacactccacaagacgaaagcctattctgcgtagttcaaccttcttgtttttaagcaatgcatagtcatgctagattgcaagggatatatatgtgaagggtattttggtaatctcttctagtgttgtaatcaagtatgtgccccattgggctaatttcatttgcaacaattcattcatataatgtaattgatttgtaatattggtatatatttcaattgaatttctatgtatccttaaaatgaataatacgatttgtcaaaaaagacatgtgtcgaccatctaaaggatttgggccagggaacctcacatgcgcttgtatgcgtgcgcaaaccacctttgccaacatggtttgttgatgggtcagtagtcaagtatgggctgataacgggccttttggcatgttttgtgtttttacttcttttgggtttggtttgtctctttgtatttcgaattcaacaactttctgtgcacaaaaacccacaaacttctgtctgtttgcttggctctagcccattttgaagagtttaagccctccaaatatgtctaggttgtgtaccaaaacaagtccatggacattgtgacgaggacatcctccactattaactgctagtaaagacgcaacaaagggccaagtggtccagttgtactcgggcggcgaccgtgtgagtctctgaataatcccaccttgcttagcttgggaggagaaagccaccttaaaaggaagagtcacccttcccctattggactagtctttcaggaagagattaggcctttccccgagtgggtgttcaactgttggggttcgggcaaccttaattttattgggcctcggccaaccctacctaggccggagcgatcatttggtatcagacttaaaaggcaaccttaattttattgggcctcggccaaccctacctgggccggagcgatcatttggtatcagacttaaaagggagagccaccctttctctattagactagtctttcagggagattggttctttggtttgtcacagctaatatgttatgctttagcacaataaaaaatcctaaactttatcagaaaggaaaaggagattgggtagatgtgtgatgtgtctaagaagagaggggtagaaagccaacaacaagagcatctaaatggacaagtaaaaaggaggactagaggtggttcaattatcgattacttaaaatatccgtagtggtgatggtgaagctaacatagacacgtgatctattaaccgtggatcaaaaaatcggacgctgcagagcgacgcactcctcctccgcaccaccatcgcgcgactcctccgtacatgaccccacttttccgttcctactgcagctcgtttttcctattttatagtttccaaccgacgtggtttataattttgatcatacaacagtgaaatttggtaagccccgaggaaactgtcggcctaaaataaatatcggcttcagagttttggaattggccgatgggagttctcaagtcgccaggagtcggattcttggaggattcggttaaggaagtctatccagaagagaccgacttcaagaaggatgcggcatggcggtttatgtattaattatgaagagtttgttagtttccttttatctttaggaaagtgtgtttagtgtccaataaggacttcatgttttccttttatctttatgaaagtttttttcttgtccaataagggctagtatctactcatgggtataaatatatacacccggagtaattgtaaatgatctcacagattaatacaactactctcggtgcatcgccatcctctttaccgagattttacttgacgcggggttgcatcggctttcgatcttcggcgaaggggtaagtcctacgttccgccggccttggcaattgtatcggctacattggtgttgttcaaggctgcatcgctttggtctcttggatcgctctggttcggttgatattttggcctacctatttatcatatatcttagttaatctagtttggtagcttgatttacttgtatcggctgagattcactttagggtttatgccggtattggctaaatcgctttgctagattagattagctaaggtatctaccaccctgaaaatcagtcaagggcttgctggcttgattatctagatattgtgtttgttttcatacttagtgttgtatcagtacattcgacctactatgtcgtgtttagaaccataatctctagcctgcttttttattgccaataaggatttcatcggggtttcagctgatgagatatctggacgttgcatcgatttataaggagtacatacaagttggatttagccgatcgcaacaaaggttatactgtttatctaatcttgcggatttaatgacatcggacctccagccgatatatgctttaacctttggatcagtgcttattctatcatattgttagccgattggtttctactagattttattgttgtttcgttacattatcattagttgattgtctttatttacatcaagtgtcagattctacatcaaccatatagccaatagctcaaaactctatcgctatcggctagtatcgacatcgactggaattactctattggcttgtcagccgatcgactcattgatctactatttgcatattttgtgagttgtagaatcaaactaactggcacgcccgcatctcatcaatctttggacctgcactggagctaagcagatctcccaggctgttgtgttcgtcgacttaattcgcgccaacacatacccgacaccatcggccatgcgcagatttttcgtcaacactatgacatcaaatttattcattttccggagattcacataaaaaaataatcaaaggaaaagaaggagcgtgaaacatcctcgcctcctgcctacccaggccacgtgataaggcccatcaagattaggtccaatataagattagccgatcaagaatcactttccatccattgcagaactcgtcgaataccaaggctcataaacaacgccgacgctgacgccaaattcaccgaaaccaatctacgtggccaccaaacgatgtatgcattgccctcaattccgctttcactgtcactgccgcggactccaccgccactgttgccgtcactgactccgccgtccccgccattgccgtcgccgctaccaccgccccaactgtcatcttcggcgcggccgccgccttcatagatagaagcaacactgtcatcacagagatcaatcctttggtaatgaagttaagcacctagctcaatgagtccatgacatctaaggctctatgctatcttgcaatttgtactacttattgcaggcagtacattagctagctaaggttaatgcatggtactgtagattaatggttggtactgtagattaatacatggtattgtagattaaactagctatttgatcaatctttttttcaaagcatgcatgcgatgcaagaggctcttgtgtgtgtctttgtcaactgcttggacttgcaatcttttgctcatgagtgacccaacataagtatctattggtttttgaaaacaaaggtttgccttaaacagaagtagtaacaccgaactgatttacgtgcttcatagttctgaaacaccatagctggattttgcgtaataattctataacagttagcatatttgagacacaatttattgtaataaattcctgaatttccccaaatttaatcactaagtgcattaactatatcttttcagtgttatataatttccctgtacaatatagatccttgcttaattttatgtggtactcaggtcaatcaagacgccattcatgctgatatgattacaacccaaccctcgaagaaagcaaaagattcggaatgtaaggataatgcatctatttttgtctcaatctatttaataatgccaaatacttatatatatatatatatatatatatatatatatatatatatatatatatatatatatatatatatatatattatttgaatcactaacatttttggtgtttgaaatactaatgtgagctaatgtgtaactgattggcaatttaactttgcttaacaaacaaaataacgtgacagaaaaataaaaattacattctttattttctatctctggtatccgtttgtgatcgacaagctaggccatgcgtgtgtgaatgagggtatatgcacatacactatatcgatataataacaagcacagtaagatgctatactgattaatttatgtgtgcatgctcaaagtttgatgtgtatgtgcatggtatttagaaaatataattgggttctgttttgtcaaatgcgcagcaccacttcagacaatgacgcattcgtccacaacgctcgctatgccaagtggtgaacagagtcggagcaactgtcaaccaaactcaggagtggatgcaaacataatattcttatcatccggctcatattgatagtcaaatattaattaattgtctgattatatatgtaggagaaatacaactagataaaccattacatggaagtgcccgtcaaactacgaatgttttgtaagaacttattaactctacttttagacaatattctatttaatattcttttaatataataataacatctagcagctaacaaatatgtaataaggatacaatacacatatatcggatgcattaattagtgcaaaagtgtcagccatacaataatatttacaatattgtcatttccatttatattgttaattacataattgtcttcatttgtttttcttttgatggaattacatttggagagcttggtatgtaagcaatagtcggtgcatcatcatcagatgaaatatcttctgccatgattggtagtccagcctctgagagcatgttttataacataccctccaagttgagatccctcaaattcccatggaatgtcttaatacaattgttcctatgttcttgcatccaatggtgacaaaactattttttgagagaaaacggtaacaacatatggaccctttcccccctcccccaattctcactcaatccctgcattaagaaaaaaaatggtaagaacagtttatacctagactatacaaaataaatgggaagatcttggtactacaatgtgtccgtgctattttactaaactagaaggtaccccgcggcgttgctacggaacattgtagaaaaaaattagaagaatagtttgtattggaagtaaaaggattctaaagtaagacaatatgtgaatattaatttgattgtatgatagggtacacaaaagttttgttagactgaaagggaactggcatatatcaaaattatgattatttgaaagcacctagagtatttagtttggacatagtcttgacaacggaaacaggatagaccatgattacgaaaatagtaaacaacggatgtgattattcggaagcatctgcagtctttaagctgtatattatgtattgacctgcaaatttcgctggacaatgtattagaataaatcataatcggatttgcttgtatgatgaagcaaggcttccaaacatgggtgattattaatgactaatttgatttgaactattagatggatgatggattgatctaaggtgaccaaacatggtctacaatttttgcttttatctcttaaaacatccgttacaacacacgtgcctttatctagttcttgttaatttcaatcgatatgtatttgttttttccatgtaaaatgtagtgaattggtttttttagataaaaaatgagattttgagggagagacgtccatccaaaaaatttttaagaagaaattataagcgtgttggggattgaacacgggacctcgagttgaaaccatacatcccttgccactgcactatcaagtgcatctctagtaaattggttttgagataaaaaaattgtagtataattgtttttttttgttttggaaaccaatatcactactgattcaccccttgaatcggcatatgatactgaccaacattgccagttgaacaacacacaatattaatgcctaatttgatttgagctattagatggatgatggattgatctagggtgaccaaaatcaggaaatgtgtattccacagtcgtgcttcgcttaaaatttaatcagatagtcatgcattgatgacaacgtggaaagctattatgaaagagaatatttaatgctacatggtgggaggcaattgtatagtaatgcaggattacaatacaaggtaagataatttaagcctcatttagatgggctttattctcagcacttcggcccataaaaacaatgatttagtgaaaaacaatatgcaccataacacatgtaaagtaggaaaagggctcaacatatgacataccacgtttggattgcagcaaacaactttattagttatgttgttacacaaaacaacacaaacaatcccctcctctgcttacttacaactgactatcaatttctcaagccttccagaaggctctttctagcatgcggcaaaatccatcgcttagcatgtacctgtacattgataagcattgagctagaagaatcatccaaggatggcgtggaggcttagaccaccaagtatggaatgatgcataaaattagtggatcgcttgtacatcaattcacaagtgtatggacatgcagtggtgcaaaaggaaagaagcaagaaaggctaacagaaccccgcaacaaacccacaagagaacaattagagacacctaacctcgatgctttttcatgaatcatcgtgtctccagttggcatccacaatatcctttactactttgtactcctatataaactactttgcttggttcccattctctcatcgaccacaccataaattggtcacctgcttcaacatcttgatataagaaaggttgtttattatatcattattatgtacttctactaattcttgagtgttagtgtaaattgtgttagtggctatacttccaacgagaagcaatgtagtttctattcaatttacatatttttactgggaagatgaaataagttgttgtttcaagcaagtacttaactgagttattgttcatgcattacttaaaaatgtaggagtaaagaaatggcgattccaacaaaggaggaggtggagcagaatgaggaggacaatacattttcaaggttgcaattgcttgcacaacaacggcatgccatggaggaattctggaggaggagccaggaacaaatcgaggcatctgcaggcaaccatgagcatatactaccaattgactgcgtgaagaatgtcattcgaccaaagaatgatgctatgatgctatctgctgacacaccaacttttgtgacaaaactttgtgagctcttcgtgcaggagctcaccctccgtgcatgggtatgtgccaactctcacaaccgtgacatcatattaggcacagacattgctgaggcaatcaccaccactgaatcctatcactttcttggtaatgtacttcgtagccacaaggcactaggaagtactgctcctgacatagatacttctgctaggaagcatattaagctagaccaaatgacctcactctaccatcctacccaagaaatgcaggcctcacgtttagctgggtatccaccccatgttcctatatatcctccataggtcaaatgggaactcaacacaagctgtctccattcacttttatgatgcaaggagaatctcttctcaacatgaaaagagaaaaatccctagttaatgaagtgatggtatgcaccaacaagatgagcataaacaactttgatggagctactagtattgg

SEQ ID NO: 81852 - DNA, 2866 bp, Oryza sativa
catcagaaaaaaggtaaattagaggctacctatgaaaagcgattgcacataaacacacgcggcaacactatatgtttactgtaaatcatagggcaaaattatgccactatctaaccaatgaggactttacagtgcctggtatcacttatcaacggttgagttgccaaaaaggtaacttaggaatagaaaatagtaacacgaaaataggataaaagataacttaggaatagaaaatagtaacacgagaataggataaaaggtaacttaggaatagaaaatagtaacacgagaatatgataaagtaacttagggatagaaaatagtaatggttgagttaccaaaggatagcatagggatagaaaataataacacaacaaccgcaattgtattccaagttacaacaaccttttaacttcttcctggttttgtttgcagccagcccactccctcgtccagccattagatgatcacacgagctagttcaattattgctaaataccatgaaaatcaattgctcggggttagatgtgtgttttagtaagttacatcgcaggtataattacatactactttgcaaatttgttcccagcaagtcatggaatatatatggggcaattgcatccatgtccccactttgaaagccaattgttgttttgcccccattttttagggtttgcatttttacccccaccttttgaatttgaagcagccgtctacccccatttatgacagctatttggtgggtcccacattatgtgttaaagaaataccaaaagaaataaaaaaaggttttaggaattatgtaatgacacttctacccctaagggaaagtgaatggacaggattcttctcttcccgtgcgttgggactccttgagtggagtcaactcaaaaccctagctagtagtcagcagcggcagcgcacggcggggagcgcgcgcggctgtgaggcggtggcgagggagcccgcgcggcgcggaggcggcggccgaggagcgcgaggcatgggacgggaggcggcggccgaggcacgcgcgcgagggagctcgcgcggtggggaggcgacgtgcagaggcgcgggcgataggcagcgtcggcggccgtgtgaggaggcggcggcggccgccgccgcgggtgcgggaggccgcggccgagggcgtgtcccggcgcccgctcgcaggaggtatacagccgcggccagttctcttccagcgtggaggcggcctctcacaggccgagggcaagacaaggcagaaaaggggaagttgttggcaatggaggaaatcatatcaatggagctaattttgatggaagagttgcacagataatgcgattggcttgtcttgctatcttatgaaaaatagacatgaaaacttagagctagctaaatctagatgaaacttagagttagatacccagatatacttagatatacttgaactactagctagtatgcattttaatcttggggctgcattcagtacggttgctttttcgtctctctatataactttgctatttaggacgatttacctaaatgtgccacttgtgttgtgatttgtaggcctactcacagcgatttgcaattagttgttagagttgagtcttttttaagtttgccggatggaggtccaaagcaatacctctagggtaaaaccttgccaacccaaaatattgacatgcataagtatgatctgctgcaagttgttaatttcattgctgaacactacacgtggggatctaagcaatatgtgagtttgtgacgttctttggatgatggttttgttgagataaaatgatggttttgttgagataaaatccgatgaacatttgcgggagtggtttcagctcaatatagataagggggttgtgtgcattgatgccaaaatcaatgatttcaatggtccattgcaattttcacccacaaagcgtaggtttcattcttcagtaaggtctagagcatgcataagtgagattgccacaaatgagggagccaaaaaaaaagagagccacaaatgaggaagctactaatgagggagccaaaaaaaaaaaagagagccacaaatgagagagccactaatgagggagccaaaaaaaagagagccaagaattccaaaaaaaaggggtcaaatgataaggatgcagtaggcattgatgatgagggcatatactctgacaatgaattacttgtggtacatagtgatagcagctatgattctgatttgtccgaatcttccgactctgattgttctgaccctaagtttgatcctgatcaagaaattattgatgagggtgatgatgatgatgtacctgtctttgcatatgatgttcaggatccttgtattgatgttggtgtagtgttcccagatgtggatcaatgcaagttagcagttacccatcatgctatcttgaatgatcatgcttttgaaactgtcaagaaagacaagaaaaggtttagagccatttgcaaaagagcagaagagggttgcaagtggtgttttttttttgcatcaacaagccctaagtacattggatgcaaggtacttttatatgtgtatttatgaatggttattctgtttggaatttttgttcaagctgaaacatgagctattaattctttgcttgtaggtcaagacaagtggaccaaagcacacttgtggatctttcaataagtgtggtgaaacaatggtcaccactaagtgggtagctgatcgagtggtggacttgttgcgggataactcctcaaggggagcaaaggatttgcaggaggagttgaataggaagcatcagattgatatcccatatttcaaggtcttcagaggtagagagagcacttgacattataaatggaaagtgggatgacagct

SEQ ID NO: 81853 - DNA, 7162 bp, Oryza sativa
  unsure (1)..(7162): unsure at all n locations
tcacccgagcacccccgcctccagttcgaggtcatccgctgctggccccaactcccacgcaatcggccagacatctgtagctgttgctaattgcttatgttnattnnanatagtnattcatnnnntntnnncnnannagcctntnngtttagttnnnnnnnnnnncnccactgaagccattactctgctgatgctgaaaatatagtagtagttcatcgagcaaataaggtttgttttttcatgtagcttttctcgccaaaacccctcatcattctccaacttccatagccattttcctaggagagacatattcattgtctctggatcaagaatcccaagcccaccctggtcttttggtctacaagtcactggccattgcaccgaataatactttctaatcccctgatctgccacataaatcttgttctataaaaatccatcatcctttttcactcctatagcatgatgagcagtagtatgtcatggtgctctttcattcatgttgaatagagttttttttatgagcgagtcccaacttaagattaagaaaaggccatatacactgtagtatgtgttatactccctctgtttctaaatacttgatactgttaattttttttaaatatgtttgatcgttcgtcttattctaaaaatttaagtaattattaattcttttcctatcatttgattcatcgttaaatatacgtatatgtatacatatagttttacatatttcacaaaagtttttgaataagacaacggtcaaatatgtgctaaaaagtcaacggtatcaaatattttaaaagggagggattatataaataaacatgaggctatgggtcctatcttattgcttagcgaccttaaacattgatggcctgtttagttcgcgaaaagaaaatttttgggtgtcacattggacgtttgaccggatgtcggaaggagttttttttacatgaatgaaaaaactaatttcatgacttgcatggaaaccgtgagacgaatcttttgagcctaattaatccgttattagcacatatgtgttactgtagcactttatggctaatcatggactaattaggctcaaagattcgtctcgcaatttcttctctaactgtgcaattagttttttaatttatctatatttttaatgcttcatacatgtgttcaaagattcgatgtttttttgaaaaagtttttggaactgcctgaagatgcccgagtaccaaacagaaaatttgctgcgtgcatatgacgtgatcgtgcgcaaatactccagttcctaaggacctgtacgccaaagggacgtcccctccgctcccctccccagatcctctctctcgaatcgtctttgggcggccaacgcatcttcctcttcctcttcctccatctcatctcaccatcccatccacgcttctcgactcccagacgacgctgctgctgcctttcgtcaaccccccacttctccttccccgccgccgctcgccgccatggatgaggagtacgacgtgatcgtgctggggacgggcctcaaggagtgcatcctcagcggcctcctctccgtcgacggcctcaaggtacctctctcctacccaatccatccgccgcctcccgtgctcggatcggtgctccccatcgtcgtcgatccgtagatcgccccccacttcatctcatctgggcttgacgctgccgcactcggatgagctgctgccattttgatcgctgatttacttagctatgcgagcgtagcgggatggtaatttgtccgtacatcgtggctgggtaggtggtggcgccatggttgtggtggttgctttgcgtttgggggagggatcgtcagtgcgtgcctgagcttacgacttcccttatcccatttaaaagagtagcggcatagcgattttgggggatttcacaacaagatctaactaaacagatcggatgcacttttcaatgtttttgcaggtcttgcacatggataggaatgactactatggaggagattccacctcgctcaaccttaaccaggtaagcaaactgcaatgaacttaatttgaccagtacagggtctatatcttgtcgtcatatcatgtcaaggaatgcttatgttattacagagtacattatttcttttaattttttgtccttgttcactgacattgttttccacttcgctttttggaatagctgtggaagaggtttagaggggaagacaaacccccggctcatctgggctcaagcaaagattacaatgtagatatggtcccaaaggtgcaactgtcactttcccccatcataatctatcttgcttctatatttagtattagcagctaacgtacgtggctagtgaggtaccatataggtggggaacctcaaaaacagaaatcccgtgatggtgcataagttcatcttgatgagaacatttagatccttttatgttacaaatgtggttattcactggtttagaaaactatgtaatctcatgtgtataatactcaaatggaaaaaaaggtctgaaaagtaatgattgccctgatttttgtagattgtcaattagtcggatggtttattacaagcgctaccactatggttccttgagtagcgtattgctgttgcatgattatctaaagtcctctcttttttttatctccgcagtttatgatggcaaatgggacactggttaggaccctcatacacactgatgtgacaaagtatttgtcattcaaagctgtcgatggaagctatgtcttcagcaaagggaaggtaacatcttcagctcatttcctctgttttcattagcatcacatttcctctagtgttttatacttttatctaagtggttgttggatctatattctgatcttattcctatgctagcagtgtaacatgcacttttctatttttgctgtcaaccagattcacaaggtacctgctactgacatggaggctctgaagtcccctttgatgggtctttttgagaagcgcagagcaaggaacttcttcatttacgtccaagattacaatgaagctgatccaaaaacacatcaagggttggatcttactacaatgacaactagagaactgatagcgtgagtacactagtgtttcttgcactgtattcaaccctttctcagtagtgcatggcttccttttctaaatgaaacaatagatttggggcatatatactatatttatatgggatatattgttgtagacttatacatgccctaatgcatacgtgaaatgtcaaacataatgacagtgtgcgggcaccggcgcatacatgaaaccacgtaatatgaaaaaaagaaaatgtgcacttcatagcaaagagaacatccattgtatcatctgtccattgtgtagaactttagaaagggtacgatagacagacttttgcatggaatccatatgtggcacatggcagtctttacatgcgtagcaacaccctaaaacttactggtcactaatgattgctaaatttaggataactgttgatatgactgaaagatttctctggataaaattaccttggtattagaaaccagcgtacttaaatttattttttcgatctgacacgggagtacttaagatacggatgcagttacattattgaaccaagcaacacatttatgttatatgctgcatgctgtggtactgcattacaagcctactttgtgctgctcatgaaatgtagaaaccttgatatcccttttagggaaaataaagtatgaaagcagaggcatcagagcatgggttgggtatctagtgtgtcacatcaatgagattctcactgcaaaattttaatttgcgttatttttaatttgttgtgtcttgactaatgtggacccacttaaatatagattagcttctattgtaacttgtaagaagacttacatcctgatggatattcttgtcgtcttctagtagttgtgttctgacaaaaaagtagtacaaataattgccgccacagaatatatcatcaatttaccttcagtctttcacatgatgcaaaaggatatatctatgcttcttttaccttttctgcatataaataactctgtttccatttgccctttcttttccagaaaatatggtttaagtgacgataccgtggatttcatcggtcatgcacttgctcttcatagagatgatcgctaccttaatgaaccagcaattgatactgtaaaaaggatgaaagtaagtattgatcaaagctcctgtagattgttcgtagtcttctgctacggatatcctgctgttctctgaatattcatgctttatgaagttcaattacattttagtgctttatctacttgtagctatatgcagagtcccttgcacgttttcaaggaggctcaccttatatttatccactctatgggctgggtgagctgccacaggttagtgaaattttaatgttaagtaaatacctgtcatactgcatgtgcatgtttttaagatggtcatatataacgctttcttattcaaatatttcttattccacagggttttgctcgtttaagtgctgtttatggtggcacttacatgttaaataagccggactgcaaggtgtgattaccatcaaccctgtcattacttgcatctctggatgaccagacaacctaataaaactttttggcatgccatacatgatcttaggttgaatttgatatggaagggaaagtctgtggcgttacttcagaaggtgaaactgcaaaatgcaagaaagttgtttgtgatccttcatacttacctaacaaggttaattttctttcctgtattcaatttatttaccacatgaattttctttcagtatgttcatttaggattcctagatgatgtacttccatcttaacacattcacagcaaatttactattttttcttcttcccttccatttgttgagaagttttattaactacaaccacatttgatgttctgtatacatttattaacaggttaggaagatagggaaagttgcacgagcaattgctataatgagccacccaattgcaagcacaaatgactctcactcagtccagattattttgccacagaaacaacttggacgcaagtcagacatgtgaggcctttctcaatcacaaacaaatactgctcaccttatgaattattacatttgcttgcccattgcttttaacaaagtttatttattcccattttgtaacatttttattggtattctcctgttaggtatgtcttctgttgctcatacacacacaatgtcgctccaaaggggaagtttattgcatttgtatctacagaagcggaaactgacaatccacagtccgagctaaagcctggaattgatctacttggtcaagtagatgagctattttttgatatctatgatagatacgaacctgtgaatgaaccatctcttgataattgttttgtctcaactgtaagttttgcaatatctgatttttgaaatgagcattaagtttgattgtctagactgtaacatatttctggtccacactccctgcagagctatgatgccaccacacattttgagacaacggtgacagatgttcttaacatgtatacattgatcaccggaaaggtagatgtgcttccgcctttcattttctttaatctttaatacatgtaatgcttctatattttgtttgaaacacctttttttggaaaggatgaaaattagccgggaggctatagagaggactagagtaccacatatgttgtaatagcttgacttttgtgtcaccttaaattctaaatccaaatccattctgttggctattgtttgttttacaattatgtattctacccttttcctaattcttttctcattgcactattgcaggctgttgatctcagtgttgatttgagtgctgccagtgccgctgaagaatattagatttcacaaccaaagctcaatcatttcacaaagatatgctttttcttggtgggtaccgcaggacagatcgtaacgagtgactggtatagttattcaaactccacgttataccgagtgttctggccaatatggcttgttgctagcagtaatatgcacaactgttggccaagatgactgaaatgatggtggtttaatttgatacttcagtaatgcaatggtgtaaacagtgtacacactacacaatgacggtcgggcgttttgtgactgatgtatcataactgctggataattttgcatgtctacttctgcagtgttgtgttctttaccttgcattttcaggtttcagttgggtgtgcctgcctccggtatcagccggtagggtagcatgagtagattttaccgagtcatgcgaatgaaaattataatttaacagcttaacctacccagaatatcttattcctggttggattaaccaaaacttcaggacaaatttaaatgtgtttgacgtttctatttgttcttccggttctacctgggatacattctcaccgtttggttggttaccgatgaaatttgaaggcccattgtccgcttgcaaggaccgggaaatttaaactatttgccacttttacgaatggcaactcttcaaatgctatccttatggttgttcttacacaattgtcatcggagagacgtttttaataatttgctacttttgctgatgtggcatgcccctcatactgccagcgtggttttgctgtgtaaattttccgttttacccctgatgggccctacaaatcggggaaatgggaaaaggagcaagagagagaggttcaactgccgtctcatcgtcgtcgattcgctcctgtgctcgccgccgtcgcagcagtggagggaggagagcgcggtgaggtcgggtgcctggggatccgttcgtagccgctcactgcctcacgcgacgcgtaatagtggcctagaagcggaagaggacgccgtcgttggggttcagcttggccgcatcgaggaagtgctcggccaccgccgcacggagcagccttttcgtggcatccgtctcattcggtgatgcattgtccggccgatgcgccggggctagtcgactccggcgctgcacggcagtcatatatggcgctatatatgcaaaaaaaaaagaaagaaaaaaaaaggaagaagtttttgttttctctctgacgatggccgctttagtctcacaggacattgacgacatcgatggatctgatcaaa

SEQ ID NO: 81854 - DNA, 8472 bp, Oryza sativa
ggcccatctccattccgggtctctctctctctctccctctctctctttccctcgttatgccggcgcgtgccggaaccgcgcagagcgcctcctccctccagtcgctcccccctccccgcttttatcctggcgagcaccccgcccgcgaaatcggcccccgcgccccgttgttcgcgcgcgcgcgcccgcgtggtcgccgcccgtcccgcgcttgcgccgtttgagtcatccggccccgctgccttgccgcgcctgcagccgcgcagccgctcggccccgcgagccagcacgcgtgcccgagccgcgccgctcaaatcgccgcgccgcccgttgcttcccgcgcgcgcacgccgtggtggccgaccgcctggtcgctgccgccgtcagcgcttgccgcgcctgcccgcgcctgtcgcccgtgtcgccgcttcgctccacaccgcccccgccgtcatcgccgtcgtcatcgccctgcccccgccactccacgcgctcgctccatcgccgtcgtcacgcatgattatgagctataaggaggtgaatggatgattagctagcttcttgatccaatggcttaaaattgttgatgatgtggcttcttacatgtcttgttttatatgagcaaatgcttcttagtgggtaccaactatataggaagataggagtgaacccaattaattaaacaacatgcagcgagccacattatttacaaaagagtggccattggattaccattacttctaatcacagccgtgggatcagctctatgtttaacgacagccataaatgtattaattgtagcttaacatacattgagaattttattaattgtcttgctttgatttaatgtttttttcctggtgttttagaaggatttctattgcttcgggatattctgtagcgcccgttccgtcgtggcgcctagcgggaaaactatctcttaaaaaccctatttgcgaaagctgtttctttgcttgtggtctagtgtccgtgccatctcagatctcaaatccccgatctatcatcgaattcaatcccgaatccaaatccttccaaattaatccctccacaaaagtctatttcgcctcccccgggttcgatgggccgaatccctctcggcccatctcccttcccggctctctctctctctctccctctctctctctccctcgctctgcccgcgcgtgccggaaccgcgccgagcgcctcctccctcccgtcgctcccccctccccgcctctatcctggcgagcaccccgcccgcgaaatcggcccccgcgcgccgttgttcgcgcgcgcgcgcccgcgtggtcgccgcccgtgccgcgcttgcgccgtctgcgtcatccggccccgctgccctgccgcgcctgcagccgcgcagccgctcggccccgcgagccagcacgcgtgcccgagccgcgccgctcaaatcgccgcgccgcccgttgcttcccgcgcgcgcacgccgtggtggccgaccgcctggtcgctgccgccgtcagcgcctgccgcgcctgcccgcgcctgtcgcccgtgtcgccgcttcgctccacaccgcccccgccgtcatcgccgtcgtcatcgccctgcccccgccactccacgcgctagcctccaagggacggaggcagagctcctcctccctctgccgcgtcgcccccgctcccctcctccttttcccaaagaggcaaggggcaagccccctttctctccctccttttccccttttcctcccgccggcgtcatcctccctccgccctgtcgccgatttggccgctagccggagcgccagctcgctggcttgaccgtccaaagtcggttcccctctcccaaaccgacattgccatcctataaagcccaagcgccctccctctcttctcctctcgtttgtcccatcgcctccactccattgtcgccgcctcccgtgctctgttcgccgtcgccgtttgtcgtcgcgcgtgtcggaggagccggcacgagcgaggacgcagaaggggactccgggcgcgccctcttcttcctcttcctcggcccgaggccgaaacgatcacgtttcgcgtcgtcggctctcgtcactgcgcccgcccgcacggtagcgcatttccccgttctccctcttcgctccatctcctccccttagactcgggtagtagcatgagtagcctccccgtagctagccggcgccgccctgacggctgccgtcgttcgccgtgtgctcgccaccgtcgccgcccgagctcggaagcgccgctcgtcgccggcctcgctcgacgccgctccgcccaatccaacgctagcatcggattcccgtagccgcgtagatgctctcgccgccgggaatcggcccctcgtgacctcgtcaccgtttcccccttcttccgccgccggttgccgccgccacaatccgccgccgtcgagcatcccccggcaaatccaagccgttggctcgactcccctcgtcccgtgcaacttcccggtgtgctcgctttcgcctagatcgccgtgtttcgctccgccgctcgccaccgccgtccgccgtccgttccggccggcgtcttcttcaacctcccgccggcccgcgtggctgccacgtagccgccacgtcggcgccagctcggccaagaccgggtcgagccgaccccggtcagccactccctctggccccgctcgcgggcgcggtccaccgtgagccgtgaggctgcgcgtgggcccgccgcatccgcgtccaccgcgaaccacgcgcatgcaccgcgccccgctccacaccctagcgccgcgccgcgtgctccctccgcacggtgagccgagccgctaacaagcgggtcccaccccggaccacgcgagatggactcggtccaccggcgccctctctctcccctcctgcgccctattgggctgtgtcctcttgggccggccgacccatttagctcggccgagccgccccttttctctcgggccgcgccctagccgcccgagggaagtctacttcccctccctcttccttttcttttttccaaaagggtttaattaaatcctttttcctttagaccaaaaatccattaatcttagaaaattcaatatcttctcaaccgtaagtccgtttgactccgttcaacttccaaatttcctcaaatctcgagatctatctaatggcacgcttagggggtcattaatggggctttattttcgccgtttgttgagtcgtcccgttttgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgcattgataggatcacacttaatctgcttgtcccgtctgcaaggcagattggcggacctacctaacttgttgcatctgatccttccattgttaattgttgtatcatgtccccttgtaaccatctagttgcgcctcgatattcgtgcactatgtactcctactctataataaagagacctctgttgctgtgatattctgtcttcctgtggtaccagcactgtattcctgggactggtatcgattaacaggttaatttggagcgtcacgggctagtctcgctcggggctagttcggggcgtgacatattcattctataatcaattcgatccccggccgggccaatccgcctgaaaaaaggttgtttgggtttacgtaaaggttgtttgaatttacgaaatgtttgcttggatttatgaaaagttttttttagatgtatacatgattttttttccaccgccctaaacaaaggacgggaagaagatagtgaacatatcctctaaattgatcatccgtaaaaattaggagtaaagtattgataccaatttttttagataatggaatgaaacatcccggcctttactccaaagagctatagccaattattacaaatagtaacacacttatataaagtcttaatccaaaataaaacgatcaaaccaaccaaaattaaaagaaagacctaacatgacaaggaaaacattattccagcctattagagaatctccatccatgattagcaaaagattgcataaccgttgactcaagagtacgacatgcaacattcaggaaaactccctcttcctcacacttttgtagttgaccccagagctgaagtcaatatgttgtcctgaaaattacctacacataggaaacagatggtgatttgtcaataaccctatcaaccaattatgaggaaagttttaataatgagtgtttgcagaacgccgccggttcattttgttttttcaacagaatcttcaggtgtatttggtttttaagagtgatgaaatctgtttcgtagtcataagaggttcacaggtcggctgtttggttttaaaaagaacaggggtatttggttttaaaagaacaggttctttatttttctttttttaaaatacagtacaaacacaggtaccctatcttaacgtgcggcaaccactgaaaatccatctggatcccatctctcaacgtgtggcaaccactgatccatctggatccattggtggtcgttcatcctgctgatcagttgagtcgccagaatgaaacaaaaatggtttgatgttttttagttagtggccggctgcggacactagttcatgcttgcataaattattatccttaatgcttccatgaccagctaatcctaactctctactttagggcacccacaatgattatctataggctctctacaagagatccatgtcagcatattttcctacttggaatgtattaaatgaagagagagagcaaaactatctactaacttagagatagtctatagagaaaaacgaggcaatgcatgagagagctatagataccaatgtagacatactattaaggtggtttactattaatcgagtctattgctgagatgtacatgttttatagatagcaccttactttaccattgcgggtactcttatataagcctcgcactgtcgcccatacagcgagttggttgtggcatgtgtaccttcacttcagagggagcttgaaggaggcacactttgaaccttgagcctagaggtatgcaatgttgttaatactcttttttttaccacagggaagtgtgttatcctatcttagtataaagttatcccccactaactccttaaacttaacatgtaaagatgtcacatcatcatccactaacaagatgccacatcatcatccactaacaagatgctacatcatcatccactaatccactaattaacaagatgtcacatcatcattcactaacaaccatcacatttaaacatcatacaaacatgctatatctctatagtttttataatttaagaacttttcaaatacaaacatgttaaattatcatccaacataattcacataacgtttcaatgtatatttttattatgttttatgatatcctatatacttatatatttcatccttacttagtgcttaaatggttaatctatggtccaaattatctttcttcttttttttctctcattaaggcatatcatatcaattgtttttagcctttagatgattaatctacggtccaaactatctccctactttttaagtcatatcacatcaagtgtttttagcctttagatgattaatctacggtccaaactatctccctacttttcttcttccataaagtcataccaccttactttttacatttggatcaccattctacatactatttaaatttaaattatcataaaccacattaatttacttaatctgatgttatctagctatcttacacgttattttgttattgttatcatactaaattcccgcagcaatgcgcggggtttcacctagttatatatatcacaaacactttgggagtaataattaaagaagaagttagcatacataattgatagagaagaaaatgatgagaaaacctgtgctcaagaggatttgagcttaggccaatgcattactgctagcagctgcctatcagttgagctaggcaccgttctcaacagagttatactaaacggatcatactaccagaaacttgttaatccgtaacggattcttggtgatggattcataaaccgtcgctgacagcggcaatccgtgacgataatcttttttccgtcatggacgtgcaccagtggttattcttggcccgctaactcatgatggttttatccagatcgtcacagtgtgtgattttaaaatcttcacagtgtgaagataatcaaaaggcatttcaaaacttgttttgcttgaaaaggatttgaatttgaggttcaaatgaattttttaaaaaatgaaaaactacactctctcttgggccatttctggctgtcctgcagccccacatggccacacccacactctctccttctcttgggctcggcccagcctccctcttacgctttcccccttcagctgggcccggcccattttccgcatgggctagccgcaggccacctgcgccttgtaaaaaaaaagagacaaaattgtgtagctctttaggggattcgaacaccctcaaccaaaagcacaatatccctaaggatccaccactgaaacacaagtgtttggccataggacaagcactttgctttatatatatcaaacgttagcaggtaatggactcctgctcgtgggattcatcataaaattcacaagaaaaccagcaggttttttcttttcaatcgctggctaaaacttgtaggtagtctttctccctcgtactaacttcaaattagattattattttttctaaaattttctaaattaatgatctatcaatttattgtgttattacaactattattttttttcatactttcatgtgactttgttttatcaattgaagatctaaatttcaaaagtgtcaacttcaaacgatattttgaagcagtaaatgatttcatttgaaaaagtcatgaacacaaaagttgtagaactgatcgagatctacaatttttattttggtcatttattcatttgacaaaatgatagtaacattgtttacacaatttacacatctatcttataatttatgaaaccatatgggagatatgtaaaatttatgaacaatgttactattactttgtcggatgaacaaatgaccaaaataaattttgtagatttagatggattatacaactttgttattgattacttttttagttgaagtcattcactaataaaaaattctatttgaattctcaaactttgaatttcaaatttcaaattattcaaatagagtcagatggagaaatgaccaaaataaaaattttgcatctcgatgagttctacaactttggttttggtgacttttccatttgaaatcatttattaacaccaatttttgttcatgtggttatgctagttcaatgaccgcatgttactagaaaatatttttatcaatggtagtaagtatcggtgcatttacatgggctattaatattgtatccatcctaaaatatacggtgtattagttttgtacaatatcttctacattatactttgaatattaatttcttcaataatatattatcaacaactacgaaattaacatcatcataagtatgaaagattatggaaaacaaatataaagatatgacatgcatatgcatatttccttttctgctacttcctatatactatcaatttcatatttgtaaatttagaattcgtaaataaaaggttgtattacgatgaggttttttcttgttctaaccatttggagattatattctaattagcaaattcaaatttgtattctcaattataggttttcatgttttagttgttctgaaatttgaaataagtatcatgttgtacgtacttaactacttatctagtcccagttagtttcttttctattttaatatttctcaaaatcaacataaataattagcaggttataaatgacatggactcataacaaagaaatataaatttatttttcttgataacataatttctaaaattgtgcaaatttataaatataatgttatgctctatgtatgtagagtatcaattttagttttcaaggtttagcaattccaaaaattcagaagtaaaaatactaagttgtacccatcttggattataatctttctcatttaattctgaaatcctaaaataataattagtaggccgtaacttacatcgacgatcctttttatttaggccgttatatttcggtccaccaaaatagatggccagatttattctagttctaacattcaaaactaacaattatcaagttgtaactgtcacattcccctcttaatttaagttattataattcagtcatacaaaggtggattgtcagatttattcactatttatcctgttaacgtgagaattttctcggagtaccctagtatatgtataatcttgagaaatatatccatttatttgtctgcagagctagcatg

SEQ ID NO: 81855 - DNA, 2888 bp, Oryza sativa
acggcgttctgcgagcggagggccggctcgtcgtcgctgtcgccgccccgctccagatcccggagggtcgaggggaagacgaagggcggcgccatctcgtcgcggcctcggcggagtcgcgacggcagcaggacgacggcggcggcactgggtggatggggtggcgggcagggaggaagccgagacgggatggggaaagggggagagagagaggagagagggggtgggacccacaccagatggccagccgtcctggctggccaactttggctagtgaggtggggaatttagccagccggatggcttggagagccatttagctagtctgttggagtagatttttttgtccaagttagctaaattttggcttggagagccatttagctaggctcttggaggtgctctcagtgaagtcactttcccgaccattccttctacatgctagaggtctctgtctcaaaatataatataaaatgtaatagaatctaaaatacccgtaagaattggtttggtaatctaaaatacccgtaagaaccaaccgacaggtttggaactcgtttttttggacggaaggagtaaaacaattagaaaatctagaactttgattattgcaaggttgaaaaaaaagaccaggatgtacagtagtgcagtcaagtcagaggagtgttctctagctctagccggcaatgaaatgtgttccgagtcatagcagtaatttgctccgaaatgggagtacgtagatcggaataaaatagctaggaatatcatttgttccttcgtgaaaatcttgagcaaaattaagtccatggcggcgaccacgcttgcttgctgtttctcttcctccatggatctctcctgcagcgcacggctgatgccgttgaggatacgatcacggcgagccggccgctatcaggcaaccagaagttggtatctcggggtgaaaagttcgcgctaggattcttccggtcaggtaagctaattaacactgaaacgctgcgcgttactgcagaagtttagtactccagaagtaagtaataagtagacataatgagtaagatagatatatggtagtataagtttacatgagttgatatggtttatgttaatttaaatagtatagagaataatgatttaaatgtaaaaataaggtgatgtgattgtataagataaaaaaaggtgaaagataatttgaaccatagattatctaagagataaaaacaattgaggtgatatggttcagtgagagaagaaaataaggaagaaaatttggaccatatattaatcatcgaagagttaaaaacaattgatatggtattgcttaatggggaacatgaggaagacaatttggattataaattaatcatttaagagataaaaacaattgatgtgatatggcttaacgagagaagagagaaataacatcaactaagtgaggatgcactatatatgtatcaatataggatattataaaaaatagagtgatatattaaaatattatgtgaattatgtgagatgatgtaacatgctagtattttaaagctttaaaatttaataaattgtagaattaatagataatatagcatgttgcatgatgtttaagatgcatgctataaaagtgtttcaattaggaatataattataatatatttttttcatttgaaatataattatatgatatcttattgtgaaaatttaattgcagcggatacaatgatacaatcaaatcatgtatctaataaatagtttagaagaaaatatattataaaatttgcttacaactttgttaattagatgtagaaaaaaaatacaaaatacatagtacattgttagagcacgtgcactacgtgagggaaacagcacgtcagcacatccatttttcttttgtcatccatcgaatgtccgacttgtagccatccccatgaacttgcattcaacgggccaaggcctaacccatgctggttctttctttttttttaatatgtccgcttgttgtcccctaactttacgtcgagtttgtttaacatcctttatcgccaataccaaaaatcttcacctctaaactattcaaaatcatgcgatttagatcccatagtagtatggatgcctggtttcgctaatgtggtgtcctagttcaaaaaaaatgtgggactcacatttaagtaaaaaatagggggctcgcgtatcagtgtcctcttcttcattctcttttcttcccaagcttagaagggagggggaggtggctgatgggagattgagagggaggggcagttggtgagcctggaaggaaggaggaggcggccggcggaagagcggggctctgcgtccctagaagcctgcaagtccaccagctctacgtcctcggccattgcgcctttgtcatccctgagcgggaacagcaggtccgtgatccggagtttcctcacaagtgccgaagttcggccgaagctggtgcgccacagcgtcggagacggcatcgctgactccgcgagacacggcggcaaggggaggagccacctgctgggaagagctaccaccaacatcacccacaagctggtctcagctattgaggatctcgaagacgcgagcgatgttgtaccactagggctcgccgccgttcgtgttgtgcccccggcaatgtccactgcggttgttgttgtggtggcggcgcttggttaggatgagatggaacaaggtaggaaggggttgctgtaactgaactccacctcacggtcggcaccgcgcaagtcatagacagcgagcactgggtcgaaagcacggcacaagaacggtgggggaaacgcttgatgcagcctccccctccctcccaggctcgctagccgcctctcccccatcccccatctcccgtcggtctcttccccctccccaat

SEQ ID NO: 81856 - DNA, 2610 bp, Oryza sativa
aaggaatggcttcaggtccttttgcataaagctaattttacaattcttttcacaagcctaaaacctagcatagactgatcaaattttagtaccagtgttcactttaaacaacgacggttctgtcaaccatccattgtgatcccaaggatagcttcccgccattgaatcgtcatggttttctgaggatgtccaccttccctcctctcgggatgtggctccatcagcataaaattcatcatgcaatatcccattccccacaagttaagaatttagagtctagccaagtgtaatacatgtcccggtgctcaataaccgcgagcacggctattcaaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgcagggcacgcctctcggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcgtgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcactcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttataaacaaaacaatttcgcaattgggatcaacatgttcaaggaatagtgatgacttgccttgctcaggataatccttattattgctataatcttgatcaaccttcacctcctggaagttgcagacgttgcctcacgactaaccgatacacaaggtctataatacgcgagaaaaaccaatattcaaacaacaatcaaatatgcgcaataaaatgtactattcgtgtttgctaatggatcccaatcatgctaaggctaaagtttcttaatctttctattgtcatcgtggcctatttaggagttaaccaacatagcatttatgggatacatatatatttggctaatcagtggtttagtctatcaaatggctatggaaggattttggctatgtatgcatctatctaaataggacggttatatactagaggttctgttgctagatggatttaggatcaatcaaacaattacagtgaatcatttgtattatttattttattaatggaagctttactttaattatgaacatattttacttgccattataaattataaaagggctaataattatccatgctctatatgttaaattcgggaagtttataatattatatttacagattatctcttaatgaacaatccggatttacaattgactatgaacatatgaggtcaagatttataattagtacttatctactattcatgtttgttatatactccccagtttaatatatgaaaaagataaattgattgtataactataatgggatgtacaatatgtgtgcaacaacgtataaggttttggtcgcctactgtacatgagcttatttagaaagtgtactacccaatgctccaagtgattcctaaatatattgtagtttaattatacattagctagtttctatgagtgatattgtatatgtgatgcgacaagtttaagcactggttctattgggttactaataagtggtaatcaatttaggcgtatatatgctattctatatggtattgcatcgattaatttacttagcgattcctccacatctagctctgttatgattctcctgaacaggttaaagagtcatctatgtgtgtttatattttagttagataatcataaggctatacttgatttaaataacctataagccatggatttaattatatggccatcgaatattaaataagtactagtattttcctatacatccattaatttgaaggattgattataactaaattactaccaatattaatctaatctgatcaagaaacatatttttataattaactcggaacttcgaccgaaatactattacgctcgaggaatttccaaaaataatctatgattaatcccgaccatttttatttcctaaatcctcctaatttcttatttatttccttttcctttttttttccttcttttttt

SEQ ID NO: 81857 - DNA, 1807 bp, Oryza sativa
ggctttgagggttccaaaattaattaaaatatcctaatgtggccattattattacaatagcacattgaatgaacttatttgtataataatgtattttacgtggatctagtaattcggtaaatataaattgagactcggtacaatattaatctaattgtctaattaaacactcacatattcttatttatatataaagcttaatttatttatgaccattattttatatgagtgattttcatgtcatgagtaactcggtgaaatgttctaagtatcaatctatatatattccggtgaattacttatttataaacacgatcattatagtggtgatcatcatttcatgtgttcttatatttcatgtgagattcgattcaaatgaataagatttaatcttactatttctttagctaattgtgacatcaagctatcaatcatggttcgaatatttaatacctgatttgtaatttgtaatagaaattaatatttgacttaactatcttgtgcataattatttgtaggattaacgatattatattctcgtaaatttatctattacttaaattttagacccttactttactttctttgtgatcatttacggtttggcaagcaatagcaatcataacaaccagcatgatgcaaaagttttaaaaagttcaaaattttagtgatttttattgtcttgaattttcaggatgttacagcaccattcctggatcataatcaccccctcaaaaaccagaggcatggactccccagcgacccccgtgggcttatctccgccacttctcggtctggtgctccgcaatgaaccatgttattcaaaaggtaaaagccgttgcccacggtggcttgtggttggcccgattaatgtttctctatagtagctcgatcaccggttcttaattgtcataagcactactatccaaaccatgggttcaatacccaccattatccagttttagttggcaagtatattaattagccaatcacgattgaccatcgtgaactatcattaagccatcattaaatagtaatgagtcataagttatcccaatagtgtgctaatgtttttaagcatggctaagcaactataaataacatctagctgaaccaatccaatatataaggtccatgctagtcaaattataacccataggaaaataaagtcatcttcggccataattaaatgggaaaggctcaccacccaatgatattcgaaaatgtcacaccctgaaaattcaaaatatataaattgttgtttaattggaatttttagaaataattttaaaagcctagaagagaagatctaattttaattaataaattccaatataaaatggggccagataaaatttcattaaatactttgcttaattctataattcctagatttttctgggatttatttgagctaagaaagtatttttaataaatggaattgcatttaagaaataatttaaattgaaaaaggttttaaaaagtcttcttttggctttgggctgaaagtcggcccaaaatcccttctctctctcctcggcccagccggcccagtccgcagccgcagccgcccgcccgcgcgagcgcgctgtcgctgacaggtgggtcccacctgtcaggatcgtcgtcctcctccggccgtaaccctagtttcgcgccgccgccgccgctttccaatccggccgttcctttccgtttccggccaaatcaattgaggggaaacaatctccgggatctcctctaccttttctcctttggaaacttcggctaaatcggtttggaatgagtttgattcgagttcgaatcg

SEQ ID NO: 81858 - DNA, 6631 bp, Oryza sativa
cccacgagggggaggggggggaaaaaaggacttttagggtttttctttttataaaaccattttaactttgtttatttcttcttaattattatttgtgctctgaaaattccactaaaatttatttacgcattttaggcttttaggaaatatacaaaaatcctccaagccttattcgacttttaacttcgcacattttaattgttggaggctttcacaaggattttacttattctaagcataattttgaggatgtgttttagagtcgttttgggacgcgacactgcttcagaaagatgtgaagtacaagtggtcggaagaatgtgagcagagtttccaagagttgaagaatcacttaatattagctcctattttgattttgcctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgagttagctgcagtaattcatgcgttgaaaatttggcgtcattatcttttcggtactcgtacagaggtgtataccgatcacaagagtttaaagtatatctttactcagccggatctgaacatgagacaaaggagatggttggaattaattaaggattatgacatgggaattcattatcacccgggaaaggctaatgttgtagcagacgctcttagcaggaaaggttattgcaatgctacagaaggacgacagttgccattggaattatgcaaggaatttgaaagattaaatttgggaattgtcagtagaggtttcgttgccgccttagaagcgaagcccactctaattgatcaagttagagaagcccaaattaatgatcctgatattcaagagatcaagaagaatatgagaagaggaaaagctatcggtttcttgaaggatgagcaaggaactgtatggttgggcgagagaatctgtgtccccgacaacaaagatttaaaagatgcaattctgaaaaaagctcatgataccttatactctattcaccctggtagtacaaaaatgtaccaggatctcaaggaaagattttggtgtgcaagtatgaagcgtgaaatcgcagaatacgtagcagtatgtgatgtttgtcagcgagtcaaggcagaacatcagaaacccgccggtttgttgcagcctttgaagattcctgaatggaagtgggaagaaatcggtatggattttatcactggtttacccagaacgtcatcaggccatgactctatttgggtgatagtcgatagacttacaaaagtagctcatttcattccggtaaagacaacctattccggaagtcggttagcggaattgtatatggcaaggatcgtgtgtttgcatggcgtccctaagaaaatagtgtctgatcgaggcagtcagtttacttcaaatttttggaagaaactttaggaagagatgggttctaagctgaactttagcactgcttatcatccgcagacagacggacaaaccgaaagggtgaatcaaattttggaagacatgttgagagcttgtgctttagatttcggtggaagttgggataagaatctaccttatgcagaattttcgtacaacaacagttatcaagctagtctacagatggctccgtacgaagcactgtatggtcggaagtgtcgcactccgtacgaggttgcctatcagttagagttacctcaatctttggcaggagtccataatgtgttccatgtgtcgcaattgaagaagtgtttaagggtacctaccgaagaagctaatcttgaacagatagaagtccaagaggatctgacctatgttgaaaaaccaatccgtatcttggaaacaaatgagagaagaaccaggaatcgagttatccgtttttgcaaagtccagtggagtaatcactcggaagaagaatcaacttgggaacgagaagatgaattgaagtcagctcatccgcatctgttcaccagttcttccgaatctcgaggacgagattctgtttaaggggggtaggtttgtcacaccctgaaaattcaaaatatataaattgttgtttaattggaatttttagaaataattttaaaagcctagaagagaagatctaattttaattaataaattccaatataaaatggggccagataaaatttcattaaatactttgcttaattctataattcctagatttttctgggatttatttgagctaagaaagtatttttaataaatggaattgcatttaagaaaccctcctgtcaggatcgtcgtcctcctccggccgtacacctagtttcgcgccgccgccgccgctttccaatccggccgttcctttccgtttccggccgaatcaattgaggggaaacaatctccgggatctcctctaccttttctcctttggaaacttcggctaaatcggtttggaatgagtttgattcgagttcgaatcggatcggctttcctctcttcgagcccgatctttccttctcgtcgccggccgccgtgggccttcgccgctgccttcgagcccctttaaaaggacccccgagctcttctctacccgccgccacccttgccttcgcctctcgtcgtcggaaacgctctagcgccgtgtgccctagctttgccgtcgtcgccgccgctccagccgtgcgccgccgtcgtttcagccgtcgctgtcgctcgggaagaccgccgttgtgctcgccaagtcgtcgccgtcctcgtccgccgcttcgccaccgccgaagaccgccggagcatcgccgtcaccgtcgacccgaaggttgccgccgcttcctcctcgtcgccgtcgtcgtccgttgttcttccgccgccgttttggtcaccggtgagttcgccacgtcgtcctctacatgctggtgccctccgtttgtgccgaagtgccgccgttcgccggcgagcgtgcgccgcccgagccgtccgctccgccgagccgccgccgctgtcggtgacgtcattgccgacgtcatcggggtcgtccgccgtgagccggtcgtggaccgttcgatctcggccgtccgttttggattggatcgatctcggccgtccgttcgcgtgaacctgacgcccgtgcgcccggttcatatgaaaccctaagctgcgctgacgcaataaaccttcttttccttttcaaaaataattcattattgcgtcataattcaatttaaaccgatataagtgttttaatccgatttaatccttaacaattcataactaattcatcttagctccgatttagttggttcaagtctctattgggataacttatgattcattattgggataacttatgattcactattatttcatgatggcttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttatcgtttgtatagcatagttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtatagtggtacatctctgatcagagtaaaactattcgaatagccgtgcccgcggttatgggcgagtctaacaatgtcttttgtgattagtcccacacttctcaccctaatagaagatgctataattggtaataatttgattagctcctggtttggaatggtacattcctggtttggagatagatctgtacagccgggatggttgttcagaatggttgggcctatacaacagggtacgttgtatagtgttggattaatattgtttaattattacttaactgttttattaaattctcaaatgtttgctaaatgctgcttttgcaaatggaaccctattatgccatcctttgttatcctgtgcacttgcatatttgatgcgtggcttgctgagtatgtcatatactcaccttgcaatcattcatcagaggaagagttctacaatgatgctgatggtgtgaaggattaggtgtagccttggtcaagctgcctgtggagtggagtcgtctgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgaaagcgtttggaattttggatagaaattccgggcgtgacagaaaacaatgcataagttgaaataaatcaatagctttaaacaggttcagcatgctcaaagggttgtttgggatctgtgtgacttgccttgctggccttggaactcttcaaattcttctcctgcgaaaacagactctccggaaacgtcggaatctaaacaaaaaggagcaaaatcaccaaaatagcacataaacaagcatgaacagtacatgtggatatttttaacatgtagatctcaattttagaaaaatttagagacttgaaccaactaaatccgagctaagatgaattagttatgaatttttgaagattaaatcagattaaaacacttatatggattttaattgaattatgacgcaataatgaattatttttgaaaaggaaaagggatttattgcgtcagcggctagggtttgcggtggaccgggcacacggcaacggttcacgggaacgaacggccaagatcgatccatccaaaacggacggccgagatcgatcgggtctacggcggctcacgagagacgacgacgatgacgtcagcggtgacgtcacctccggcggcggctcggcgactcggcagctcgggcgcacacgctcgccggcgaacgacggcgcggcggcgcgaacggagggcacccacgggtagcggactgcacgacgaactcaccggcgaccaaagcaacggtggaaaatcaacggacggcgacggcgtcgaggaagaagcggcggcgaccttcggcttgacgacggcgacggtgctccggcggtcaacagcgacggcggaggggcggacgagaacggcggtgacttggcgaccacgatggcgacctccccgagcgacggcgacggctggagcgacggcgaagcacggctggaccgacggcgacgacggcggctcgaggttacacggcgctagggctcttccgatggcgagaggcgaaagcaaaggtggcgacgggtagaggagacaccggggatccttttataggggttgaaagacgacggcgaaggcccacggcgaccggcgacgcgaaggaaacctcgggctcggagagagagaccgatccgaatcgacctcgaatcaaacactttccaagcgattttagccgatgattccaaaagagaaaaggtagaggagatcccgaagattgtttcccctcaattgatttcaccggagaaggaaagatgcaaccaaatttggaaggagacgacggcgcggctcggctagggtttcgggcggcggccgctggaggttgacgacgaccccgacaggcgggacccacctgtcagcgaccagacgcgcgcgcgaggcggctgcggactggactgggccgacttgggccggggagagagagagagagggttttgggccgactttcggcccaaagccaaaagagactttttaaaaacattttttaatttaaattattcctgaaatgcaattccatttattaaaaatacttccttagctcaaataaatcctagaaaaatctaggaattatagaattaagcaaagtatttaataaaattttatctggccccattttatattggaatttattaattaaaattagatcttctcttctaggcttttaaaataaattctaataattccaattaaacaacaatttatatatttttggatttttaggatgtgacagcggtcctcggctcaccctaggtcgacggcgacgacgaaaaaggctgtcggagcggaggaaggcggcggcgcggctcgggtcgtcggggtcgacggcggtccggcggtccgcgggctcagcgaggggttggacggggtcgacggcagtgcggcgaagccggaggaggcgacgccggggcgggagacggtccggcgagcggagaaggccggccggaggtcgtaggcgacggaggagagagagagcgacggcgcgagctcgattccggcagggagacggtgcggcaagggcggaaacgggcgagggaggcgcggggagggtttatatagggttggaagggggagagggcggccggaggggaaggaaaccggcgcggcgctctcgggctccatcaatggcgccggcgggattaggggagggtttccaaacgaatccaagggagagagggggggaa

SEQ ID NO: 81859 - DNA, 18890 bp, Oryza sativa
aggtttcgttgcagccttagaagagaagcccactctaattgatcaagttagacaagcccaaattaatgatcctgatattcaagaaatcaagaagaatatgagaagaggaaaagctatcggtttcttggaggatgagcaaggaactgtatggttgggtgagagaatctgcgtccccgacaacaaagatttaaaagatgcaattctgaaagaagctcatgatactttatactccattcaccctggtagtaccaaaatgtaccaggatctcaaggaaagattttggtgggcaagtatgaagcgtgaaatcgcggaatacgtagcagtatgtgatgtttgtcagcgagtcaaggcagaacatcagaaacccgccggtttgctacagcctttgaagattcccgaatggaagtgggaggaaatcggtatggatttcatcactggtctacccagaacgtcatcaggccatgactctatttgggtgatagtcgacagacttaccaaagtggctcatttcatcccagtaaagacaacttattctggaaatcggttggcggaattgtatatggcaaggattgtgtgtttgcatggcgtccctaagaaaatagtgtctgatcgaggcagtcagtttacttcaaagttttggaagaagcttcaggaagagatgggttctaagctgaactttagtactgcttatcattcgcagacagacggacaaaccgaaagggtaaatcagattttggaagacatgttgagagcttgtgctttagacttcggtggaagttgggataagaatctaccttatgcagaattttcgtacaacaacagttatcaagctagtcttcagatggctccttacgaagcactgtatggtcggaagtgccgcactccgcttttgtgggatcaaacgggagaacgtcaggttttcgggatggatatcctgatggaagcagaagaaaaggtgaaaatcattcaagaaagattgcgtgtggcccagtctcgtcataagagttatgccgacaatcgccgcagagatttgagttttgaagaaggagattatgtgtatcttcgtgtcacgcctcttcgaggagttcatcgtttccacactaaaggaaaattggcaccgcattttgtgggaccttataaggttgtcagtagaagaggagaggtcgcttatcagttggagttacctcaatctttggcaggagtccataatgtgttccatgtgtcgcaattgaaaaagtgtttaagggtacctactgaagaagctaatcttgaacagatagaagtccaagaggatctgacctatattgagaaaccaatccgtattttggaaatagatgagagaagaaccaggaatcgagttatccgtttttgcaaagtccaatggagtaatcactcggaagaagaatcaacttgggaacgagaagatgaattgaagtcagctcatccgcatccgttcgccagttcttccgaatttcgaggacgagattctgtttaagggggtaggtttgtcacaccctgaaaatcctaaatatacaaattgttgtttaaatggaattttcagaatttattttaaaagcctagaagagaagatctaattttaattaataaattacaatataaaatggggccagataaaatttcattaaatactttgcttaattctataattcctagatttttctgggatttatttgaactaaagaagtatttttaataaatggaattgcatttcatgaataatttaattgaaaaagttttttttaaaagtctcttttggctttgggccgaaagtcggcccagtccacagccgcagccgcccgcgcgagcgctcgctgtcgctgacaggtgggtcccacctgtcggactcgtcgtcttcctccggccgccgccgcccgaaccctagccgaaccgcgccgtcgtctccttccaaattcggccgcgcctttccttctccggtgaaatcaattgaggggaaatgtttcccgagatctcctctaccttttctcttttggaatcatcctctaaaacgctttggaaatccgtggattcgagttcgattcggatcggtctctttcctccgagccttaactttccttctcgtcgccggtcaccgtgggccttcgccgcagccttccaacccctataaaaggatccccaagcccgccgctacccgtcgccaccctcgccttcatctctcgtcgctggtagagtcctagcctcgtgagaccttgtgccgcagtcgtcgccgtcgctccagccgtgcttcgtcgttgttccagtcatcgccgtcgctcgggaaggtcgccatcgtggtcgccgtcgcgtcgccttcctcgtccaccccttcgccgtcgcggaagaccgccggagcatcgccgtcgtcgtcaagccaaaggactccgccgccttttcctcgacgccgccgccgtccgttcattttccgccgctgttttggtcatcggtgagttcgccgcgtcgctctctacgtgctggtgccctccgttcgcgtcctcgcgctgtcgttcgccggtgagcatgcgcgcccgagccgccgccggaggtgacgtcaccgctgacgtcatcgtggccgtctgccgtggcccggtcatggaccgttcgatctcggccgtccgttttggataggatcgatctcggtcgttcgtttccgtgagccgccgccgtgcacccggtccaccgcaaaccctagccgctgacgcaataattcccttttccttttcaaaaataattcattattgcgtcataattcaattaaaatccatataagtgttttaatccgatttaatctttaaaaattcataactaattcatcttagctcgaatttagtgggttcaagtctctaaatttttctaaaatcgagatctacatgttaaaaatacccacatgtactgttcatgcttgtttatgtgctgtttggtgattttgctcctttctgtttagattccgacgtttccggagagtccgttttcgcaggggaagattttgaagagttccaaggccagcaaggcaagtcacacagatcccaaacaaccctttgagcatgttgatcccgtttaaagctactgtttctattcaactattgcatttattttcgaatgtcattgggtggaattaacctattgtttgttatagccctttttgttcttgattactttattccttgataccttgggttattataacttgactagttgggctatatatatattggttcagctagatattagatatgattgcttagccatgcttagaaacattagcacacttttgggttaacttatgattcactattatttaatgatggcttaatgatagttcacgatggtcaatcgtgattggttaattaattacttgccaactaaaacttgataatagtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggttgctggggagtccatgccttgtttataagggggtgattatgatccaggaaaggtgccctgtggtggattgtgttgtgcgaggggtattgtcacagctcctttccgaggtactgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacctctcatcataataaaagatgctataactggtaataatttgtttagctcctggtttggaatggtatattcctggtttggagatagatctgtacagccgggtatggttgttcagaatggttgggcctatacaacagggtatgttatatagcgttggattaatattgtttaattattacttaactgttttattaaattctgaaatgtttattaaatgctgtttatgcaaatgaaaccctactatgccatcctttgttatcctgtgcacttgcatatttgatgcgtgacttgctgagtatgtcatatactcaccttgcaatcattcatcagaggaagagttctacagtaaagccgatagtgtggaggattaggtgtagccctggtcaagctgtctgtggagtggagccgtctgcgccgtttatcttttttttccgctgcttagatcataattgattgagaggaattatctacctctgtaatgacattttattcgcttattaattagagtaataattgtactctattatcaatttgttattgtgtgtctcggctgattcctggacgagggttcacacacatgtaagcgtttggaattttggatagaaattccgggcgtgacagtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgtttttaattcttaaaacctgcttaacaactaaaatgtagaatggttggcctgggttggcttgggacgagctgggacccagggtcgggttgccagttcggtctgaatcatcgtaggccttgggttaaggcaggttcgtgtgagttcacggccttgattaataatcttgtatagctctaggactgtgtttacaaaatagctttgagcaactaagtgtcttttagtgctgtttactgcaaaccctaacccccctatattatggctcccttgtactcccttgcatttattctgcacttgtgggtgtgtcttgttgagtacggtggttgtactcagtcttgctcaatttttcccaaacccagaagaggagcccctggatgatgaaggctttggtgtctagctcgtgcctgccgtcaagcgcctgtggtcgtcgccctagtcttccgctgtttcccgtttgtctttgtgtgtgctgggccttcgccgcccatgtaataaagtaaccatttacgcctccgcttgataaactctgaaatgtatcaacttttggtgtaccttgcctcctgggacaaggaataatacacacatgtaaggaacgcccgttgggttatttccggtcgtgacatatttctccgtatttagccccggttgtatggttatgacgggctgtcgtaaagaactcggcagtcaggggtggctcctcgaagtaccaggagggcatcggaaagagggtattagctagtatgttggttaactagaatgtatgtatactatgtatattagaagtatagtaatagattatctttctattttcttcctacctagcttagataatatattataagaatgagtagcttatgcttgtgtgttactctacccttggattatcttaacccatgcttagaatatgattatcacaaataatatataaattgttagtcaagttctctctatatgatcttcccacgggataaaataaatacaatacccttggaatactctcgggtgaaatgctacaatggtatatccgtgcgcttgcggatgaactctgtaaccataatataccagaagtatttgtgtgccattggtgggaattatatttctagtaatgtcgttaagaaataccaacagaggggagaattatacccgaacgagtaagctctccgcagccgcgcaccctacgccgaactcattatgctcggtgatgggactagggccaccagatggcgaaataatctgccagaccccttcaacaaagggaccgatctccggtcggggaggtgaagtcggcagagacaaactggggcgcggtgagtgtcatatcagacactgtcatttagatcgccactgcctggccctctcgctggcgactcgccgaaggcaatgtcacagccccaccagcgccagaggctttcgccgtcgccagttgcaatgcctggtccgaagcaacagcgttggccgaagtgctgcccccggttggcgcgtcggcatcactagcaggcagtggagacaggagcctcttttgtggaggtgggtgtcgtggcgccgacgaagttggcatcccatccgaagatgtttcgctgtccgagaagccaccggccacctgcaccacccctttcttcttcctttgggcggcggcaccggccttcgacgacgagccagtgatggttagcaacgcattagcactagcgatgttttgaggacgcgtgggcgaagcgctagagccggccccagccttcgcccgaacagggcttggggtatagccgtgtgacccagcatcgtcgtccgacccgtcttccctctcatcgtcgttgtcgtcgtctgcgttggtctccacggcgtccttggccactcgccgagttcaaacctggcttctcttggccacgtcgcgcttccacttttttgacgtcccaacgtcgtgatcgactctcgcagggttcgcccggctggctagcgtgccgtcgtagacgcgattcgcctgtccattggactgttactgaagcaggcgagcgtactcggcggtaattaaacccccgatcattttcgccgactcagctttggcatcctccagcaaacgaactaattaaaaaggggaaagatgacaaaaattatataagcccaaacaagccccaagatgtgagatatcgaaggaggggagggaagcttatgattgatgccaggaggaagcacgaggcgggaaagaccgagcacttcttcaccctctgcggtagtaatcccccaatctcgcgcgaggggagaaatctgtagcatgcaaaatttttcgcagaggtcgcgggtgctcaaccgatgcgcaaccttgcgaagaaggatgagccgtgcctcaagcacgccatcaacatccacgttcggcttgatgatcatggcgatagaaagacgccggaagcgaagccacttcgccttgtcatcttcggcggaatcgtctttggagaagtaggggttgtcgatgtagaaccatttttgcatcgaattgcggtcccactttgccatcgacacaaggacaggccatgcatccgagcgctttggccgaagcatgaagtttacactgccaaaaacagtcttctttggccccgccagagtgttgtcgtccttggtcgccacgcacaccatgaacagggtggcgaagagctccgcggtaggagtaaatccacacgtccggcacatccagacgaacacgaccaagttgagaaatgccgatgggctgagctaggggagcttgatttcgtacaactccagcactgatggcagaaagttgtcacatggaaggcggagcccggcggtgaaaaaggcggcgaacaccaccgttcgcccgtccccggtcgaagggacaacgtcttcgcccgcacaggacacctggcgctccgcaaggacgctggagaggacaagctcggccaggtcggcctccttgacaagaaacttgccaaggtagcacgaccaaccatcgctgaggctgccagggtcttcgccagacgatccggccttagtaggcttgcgaggagccatcgaatccgcgatgaaagaggtggcgaagacaggaggcgaaaagctagagcaggaatgatagggctgaaggcacgagagtctgacagcggtaaaaacgagaagtggggaggagtgatagcgacctgggatgagggttgtatagcccgatcgcacgacggttcgactcccacccaaccacagcctgacacatgtcaaatggtagacggaacggtaaattcccatcgagccgggccacacagtggcaggctagaaccaaggaaaaccaagaggcccacggagcccgatactgttcactttcaatttcaaaccacctaaccatttcgccataacttgggcgaaataagaaaagattactaacacaggaactaagctctttgtaggtgcaaaaggataggtttcagtaggaacatcggccgaaagggggcgcctcatgccataccacacaatttgcatttgcacggtatcggccgaagctccctacttacccttgcccgtgaggggcttgttggaggtataccacgagggccttcggccagacctgccgaaaccgttgtcacaccctgattttcgtcttaggatttataaatcatttaataaattattaatagaatttatattaaatgttcattaatttacaagtgaagttaattgtgggaaataaaatttcctaaatataaagcatggatggatttaattttttattaaattctccatggttaattatactctctggaattttctcggattttttcggagctcaattcctaaatgatacaaagaacagttcagtaattatttgatcaataatgatctaattataattgttaagtgcttttcttgcttaaaatccttaaattataaattgttgtttaaaaggaattattagaaatgattttaaaagcttaaaagagaagatctaattttaatttgctaaatctcaatataaaattgggttagataaaattttattaaatactttgcttgttcctctattttctagaattttctgggaattgtttgagcaagggaagtatttttaataaatgaaacatcatttcacgaattattttaattggaaaagtttttaaatcctcccctaagtcgttgggccgatttcggcccaactcttctcttccccgcgcggccgaatcggcccaagccggcccagccgacgccgaccgcccctcctcctcgggtcaccgacatgtggggcccacatgtcggacccatcttcctcctccagccggccggctgcaagccgagcccaagccgtcgcccgagccgccaccttgcgccctcaaatccgcatccaatccggccctttttcttccgtttgtttgaggggtttttatccccacatcctcttctatctttcccctcaagaatcggagcaaatcgttgggtattttgcccgaatcaaactcgttttcgagtttatccccaaaaaccgagtttagattttcccggagcgatttcttgcgggtggagtccgatctcttcaatccaaggctataaataggaccacctcgtcgccctctttcgtttgccccctctcccgtggtctcccgtgcatcgtagctcgccgtcgacgtcgcttagtccgccgccgccgccggccgggttgcagccgcgccgccgcgtcgctttcgccgttgccgccgcttgccgtcgccgcccgtaggtgcgccaaggggtggagaagcctggccgcccgtcccccttcgccgccggccaccggagagccgtcgccgccgttcaaccgagccgccgccgcctcttgcgtcgtcgccggccgtcgtcggttgtcgtgggacgttttggtgagtaccatcgggttcgtctcgtcgtcctcttcgcgtaggtgcccttggataggccggccgacctctctatcgccggcgaggtcgtctcccgtgtcatgccggcgatgatgacgtcagcatgacgtcatgattccttttttccagttttttctaatagattaaatcttctgaaaatcatatctaaataaccgtagctccgtttcaggtggttcaagttactaaatttttctaaaataaagatctacatattaaaattgtccataaattgaattaaatctatttaattctttttaaatgggctttaattagatttaatcttgtaaaatctataataaattcacttggagtcagaataaggccgttcaagtctcataattcatctaaaatcatgatctacatgtttgttacctttatatgtattgtttatttgggtttttattagccttttacttcgttttgcgtgttagcttgtcgtttccgtcgttgagaaggtttgtgagtgcgtcggaagtgatcaagaagattaattgaagatcgattattgcaaggcaagtcacagatcctaaacacaatcctttgagcatgttgatcctatatttaaattctctatttatttcaactgtgcatttattttcgaatgtcaccgggtggtgtgaacctattcctttgttatggccaatttgcattgaatgctctattccttgataccttgggtaataaattgattagcttgaaccttgtatattagattggttcagctaaatgctatatgtaagtttgcttagctatgcttagaaacattagctaactaaaggggttaattataaactatgttatattattattattaattatggttacattaaatggtagctcacgatggttaatcgtgtgatgttaattaattgataattaaaatctggttaaggtgggttgtgagcatatggttttgatggttgtgctcatgacaattaaggaccggttcgcgagctactgttgtgaaacatttatcgtgccaaccacaagccaccgtgggcaacagctttatcttttgtatagcgtgattcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccatttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttaatatctggtaataatttgcttagctcctggtttggagttagatctgtacagccgggtatggttgttcaggatggttgggcctgtgcagcatgggtgtgctgttcagtgttgattaaaattaatgattaattactctactgttttacttatcttaaatctttgctaaatgctgcttttgcaaatgagcctatattatgccatcctttggaatccttgtgcacttgcatacttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttctttgtaagtatgtaacgttattattatgatggatttgtatattaaattgtcagtttgtgtacctcgactgattcctggacgaggattttatgcacaaattagttcggaaattactagtgaatttccgggcgtaacaaccgtccacccaatgaaggatcaagccagaggcgtcaacttcgacaaaggcgaaggcacacggcgaaggctatgcggcgaagcatgtgggcgaagatcaagggcctggctccgagcttcgcagttcgaaagaccacatgggcaaagggtatatggcgaagggcatttagcgaagcatatggacatcacccaagacgggccctgggcggagaaggcccaatgggccactatgcgcccgggggccctttcgccatggctaggccaagcttgttggcccgttaagagcccatatatgtaaaggacacagtatgccctcaataatgtccctatcataagggcaaccatgtaaaatcccctataatcataaaccctagaagaacagagcctataatagggttataaatagccccctaaggccatgtaatggggggatccccaaaaaatttctaatcaaccaatacagtcgtctttatttccaacctgttgagagagccacgtcgttcgacgtgacgcagttatcgttcgacaacaaaaactaagcaaggaaatagaaagtggtactctatgatctgttctgtctctcaattgcctaaggtggtgacaagcgtgtattccacaaatgttagtcgtaagggtaagcctccgtgcatatttaattaacatgagagagagtactcaaactgtgcgcttgtacattttagatatacaccattgtagcaactcctgattaacaaccaagtttttgtttccctttcgtcctttactcgggacgagcaaaggttcaagcttggggggttttgttgacggtcgttacagacaaatttcgaccgtcaatataactaaaataatggagaattagctatgcttacaatgcattttgtttccaaatagtatatatatttccacttgtacatggaaataacatgttacaggaatttatcaaataaaataaagagaaagcggagaaaacctcactcctaagcaatcaaatggataaggagggcccacatgtctggtgtaaccgccagaaaccgctttaactgccataaccacctaaaggacccacctgtcagtgccctgcccgaagctagaggcctgctgggccggcctaagttcggctgaactgccgaaccctaatggcgacggctcagcttggccctccacgtgcacgctccaaatcgcatactaatgacggttacaggggcaaaatggacaattcgcatagctacaaccgtcataaatacccaataaaaggaggagctcattcactctctcaacacactcaagcaagctcaaattcttcttcatactttagtattagtagtatagtgctaagcggagtagagtagattagtattcggagtcctcgaggtctccggaagagttttggtatggctctagcagctcttgtattctcttctgtaatactttccgaattaatgaaatactcatttttatacatcttcggtattttgttcagtctgagtactggtcttacattatatctgtgttatattaattatgtgggtagcctaccagagaggtgtaatggtgcgggtttaatgtctggtttaccagttgctctatgtcgtgtgcgcgggtatagagtagtatttagtaatgtaagtgtggtacttagattattaaatatcattaattgggcatatatgctgcgggacagtagaggtgggccgctgatggtgatagctcagtactggtattcctccacgttagtatatattcctaagacaaattcctggggagggtactcctccgtatttagccccggttggacggccatgataggttgtcgtaaggaactgggcaacccggggtggtctctcgatgtaccaggaggacactgtaggggggtattggccatatgattgtatattagcagatgtaaactaggaattgagtgtatgttagaagtatagtaattgagtgctttctattttttcttccacttagttagaattattttattatgaggagttgaatagctttgcttcgtgtcactctacccctatattaaaattaacctctgcttagattttgataaatacaaataatgtatgtataaagagtattagcatagtctactcatattatcttcccttggaattaaaaatacgataccttggaatacttccgggtgaaatgctacaatagtatatccgtgtgcttgcggataacttccgtaaccataaatataccaggacaatttctgcgccattgctgaacagtgactactgtgacgacatgggtatcaagctctgcttcacctcacccgcccaccccaagagcaacgttcaagcggagcgtgccaacacggaaatcctcaatggcctcaagacgaaaacttacaacgtcctcaagaagctcggggactcatcgatcttggagctgccggcagtgctctaggccgagccgcgcaataggagaaactccatgtttcctcgtgcacggggctgaggcggtcctcccatccaagctgaccctggggtcaccctgggcatcactgtataacgaaaatgatcaagatcagcttcgacacgacgacctcaactaccataaagagcgaaggcaacgtgcagcccttcgggctacccgttaccaacaaagcctgcggcgctaccatcagtgcaacgtccgggcctggtcactgcaagtcaaagaactcgtcttgtgccacgtcccaacgcgtgcaagattgagcaaactctcacccatttgggatgatgttgagggtcgttagcgatcaatttcgaccatcaatattatcaaaataaaggagaactagttatgcttgcactgcatatccatgttagaataacaatattccacaagtgttaggttcattaaccttttgcagagaacaaccataaagtggaagagaaccgatatcaactcaaacgataaattaattggacgatgtcgagaatcagacttatgtccgaatgggccaagaactcagaattgacacgatcaattgggccaaaattcacaagtctgcgaagagaagcaacagaggaggcagccagccaaaacctgggctggttgggccggcacctggttcggccgaacccccctggcgccgttggatgcagggtttcttctagacggcgtggatcactccccaatgatggttggagggcagttccgaccattccaactgccacaaccgtcattggcagcctatttaaggagctcctcttctctctccacacacgcacctcaagcaagagttctctcatattcactcaagatagtttagtagtcttaagctagtggagtaggaatagagtagaaatcggagtccggaagccttcagaagagttcgggtatggctttagtagctcttctcttctctttagtaagctttgtacttttattagaatactcttctttatacatttatggtattgaaatactttccgagtacatggatgccaactttacattatgttcatgttatactgattatactattagcttatctcggagatgcatcggtacaggtatagtgtttggttatgcaattactctatgtcatgacaatgatattagagtagtatctgttagtttaggcgtggtatctagattgggggatatcattatttggggttatatgctgcagatgagcggtgggccgctgatggtgatagctcagtacgggtattcctccgcgcgtgaatatagtcctaagttaatttcctggggagggtactcctccgtattttgccccggttgtatggtcatgatgggctgtcgtaacgaacttggcagttaggggtggcttctcgaagtactaggagggcatcggttcgagggtattagctagtatgtcagataactagaatgtatgtatactatgtatactagaagtataggaatagatttcctttctcttttttttccacttagcttaggtaatttagtatgagaatgagtagcttcctgcttgtgtgtcattctacccttcgattatcttaacccctgcttagactatagttattacaactaacatataaattattagtcaggttctctctattatgatcttcccatgggattaaataaatacaatacccttcgaatactttggggtgaaatgctacaatggtatatccgtgcgcttgcggatgaactctgtaaccataatataccaggagtatttatgcaccattgctgggaattatatttctagtaatgtcgtttagaaataccaacaagcatttctggcaccgttgctggggaagatttgtaatagagattaccataactagtactttatattttcctctgtataatcactgtcctttgcaggctaaccttggttgttttcacttttattatggaaacagggtagtgcacgactggttttaagttgccagaaaacttcaaagaaaatccagaagctttcttctggagcgtcaggccgcgagtcgctgctcgacagaaaactctaccaacagagaaaccagccgtaccagcgtcaccgaccttcaagactatgactaacaagactctccgtgaattcgctgctccctctgctgacaatgtgaccattgggccacaaattaacctgggagacgtggattttgatttgaagtctagcctcatcacgatgcgcaggctagccctttctgtggcaaccaaatgagaatgccaatgctcatttacagtagttcctagagatttgcagcacatacaccatgaagggtgtcagtccaaacaacgttaggctacgactgtttccgttttctctccttgggaaagcgaagaagtagttttatgctaaccatgctacgatcaatacctgggatagatgcttcacgacattcctctcaaagttctttccgatgggcaaaaccagcgcccttcgcggaagaatttcaagtttctaggagacaagggacgagtccattcctgaggcacgggaacgacttcaagaatatgtggccgcctgtcctcatcatgggatggatgactggctgatcttgcaaaatttctataatggactcactcccatgtcccatgaccacctagacacggcagctggatgagatttcttctcaaagacggttcgaggagccatcgatttgatagagaagatggtctctaatatgggttggagcgaggaacgactccaaacccgtcagcgaggcatgcacaccgtcaaggagatggaaatgctcgctgccaagatggacctcctcatgaaatgattggacgaccatgacaaaaggccacaaggcatcgtcaaagccttggactcacacgttacatgtgaagtctgcggcagcacgggtcattctgggaatgattgcccggaaacccatgaattggcgatgtacatgggcaacaacaacaatgggtatcgtccacaaggaggtcaggggtggaatcagccatgcccatattatcaaggagctaacaacaacggtaacttttctaaccaaccctccttgaaagatctcgtttttgtgcaagctaagaccactgatgctttaagcaaaaagctagctgccaattacaagatcttagaaaacattaatgttaagctagatagcttcgcttctgctttccaaaaccagctgagctttaacaaaatgatagaaacttagttagctcaattagctgccttagtacctgcaaatgagtctgggaggattccggggcagcggactcctccattgaaaatgttaaggtgatcaccacgaggggaggtaagtccacttgtgatctgccatatcctaaccctgtaggaactaacaaggaagcgccatctggtacttcagctgacaaaaagattcagctagagaaggttgtgccacaagcatactatgacacgcaattgctgccatttcctcaaaggaacaggaaaccgtcagtggacgagcagtttgctcgttttgttgaagtgatctagaagattcacatcaatatgccgtagttggatgctatataagtgctaacatacgcacgttacctcaaggatatcctcaacaacaagagaccgctcccaacaatggaggtggtcaagctgatggagcagtgcaacaatgccatactccacaagttcccggaaaagaagaaagatccggggtgtcctacgatcacctgctcgatcggggcacaacagttcaaccaagccttttgtgatattggagcaagtgtcagcgtcatgcccatggacgtctttgaaaagctcaacttcacgatgttggcaccaacgccaatgcacctgcagctggccgactcattagtccgttacccaacagggatagcagaggatgtgccggtcaagatacgggattctttcatcccagatggtttcgtggtgctggacatggaaacaggaaaggaaacactgctcatcttggtgcatccattccttaaaactgcaggagccaacattgatgtgggaacgggaagtatccgtttccgtattaacgggaaggaagagaaatttgagtttcagccaaggactaaacactgctccatggtcagaatcaagtacgggccaaacctacaaaatatcctggtgaagttcatgcaaaatttcctggaaaaggaaaccacgtttcccaggaaccgttattggaacacactggtaaaacctagtgttccggccaagaagctagagcagccggcttagaagaagttgtctcccgcaccaaagccaaagaaggtgtggaagaaaaagccaaaggcgcccgctccatgacctctagagataggttgaaaatccgcgaactgaactgaaaggaggtacgatcttgcacatcggacctaaaatgacgcgaccttcgccaacaggtaaattggtatgtatctgcacatttattttcatcaacttgaatttttgcattaacacatgtttggatttcaaaaaaaaaatcgcatttaggatttttgaatttttgagcaaaccaaaataaaattttcaacgaaaatttattgtgccacgaccacattgaccgttgaaacccaacggccaaaagtgcggccggttgggcccacaggggttcggccgaaccggccaggcaacggttacatgccacttttggcagggtaacggctagtgggtcccacatgtcatttctaaccattgtaggtgtccaatataagccagccagccaagagagggaattccatcccatttcaacacattttcattccctctctaaagttttctctcaagttcattcaagctttgatagttttccttaaattcaaatacttagttgcatacatacaagttgctttggtgaaactaaccagcgggtgaaattcttgctattctaaccctcgccgagttagtccgttcttgctccattgtgtagaatgaggaggcgattgtctcgtttgttcaaggggtccgactcttcatcaagtcatcatgactagtctatagctcgttcatcagccgatgtctcgatggaggacgccgacgctccgcgacgtctcctgaacgacgccgacctcgatcttgtcgacgatcgggaaaga

SEQ ID NO: 81860 - DNA, 860 bp, Oryza sativa
ctggtaccctccgtttgtgccgaagtgccgccgttcgccggcgagcgtgcgccgcccgagccgtccgctccgccgagccgccgccgctgtcggtgacgtcattgccgacgtcatcggggtcgtccgccgtgagccggtcgtggaccgttcgatctcggccgtccgttcgcgtgaaccgccgcccgtgcgcccggtccaccgaaaccctagcccgctgacgcaataaaccttcttttccttttcaaaaataattcattattgcgtcataattcaatttaaaccgatataagtgttttaatccgatttaatctgtaaaaattcataactaattcatcttagctccgatttagttggttcaagtctctaattttttctaaaattgagatctacacattaaaaatatccacatgtactgttcatgcttgtttatgtgctgttttggtgattttgctcttttctgcttagattccgtcgtttttggagagtccgttttcgccggagaagagtttgaagagttccaaggccagcaaggcaagtcacacagattccaaacaacccttggagcatgttgatcccgtttaaagctattgtttcttttcaactattgcatttattttcgaatgtcattgggtggaattaacctattgtttgttatagcccttttgttcttgattactttattccttgataccttgggttataataatttgactggttgaactttatttatattggttcaactagatattagaaataattgcttagccctacttagaaacattaccacactattgggataacttatgattcactattatttcatgatggcttattgataagtcacgatgggtcaatcctga

SEQ ID NO: 81861 - DNA, 15623 bp, Oryza sativa
cagtggtacacctctggccagagtaaaactattcgaatagccgtgcccgcggttatggcgagggtctaccaatgttattcgtgattagtctcacacctctcatcatgataccaaatgctataaatggtaataatttgtttagctcctggtttggaatggtatattcctggtttggtgataggactgtgcagccgggatggttgttcagaatggttgggcctatacaaattgtatagcgttggattaatattgcttaattattaactgctttattaaaatctgaaatgtttattaaatgctgtttatgcaaatgaaaccctactatgccatcctttgttatcctgtgcacttgcatatttgctgcgtgacttgctgagtatgtcatatactcaccttgcaatcaatcatcagaggaagagttctaccgtgaagccgatggggtggaggattaggtgtagccctggtcaagctgcctgtggagtggagtcgtctgcgccgtttatcttttctttccgctgcttagatctttattgattgagaggaactatctacctctgtaatgacattttattcgtttattaattagagtaagaattgtactctattatcaatttgttattgtgtgcctcggatgattcctggatgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatggcacatgtatttcataatatttttttagtggttctcattcaaaatttattccagtgttattagtactgtactactggctcatttaccagcaaaagttttacaatattgttttatttaatcttgctgcaatgaaataaatttagcatgttgattttataactttcttttatttcttttgaaacctgttgttcaaaagtacaaaatttgtgaccttatttccaactatttcaacttatcctgcaagcttggtttactttatttacttaccttttactttgattttctaactttactcaaattaatccaaaaacttgtgctattaattggataaatgtcttaactccctcctttcacttgtctttagatgccgcgctacaagcctgagtacctgtttggtgttgagggttttgtccaggagttgcgtacgatgtcctttgtcattggatttgggactgcccctttttatgcccagattcctcatgatcgtcatgaagagaagtgtcgagtcaaagtcactttgaacagtaatagtgaagaggtcccctcagtaatgttcgaagctggaggaagaaactacatccatgcatgtcaggaggtggcaaggatcgccataggagagctccgcgatcgctacagtgatcagttggccgacactgagtatcgctaccatcctcgtcaaccacagggaagtgaccgtggcagttaccttgagactgaaggaattgaaaatgatgctaccacaaggcatttggttgagatgttgtgggctatggatgaaagtcgtgcggagactgtgttagcagctcaagatcgtgaagaccggaatcgtggtaagatttgcaagctcgaagacaaggtggatcgtttggagaaggaactagccgcattgaagggagaagcaccgccgcagaaggccaggattcgtctcaccgcaaggaagagagctctatttgtccctcgctaccaattggcgccaaaggttcgtgtggtggagaaagaagttgccccaaccttagcagatcctccgatcatcatcataagtgatgatgaagaagaagaatccaagcgcacccattccaagattgagtgggtagcaactcaagatgatgaagacgagcagaacgagccttcaatcgacctccgatgctcggaagaactagagtgacttgttaaatcgtggtcttagatcgttgtgttagtttgcttgctttaagtttgcttgtgtgtgggtcgcatgtgatttacatcagtggtgggatgtaattgcatgtgtttgtttgtttttgagtgttaggtgcttttgagtgttaggaagttggtgagtttagtggtgtgggagtcttcagtttgtaataataaaactcagttaagatcaataaaagttaaagtaattctctatcctaagtagtttcccccgatttctcttcttgtgccctgccagatggtgaacactcgcagcaacgggaatggccccagtaacaataacaatggagagaatcccactcttgctcaagttcttgctcaacagacacagctaatgaacatgatgatgcaacaactccagaaccagcagaaccaaggaaataatcatgtacctcctcagaataagttagcagaatttcttcgtgtgaggccgcctgttttctctagtaccactaatcctgttgaagctggtgattggctgcatgccatagagaagaagttggatttacttcagtgcactgatcaggagaaggtctcatttgcatcacatcagttgcaaggccctgcctctgaatggtgggatcacttccgcctgaataggattactgctgaacctatcacttggcttgaattcaccgctgctttccagaagacgcatataccatcgggagtggtgtctctgaagaagaaggagttcaggtcgcttacccagggatctcgctctgttacggagtatctgcacgagttcaatcgtctggctcgttatgctccggaagatgtgcgcaatggtgaagagcgtcaggagaagtttttggaaggacttaatgatgagctttcttacccactcatgactggagattatcatgatttccagaagctagtggataaggctattcgtcaggaggacaaatacaatcgcatggagcagaagaaacgtcggattgctcaattcaagacacaacaggggaataatcagaagccgcgtcttactttaagaccccagtccatgccacatggaggttcttcgtttgttgttcgtccgcagcgtcagttcttcaacaacaatgctggcaacaacatccgcaatcaagctccacgtcctgttgcagctccaacacagcaacaacctgccaagagggagcaaggcagcaagcccgtggtgtgtttcaactgtggagacccaggacattatgctgacaagtgtccgaagccccgacgcgtgaaggttgtccctacccagagcaactctacggtaccagcatcaaaggcccgtgtcaatcatgttgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcatcgtagcccctctgtcagaatagaaattcaaggagtaccatttctggccaatcttatcctgttagaatccaaagacctagatgtcatcctagggatggactggttagccagacataaaggtgtgatagactgtgctaacagaaaagtaactctcaccagcaatgatggtcgagttgtgactgtttatgcattgtcttctgagtctttaaggtcaagattaaaccaaataactttggaagagattcctatagtccgggagtatcccgatgtgttcccagatgatttacctggtatgccgcctaaaagggatatagagttcagaatagatctggtaccaggaacaactccgatccataagagaccttatagaatggcagccaatgagttggcagaagtcaagaggcacgtagatgatttgcttcagaagggatacatcagaccgagttcatcaccatggggagctccagttatttttgtggaaaagaaagaccatacccagagaatgtgtgtggattatcgtgcattaaacgatgtgactatcaagaataagtatccgctacccagaattgatgatttgtttgatcagcttaaaggtgccactgttttctccaagatcgatcttcgatcaggatatcaccagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactcccgaaccaaagaagagcatgaagaacatcttcgccttgcattggagaagctacgagaacatcaactgtatgctaagtttagcaagtgtgaattttggttgtctgaagtgaagttccttggtcacgtcatctcagcaggaggagttgccgttgatcctagtaatgtggaatccgtaactaattggaagcaaccaaagacagtttcagagattccagttttctaggcctcgcaggatattatcgaaggtttatagagaatttttctaagattgctaagcccatgacacgactgcttgtcacgaccggaaataacccaacgggcgttcttacgtgcgtgcattaatccttgtcccaggaggcaaggtacaccaaaagttgatacaattcagagtttaacaagcggaagcgtaaatagttaatttattacatgggcagcgaaggcccagcacacacagagacaaacgagaaacagtggaagactagggcgacgaccacaggcacttgacggtaggcacgagctagacaccaaagccttcatcttctaggggctcctcttccggggttgggaaaaattgagcaagactgagtacaaccaccgtactcaacaagacacacccacaagtgcagaataaatgcaagggagtacaaaggagttatactataaagggttagggtttgcagtaaacagcatttaaaggtatttagttgctcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgataagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccatggtatacagacggaagacgtgacatagtttccaacccatcctagccatagacaagagtaccgacccgatcccacctacggccggaacccccgggacaggcaggcaggactgagcccctagcagcaggacaccggccctgtgccatgacatctcgactaccgggccgcagctcgtgtagccttcatttgccctagagatgtcacccccgacttcgtccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaagccaattccacaacaaccaaaccattccaaagtgtccaggtgatatgaatattcccaaagtctagagttgtaaaccgcctaatgttacctaattaaattgcgaagcatctacctaaaattatactagtggtactatgagtagagtgtccactagttggggttttgtttattctagggtgaataaggtaataataacaataacaataataataaggtcataacaaaggtaaataggcatggctaaataaaacagtgataacgcgggaatttaaataaagcgataatgcaataatttaaatcaacctaattttgtaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaaccccatataacaagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaatttaaaatcggatttattgcgtcagccgaggggaggggcgcgcggaccgggtccacgggagtggggcccacgcagcagccccacggtccacggtggaccgggtgcacgcggcttacgccggccggcgccgtgggtcccacgcgtcagccgcacccgagggcgcgggcggctgacggccgggccccacatggcagccgcgggacgcgcccgaaggcggccacgccggcacagccgacgggaggcggagcgcccgcgcccctatggtcgccggcggcggccataggcacggcggagcggcggccgagagaggggagggaagggggaagcgaaacagcggtccacggctcaccccgggtcgacggcgacgacgggaatggcgaccggagcggaggaaggcggcggcgcggctcgggttgccggggacgccggcgttccggtggtcggcgggcgaaacggagggggtgacgaggtcggcgaggtcgcggcgaacccgaaggaggcgacgccgaagcgggagaaggtccggagcgacgacggcggcggaccggagctcggcggcgacggcggagagagagagcgacggcgcgggctcgattccgacggggagagagagcggcgagtggcggaaacggtggaggaggcacggggagtgtttatatagggttgggagtgagagagggcggccggaggagaaggaaaccggcgcggcgctctcgggctccatcaatggcgccggcgagatttgcgggagcaaatccgcccgtttgaacgagagagagagagggaaaaatggggggaaagggagagggaatcacggggagtgatttccccctctttattgcgcgcggggacggcgggaggcggcgggattcgcggcggcagcggcgctagggcacgggcgaggcggcgggagcggcgcgaggtaggggatgacgggtgggccccacccgtcagcgagggtggcgggcgggcccgcccgtcagcggcgcgcgcgcgggggaaggcccgatgggcctcgggggacaggacagagacggagggagctgggccgatccggcccaataggcggagggggggggggaaaaaaggacttttagggtttttctttttataaaaccattttaactttgtttatttcttcttaattattatttgtgctctgaaaattccactaaaatttatttacgcattttaggcttttaggaaatatacaaaaatcctccaagccttattcgacttttaacttcgcacattttaattgttggaggctttcacaaggattttacttcttctaagcataattttgaggatgtgttttagagtcgttttgggacgcgacaaacctacccccgttaaacggaatctcgaccccgagattcggaagaactggcgaagagatcgggatgggctgccttcagctcgtcttcacgctcccaggtagcttcttcctcggcgtggttgctccactggaccttgcaaaaacggattacccggttcctggtcctgcgttccatggtgtccaggattttcactggcttctccacgtaggtcaagtcttcgcgaacttcaatttgctctgagtcggcctgctcggatggcactcgaaggcatttcttgagttgcaacacatggaacacatcatgcacgttgcccaaggaggcgggcagctccaactggtaagcaacttctccgcgtcgagcaatgatacggaaaggacccacataccgaggtgcgagcttcccctttgtctgaaacctgtgtacaccgcgcaagggcgtgacccgaagatacacaaagtcatccactgcgaattccaggtcacggcgtcggttatctgcataacttttctgccgggactgtgccacctttagattatcccgaatggttctgaccttcgcttcagcttctctcaggatatcagtcccgaacacttggctttccccaacttgatcccacaatagcggtgtccggcatttgcgtccatacaacgcttcatagggtgccatttgtatgctggcttgatagctgttattgtaggagaactcggcataggggagactcttatcccaggtcttcccgaaatctaggacacatgcgcgaagcatatcttctaggatctgatttagacgctcggtctgtccatctgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgaaaagaaataaacaaagttgaaaaggtttataaaaagaaaatcctaaaagaagtcttttccccctcctcctcccttcttgggccggctcggcccattccctccctctctctctctctttccccccggcccatcggctcctcccccgtgcgcgcgccgctgacaggcgggcccgcccgccgctctcgctgacgggtggggcccacctgtcatcgccttcctcccgccgcgcccgccgccacgcccgtgccctagcgccgccgccgccgcggattgcgccgcatcccgccgtccccgcgcgcattaaagagaggggaattactccccgcgtttccctctcccgattccccctcttttccctctctctctccctcggattcgtccggattcatcccgcgaagttcgccggcgtcttcaatggcgcccgagatctccgcgcgcggttctcttcccgggcggcttcccctgccgtgctatatattcgatccccgtgcttcgctcttccgtttccgccgctcgccgctcgctctcgccgtcggtttcgtgcccgcgccgtgctcctctctctccgccgtcgccgccgacctttggttcgccgcagacgtcgctccggtcctccgcccgactcggcgacacctcaatcggcttcgcagagtggttgccgaccccgtccgccgctccgcttcgcccgccgaccgtcggagcgccgccgtcatcgtcatcacgagccgcgccgcagtctccctccgctccggccgccgttctcgtcgtcgtcgttgtcccggggtgagccgaggaccgccgttcgccttcccccttccctcctctctctcgggcgccgctccgccggccgatggtcgccggcggtgaccatcggggcgcgggcgcgccgctcccgtcggccgtgccggcgaggccgccctcgggcgcgccctcgcggctgccaagtgggcccggccgtcagccgcccgcgcccgcgggtgcggctgacgcgtgggacccacggcgccggccgccgccagccgcgtgctcccggtccaccgtggaccgagaggctgacgcgtgggccccacccccgtggacccggtccgcgcgtcccctccctcggctgacgcaataaataggatttttaattaaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtttggagtttattagagtaaaagccttttcttttccgttggccgtgtagacgctgcagcttcggaagatccgctcttcgtggaagttgaagccggcgtttgggaaagcgagcaaggcaagtcacgtcacccttgagcatattgaatcccagtttataaaattattttgatttaaattattgcattatcgctttgtttaaattcccgcgttatcactgttttatttagccatgcctatttacctttgttatgaccttattattattgttattgttattattaccttgttcaccctagaataaacaaaactccaactagtgggtactctattcgtggttccactagtataaatttaggtagatgcttcgctgaataattaggcaaccttaggtggttttataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgtttaataatactgtgtagctctaggatcgtctttataaatggctttgggcaactaagtgacttttaaatgctgtttactgcaaaacttaatccctattattattcccttgtacctcccttgcattaattatgcatccgccggtgtggcttgctgagtactgtggttgtactcattcttgctcaatccctcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttatgaataaaactatttgcgaaagttcctttttctccttcccctaatgctatttgcaaaaggtttactccgttcttccttcttcggattttcaactagtactagatggtcagctttgcgaagaagaagatgtcgtcaattgtttgccgaagctccggaagactgcaggatccgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaaccaattgcttatagagatactacagcagcatcggatgccaattttgaacccgagtcagatgcaacatcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcctccaccaggaatgacaaaacatcagagaagaaattcctcccgaggtgcacaacagttgacagagcatcttttagctaatggaggtagagtgtctggtagtgaagattcagatcaagtctcctcagatgatgaagatgcgaagtctccccaaggctttaaccagaataaaatagaacttaaggcatgctctcgttgtggagaaatcggtcatgttgccagctcgtgtgcctctacatgcgttcattgtgaggaagaccatccacccgacaggtgtccaacgagcaggatcacttgtttcttttgtgaaggaactgatcatgtaccaaaagattgtcaattcagttttctgctgacgaagaagatggccaaccaacccgccagttccaacggagagaagcatcaaggcaacacaaatccccgccaaggtcaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatcccgaagcagtcctatagcccgcgttgcaacagctccaattccaatgaatgcactaccacaaggtgtcaatgctcaatttcagccccagccaccagctgacaagacaggggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcttagcaaccattctctgcatcgacagcctcagcaaagaattgttgtagatggaagaagttgtgtctctccccgacctactccaggcctagccaagggcaatcaacctccggagggcgataccaagcagaagaccgtcatccgcttcaaccagcaatcagaaggaagcttctcctgtgaatgatagcattatgcagtcctatcacatcatcacagaaccaatcgaggatgcagtcactggaacaatgccagctatatctctccagaatcaaaatgagcagccatgtttgtggttttcagtccgctacttatcatggtgtaatcgaaagtttgcagcaatcatgtaatacataaatatattcatgtctataaacagtgagcttgctatgcttatggatgattcatattgagaatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgtataattgtttactgacaaaggagacctagggtctcgtgtcagaggaactatattctaacctcgagttaatagccaacctgtggatggaaaagaaaaacaattaaactgtgttgggttaaaaagctaacgagacagtagttgaggataggagttcggatacgccttttacagatcaagataaggattgttggaggaaaccccgaagggtacccgccatacctctacattgataagatcggatatacctgccaacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcagacaatgtatttccctgaaggtagtcagtgcagcttttgacgaaccacatcaaggtttcaccgaaaggcagcaagccaaaggacctcatcatccccagaagcgtccgcaatccacattcaagaataccacctgttagagataagccgaaagatgattgataaaagagattggcaaagatgttctctagcataaaagaagtaggccgaaaggtgattgataaacagaaacatgctctgcatcgctcaaggaagacccctgattgtaattgccccgcaacagtcaccttgtcattaagtaagcaagatgacctaggtaaaagtgtttctatgaaggcaaggagtgaaatcttcaactcggtatcagatgctacacgaagtgaaaagtgcaagcaccggttaccaggtaatgccaagtcttgggagatgatccaatgggaaagaacacatcaaggttaaaagtgtaaaggaatacgttgaatgctaactgaggacaacctgaagataataatgggaagtaaactgaatgtaaagaaagtgaatccgagctgcttgttcgtgagagccattcccagttatagaaccagtgatatgttcgaagatagtctatagaggtcaggttaaaatcacctctcacaacgaagcctcagatttgacagggtaatgattagacaataacaaatccagcagtaaagccatttgggaagacgtcaaagtataacaagtaggataagttggctctcttgggaagcataattcaaaggtaaagtta

SEQ ID NO: 81862 - DNA, 958 bp, Oryza sativa
cttgggttaaggcaggttcgtgagggttcacggccttgtttaataatactgtgtagctctaggatcgtctttataaatggctttgggcaactaagtgacttttaaatgctgtttactgcaaaacttaatccctattattattcccttgtacctcccttgcattaattatgcatccgccggtgtggcttgctgagtactgtggttgtactcattcttgctcaatccctcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagcaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccaggatgcaccttttggctgactcagactaggttgcggtagttcagtgatgcttccgttctagaacttctcatgattcatatcttcggagtcaacctcggacaagttatcaacttcatgtcatgcgtcgtaacctgcttgtcattactaggataccatgcttgttatttgcttctaactcgccaccaactgcctcatattagcttccctggtctccgggtgatagctacttctgctatttgatgcaagggtcgata

SEQ ID NO: 81863 - DNA, 10136 bp, Oryza sativa
tatacatggtggcggcggcatccaaggctgatatggcggtggatttggcgaccgcgcaggcagtaaacagagagagaaaaagagatggaggatgaaggaaagaggctgacacgtggggtccacttgagggcaaaattgataattcacaccatccatcatccatgcttggcaatcggattattctgcttacgtggacaaaaaaatggtataaaattaagatttcttctctctccaatggtaaattagtatgtgtaaacttaagagaagtacttggataattgccaaacgaaaaaatggcaaatagttaagttttctaccatgggcaatggttctgacctcaataaggcttgagcgacaccacttcgtctcctttctcctccacagccgcccatttgtgcacctggcctacaccaccacttgatccatccttcctctcctctcttctcttctcttccctttgtctcctctatgctaacggcgaagtttggcctcttctccgacaaaggccgagggagctcaagcttagacggctcgccagtcgcctccctcactatcaactcgtaaacggcgcgaggtggaaaagaaagagaagaaagaagtttgacactgatatgtgggcttcacatatatttctttattttttacttctcactttacacgtgggtcatgttttttattttctttttattgattaggatgccacgtcagcgaaaccaaccatccataccaccacattcattctgccatgagatctaatttaacttggtttagggatatgattttaacttcattgcatgtggacttattcccggtcgatatcccattcgaaacatgtgttgatgcgaaaacacacacactggcctgggagatctgcttagctccagtgcagatccaagggttgatgagatgcgggtatgtcagtcagtttgatcctgcaactaacaagatatgtaaacagcagatcaagtagccgatcggttgtcaagccgatgaagtgattccagccgatgccgataccagccgatagtgatagggttttgagatatcggctatatgtttgatgtagagtctgacactagatataaataaagacaatcggctgatgataatataatataacaataataatatctagtggaaaccaatcggttaacaatatgatatgatagaacaagcactgatccgatggttaaagcatatatcggctggaggtccgatgtcataaaatccacaagattagattaaacagtgaaacctctgttgcgatcggctgaaccctacttgtatgtaatccttataagccgatgcgacgtccagataacttatcggcttgcaccccgataaaacactaacatgaacctatcggcttaacaagatttatattatcaacaacagtctagtaggttgaacctaaccgatgcagcacaagattgtatatgataatctaatactcgatgagccgatagatctgtctaatgtgatggatataacaaatctatttacaacagcattgtgattgtagagatatatcggctaagacagaagatcagacctaactgagacagttccaactaaaccgatgcgtctctaaacacaatgcagttagagatagaattgagatatcaggtaggcaaatatatcaaccaaaccagagcgatccaagagatcaatgcgatgcagccttgaacaacaccaacttagccaatagattcacctggcccggtggaacgtaggacttaccccttcgctggagatcgaactgaaccgatgcagccccacgtcaggtgccaaattccgctggttgataagtaaaacctcagaaaaaagggtggcgatgcgctgagaatagttgtattgatcgaaagattgattcacaatgaccctgggtgtacatatttatacccatggggagatactagtccttgtaggacaagaaagaaactttcctaaagataaaaggaaaagataaagtccttatcggacattgaacacaccttcctaaagacaaaaggaaaagataaactattcctaattaatagataaactgccatgccatatcctccttgaatttggactcttttagataaattttctttagttgatcgaactccatcgagaacacaacttctggcgatttgacgactctcatcggctaatgccaggactctgaagccaatactgactctaagccgatgattactctgggcttaccaaatttcactgatagcaacatgttagaccttgtttggctaattccacccacaaaggtctcaatcccctccttgtgggaataaccgaacaagaccttatatatgccataaaagagtcgcaattagggatggcaacgggactgggcagggctgagttgggctggaatggccccagccccactcctccgcgggtccatccagcccctacccccagagtggagggagatttgaaatcgatccccgccccaccctctctggggacccgccacacgacgggggcttgctgcactcgcatgcaaggatgcttggaggaggcggtgcgaccgcacgtcacgttgacgagaggagatggcgaggctgaccggcggcgggtagaggcatgcctgcgtggaggtggagtgagatggaggccgcgcgatggcggttggaggcacggtgacgggcgaaggtggcgcgacgtgggccaaccgatggcggctgtgggggatgggtgacaggagtgggggtagaggatgggggatcgaggaatttgggtttagtaaatatggctcacttattgggtcaactaagcttctattgttggaatggactactttttaagacatatctcatatccagagcccccatcggtttactcgtgtatgactaatgatcttcatccccgtccctagaaatttgcggggccccatccccagtcacccatgggtgagaacccccaccactgccccgtaggggcggcccccacgggatccctggccccaatgtgaaatttgtcaccccaagtatcaatcccgttctggcccatgggccgcacgcgactgtaatcccaagcccacaagggcccatcaggccttcttaagagctccccgcgagtccaaacccgaaacgcgaaaaaacaaaacagaaaaaaaacaaaaaaaaaacatattatttatcgagcaaatgacacaagtttatattggtggcaaccgattactttatcaagtgggtagaggcgattcctttgaagaaagttgattcgggggatgctatacaatttgtccaggagcatattatttatcgatttggtattcctcagatcattacaaccgatcaaggctcgatcttagtgtccgatgagtttgttcaagttgccaatagcatgggtattaaattgttgaattcttcaccatattatgcacaagctaatgggcaagccgaggcgtctaacaagagtttgatcaaattgattcagaggaagatttctgattatcataggcagtggcatactagattggccgaagcattgtggtcctattggatggcttgtcacggttcgatccaagttcctccttataaacttgtttatggacatgaggcggttttaccatgggaagttcgaatcagctcgaggaagacagacttacaaaatgagttggcagccgatgaatattacaatctcatggccgatgagagggcgaacttggttcaatcaagattgagagcccttgcaaaagttaccaaagataacgatagaattgctcgacattacaacaaaaaagtggtggccaagtctttttcggaaggtgaacttacgtggaaattgattttgctgataggaacttgtcacgcccagaaattcacgaaccagaatttctaagctgaatgtgtattaaacccctgtccaggaccagccagggtacacaaacgacaattgttgacatacagatccacgtcttacaaaaatacaaaagattacaaatgcagcgaaaaaggtaaaagcgagctaagccaagacttgactcctgcagcgggcgattccattccacaggcaacccttgacggcagcgacgaaccaaccttttcaagacatctccaactgagaagaacttcaactctggtgtgggggaaaagagcaagactgagtactacccactatactcagcaagtcataccggaagaggaggtatgatgcaggatataaccaaaggaggctacggggttcatttgcataaagcaggcatttaaaaccagtagttgaaaacagtaaaaacagttgtagtaattaagcaatattaaccagtcactgtccaacgctacgccacgttgcaacaggcccaaccaaccacctgaactacaccagttaattaagctaaactaggggtgagactaatcatggtgaatctggtcgaccacccataaccgcgggcatggctattcgaatagttttactctgatcagaggtgtacaactgcacccacaagacacagccccacgacacgttcccgtgcgccgacatgccaccacgacataccggaaagaggccgtgacaggacccttcgcataaccctctctaaccgatcgcaccacaccttagggttcgcccccgtccccagcaggcaacgggcagcccccctttcatgccgcggtgaatccggaagccgatcaaccggacaccccggccgacccaactccatcacgcccaccctcgcctgggtacatcggctagagaaaagctacactacaagcccagccgttacccacgctggcttgtggtaagtacgataagttcttccagggcatcccgcgaaccggtccttaatcgccatgggcacgactagcaaaaccatgcacccacagcccaccatgtagtgtattttaattaaccaacaccattgcggtggcactaatccaaagctattgccaataatcaaagtctatgctttaatgtgatccccttttgtgcactagttgaactaagcttggctaagcatctcctaaaccaatatctagtcattttaatacccaagttatcaatggcgtaagggaaacaacatatagctgagtaaaaggacccatcccacatgatattgtaaaacaatgcaatatttaatagaaatgcgggacatttgtaaattgggtacaatatgatcaattgcaatgtatgacttgccttgctctcgcactgatggaaccacagtaacgtcttcgagaaaccacgaatcgacaaaacgggcgaaatctacgcaacaaacaaaacacacaagcaaaacatgctataagactactgaaacaggaaacaaaaccatttttaatggattctatacatttttatgaatttactgagacttgaatggactttatcggagctcggatgaattagttatgatttttagaagattatctgtgtttttactaataaagaaaaagccttaatgtatttattgcgcaataattcatcccaggactgacgtcagcaaggggtggggcggcgccgacatgcgggccccactggtcaacggctcaagggggagggaggggtactggcaggcggggcccaccgggcggcgactcatggggaaagaaggaaggcggcctggctcggctcggcttcaagccggctggccggttaaggcgagggcggcggcggcaagcggccaccgacggcggcggccggcgacgcgggcgacagtgcatcgcggcgacgagcatgcggggagcggcggcgcgcgcgggaggaagagagagggagttctgaccggggttcggccggcgcgggaggagacgacggcaaacggcgacggtgagtgaccggagggcgacggcgaacggcggccgagctccgggacaccctaagagaggaagtgtgagaggttatagggagagagggtgcccacgacgagcgagagccatggccgacggcggcggctatggtggtactcaccggcgcgcggggagaagcgggccccgacggcgggattggatggggatgcggcggccggggtagctttggcggcggcgaagctaatggcggcggcagattggctcggcggcggctccagcggcggcgagcggcgatcggaggagtggaaaaggcggcggcggcaggagcgatagagggcacgggagggagcggtggaaataggaaagggtggaggggattggagggatggtttatatgggctcgggaggggcggacgaggctgggaggcagccggatttctcgccaacgtggggaatagagagaaagagagagagagagagattcgaattcgaatctctctgttgcggggtgcacgcgctagtgggaggagtggggatggtgggcggcgacgtgggcgcggggcgcggagtggggcgcggaaggcgggggaggcgagcggcgtgggcggctcggtggttgccggcttggggagcggcggcgggaggtggaagaaggagccgacaggtgggccccacctgtcggtgacccggaggggttagggaggagggaggagccggcttgggccggcccagccaagggaaggccggcgcgggaggcgaatggactgggtcgacggcccaggaagagaggaaaaaggaggaaaaagaaaaagaaaaagaagaaaggatttttccagggatttaatattgccctttgctcattttaattggttaaaattattttcaaggctctgagaattccactaaaaatcgtgttagcatattttgacatgtagaatccaagaaaaattccacatgtcgattccgattattatttgcatttattaattagggattcatctctaggttaaattaaacaattacttcggacgatttattttatgaatttagagcaagggaggggaacttcagggcgtgacagaactcgagataacaagttcggcaagtggtcaccgaattgggaagggccgtttcaaattcataaggttgtgtccaaatgggcttatatgttgcaaggacttaatggagaagtctatggacgagcgctcaatggcaaatacttgaagaaatattacccaagtgtttgggtgaatgcatgatcggctggatgttgccgatgcatgttagccgatgtgtttacatcgccttcagatggccgatattgttatatcgcccttagctgttttcatactgtaatcagttgtgttttgccgatgtacaatggccgatattgttatatcgcccttagtttttttcatattgtaatcagttgtgttttgccgatgtacaatgaccgatatggttatatcacccttagtccaaattttaattttatcaatgccttcatcattataaaattaggggccacatatatacaagaagttgcaaatttttgagaattttttagcacattaagatctattaatcggcatagcagttcaattgcaaaaagggggtttcaaagtttcttagcgaactacaaaataagttatcctattacaagaccaattatccagacaagtaacgctggatagccgacacagcgcgttgtctaatttgatctacttcttcgatggcttggatgtcttgggcgttggttccagagatgactttaagggacttggtcatgtcagccacatttgtgatagccgatctcaatttagacttctgttcttcaacagcacttctgttcttcaacagcacttgggagattggctaacttttgcttttcaagatccaactcggcattgcattcttcaagttgagctataagatcaatcttgcgggcttaaagccgatctatgtttgactgaatcggcccaatagaaggatgatcaagcttggctttctcctcatgcatgagttgccgattggcttggatggtggcttcgatatctttccgctcccgccaatcggctatccgttacttagccttttccagcttgaattgatgttgttcgaggaatacagctagagtaatggtgtttgccagatcgtctgggattagggcttggatttctgcaaatcgtgcccgaattaaaccacagtcagccaccagattatccaatgatgactctagccgaagggatatatcttcaagtgttttcttgacagtttcatctagaggggctagagccttgcttgtggtttcttcctctatctcatcaaagtaatccttgatatcgaaagagaacagatcggctaagacctacaagagagaaattcgaagaaattaaatattaaatagatatagccgatctaaaatcttatgttaaggagagacttactgggatagcaggagcaattggttgttcttcttccccgacattatgacttcctgtagccgatggagtgtgatcacttgatgtttgttgtacaggaggtgaaggaggaggaggctgcaaaaaagacaagggataagtaaatatcagctatgatcagataagtgaaaggatttgtataggaaaatcttatcagtggagctggtttaagtgttgttgttgccgatttcttcttcacagcagtcttctttttctgaaaaaaggggatttataagtgatcggctatgaataaaatgattgcaaaaagaaatcatgagagatgtttacccttgaaaaatgagctggagcagcaggaatgggaggagtttgcttgggcgaagccgatggtgttttttctcctatatcactcaattcggctgctgcttgatcgatatcttcttcgatttcttcttcatccagagcttgctcgatggatggatctaaggtgggcaagtcatcggctggcttgggtttgtgcttcttcacgttcttcttaggagccagagccgatggatcaatggccgatgccttggtcttcctcttcctgccaacatcggttggttctctcatttgtccttgaagcagacttgaggtactgggggcatgatagccgatgactagaggagctaatccacctccgttaggtagaaggcctgcagcatattctatgtccctgccgctattgctcttgcgaggaggagaagattctgttgtctgcaagataaagagagaagttagtcaagattcaaatcggctaacaattattcaaacaaaattggctaagtaaagatgtacctgagggacaacatcaggaaataggtctgtcatgtacatagaagctaactgatggaatatatgttgcttccattctccccaccatcggtcaaagtttctgctcctaaaccttgccagctctatgttgtcaatgctccccaaagggggtcctgggatattgagtagccgatccatcatcagtgtggatgagatctaccctctgcattggattttatcggcaaagaataagccgattggtagctaccccattccaaattgcctagctaagctcatttggtgatagaactcataagacacctgtatgtttcttccttgatggatgccaacaggaagaatgcatggactaatggcagtcgagaagacttctctggatttttgatgcttttcagagttgatgtcctcaaacctaaagtctgccgggaggtcaaaattcactgagtcctcataagggaaccaaatccgagcatctctctggaatccctcgtagaaactacaaaaccagtctttgagtagttcggccgataactttgctctagaatcggctggtgttgatgcagcttcaccatatgacatacatcggcggtgagtgagttcttctccatcatcacctgtgatcggctccagcctcgggaattgtgcatctatcagaagtggccgattcacaaccttcatgacaacaaggttgagccatgtttgcagcagccaccatggtccacctgcacccactactgagcctatggctatcttggccgatgcattgctcaacatttcgtattgatagccaagaaggattttgcccaagagaaattgccttttggtttcaagggcttcggctaagaattgccagttggtagtcggaccacagctcgatccacaaaagagaaacttcttgagccacataatgagaaaggcagtgtgttctcgaggggtgacagatcccttgcccatgtatgctgctacatagccagacccgccccctatgctcttggtcctgaagtcaaactggttcttggtgtttaggcttatggggttagccgatgaagtcacatctaacacagtaatcatagtgatgtcgatcagagttggggtcattggcccttggttgaac

SEQ ID NO: 81864 - DNA, 4345 bp, Oryza sativa
gaacttgcttgctagccgatatatgcttataccacacagtccaactcttctcgggggaagttttctcaagagagggccaagacttgaacatgttcttccagtgacctagattcgggttggccaatctaaaaggaatcctattggtttcagcgatgatgaactcaataggatcagggttgccaatcggaccaagaaaatagtgatgctcatgcgacaggctaggaatcgcgaccagattggacagatgctacagatgcaaacaagaatagagaagaagaaaacaagatgagacaaagaagaaccaatctattgcgaaaggagaggatctagccgatggatacttacctctgtgtatttggccgatggcgcgatagacgggctggcggaagttgacatcgccacaggcggagatttggccagaagggaaaatcgccttggggtcatgtggtgcgccgaggggatcgccggagagagaaaagatgagtttggcttaagcggtgaaaacggaggtgacggtgtgaagtttcttaggggtgacggttagtatttaaagcgctgcggtaacggtcggaaaaacagcaacgagcgatattcttggagaagcagatatggcaaatccgaaacattaccaaatattccggacttggggggcatgtgttaacaaccaaatttggtaatttcagtatcagagacaaagataaaactgaggtggaatccaagatggaaatcgtttcggaaatagagaaaggatcggctaaagtccgattcggctgcgaccgtgatcggcagggtccgagttggacaaggttagtcgattaagccgaatccgacaatgtgacacggtacacgttgtcgggttgagttaatgtgcttcatgaagattgccacgcacggattgagtcctgagaaggcaattgtatctattaattaggatatttcatgtaatttctttagagatatatttgggcaaaagtctgccgcaaagacttatggtattttagagttcgttagagataagagtcgtgtctgacatggacatattttgtaatctcggggataaatagaccccgagccccatgtaatcaatctaacacacgttcaatacaatctcggcgcatcgccaccgttttactttcgtttgtttcgacgagttcttacttctgggtcgagctgcatcggttttgatcttcaactagaggtaaaacttgttatggcggcttgcgttctcgggattagtgcttccatctttatgatactctaatcctgtttatgtaattcgtcgagttatcatgtattctatataatcctgtgcaatattgttatttaaccttcaatcggctaacatctgttgttagaaggcgaccgatcaagttaaatatcaacgttgacttagattatataggatatccaccaccctatgagacaatcaacggcttgattatctagatattgtccttcttttcatacttatagctgcatcagttgagtttgatcttataagtcgtgattagaatctcaatctctagcctacttttggttgccaattagggtagcatcggggtttcagcctatcttacctgatttagcctcatattttatgtgcttaattgacatgctagatctgccctttatgttaagatcttgttgctcttaggtatattaagctccatgtttgatatattttacttgtgttaattaatatcttaatatagagtggtatcggagtattaggtgatacatgctagatctatctgatcggctatgctataaatatctataatctcgttgttgatatatatttcgatcaaagtgatttatactgtctcggcatggcgaccgatctatcccaatcactgacttaaatacatatcaacataaggattatataatgttaatatctacagccgatcgaatagatttagttctttcttacttatttatatctgccgatcgatttaaatatgacatcggctcggagataaatgatatctcatcggcaactggccgatcggctatcatttatggatttatccgcggtttctttatctttattccttgttgattgcaggatcaaatcaactggcacgctcgcgaacctaaaagcaagatttttggacctgcactgaaattaagcagaggcctcgtgttttcgcatcaacacatgcccgtcctgagcccccacctccaccgctcaggggacggacgaggtcgccacgaccctcacttcacgcgcatcggcctccaccctggccagccgccgtgcgagccaaccgtagtttgtaaaatggatttaaaaccttgtttaactgctatgacactaacatgtgggccccagatccttgatagtcaaattttgaccaagtcaagttgaccatagacccacctatcaatagtttagtgtttttccttctaaaaataaatgttctctaaataaaatactgtggtataacgctgtcactgaaaaaaaaaggttttcttccgaaaaataactcttacaaaacatagaataactgaacagggaatttttgcaattaatctgatttatttcaaatttaaatatttgaaatgccataactcactcgttttaaatcggatttcgataaaactttcactggaattcttctaaaacaagacattcccgatggcattggttggagtgccatggagtgcgagattaaaagcatacatacactgcagtgtgagcgtcgggacgtgtactagtcttgactagcctcataagttttaattctacttagaatagtattggaaacgattgtgtgacctctcctgacgtgtaggaaggtcagaatggtgagaaatgtgggaacctagatacgagggtaaaccgaaccaagtgaagcttggagaaggtggatgaaccttccttaattaacaacaacttcaacttttttatttaaaactgccaagtgataggtttgtgaaatctagctttatgttaataaaccaagctattctttgaaccccttatgtgtactaatgcattatgtagtattggcttactgagtacaggtaggattccacccgtacaaatgctacatggacgaggaggagccgaagaagatagagtagggacctaggtttctccagtcatcgcctgtggaataagatggaccatcgcagcttcttttccactatgtcatctactccttttggtgtttggtatggtaatcaaccatgtttggtcttttttatttgagttctactcgggcaactctagtattattaatgtatagtgagacctttataacgatgtcagttaaacatgatatgtaattttccatgtgtgtgcaatctactgatttataaaatagtattataaatacatgaggtctccgatgtacaaaacctagggcccacgttacgttcctatttctggcatctaattgcatcaccgtgattccctactagttaaacaatatcagatcgattaacaacacggtgcaattggcaaagcggcacatgtctggagctgtacttaactacttaatcgcgtgaacccaaattttttactactgacgaagaactaacttgatggggttgatccgtgagatgcaaccatgtacagtcacatgaacagggcacatgggtgattcatcaatattctgaacttttttgctgtttctttgacttcttgttgaaagtggatgtgaagctcgtcatattgtttgttgcttaggaagctcctcccgtatatagctctcaatcaggcgcagccttgacattgtatgacggttctttgtttctgcactatactaattcgagcatcatatagctaggctaggctccttacatgctttttccattcatgttgctaattaacagtgtcacacgcagacatctctcaatttcgtactagtgcagttctgttgcaggatctcctgaagattgatcgcaacaatggcacgagggccgatggatttgtggaaccagtgggcgacccagatcctggtgctcttgagcctcacgttgcaggttgtcctccacatcttcgccggggtacgccggcgcgaagctacgccggtggagaggttcatcctctggctggcgtaccagctggccgactcgaccgcaatatacgccgtcggtaatctttccctgagcagcaccgcacgagagcacaacctggttgcgttctgggcaccattcctcctgctgcaccttggcggcccagacaacatcaccgcctactccctcgaggacaacaagctctggaagcgtcacctcgtgactcttgtcgtacaggtcctcggagtagggtatgtcctctacaagaacatcgccggcaacgggatgatgatcgtggtggctgccatcctgatgtccg

SEQ ID NO: 81865 - DNA, 12276 bp, Oryza sativa
agcttgtacagcgtgacaagcaccagcatttctatatcaagtatgagcatcctcgccacgttggtgacaatcatggttccaatgatgagttgcttctgcatcgagctcactccttgttccacgtatgcgagcgtgggatagttgattctgtgatcatcaatgatgatgatgattcagataatcctgacagtaaagtaattggggaccttcttatgcaagataaagatcacaagagcatgtggacagtgatggagatggagctctccctcatgtatgacatcttgtacaccaaggcatatgtgattcacactagcttaggatacatcatccgcatcatggcgccgatcaccatcattgcctcactcttactgtttcatttcagtggcaaaggtggccacaaccgaatcgatgtcatgatcacatatgtcttgttgggcggcgctctcgtcctagagacgaggtcgctgttgagatcactttggtctacttgggggctagtgttcctctgtgacacacgctggagctggcttcgacatgtagctctctgcagcggaagatggcatcggcttcggtacacagttctctctttccgcagagcaatcaagattgttttttcaagaaattcaaggaggtggtcgggaaggatggggcagtacaacatgctgcactcatgctatcataagatcaccaaagcgacagcaagtcaccattggttcaagacgctcaacgatttgtccactctggtgggcttcgctgactggttggatatgcagcattgctgtcaaatctcgaaattccagacaaggtcaagacaactttgcaagatatgcatgagagatttgcaccaaatgatttgaacactatgggcttactgaggcataactgggggatgctggcaatgggtgaggacatgggcagcgggactcgccctgagcagttcaagaacctgaagaggtttcatggtgttgacttccatgagagcatccttatttggcacatcgccacagacttattcctcgctaaaatagggaaggaagggccaactgtagaggcaatcagggcgatgtccaactatatgatgttcctctttgtggatcgcccagaaatgctaccgggactcccacataaatggctgtacgagatgacaaaaaaaaacataatcgaatcatgcagagcatctaatggtttcactaatgaagtgaagcatggtgggcaaagatcccttaggctcaaacagacagagcaggtagctggcaaactactcaatattgacaaaagggaagtacaacctggccctaaagttcctcgtctcaggtatgcaagaattgttgctgacacactgtacaaatggaaggatgaagatccaattgatgtgttgtttgacctgtggatagattttctgatgtatgcagccaaccgctgcaatagggaatcacatgccaagaagctcaacgctggcggtgagtttttgaccatcgtctggctaatgattgagcactttcaacaattagcaaaagcaaaaaaggagcacggcaatgaataatgcaggttaatgtctatattggcatatgactatgagtaatattttactttttgagattttctaaggtcttagaaaaggtacggggacttatcatattgttagagtttaatcatactttattactttgtatgttagcctaaacatgatcatctctgtttaatgcgaaaattaatctaactgaccttgtttgtaaagccattgaagccaatttgctgaattcatttgcttgccgttcttgctttccttttctttcttcttctgcttttcttctgttcttcctctttttgctctactttgccctgagcttcctgctgatgcaaaaaaaaaaaaaaaagaaaattgtagagatacctcatgaaccctttacaacgtcgaatcgatagagcgacttaggtttagggttttagagtgaagagagagagagagagagagcgggtaacccctctgcctctcctccacttttaatggttttaataaatatattattagaaacaatctgaggtcaaacatgtgtttggagatgttgtctgaccatgcaagaggtaaagtaaagcacgattatatttttccaaagacaaatatacctatcatacttgtatgaaggaagtcaacgcaactcagtcggtttcgttactacatagtccctccattttttattagataacgttgttgacttttaaacacatgtttaattattcgtcttattcaaaaattttatgcaaatgcataagatataaattgcgaattgcgcttaaaatacttgaagtaataaaacaactcacaataaaataaatgataatttcataattattttgatgagatcacggtcaaacgtgtactatatgataaacgacattatctattaaaaaacagtaattaaattaagttacatcgtttttcaagacatcaaattagtactccctccgttttatattataaatcatttgactttttttagtcaaatttatttaagtttgaccaagtttatagcaaaatatactaacattttcaataaaaaacatattatctaaatatattcaatgttaaatttaataaaactaatttgatgttataaaatgttgctaatttttcctataaacttgatcaaactaaaaaaataactaaaaaaaagtaaagcaacttataatatgaaacggaggaagtacattgcaatacgtcgtctcatagtcatacacggtgtctacaaagcccaacatcataccatgtctcatataacagatttagcaaccattttcagagatggacgtgacttggcccagggataatccttacattattattataagatactttttccattgtatattataagtcgtttagttttcttgactaagtttataaaagaaattagtaataacaccaaatagttttattaaatttaaaattaaatatattttgataatatgtttatttaatcaaacttaaaaaaatttttaaaaaaattaaactacttataatatgatatgagtagaaattggagccgtttgttcaacccatctggtctgcttaattgaagaactagagccgttgacgagctttagtccacgcaagttctctgctcaccaaacctccttccatttgatatttttccaaagaagaccgccatccacttgactccctatagtctccgtcataccctgccataacactattcctttaattaatatttaatatcttcccctcctcttaatattataaatggtttaaatctttatcaaacttatttatgtttgatcaattttacagaaaaatatagctagcaaaatttttaatacaaaacaaatatactatcaaaatatatttaataaaaactaatttcaggtcatagttgttgctatatttttcgtaagttagttgaacttaaagaaaactagatttagaaaaaagaaaaacgcaacattagttaatagatttatatttggagatactttgatgtcataatattttaatggttttaataaatatatcattagaaacaaaactaaggtcagacacatgtgctttggatatgttgcttgtctgcccacgaaagatgttaagtaaaacatgaatatattttccaaaggcaaatatagcttcatacgtacttttctggtggaacttaacggaacccggccggttggcctctggccaacaacgacacgaaagacaacgacgcacacatgatagaaactgaattcattaactaatccccccttctccaatttattcattgacaatagttataaacttaggatgatgatcacatggtcacttgctgctgatcacgtgaagcagtgagaaatggtagtaataaaatctgcaaatgacaaatgaaagattattattctgtttttaatttatacatgtcgaatttgaacttggttatggagagttatattgtcaaaacttaaaacttggatatggagtatttaagaagacatacaacaatatagggatattttcttaattaagggagaaaaacatgtttacaccaaagtaggaagataactactcctagttgatacatggagttgaccgaatattttcacgtcttcctttaccatgtctatgaagtattgaaggtactgctcttgtccttttgtccaatatctaaaatccgtagtccacacttctttgttcattcaacgtacacttcaaccatctatatttcttttaaaaatttaaaccactatttgggttgctataaatattacatctcagataaattaagtaatactccatctacttctaaatataaaaacacttattagacatatgtttgacaattcatactattgaaaaaagttaagtattatttatttttttgtggtatattttattatttaagatatttttagcatgattatattttttttgtatttacacagatttttatcaataagttgaatagtggaacatacgtcgaaacatcatatatttatataaaaaatgaaataatggtcaaagctatatctccactatcaaaaaaagaagggaaaaaacaagaatagagatggagcagtacttcacgtcagaataatgtgtgactatgatgtgtgggcctataagaatggacttcatctgattaggtactcacgtagctgcttccataaagtaccaaccacatcggatgtggattaatatattcctcgaggggacatcacttgttgtttatatgttatataaaatagttattaaaccaataaaaaaaattaccaacatagatgaatatgaaatatatcactccgcaaacatgcataaccaaattcaacttgtacaagttgcaacaaaaagaacaagtttatcgcacgttcacaactatatttattatttttgttacaacttgtataagttaaatttaaacttgcatatttgtggagtgatatatttcatattaatatatgttgctaatttttttctaattttttaatacctatttagtggcatgaatgaaacgagaggatatctcatctagagatgaaatcactttctcaaccacggcaccctcaaccacatcaacttgatacagtcctttttcttactgctgtacatgtatgaaacttgcaagttttttgggattacacgatggacacttgtgagcaacttggttgttaaccatgtccatgtagacattgaattgaagctggcgcagccagcaacaatggcgggaggaggggtgatgcacctcctgaacgaatgggcgatcgagatcctgctgctggtcagcttctccctccagctcgccctcctcttattcgccgggttccgccgcgtgggcgcctccgccgggctcgggagctggtggaacaggcacgtcaacgccggcagcatcgtcatctccgacgaggtcaagagcacgtgttcggatacatccagaacatgttgaggggcgtggactccatgtcgaccaccgagctcgacgccatcaggacgacgagaggccagcgcgcgctccggcgccacggactccacggcgacctcgccgccagcctcggcgaggagttccaccaaggcatcctcacctggcacgtcgccacggacatctacctcgccgtcagcggcggcggtgaccgatcttctgcagccatagccaacgccggagacagggcggcggcggcgcggcggctcgcggaggccgtccgcgcgctgtccaactacatgatgttcctcgtcgccatccgccccgacatgctcccgggcctcgtgctccggaggctgtaccaggtgacatgcgaagacatggccagaatatggcgggaacgcaaggacacccacgaatcatcgtcttcttcctccagcggccgcttcatcgacgtcctaagcatggtcaccaagctgttccagctgcacgtcgacgacccgacctccgcctccaggacgccggagaggaagaagctggcggcgatgctacgtgacaacgcctacaatggcgatcagaatgtgaggagccatggcgtcttcgccggcgctctgctcgccgacgagctgctgctgaaggagaaggagcggcggatgtcgtcggacggcggcggcggcgggttgttgttgccggtgatcttcgaggtgtgggtggagatgctgctgtacgccggcaaccggtgcagcagggagtcgcatgcgaagcagctcaacagtggtggtgagctcatcacgctggtgtggctgttggctgaacacgctgggctgtatcgtataaacaaaactaagcagcattttaagtgtgctgaatatgctactgttatggtatagtttactgaggtagactctgtctcatttttgtttttttgggcctacaagtctgcaacaccggaacatcccaatggatggatgatttggcaggtatatatggaaaagtgatttcatctcttgagagcatatcctctaaaaaaattaaaaaaaaatacaagatagcttaatatgaaattaatatatcactccacaaaaatgcaaaggcaaattcaacttctagaagttataacaaaaataacaaatataactgcaaacgtatgataactatcagtttaatttgttctttttgttgtaactagtagaaatcgaatttggtcttgcatgtttttcttaatttttttataattatttagatgatatgcaatcaacgaggggacatactccggtatatatacatgggttaaactgggagtcaaatcaactccgttgattttttttccgtatatttatcctcatttttgcatgtcaattagataggtatcaaaaatttcaaaaaaaatattgatacgatatatcaatataaaatatatattatcaaatatgaaaaattcaaattcaaaaaataacaaatatgcatataaacagtacgtactatttacagtaaaatttgttatttttgtttctacttatatacgtagaatttgaatttacatgtttatgaaatgatatatttcatatcgatctatcacgtcaatcttttttaggcaacatgcacaaaaggaggggtgtgttggcaacttttttgacaagtcgacaagcacgatcgcaacacctaaacgctttgcggtgctatggagtcgccaaccacctcgatcttgccaatcggtcaaatcaagatgggtttttttagaaaaacagctaaaccggctagcggagccgatttagatatcaaaatcagcctctagaccaatttagatcaatatgaggataactatccgtctcatgggcaaaacggaaggtttccaggacaaacctacagagaggtgtcgcactctcgcagcggcggcagatgatttacagtgcaaatcgacaaagatggactaaaactagggtaaaatagaaaacatggtaaaagaacgatttaagtagattgtattcgggggattacaattgaaccggccttttctcttaaataggggttggtcttgccctttacaggccctcctccatgtctaactcgggatagaaaccaaaggaaacccgaaacatgccttcccaagcaaggaaactcgagacccgatgaaaacagacttgggctgggaccctgacggtctgaccggccatatatctgcggccagaccggccatatacctgcggtcagaccggccctactatctggtcagaccactcacatacctgcggtctaaccgaccctgtgaaggaaacccggcattttccaaacttttgcaattttcccctatttcgtccataggtgctaaatttgggtctaaacacatgccccccttttttatgaacatcgtgaatctaaaagcatagagcatattgtcttagggacgatctttttgctgaactgagccgccaaggtcgctagttccggttttttccagttcaaccgttggcccggtctgattttttcgtactatggcgtatataaggctcagagatttttctggtatgggtactcctctgtatctattaccagttggatggccatggcagattatcgtaaagaacttggcaataagtgatggtttctcgatatactaggagggcatagttatgggctattggctgcataattatacaatagcaagtgtagactaaaatgactatatattatatattataagtacataaatgattcttttcttattctttctccacttagcttagattattattttagtgagaatatttttgtttagttccttgtgtgtcaatctatctttatccctaaaatgattaatccctacattagactttatctatacaagagatatatattattagtatagtactctcttaccatatcttcccatggcattaaataaatatgttaccttggaatactttcaggtaaaatgctacagcggtatatccgagcgcttgcggattatatctgtaaccgtaaagaataccgagtaatatttcgagcatcattgctggaaattatatttctattaacgttgttaagaaatatcaacaaccatctcatagtgacttcgcttcaccagtactccattccttccctctgcttcttttctcttcctcaccgacactccatcctcttcttcacaggcactcaacgcattccacccgtcaatcttatgcctcttccctcaatatatacccaaggcagcttcattccattgacacgggaaggcgtctttgacctccaacaagtccttgacaacagcagctgcaatttgtcatcaacttctctcctccaaatgtctacaacatttcatggaacatgtattcgagtggacatcatttttattttttcaaatcgatccaattcccatgcacatacgtagcatggtcgtcccatctctcttctctaataccctctcaaacattcgctgcagggtctggtggtggcactaccacagggtgctggagttggagagacaaaaaagccagttggagaaccaaaactggcagttggagcaacaaaactctagactgtccagtgagaagcgtgacctggagagcagggtgaggaggttgggttatgaaaacaccaatctattagatgagaagatgagggtggctcatgagtcctcaagaaaggtctccgcactggagtaccgggtgcgggagttagagcaccaaaacaccaaactgtccagtgagctagtgaagcaacgggagaacacgaggaaggcgggccagctgttcatgaatgctgccgatacgtaccaacaagtagcagagaagcaaattagaacaaagaaagaggaattggcaaacacgagaaaggcaggcctcctgttaataaacgctgctgatacgtaccaagaagtagcaaggaagcaaattaaaacaatggtggaggacctggaggatgcgaggatggcggttttggtggtcatgaatgctgccgatacataccaactagaagcggagaagaaaattaaggataagatggaggaattgagggtccttggggtccagaaggcagaaatggatgcgagggccgcatctttggaatctgggcttaagacagctctagcaaagattcaggaattggaggctgactgtgataaggtgatgattgaaaataataagctttggttggaggttgagaggctcatgatggaactgagggtaatggcacacaagaaagaggtagctgcaaatgcatttggtgctgaaaaggcagaaactatgaaggaattggaaaaccatttgatgaatgtggaggaaattccgactagcatggatttgatgaaggatgaaaatgataagattcagttggagatcttgacagcaggcagaaacattgcttgcttgaattagatgtgttagtagaggagaataaagcatgctaaatcaagaaggaatccggggacatgaagggggaattgatggaaatcaagggtgcagatttcatgaaggctgaaaatgaaagctttggttagaggttttcactgcagaacaaaaacatagtctgccaggagcagaagttgagaggctcaaggagaatatttggatgatatactttcttgaaacatttatatctctatggatcgtccagaagctagggtggcccttttggtgcgacctgtttctatccacttgaaaacaataaaataaattggtcctttggaatgggtttacaatttttagaaataaactgtaaatgtgagattccttatcgtaatacatggagcaaatttatcttttcaattatatatgcatggctctctcacttgggtagtataaatacatgcatattatacctggtgaggattggtgtcctggtctattgatagaaggtcatgatcagcaaaagcatggacatcaaacaaaacagtacacgaggattttatacacgtttgggctctcaacatcctgttggttactatatacttcttccatctcataataagttcatttttaatttctttcatttgtcccaaaataaaagttcatttttagagtaatcgtagcatcggagtttgtgaaagtatattggagtttgtgaaagtagagaataattgtattgtgaatagataaagtgagaaatagttgtattggaatttgataaagtaaggatattctagtctttttgttttgtattggtatgttaagatagttgtattgtattgtgtgggacgcactatgaatacccttatgttcaccgctcacgaccccgtcgtcattagacctgcacgtacaccacatggttcctgtcacgcccggaaattcactagtaatttccgaacttatttgtgcataagatcctcgtccaggaatcaaccgaggtacacaaactgacaatttaatatacagattcatcaaattaactaaaacgataaatacttacttataaggcacttagtcctcatcttgaagaaaactgcagcggaaaataaaatctagcgaagctccggctccactcccacaggcagctcaactggggtttaagccaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcatttagcaaaacatttaagagaagtaaaacagtggagtaattaattagaaattttaatcaacactgaacaacacacccgtgctgcacaggcccaaccatcctgaacaaccatacccggctgtacagatctaactccaaaccaggagctaagcaaattattaccaggtataacatctataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccatagtgcaccattcctggatcataatcaccccctcaaaaaccagaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaacaacagtgagtcatgagttatcccaatagtgtgctaatgtttctaagcatggctaagcaattatatctaatatctagttgaaccaatatatataaagctcaattagtcaaattataataacccaaggtatcaaggattaaagtaatcaatgcaaacaggccataacaaaggaatagattcacaccacccagtgacattcgaaaataaatgcacagttgaaataaatagagaatttaaatatatgatcaacatgtttaaaggattgtgtttaggatctgtgtgacttgccttgcaataatcggtcttcaattaatcttcttgaatacttccggcgcactcgcgaaccttcgcaacgatggaaacgacaagctaacacgcaaaacgaagaaaaagactaataaaaaccaaataaacaatacataaaaagtaaacaaacatgtagatcataattttagatgaattatgagacttgaacggcctcattctg

SEQ ID NO: 81866 - DNA, 16612 bp, Oryza sativa
ccacttacacccctagtgacggctgcacatgttctttttttactccatatatattgtatgtccaacttgttgacagaaaatgtatggcactattgctgatatggtttaggagtgtctattgctcacacaaacttactagatgggatctggccaatccaccaagtataaagcaacattccaaggcaaattgtagcatcctcaatgtttgttgcaaaattagagaccaagttgaacctatgtcagctgacaatactaggtaggagagacatcacaatgtataaatacgtagatgagtaatataaggtggaacctgccttaaataaaatccccaaacatgagtcatgccataattttaaaaagagaagcggaacccaccataaatagtttatacctagtagtaagcttatgccctggaagtggtagttactacctccacggtgtatcttacatgataacaagaatgtgtttactacttattatcttctattccactatattgtggaggaccttacgactacatcaatcatagtgagttaatggcatagtgggaggcaacaaatgaagtagtacatcaatgaaaaaagaaacagaggcttgtttgaaaaatcatattaagtagcgacaataaagtacatcatccatttttctccactatccagtctgtgtggccgtgctcgtgctcgcctctgagctagttggtgatatggactttccaactaggaacttggggcgcttgacatgcgtactgagctggctttgcaatagctgcaccagtttctccttaggaccacatttcttcagaacaagctcgttaaggttgaggagatgtaacactccagacaagccattatcatcatcgctcaatttctggcacctgttcacccaaagttgttgaagttcaggcatcgcacccttctcaatgttaactgtttcaataatctccaatccatcgatatcgaggaatatgagctttcggaatgtgccatcattgaatatcagtgacttctctttgtaggacttctcccacaagcctagtgaagctaggatgcgcaggtccttgaggcgatgaatgtcatcctgctttagttgtgtccctattagcttcaccttcgtcagatcattgagtgacttgatccatacaggaagttcgtccaacagaccgcacaacctgagtgacactagatactttggtggtgttgcatctatgtccttgttgttgacaagaaaatcaagtgactcggagcgcacctcaagccgttgcaacctattgaggttctttatcgagttccatagctccttgccttcctcctgaccaagacctgtgacccctagcctttgcaagttcgtcagcctctccagcttcccagccacatctttgctcttgcgcacattgaccacactcaacatgtgcaagttccttaacttctcgattccttcaggaaccattacactgaattgatccatgccagatatctcacaagattgggtgttgtaacaatataggcaggatgccaagttccccaacaggttggaattgtggttttccatcccaaactgcggcatcttttgtagcaaatctcttgagaaattgactccggcgagaaggtaacggagcttctcaagtttagcaatgccatctgggagctgggtgacttgcgtgtcttggatgtcaagcgtctctaggtacagaaggttctgaagagaagatggaagcttggaaatatctgttcctctaagacccagatatcttaggtgtctcagctttcctatgtgcttaaggtcttcgttcttcagattggccatatcttccaggtcgagaacacgaagcattcgcatctcaagggtaatgagagatgctgggcactctccaaataccgttagcgatcgaatcaatgacaggtttatgttctccaacttttcatccctcttcttccatctgttcacaaccaagtggcgtatcttactttgtggaacctcgttacagtgcttcttgatgacaaagagctggttctcatcgatggacttggacaggattatatggagcatcatgccatgaactcgacagcgatcgactttcaggccatggctgaccttggaagattggatcatgcttctgttgataagctcattgaagaagcgctctcccactacttcaacgggcatgtcgcggttattcgctatgtaaccttctgcgatccatctcctcaacaagcgggtgcgccggatctcgttgttctcggggaagatactaaggtataagaagattggcttcaggtgatatggcaggccatggtaacttgagacaagtaccttcgtgatgtcctggagctggtcggactccagctctactccaaggtgttcgtgcaacttcttccattccattcctgttttaggcctattggcaaggagacctccgattgtggatatagcaagaggaagcccccagcatcccttcaagatgcgactgatgtgcggtttcatgtcctccggcaaggtatagtttggtgttctgtagacctttaaatgatggaaatggaatgaaataattaaattaatgagacgagcagtgcgtaggccagcgtttgttaatgtttgaaaaatgaaaatgactatagaatgaaattgaaattatgaaagccaaatgtaggtgcatgaaggaatcttgaaaaaaaaatttactatttcggaatacatagttatacccgggtcactgaaatttcaggggaaaaaaggggaaattttcaacaatttcaaaatcttgataatttttgcataatatgaatataattttgttaatataaaaaaacatactttgcacagtagaacatccttcttttagaaaatggattaaaattgagcttctacagccggtagaacatcctaccaacacaccgaaattttggaatttcggatccaaaattgttaaccctgtctagaagtgagttatatgtatgggtgtcgttcttgccaatttcccactgaaatcggtcaggtgatttctggaaagttcccatttctggtttcctccaaaacttcacttcctatatgcaagggaactttatgagttccttttgtccgaataagatcctcgactctatttatccccaatcccctcaattttacacatgtcataatttttttaaaattttttaacaaaatagatcaatatgtgatatatcactttatacaagttgaagtccaacttatacatgtagaaacaatatcaacaaatttgactctgaacagaacatgtaattcctagtcaaatttattatttttgtttctaattatattggtcaaattcaattgtgcagtaaatatcacatgttgatctatcttaccattttttaaaaaaataatgattttttaatgacatgcacgaaaaaagtggacgtccccttgagagacgaaaatccatatgtggtggtgataaattcagtccgaccaaccatgccccactatgcataaaagttttttaaaacaccttgagggatgtccctatatttgtttgccatgcaaatatttatgaaacagtatgtttaaaaaatatcaataaggattacagtctctattactgcatacagtcgttaatctatgattttcacattaactatgttttacttaaaaaaggagtgattttatggtcattgagaaagtatccgtaggtacaatattattttaaatgtaaaatttagtacctccgatattaggagctatggaaatttgcactataaattttagtaacactcttggtgcctcttagagactttaaaatttctcaaagaaaataaatataaatgttactccctccatttcaagttataagatgttttgacttacaatgttaatagacaaatatagtaatatttatattactaaattagttttattaaattagtaattaaatacttttttataataaatttataataaacttagtcgaacttaaagttgtttcactttgataaaggttaaaaacatcttataacctagaactggaacggaggagggagtatcaactatcaagcaaagacatgcatgtacctttcgacaaaggagatccttggattgcttatcatccagacgtttcagctcgtagacatggccatgctcctcaggcgcgaggcccgcgcagtgcccggcgacgtccttacggcgcgtcgtgacgatgacgacgctgcccttgttgttcaacggcttgaggacttgccagatctgatcccactcctcctggctgagcaggtcgtccaccatgatgatgtacctcttctcccgcaggtagtcctggatgacgttctggtcgtctccggctgcggcgcccaagccgaggccgagctgcttcctcagccgccgcctgaactcgtcggcgccgtcgagcgggtgcggcaccgtcacccacgcgctgcagtcgaacacgtcgagcaccgccgggttgttgtgcaccatcctcaccagcgacgacttccccatgccgcccatcccccacaccgccaccacgctcggcgacggcgagccactgcagcgggagatcagatccttcagctgctccttctcgcctgcgcggccgatgatctccgactcctggaacgcgagctcgtcggagctcgagccatggccgccggggagcatggcgacgacgcgctcatggtacgtgcggctcgggtggtggtggtcgtcgacgacgatatggtaacgcagcctaagctggttgagctcctcgacgctggccttgagctcgcggatccggtcggcgatgcggccgcgcgccgcgagggggcctggccggagccaggagctgcccgtcggcgacgacgagatcctggcggcgtagagggcgaagtcgaggaggcagtcctcgatgtcataggccaggtcgcgcacctgcttcacccacgtcctcaagatgtcgttgtccccgcctccggcggtggcggcggcgtcggggtgcaaggaagaggaggccgtcttgatgaaggcctgcatcatctcaagctcgttgcggatgaacttcacttccttggggacgccgaggaagcgcgcgacctcgtcggcgacggcaggcccaacgctgctcaggacgacgtcgaggacggacctcgccaagctcaccgccgtcgcttccatcgtctctctgccctctcacgattagagcctttttcctggtttaatttgcttgcagagtgcgcacgacagagcgagatttatctgcttcttgttgatgcaattgagggatcattttatacaaaaactttggcgggaacgtgcgcgatatatatgcgtacccgccatttctttttgactgcctatatgtaatttgacaggaatctaggatctaaatcttgcaaattttataccgttggttcaaatttaaaccaaaggcctagattttgtcatagtcccatatatatttgcccctaggcgtcacggctagggatgaaaatggtgcgggtatttctcgaccactcgcccaactcaaggctcgtgggaggaatataggagaaaaaaataggataccagatactatccgagttcgaatccgaattcattcgaattttattgttgggttggaggtttgctccagaaaaatttggaacaaaacgtctaccgcgttgaagcccatagccccatggagttccacgaaagtatgattcttatcatcaggagccttttgaacgtctctacgatgagtccagattctatagcagtccaatctgaaatgaaagacttctcactcttgatcggagtcgtaaactaaaactacctcttcatcaaggttatagaaaaacttcgtcatctagttctaccattttgaaaatcaattctcttttcttacgggcatttcgagttacttgttgactcacgattgtgcctattaaaagtttcaaaatgtcctctataggatacgggatgacatgtatccgtctatatgtcccatattataaaacatgtatgaaaatctattacctataaacatgataaaagatcggctaatcactattttatgagctcacatgtaatattatataatttgtctcttgatgtatctcttttagtactttaattaccttagtatatttaatatctatgaattagatatacaaatagatatccgtttctgaatctgattcaaaggaaataatatgggatatgatacaccttaatatatataatttcaatgaattagatatacaaatagatatccatttccgaatctaattcaaaggaaataatatgggataggatacgagatgagtgatatgttatccggcactacccgtatccggttccgaacttaaagggaaatataggtttggatatggaaaatgttataattcgaccgtacccacccattttcacccctagtcgcagcttcttccctcctggcccctccccctcccccaagcactgccggcgagaccagccgaccagcaccaacaccaccatcatgtcctctggtgcccagcgccgccacttagggttcagaatttcggaaatttttttttctattggaccttggccccccgcgcggtcttcggctcaagttgtatgaggcagaaactcgtcccatacatgaaattatttcaaacagatttggattttttttttcattttttatgaatttggtcaattttgtactactttgacaaaattttattcaaatggtggaaattttctaaatttttatcaaatcggtaccccgaaatacattccgaaaacggtaaattaaaccctaccaccacctccctgtcattccccctctccccaaataccccgacgccaaccctgaaatctagtttgtcgaggtcgccggagttcatgactctgtgcacgaatcttcaaccgaatcagttggatcggaatcaaaatatgaaagattgttatagcaattccggtttttttaattagaacggcaacccgctaagttcgttgacatttgcttgcctcccatgcttaagcttccttggtaagctgtggaaatttcatgtacgcaatgatttaacaatttaaaactgaggtttaaactagggtactcaactttgatttctccccatattatagtaatttaatatgtcaagttgtcaacatgttagttcttgttaaggcgaaactgcatttttactcttttttttttgcggggaaaactgcatttttacttacctaaacatagcgtatagttctagtatttggttgttcaacctatgatggagtgctcagtggtggacgcagacatgggacggatatactcgataaaaacagctaattgcaacatatacttcctccgtattttaatgtatgatgccattgacttttcgaccaacgtttgaccattcgttttattcaaaatttttacgcaaatatggaaatattaatgtcatgcttaaagaacatttgataacgaatcaagtcacaataaaataaatgataattacataaactttttaaataagacgaatagtcaaacgttgaataaaaagtcaacggcgtcatccattaaaatatgaatgtagtattatataaggttttgggatttataccgaatgctctgaaattcgtctatttccatgaggcccaagacatgacctcctgttcattgatattgtttgacttgtatgctcatgcttccttgcaaatggcggaatattcatttttgctatatatagtttaaattgaggtttaataaagctaggatgccctccatattataatatataggaggctaacatgcatgtcaacacggttgttcttgttaagataaaaataacggcatcaccttaacgaagtttagttttagtatttgttgttgaacaaattaaagagtacccgacgagttagttgacattgtttacattgcatgctcacgcttccttgccaaatggtgggaattttttttctttagtttaaagtgagtttaaattaaattagggtatatataatcgggttggggtttctcttcatattataataatataggtgggaatgtggctaacatgtcaacattttttttacgtaatacctccttccgcgctaacataggaacatggctgttcttgctaagataaaactgcatgtacttaccttaattaatatactagtttagttttaaaatttgattgacgaaccaattaaaggtacttgacgagttagttgacattgtttgcattccgagctcaagcttctcggcaactggtggaaagttcattaatttttctatagtttaaactgaggtctaaattaatctgggcataaagttgggatttctctccacacagaggctaacatgtcaacatgttcgttcttgttaagataaatactactacaaaacagcgtatatatatgccacccttatcgatgccggttggaccaaagccggttctgataaggtttcctgccctctcatactcacgcgctctcaatcagtgttggttccttaaattaatgcctagctgcactgacactacgctggattagaccatctctgacgggttcaaacccttacctttgacaatgccataataactctgttcacctttgttgggtggacagtcacattttatatatgggcctgtatttttcgtcccatcagaggtgaggatcttcacaagcccacgtatgcttgtaacccgtcagaggtgagacacctgtgacgggtgcaaagtttacgacccgtcagaggcatccccttatctgacatacctactttggagccatcacaggtgactcacctctgacggactgatataccaacgctgttagagcttaggtcatctgtgacggtgtttgtttatgacccgtcaataatgaggtactttcaaaaaaaatttaaaatattagctagcttcaggatttgcttgccatgccctctaagaaatagatacatcacagatattccagccaatccccaatttcacagttttccacaattcagcacagatacatcacagaattaacatcatacacatgcattccaaaatcccacaaaaattacattgccagtcacatattcacaatgcacatgcctacctcacatttcttttgagcctatgaaggcacaaacttacccatttttatgagcacatgaagctgcaaacgaaacatggcagcctgagagatctgcttaactccagtgcgctaagggcgtgccagttggtttgatcctgcaaccagcaaggaaacaacaaacaaagtgagtgagccggtagccgattggccgatgacgtgtcgttagtgatcctagccgatatagttagaccagatcagctatggattgatgtgtaaattaagcacaaaccctaaatatgccacatcggctgtaatatcatctccttagttttgataaaatagatttaagacaatatcataaaaattgtcgatgtaacattatttagagcaagataggtaaataaaaataatgtactagctaatactctagtacaaacttatataaacaaattaatctataaaaatatatcaaataacgatcaactaccaggtttgataacctagccgatgttgatctaaacttgatatatttatatgaagtgatctgtctatataagtggcaaatatacataaaacatgtaaagtagcatctatattacgtaagatcggctgaaactccgatactatctctaattataattaattccaggttagtttttagggttctagacaatactatcataaagtaagtaatgaaacctaaagtctaaacggtcaagaaattaattacttttcaagatggtagatgccttagttaatctaatctagtaaggcaatttatccgatatcggcaagaaccctaaaacgagaaccaaccgatagagctaaattgagatactaagactagattaactaatacatatgataacagatggtcatgataaaaggattagaacatctaagatgatatattggaccaaccgatatagccccgatagctcaagccatcgagacgggttacttcttttcgagagaactcgccgaaaagaagaacaaaaagggtggcgatgcgccgaagatgtattggattgtctctctcttttacaatgatctggggtctatatttgtaccggagtacaaatttagtccattataggcacgactcaaactttcctaaagataagatacaaacaaagactacatcgcgatctcttaccaaatctctaacaaaccgacctaaatatcatagataatgcagcaaataggagttgttctaccaaggtcccacattttgcaaacattgcatgcaatttttaaacataataaaacatttgcgaaaatatagaattcaacatgttcgaaggaggaattgaataggacttgccttgctcaggagttactcaaatatctcttggtcgtgcacactctcatcaacagcaacaatcaatttgtcctctatttaaatttaaacatatattcaaacgaaaatccaatagaactccaagataaaatgtgatgcagggtgcatgaacatattcagtgtatagagggtgatttaatataaatttaggagaaataatcgcctaaatacgatgtcaaatgtgcaagttatcgtgtttctaagattttaaaatacactactattcaaatttaaattagtgaaaattttcacaacagtgatgctatgtttgagtgcgcagtattaaagagagagctattatgaaactaatccctcagggttgataatacttgttgttttggacaagggcattgtcttcaacaaacaactttaaccattattttttattataatatgtatataaatgttaacaaatatatgattttattgaagtattttttaagactaatatgtgaatatagtcaccatatttcaaagataaatattttagaaattattcataactaaagattttaaagtttgacctcacccttatccaaaacgacaagtattatcagcccggagggagtaacaaaatttggttcacgtcaatcggatctaaaatgaattttctatgattttccaaattttcagcattttatagtgcataaataattaacagaaaaccttttctcagatttaataatttgtttataaaagaaactaaagcaaactgtcttcaatacgttttcctacagggaaggcgcattttcgttctgtgtaatcattttaaaaccgtggggtccaactaaactaaagtttgcataaattacatgtaagtcctaggccaacctgtcagtgtctggcattgttcggaaagaaccctatattttatcctaattacagaacaaggtccttcttgttcaacctgggcacaggcagctcggtaggcagaggcgcggcggctcgggaagggcagcgtcgcggcttttgcgcggctttgcagtagcgcgcgcagctttgcaggcgtggtcggggtcgttgtgctgctgcgtcgccgcacgggcagaaggagagagagagaccggcggcattggagtggtggcgaggggcggcggcttcgggttggccgcggcgggctgcgaggtcagcgcctgggcgcggcagggcatcgggcagggaagcaccagccttgcctcagctttgccagcgggaatcgcgggcagaggttgcttggtcggcttggaaacgatgacctcgatctcgcacgctaggtgctcgatgaattgcctgaaaggaatagagggagaggagggagaaagagagctgggagatggggatggtggctggcaggtggggccaatggtccttaggcccactgatcagagagagagagaaagggagaagggatgaggtgaggggatttttctgggaatttccaagaaggctgagagtttgattaatttttggatatgctacagtgctcaaatgcttgcgcaaaaattactggaggttagtgtggtcaagaactccacttggtgaatttttgggatttttctcaagtcctgtttatttttgaaaattaaaacaagtttactaatttgaatcaaattttggatgttttcatccttttaattgagttgcaaaacttttgagatttatggaagtttatttcaagtgtctaccacttattttaattctttttatttgttaatatttattgcatgcaaaagtgttatgagatgcaaatcggttgtttttttcgtccacacttaatgctccatacatgtgtctaaacatttgatgtggtggaaattttggaagtttgaagggagctaaacacagcctctatctataaatagctgatgcatgccagcttcagtttctcacatccctcacagccacagccatagaccatagtactacaccacatcttctcccctacccaccagcagttcccagccatgtctgctagcaagctgcaattcaccccatgcagcacacccattcagggcaatgagatcaactttagcaaactctacctgcaccacacgccggctggtccaagaccaaaccagtccggggtcacaagcacaaacaaggaaaccgggttgggttccttggttgttaacaactggcaggtatacgacggaatcggctgtgacgccaaggttgttgcccatgcacaaggcctgcacgtttatgccggtaactggcacaactccttcaccctagtgtttgaggatgaaaggtaagcatatatttgtgtttcagtgtttgtgtctgtatatatgtgtatgcatgcgtgcgtgcatccttcggtatcaatggatgggttacacatacactctagcccctttaatcacactacaaaaataagttctacacttgcattttagaagcacatgaacattagttttttctcaatcaattgtaacgtggtagattaacattatgtatatgctacaggttcaagggttccactcttgaggtgatgggaatagttgttgaacaaggtgaatgggctattgtcgggggcacgggacaatttgctatggcaaatggtgtaatctttaaaaagttccatgaacaaaaaaaagaaggaaatattatggaactcactatcaagggattttgccctgtcttgaaagggtcaccgtcacaggtaagaacattaatctattttctatagctttgttaaatgttaagaagcacttgagataccatatcattatgggatatgtaagatgtacaacatatctatgcagggccttgtcaccaagattgggccttggggtggaattgatggaggcagagctcaagacattacagctactccaaagcgtctagaatccattacaatacacagcggctggactattgattcgatctcatttatttactttgaccaagctggagagaagcacagagcaggtccatggggtggtcctggtggggatccttgcacggttagtgaacttccattgcaatttttatttaacgacagtcatctaggagtacctcacagcccacaccacacacccacaattaatgaaaagaacagaacatatttggtgttaaattacttatacagtagttatcctttttttatgtagattgaatttggcagttcagagtttctcaaggaggtttctggaacgtttggcccatatgaaggctggaaagttataagatctattaaatttgtcaccaataagaaaacatatggtccatttggacgacaggaaggaaccccttttagcgtcccggtgcagaataactccactatagtgggcttctttggacgcagcgggaagtacctcgacacagttggcatctacgtgcatccgagataacatgtcaaaatcagtttcccatgtttgactttgaagtgtgttttctataataaataaatatgatgggatcctccctttcattccagtagtgatgagggatcctttctagctgaagtgtgtttacttctgaatttgcagtccttctgtcggtggtttcagtttgcaatgcattgtatgcatcaataaggatcttcgttgaaggttggtttggtgaataaagtcgtcattcagttagcaatgtgttgtatgcatcaataaaaatcttcattaaaagtttggtttggtgaatagttttcatccaatgagtatatcgatcatctaagctgaaatatttgtagtgcccttctttttgaagcaaatagtaccctatctaaggttggttttatatcaaccttatgaagtatgaaagcgaccgagttgtgtatgttaacttggctgctatttctcacatcacgacatcttggtatttgaaacggatggagtaatttatattcttatatttagtaaaggtatgttataagaaagagttcaatcatttatggcatcaaataaaaactaaaaattaactactaggattgcatgaaaactcttaaccacttcgaggggcaagatggggcatggtgaaaggcctcgttttcttttagtactagattcagcttatagaattgaaagaaaaacagatggcttaattctataggcggtttttcaacaaatggtaagatggcttgatgttgggtgctccaataacgtcggaccgggagcacatgtatactgaagattaacattggattatttgtaggaacacacaatataggcaaatacagtatactgaagattaacactgggttatttgtaggaacacacgatataggcaaacacaggaatagaaacaaaaccttatacgtacacacacgagctagcagctctcttattacccttataagaccacgttgctttatacatatagctacttatctatctattatatactaaaagtacattaaacatcctataaacgctcttaatccgtcatatcgcacttctgcaaacgcttctatgatgctacatggcactctaataaattagagaaattcctacaaattttaaggaaaacaaaacatctagttaatttaatttcccattgaaatagtattgaaatatccaaataacaccatatgaaacattaaataaagattaattacaacataaaaacttaaaatgtgtaacatactcgaattctcattgaaacattaacttctcatactattataaatgagttactcaccatttatcaaatgtagcatactatacatgcacgcgtgaaaatcgcggcttagcttcgtttgggattaattgtctgacgagttgctattgctagcctaatttcttccgcatcacaaacacaggagtagtacaagaattacttctttcccgatgaggaagggtgatcagtcaaacggattaatcgatcgtcctctcgtccattcaattcgataggagtacaggaccaatagcctctgagacaattaatcatacattaattggcatatgtcatccattgtgacgtcatccatgggtacgtcatcaaaattctcatgtgatgggcgtcatgacatcagggtctcacgagtaatttgtacctcagtcaaagagaaatttgcatatatgccatccttaaaaaccggtttcgctagaatgtcatcgttaaaatagaattcgctcgaatgccactctcaagctgtgggcattcgttacaatgcaattttctctatttcttacatttggagatcatttttcatccatttaatttttttctcagatgctttatcctctagctgcacgggttgaaccaaaccacatccactcgctctaagcaagcacgaggaaaggcaaccacgatgacgctgatgccacccaccacttgctccagtaccttcccatgaccgcgctggcgacaaccaccacctactctaccaccttccccaaccacccctttccccgagccgcaccgcctcccccgcggagccgcgtagcttcctcccgcggaacagcgccgtctcctggcactagagcgaggcgggcaagttgctagagttgagggaggtggagtggcgggctagtcgctggagtcgagggaggcggagcgtggcgggcaagtgatcggagtcgagggaggcggtggtgcgaatgcgacggagggagagggagcgcggctccgtgtggggaagctgcgtggctcggtggggcaggcggagcaggtggtaggcggctctggcgtggttgcaatcgccccttctcgcgcttgttcggttcttgaaaacgtagttacgattcacgagagagagaggatgttgtttcgttcaaaccatgcaggcaggagcaaaaacatccaagaaaaaattaactggatgaaaaatgatttacaaatgcaagaaacaacaaaaattacattgtaggaaatacccacagcttaagagtagcattcaaacgaattccattttaactatggctttctagcgaagccgtttttcctaaggatggcacacatgcaaatttctcccttgcctccacttcctccccttgctcgtgcctccgacctccgatgcatccatctcttccgccactgccgctgctacgggaatcgccaactcttccgccctcactggcaccgcagcaacttcctccctaatcaacatgctctcgcagaccgcgtcatcagtatatgcttcgtaacctctttcttcctcatggttgcattggttttgttattcttatgttgctttggcctaaatttatttgcgttactccattcaacagtgcattttgttgtttatttggggatttgatttgcatgccatatattaatatataagcgagcaatttgccttctagctatagggcttatttgggggacccc

SEQ ID NO: 81867 - DNA, 9849 bp, Oryza sativa
ttctctatgccaattgaagaacttgaggcacttgtacttttcccgtactgacatacgtagcctgccagatggcatcggcaagatgaaattcttggagtacattgggattacatgctgtgaacaaatacaacaacttcctggtagcattataaaactagagcggctaagatctcttaaccttatgggcacaaacataaaaagtatacctaggggttttggtcgccttacaagtttgagaacattatactcgtttccagctcagatgggtagcagttcatcaaaagatgagtggtgtagtttggaggagctgggacctctttctcagctcagggatctccatataaagggtttggagaatgtatctgccagctcttccgctgcaaaggccatgcttggtgccaagaaacatcttgccatatggtggttagagtgcactgataggcagagagatgatggattcttgaaagaggaaggaatcatttctatagacgagcagcgacgaatcaaggaggtttttgatgagttgtgcccttcatactgcttagaacaactttacatcagaggatattttggttggcagctcccaaagtggatgacatcaaaagcatctgtgaggcttgatagattgacgagtcttaagttggatggcctgccttgctgcaccaaactccctgatggcttgtgtcagctttcctgtttgaagcttctacagatcaggcgtgccccagccattgagcgcatcgggcatgaattcctgcagatacagcaacacaatggtgattgccatccttcccgagcagcggttgcatttcctatattagagacgctagagtttacagtagtgctggagttggaggaatgggtgtgggaggaacacattcaagccatgccactcctgcatgagcttacactagacaggtgcaaattgcgacaacttcctcttggacttgctgagaacatgccagggctttgagtgttctcaaattgttcatggtccataacctcaagtctttacagaatttgccttcagttgtggagcttcacctgtataaaaaccctgacatggagagcatcagaggtgtcccaaaactgcaagtgcttagcattaattactgcccaaagctcaaactattggagggaatacctgcgctgcaaaagctctatctgctagacttcagcatgaaaacactcccaggatatctacaagatgtaaagccaaagagtttggtgctggactgtagtttgccactgcttggtaacatatcaatgggggcctcttgctctgactgggacaagatcagccatatccagcaaatcagtggatatgcaggtgaaatgcgcatcaggagaaggtggtatgtgttttacacacgggagcccttcaaattggacacaaatatcgtctgctcttccatatctagaggtaaacattactcattggtgtatacttttgtcgacgtattctcttcctatacattatggagtattttggtattcttttcttatgttttggaatctgtatgtgcatagccaagaatagaatctagaagcttaaactgcatattatagttttgcctcctctaattaatccatcactgtatgtgcaaactaaaatatagtttccctggagttagtgtttatgtagagtatatggttagcctctttcttttttctcaagctccgttgtcatataactaccaatatagtgttcacttgataattatttgcccactagaataaaatttactacagtaaattaacgtctactgacgaaaagagagatatggatggaacggtttggatgcaaggcaaagcacatgatgcgattcatcaccttatcttgcacatcatctctatgaaacgtgattattgatagaagatttttccttcaagcattacatacagagctagattatttttgtctgcttgaaaatttcctagagtgatatgataaggaacaacagattgtttttcaccaagtagctcttcggatgagcttgcttaattagaccacaactaaattttactgccacaggtctaaatcgtagtttgagacggaagcccttcatcagtagcagtgtgtggatattcctaattaacctgagttgtatcgcaggcattatcgatggtttgttgaaggacaaagagaggcgcgccaaggagttgaggatggtgaagcttctgtgtgccctcctcgccgtcgttggatttgtttccattctgccacattgttatggattattgttgtaagataagacgacgttgccgccgacggatctcgccgggctgcgtaggctccttgccaccgcctcgccacagtgaggcgtagagatcagcactagaagagaagacgtacgggaacaactgtggaggccatgcagccaccgccgtggtctcccacatcgccgtttggtttctctgtagctcaccggcatgacatcttcactggctgcctcctccccacgcagcagctgttagcccaatctgcctccgatccttgtcattgtcattacctgtgattattaattgttgattgatctgatatccgcctggtctgggatatggcctctagcgttactcgcttgtcgtgcttcctgattgttgatgtaatttctgatttgtagggatgcctaattgtgaggttgatgatgttatgttatcagtgaataattcttttatgaatactcattcatcgtaacaatacacgagtaaaatttatttttacgtcaaggtgtctaccaacaactcgattgacatgataaacgggtcgggagatcctacaagagagtcaacagcttctgccgccatcctcctttaggaaagatatgaaccttgagtccttgatgtactcatctttttttttttgagaagggtataactcaagacgcacacttacacacaccgcactcacaccatgacacacttacacacatcctccttcaggaaagatatgaaccttgagtccttaacgcactcatctttgaaaggtaaaacaaagggtatatataaattaacgatctacaacaaagatatatagaagaagctcctcgctcgcatgttcagtagtactccttgctgcaatagcccatagccaccacactattacatatgtaataggaaaaatgagatgacactatatgtgccggaaagtctagaactgacacctataatattttttccacccgaacacacgcctgcagggttctattcaacacaaacagcacctatgtggcaacatatgtatgctggatgttaataggaaccggcacctatatatattcctcctaaaatataggtgccggtttttttcttctaatcaacatatttaaaattagctatcattctagttttttgaaaaccggtacctattgagcggtaggtgaagctgagcggggtgggataagaaaccgaccttaaccattcacctctctcactctccctgtccttatccatttggcttcctctctccctctcccatctccctactctcaatccatcagcatattctatgatgtgaatttgtgactctttttttaaaaggattttgtgatttattttatggagcatcacctccgcttgaattaagacgagcctgttttgttttttcagaaatgtagtacaactcataggtgcagattttcaatctggcatcgatgagtccctctcatcaataccatctccgtggtgccggctgaaaaatctagctcctatatgggattccctactggcaccgaagtgagttccgatagtagtatgtgccacccactctctccaataggagtgaaaacggtacgaaaatcttcgagatttcaggctgctgtttctggtttgcaccgatcatttcagtcggtgcaggcaatagttggtgttggaaatggaaatggtaatatgttccaaaaatggtagcaaaatgggatggaggttttttcgaccgttttgttgataaccctatttgtctaataatttctatcaaaattccaaaacattcctagtgtcccagccagcccaacccatcggaagcccatgaattgaggaagcctaataagcttttagcctattagaaaggagaagtgtccaggggaaaacgtgttaaccctagagtgtggcatgtggactttgctgaactttggtcttttcaacttatcgatgttgaagaactgttgacctttgtaattatattgttcgtcggacttattattatatcatcaatcatcacatcatggtgttacgtgaagtgtgatggttcaataatgaagttataaatttatcttcatgcatagttaaatgtgtggttatgtcacactccgttatttccgacatgaattttcgacttccgaccaatatcggtagatttcattccgacagtcccgttttcaatatatcgttattattgatattgttatcgttttcgggtctactgttctgattccattttcgagaaaaaaatataaaaataaaaatggcagagggtttcaaaagaaaaaaaaagatcgatgaagcttgcacacagaagcaacaagcaacacaggcacagccttcaacaccaaagcacaaaggtaaaacaaatccacaccgatcgagaagcatatatacgcagatcaacacggccacagaaccttagaacacacaagccacgcacagaaactacctcgccccgttaccacacatgcacaaaagcaaacgacaaacgcgtagttcttacgcgctctctctcttctagttttaattaagccctaacacagcgtacgtataaacgtgcacttatcgatcgtgtggcggccttatctataaaagatttgcttcggtccaataaaaataccccgaggtaccagtacctcacgcggtaacaaattgttttcgatcgttggatctaacaatatccatcttactcagctagatccaacgatcagaaataatttaatactgtaaggcaccgatacctcgaggtatttttttttcaccggaacaaatctctatctataaataccacatacacgccagcttcagtctatcgcatcgctcacagccacagccacagtagcacacaccaattctgatctgccaccagcagctagctagctctcagccatgtcggccagcaacaacaagctgcaattcaccccacgtagctcgctatttcagggcaacgagatcaacttcagcatgctctacctgcaccacacgccggctggtccaagaccagaccagtccgggcttacaggcaataacagagaaaccggcttgggccccttggtcgtcaacaactggccggtgtatgacggcatcggccgcgacgccaaggtcgttgcccgtgcacaaggcctgcacatttacgccggtaactggcataactcctttagccttgtgtttaaggatgaaaggagcgtaatgtataccgttaactttttttaaacatatttgaccgtttgtctattcaaaatatttaattaattattaattcttttcctatcatttgattcatggttgaatatagttgtatgtatacatatagtttttgatagaagtttttgaataagacaaacagtcaaacatgtttaaaaaagtcaacggcgtccaatatttagggacggagggagtatattgatctgtatgtatatatgtgtatgcgtatgtatgcatgcatgcacgaggatggatacactactctagctcttttaatcacactataatgaaagctaagttctacacttgtattttggccattagtttttttctcaatcaattataacgtggcagtaacctattggtcgatgtggtgttttatgtatgtgctacacgttcaagggatccacacttgaggtgatggggatagtcgttgaacgaggtgagtgggctattgttgggggcacgggacagtttgctatggcaaatggtgttatcttcaaaaaattccacgaacagaaacaagaaggcaatattatggaactcactatccagggattttgtcctgtcttgaaagggtcacaggtaattaaggacaaaataatctatttttagctttgttaaatgttatgaatcacttgacgtgcaatatcaatatatatggaatatgcaagatttacatatatgcagagccttgtcaccaagattgggccttgcggcggaattgatggagggagagctcaagacatcacagcaattccaaagcggtctagaatccattacaatacatagcagctggaatgttgattctgttaggaaacgataggcgaacaaacgataaagaataataaatcaatcacaaaagacacgagatttaacgtggaaaaccctcccaaaacaggagagaaaaaaccacgggcgccagccagcaaaatatcttcactatatctgaggtgaggttacatcgtcgcacggcggcttacaagaggtatatatatagtggaaccctaaaagggatgatgatccgtacggcagaagctggcctttattaagtgcaaatgaatttggatcacaactcaacaaactccaccttgagacaaattccttcttgtagcatgaatcaatcctttaccctgaacacaacaaagacaaaaaaaaacactttcggcgccaaatagcctctcgggctaaaccactataccaactaagcttgagcaaagctcaaacttagcaacaggaacaggttttgtcattatatcagcaggattatcatgagtacttatcttgcatacctttagcttaccttgcgcgactacatcgtgaacataatggtacttgatatcaatgtgctttgtcctctaatgaaacatctgatctttggtgaggcatatagcactttgactgtcacaaaacaagttaatgcaagaatcaactccacaaagctcagcaaacaatcctttcagccaaactgattatttacatgctggcctttattaagtacaaatgaatttggatcacaactcaacagattcgatatcgtttatttacttggaccaagctggacagaagcacagagcaggtccatggggtggtcctggtggggatccctacatggttagtgaacttccaatacgatctgtatttgatactccctccgtttcacaatgtaagtcattctagcatttcccatattcatattgatgctaatgaatctagacatatatatctatctaaattcattaacatcaatatgaatgtgaaaaatgctagaatgacttacattataaaacggagggagtactatattttggagtaacaatcatctatccctttgttcaaaaatatataaacctagtaatttactactatattttggatagacgctcgcccagctcacaccagacactcacaattaatgaaaagaaaatactaatatattgggtagtaaatttcttaccatacttttatatttttccttttctttgtgtagattgaatttggcagttcagagcttctcaaggaagtttctggaacgtatggcctatatgaaggatggaaagttataagatctattaaatttgtcaccaataagaaaccatatgggccatttggacggtaggaaggaacccctttcagcgtcccggtgcagaacaactccagtatagtgggcttctttgggcgcagcgggaaatacctcgatgcagctggtacctacgtgcatcctatctaaacagtcaaaatcagcttcccgtgtttgagtttgaagtgtattttcagctacaaataaatatgctgatgggggttcgtccctttcatttctgtattgtgatgagtgatgctatgtagctggagtactgtcagcggtttcagtttgcagtgtgttgtatgcatcaataatgatcttcattgaaggttggtttggtgaatcaagttgtcattcaatgagtatatctatcaagctgaaattaatatttgtaatgccatactgaagattggttttagagagaatctattattctatacaactaagtttacttcaactcaacggttagccatcaactttgtcttccttagtaatatgccaccgattttgtcaatgttttctacaatataccattggggtggatatttttcaaaaaaatgcctaaaatgccctttaatacatagagggtttataattgattgacctactagaaaagtattgaaaaaatatgaaaatttttacatagcctccttaaatattatgaagtgtgcgtatattttaagactttcaatttgcatgtattgattttttttttgaaaatatcatttatgttcaatatgctaatagaatactcatgcgttgatgttattttatataaatcatctttcatatgacacataaaattatttttctaatccggctatgttttgtgtatgtgattcatctttcatatgccataaaaatagttttaaaaaaacattgaagaaaatcctaaaatatatacataaacttctacattctgtaagaagcctacacaaaaactttcatattttttcaaaacttctaatgagtcaatcaattatcaactcttgtatggcttgaaggatattttaggcatttttaaaaagtatccacctcagtgtggtacattatagaaaaaattgacaaagtcaatggtatattatagaggaagacaaaatcaatagcaaattatcgaagtagagtaaactcagtagaataaaatagattctctcttagttttataccatcgttgtgaagtacacgaggaatattatgcatgttgtcatgaatatgcatgtacacgaggaacactgcaggaataaccactaaaataataaaaaaagattagcaacattagttagtattatctgaatttcagatttatttatctatagctaaaataaaccagcacgtgatcagcagaaatttgtaacctcttctcttgctactgcatgctcctccatactcctattgtcttgttgtgaagttgatcatcttctaaggtttaatgttgaatgtgactggtatttctaagcatttctcttagttttgacattatacagtttttcggcactcccataaaaagaaaattcaaaaagaacttcttgcttctttaattcgcaacaacggctgaatctaattgtgcttgtggttggctgaaaagtaaacaagatgatatatccaacaacgcctgcttctctttttaatttaaccaaggtagatctcatgcctttctactaaaaagaagttgttgtggcaaagatgaaggatataaatcaaactaaaatggggactacctagatatcactcgaaagattttctttaataaaaatcacactaatataattaaagcataagtatggtgtaattacaattacatcatttgtatataaatcataacaagattgatagcttgctcatttggttacaaccacacggcatcaaccaagaggttgtggcgtttgccttcaattttttcatctcaatgcacgcatcatatggtcaggaattgcgtgtgatggctatggaaaaaaagaaaatctttcgagtgatttatagtaaaactgaacaaaatgggagtggacatagcgcagatgacaagatgcaggcagtgtgctgcccgtggcccatgtttgactctccaaaacatattttttttactcaataaggagagagtatggggaacatttttttttaccatgttcgataatggggaacatgatgacaagatgcaggcagtgtgctacccgtggcccatgttgaacctttttttttatggttgggattaacattgcgctgggagtgggttcattccgattatgggactgagtgacaaatcaatacctataactctaatataagtgttttgatttattaaaaaaaattggcccctataattataagggatccaaggtggcagtttttaattttaaacacgtcca

SEQ ID NO: 81868 - DNA, 785 bp, Oryza sativa
aactggtgttgctcaaggtagacggctggagtaagagcgtcagctagttcatctgggagaagagcttggatgtctgtgaacctttcccggatcggtccacagttggttaccaggttatccaatgatgcttctagccgatgagagatgtctttgagcgttctctttacatcatcgggcagaagagctgttgctttactggtgatgtcttgttctgtttcatcaaggtaatcttttatgtcgaaagagaacagatcggctaaaacctgcaaaaggtaatatcgtggatgattaaggatcaagacataattgcccgatttcaagtttatatcaacagaacttactggaataacaggagcagctagttgttcttctccttcaacatgatgactgtctgcagccgatggagtgcggccacctgattccacctgcacaagaggagaagaagagggaggaggctgcaaaaaggataaatgttagacatagttggttcagattagctagagagacgatgaaaagtatcttactggtgcagccggtttaggagttgatgtagccgatttcttccttacagcggttttctttttctgtagttattaaaactatgaggaatcggctataaagtaaaacgaatacaaaaggaagtcgagagaagctgcttacacttaggaagtgaactggagcagaaggagttgaaggggtatgcttgggtgaagccgatggtgttctttctgtgtcacttatttcggctgcggcttgatcgacatcatctccaatcacttcttcat

SEQ ID NO: 81869 - DNA, 4609 bp, Oryza sativa
acgacgcgaacggagggcaccaacgggtagagggcgacgaggcgaactcaccggtgaccaaagcggcggcggaagagcacggacggcgccggcgacgaggaaaaaacggcggcgaagatcgggtcgacggcggcgacggtgctccggcggtcttcggcggcggtgaagcgacagacgaggacggcgacgacttggcgatcccgacggtggccttcccgagtgacgacgacgaccgaagcgacggcggcgcacggctggacgaacggcggcgatggcggcgcaaaagctcacggggctagggcgctacacatggcgagagacgaaggcgagggaggcggcgggtagaggagacaccgggggtccttttaaaggggctaagaggcggcggcgaaggcccatggcggccggcggcgagaaggaaacttcgggttcgggagagagagaggaatccgattcgatctcgaatccatcgacttccatatcgaattaggcgacgattccaaaagagaaaaggaagaggagatcgaggagattatttcccatctatcgattcggccggagaaggaaagacgcggccgaatttggaaggagacggcggcgcttgcgctagggtttcgggcggcggcggcggcgcgaggaggaagacaggcctgacagacgggccccacctgtcagcggctgagagagagaggagagcggcggctcggcggattgggccggactgggccgagggaaagagagagagagagggttttgggccggctttcggcccaaagccaaaagaagacttttaaaaacttttttcaatttaaattattcatgaaatgcaattccatttattaaaaatacttccttagctcaaataaatcccagaaaaatctaggaattatagaattaagcaaagtatttaacaaaattttatctagcccaattttatgttgagatttaacaaattaaaattagatcttctcttttaggcttttaaaatcatttctaataattccttttaaacaacaatttataatttaaggattttaaacaagaaaagcacttaacaattataattagatcattattgatcaaataattactgaactgttctttgtatcatttaggaattgagctctgaaaaatccgagaaaatctcagagagttgacttaaacatggagaatttaataaaaattaaatccatccatgctttatatttaggaaattttatttcccacatttaacttcacttgtaaattaaagatcatttaatatgaattctaataataatttattaaataatttataaatcctgaaacgaaaatcaggatgtgacagttccacactcgttggttgtgccctgccgctgcagcctccctgtcaccacagatccgcgatcaccgcgtacgctaagcgtgccatccatggatctatcactcgatctctctagtcgttttcggccacgctcggtctcgtctttcggccacgttccatcatagcaggtctaatcatcagtgaggtcatcgcctctacaacttccttgttgtcgccatcaatctcattgccatgactgatgattttctgtcaatgcacgaccgcacttcatgtttcttccttcgcatgtcttcttgatctgatgaaaccttcggctctattactacttgttataaaagttagttgatatagcggaacgacgactaaccttctcaatagcttcgtctattcatcacccaagacatgccagatgacgatataggaacacaagatatttgttaacgaggttagccgaaacctaatcccaggggctctgattatgggcgttcctccccaataaatatagcaccttagctgccacgagtacatggcctcgtcatcatcatctccctgcatgtttatcctacgttgtagtctacatggttatattgtggtgcccccctctctatttaagaaagatttttgggttacagagtgtgactctaactatacccctaccacctattacaactataaatccatttgtaaccaaatagaactagtatattcgatacttattctaacaatacgaactaatgatcataacataattgggtggtatagtctttttagtcttcttttttgaaatagaccgttaacatgtcatatgggtaacgctagtccaaaattggtgaccaatcgacttatggattgaatagagataattgaattgagggaataaaagcaagtgttacactgaaacaatctgaaccgaccaagttaaatcgaatgggcagtggccaataacaaaggtactttggagcgctaaattttgatctaatagataaaatttattgacttgatgttgtgcaattaaaagaaaggaaaatagctttaattgcatccaatggagatgaactttatacatatacatataggatatgcaaaaagaatgatagatgcaagaatttccattttgcctttctttaaaagaaagggaggtactagctagtacaataccttgggtggaatataatcattatggctttgatttcttgcaatcgaagcaataagaataatgagatcgagctatgtcgcggaacggaaagaaaataaaagaaaacaaaaaaatatgccagcatcaaaatagcaaaacatttgatgccatgcgattgcagtcattgatgaacgatcgatatatctctgctgatttaatttccaatgagaattcatttgtttctttcttccttctgcatatattgtttttttttctggtgatttttctcctttgttgaattactagcactcctctgtccttgtttaattttctttgtacaaaacaaaacgtatattcactcatcactcttccccatcgacactccatacctttgctgaacccacacttcttctcttctctcccttgattcttccctcttcttcaagggagtcatagatacttcatcctctagttctccttctcttgtataaattttcacgatgcaacttcggcagaggcaggaaaacattcatcatccttcagcgggtgcacagcaagacagcgaggcatcttccacctgcacctttgtgacaacaacgaccgacaatgtcgtcgtcgagcgcatcatggtttgcgggtgggcaaagacaacatcttttttttccttctgcgttgtgtggtggtcatatctctcttctctcctcgaattacttttacggtgatctcaaaaggttgccaacaaatacgttgcacgggctttttagtactattatacaaaccgtatgattttaattatgtgtcgggtgtattggttaaaaattttattttctgtggaaagattaataaattttattagtcatttaacataaataaaacttggtgataaaaaattatatagaacatgttgcaatattccatctgttgctatctgttttcttaatttaattgtttaaattttttgaatgagtaagtactgatttttattcatatggtactctcagtatagtttttgtcttgacttcattcagtaatttaaaactaataattaagtactgagtattgtttggcgccttgtttatagcttttgaatcatttaataattttgaattctgtatgtaacatatatggagttgtatttggcttggaatctcaagtatagttcttccatgatgtcataattctgtgactggtattaataagtacttgtaccctgtcaaaaaaaaagtactgagttgtactccgtttggagtttcaattatgctttttcttatgatttaataatacagaaatttataattagtcattgcctatttgttattgtattgaagtcgttgacattattccgaaattaggaaattaattattacaaaattaataataaggaattttagaattaacaagtatcaagctatactaagtatatccttgatttaatgatccttaaattcaaattgacaggtacggagtagtatttgtggtattatattttgaatcttgtatttcttcaaaattgactaacatgtatttttgttttattttaatctgatttagctgatatttgcgtgtttattttcttcggaatttcagttacatgtattatattttactatatcattctaattctacctcacagccagtggaaggccatattatttttcctttgtcctaactaatgttagaatttgtcctaattaatgttagaatttcttataggcctaacttttttaaagataatatacttcctctgtcctagaatatttcatttctaccattaagttttatcaaaaaaaatattatatttctaatgaggtgggacccaataaattaattggatgaagattgcattgcctcaaccttcactttaatcaagtcctctaataagattattgtggtcatttgtgtatgctgctaatctgagattcaattattctctaactccatactttttagcaaatgatactaggaaaaacaactccgccaaaatgtgctcgagtaattaactaataacctactctgtcctgttccataattcttgacattttgaataataacacggtctccaaaatatatattttactatgtttttctattataatatatacaataaattaggcaaaatttgccctgggacacctataaattgtgtaatt

SEQ ID NO: 81870 - DNA, 4913 bp, Oryza sativa
ttagctccgtggcataccagtgctccgcccgtgctgtgcctgcgcctcgccgccgcgcgtgtgccacaccgccatgcctgcactgcaccctcgtgcgagcaccacgccaccgcgctgcacagcgcctgcgctgcccttcaccacgccgactgcgcagctagggttgggatgggaaatttttcacgagagagagagatggggaggaagggaaggggctcctccacaatctccggtcaagcagagcacaagcgtgctagctctcccggtggcttgcctcgccggcggcggagacggcgacggtgcggcgcaggatggagccgcgggtggtgttggtgcttgcgctggtggcggtggcggcggcgggcgtgccgtcaatggaagcgccaagcggaaggggaagaagagaaggggcaaaactgtcattttacgcggtttctctctcatcaattcagtggatattatattttaatgtgcccagtgtcctgtggcaaattaccacacttttagagtgtcctcaggcaaattcacgtttttcgggtgtcccccagctaattacataacttttgagtgtcctgtagcaaattttgccaataaattaataaagttagtttatttttattgtagtacattgtaagacaaatttatatatgttgttttaatacctttaaactaaatagctttaaagttactgatagtcaaagttataaaagtttgattttaaccttgttctaaacgtcaagaaatatggaaccggagggaataccattttcgcatgtgcccgctctcgactaatctcggtatattacgtactcgtacagtgatattagtatattaaaagaaactccttgctctttgtcttacattgcaactaattatgctactaaatttttcaagtaaaaacgtagtgcaagataatgtgatgaataaccaacaatcttgtattcaatcaagctgtataaaagggaaatttgtaaatggagatgtttacctgagaaaaacataattgctgcttcgtccatcatgggtgaacgtctgagattatatgcaaatgcgaacatgacaccacggcatggctgcttagttgctttcaatagcaattccgaatattcatatgggtacagccgtacatgagcgttcaatccaaatattacgtatggttatatacctttgaattctgttccacgcatgctaatttaatttctgtggaaaagattcttacaatatctatagacaccggtatgattagacttaccatcatgatgatacgatccacataaccaataactagatgtttctgattaatatatatggagctcgtagaaagtgtcaaattagtataggtatagttatactgatagattctactagcagtattagccagtacaaatggcctcaatggttgatttattagttttattaccagtagttatttatgatgatagtataaatacatatgatctattcgcgattctaatgcccctctaaaacatatgcgcagagatcttcacagatgacagggtgaggaccctatcacaccaagtctccacacttggggacagggtgtgggagttggagcacaaaaaccccaggctgcttggcgagaaaggtaaactggagaagcaattggaggagaccaaggccggggttcatgcccatctaagcgagaaggaaaggtggagaggagcttgaagggtgaaaatgataagcttcggttggaggttttgaccccggaggaaaaatatagccagtctgcagcagaggttgagaagcttcagaaggaattagttgcattggcagaggtgaaagaggtagctgcaaaggcatttgatgatgagaaagcaaaaatgatgatggaatctgtggatcttaagagtaggctagaggaaatccagggtaacatggatatgattaagagtgaaaatgataagcttcggtcagaagctttggttgcagagcagaaactaaacatatgtgaagcagagattgagaggcttaagatggaattgggtgcattgacagaagcgaacgaagcagctgcgaaagcatttgacactcaaaatgaagaaatcacgaaggagctagaggatcttaagacaaagttggaggaaatcaaaacaaataaggatctagcggaaagtgaaaatggtaagcttcggtcggagcttttgtcagcagaggagaaatacagccagtctgaagcagaggttaagtatcttaagcaggtaatgggagcagtggtggaggcgaaggaggcagctgcaaaggcatttgctgccgagaaggaagacattatgaaagaatcagacaatcttaagaggaaagttaaggaaattcaggatagcaagcttttggtggagagtgaaaatgatgagcttcggtcagagattttaagtatgaagcagaaacatggtcaatttgaagtagaggttactagcctcaagaaggagctgggagcactagaggaggcaaaggagatcaccacaaaggcatttgaggttgagaagacagaaatcctaaaggaattggaggatcttaagaggaaggtggtggaaatccaaaccaacaaggatttagtggaggtagggaatgataaacttcggttggatgttttatctgcacaacagaaacaaagcatattagaagtagaggctaacaatctcaagatggaattgggtgcattggtggaggcaaaggaggtggctacgaaggcattcgacgctgagaaagcaaaaataacgaaggaattggaggatgttaagaggaagatggaggaaatccaggtcaagaaggatttggtggagggtgaaaaggataagcttcggttggagatattaatagcggagcagaaacatagcatgtctgaattggaggttaaaaggctcaagatggaacttggtgcattggcagaggcaaatgagacagctgtgaagtcatttgatgctgagaaggaaaaattcatcagggaaatgggggacctcaagaggaagatagaggaaatccaggtcagcaaggaagctgctgaggaagtagggcgcaacaagaatgcagaggctgataggctgagggctgagttggtgaagatccaagtttctttatcgcaactacaagcatcctataatgaacttgatgctaagcattctctcctaaatgatgagaagaattcagcccagaaagcattagatgttgagaaggttgaagcatataagctgaagtcaaaatttgaggaacttgaaaattataaggctgaaaaggatgaagaggctgggaaactgaaggcggcattggaggaaaagaaaagtgagattgatgtcctcatcaaggacaatgagttgctgcgtctcgcaattgctgaggcacaggaaaagaataagggaagcattttatcatgcttatcaccatgcggctccaaataattaggtcgggaatgtgttgcattaataatgtaatggtgatcaattaatactatgcaatgaaataaaactttcacttcctttgttatatgtgatatgcaagaatgctaatgttcttgattagtcaggtacattttgtgatgtctctaaactgagtattttggtaaacctgtcaccttaactattactccctttgtcccaatttagagggcatgtaaattttttgacggtgtaccaatttaaagggtgtggttccttttccactgcttttcttcccggagtaccctctgcattcatgcacatgacgcttgcacatgcccgcgcaataagggtgtgtttggttcctcgcatcttcctagcatggcccatcttcctcatccaggttgagtttatcctgttaagtggatacacacgcagtcgtttggttgtttgcatcagtctagcctggctcgtaccagatattgtttggttgtttgtgcgatagatacggtttggaagagaatttgtttggttgattttatgagccatatgtatgaggactttttttttcctgtgggtgagattaccgattgcaactattttctatattaatatttttcttctggtaaaactcataaattgaactaattgtctaaactagatttcggcaataataaaagggggtggctatcaagctcgagaagtgaatgggtttggagacaaaggatttatacaggttcaggccttctcattcaagaagtaataccctactcctgtccggggatgaatccgccgagtatcttattgattgtatgatttggagaaaatcaacacatgcccctagaggcacccggaccccccttatatatgggaaggagtccgtattacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggacatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcgtgcatcatatgacaaaagcatacacggcgcctaaagaggcattcttagccgactgctttttagccataattaaaaggaatccgagtggttaacactctaaaaggttcacgaatgaacacacttgacaggcatccgaatagaaaactctaaagattacccaccaaatattataaaaattatggtaatgaataagtctaata

SEQ ID NO: 81871 - DNA, 13936 bp, Oryza sativa
aagttaacccatacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaagcccattcgcacctccgatacccttaacaagaaatcccgtgatccaagcgacacttcatcttccccgccggaactctcgccattttccccactccctgctacagtacagagctgcgccggcaaactagggttcaccattccactcgaatccaccttcgaaaagttcatcaaaatccttcccgtgatccaccgcctcaatccctcacctctccctagccatccctcgaatcaaatcagcgcattcggaaaaaatcaatggcggaagagaaggaaagctttgaaggccaatgggcgccatccgacgtgacggaggagaacctgaaggagatggtggcgcacggcgttctccctgccaaggaaatcatcgggtggcggccagcgtgcggtgaggcttttccgacccccgatacacacgaggctgtagtcttctcccatttcttctatggcggcttcgctcttccgacctcaaaatttttccgcgggatattaagcttctatggaatcagcttgcatcacctaaacccaaattccatagttcacatcgccaatttcgtccatgtttgtgaagccttcttgggaattaagccccacttcgctctgtttcgccgaatcttctttctcaagccccaaccaaacaagagtaagccatgtgtagtcggaggggccggatttcagctgagggggactctgagccagaagtacttctctatgcccttcaagacctcaaacaaagggtggcatgcaaactggttttatattcagaatcctgagcctgctcttcccgagtactcttgtcttcctccggtgtaccaagatacctggaactctcttccgattggggatgaagcagcccaagccttggagctgatggatcgcatgctaaaactcaaagaacaaggcttacaaggagagcagattactcggcacttcatcaaatgccgattggcaccaattaaagaaagatcccgtacggtattcgagtttgacggcaagcatgatcctaatcgtgaagaaccagattctctggattttaaaatcatgaaggagagaatgtgtaaaatcttctcaaatgctattgtcgtcagctactcacatcagctgccagttgtgccatataacgcattcaatccgcctccgcaggtacgtatccgaaatcttcaacctatgaccaaaacataatcttgtcttcatgttgagttaactaaccgtggaggcatctcattcaggaatatgtattgatgaagtctgaccccccaatcactcagcgccggtctcctcgccagcacaccgttcagggaggtggagggccgacaatcagatcagatccgcaacctcaaatctccaatccgactgggcagacaggttctcgcaagagaaagctggtgcttaatgatgacgaaggcgacgacggcaacaaatctggggacaaaggctcgcccaataaactcccaaagcataccactcccaggaaaaaactggctagtcgtccaaggccaaagattagaacatcttccaggtataaacctcttggcaccatttcacttcaacatgcttctctcatggaaataatactgaatattgaaagaacactttgcaggaaaccatccgacatagatccaactggaaaagatcctgatccgactgtgacagaaccaagttcatccaaggattctgagccgactgccgaaagccagccgactggcgcccatacttcaggtgataaggccaatccgagtgaccagcctccgactggaaaccagtcggcagcaactgaaactacaacaacccaagagcccccgattggaaaccagtcggatgtaggtccagatcaagaaactcccgaagttgaagcgcagacgacaacttctcaaggaccagaggctggtaacgactcgatgattgggtctccagataaagaacaaggatcaccccacgctcagctaggaacatcctcaagtaactcatcttctcaagtgatgccgatttaaataacttcagcttattcgtctaatatcttggaaatacatcaggaccaccaggcgatgacgaagaagaaattcctcgcataaaggcggctgatgactctcgtcctcctatcttgctcaaatggtgggacgagaactcacaagctgccggcatcgtcataaatcgtcaaaaagaagatgaggaagtgtgccagctgaagaaggcacttggagaagccactcgcattgtgaatgtaaatcttccgggtgactgcctttgatgactttgttttctcttcagcaaaactaaaccatgaaccatcatgcaaagaatccatcttcgcaatgaggccaagaccgcaactttagaaaagctggttcctcatttgggaactcttgaagcagttagggaccagctacacgaggccaaggagctcgccaaaaagacagagaaggaattaagggaccgaattgctcagctccaggattcaaacttcgagctgagtggttcatcaaaaggtaatctctagatctgtcccattaatttacgctgtcgtaactgtatcctcaaccatttggatttcaaacagcgcaagccgccaggatggctcaaatggagaaacaaattgaagccctggaaagagacaaggtagaactggctgcgcaaaggaactcggccttgaaggaggttgaaggtactgccagctgacaatctgaacttctctctttttaatgcagtagatttttatcataaatgtgttttgtagaccgcaaaatcaaatctcaagctcaatttgacgtcctggttggtaagatcaagaggcttgaaggagcaagagatgaagtcgctaatgtcgctacaccactcgtccaagctatgttcctcaataacagtggtccgagtgcactcgacgcaaccgaaatcttcgacaagctgagagttgctccggatgtatatttcaagaatatcaagaaagctggaagtatgggagctagcacggcattggcgatgaccaaatccttgtacccgaggattgaaattgacgccattgatggctttacagacgggacaagcgtagaggctgctcttgatcttatcagcaatgctcaaaatgcggctgacaagattgcaagtgacgtcgtagatcaattccgcaacaccgaccttcagccgagtagtaataactctgatgatgaaaggattgattctgactgagcataaatgtagcaaatggaggcataacttgtacaatactggtgtatttatgctgtgcttgataattctagccaagtctttgatttcttaaaagcttttatcaagctttgttgagcctaaaacccaaagaagctattaaaaactttcagtcctcgcagactaagtagaaaaatcaaacaaggcaatgatagaccaaggaagcaaattgaattgataaaaaatcacactccgttattatgatgatagaccccgactgacaacttcaagaagaaaacttgatgttgacagtcaagatagggaagtacagtgataagcttaagcgtagaaacgacgaagatgttcgatgttccaagagttgtcgacgagtgtaccgtcttcgcgcttgagtcgataggaacctggccgggtgactgcagagatgataaatggcccttcccatagaggagataacttgtgccgatctcgtgtagtttgaattttcctcaaaacgaggtcgccgactagaaaggcacgggatcgaacattgcgattatgataacgtcgcaacccttgtaagtatcgagccgactgaatcaaagctgcttcgcggacttcttccagtcggtgcaagtcatccactcggtcctcctcgtagcgttcttcgcggaaattacgaaagcgcaaagactcgaattcgacttcactcggcaacattgcttctgccccatagacaaggaaaaaaggtgactggcctgtggcccgactgggtgtagtacgcaaagaccaaagtactgatggtagctgttccacccatttaccggcatagggttttagccggtcaaaaactcgcgctttaatcccttgaagtatcatgccattggctcgctccacctgtccattgctcatgggatgtgccactgaggcatagcaaatcttaattccaaagtcttcacaaaagtcttgaaaaactccgccagtgaattgtctgccattatcagtgatgatccgattgggcactccaaatctatgcacactgttgatgaagaagtctcgagcgttatctgctgtgattgtgacaaccggtttagcttcaatccacttggagaatttgtcaatggccacaaagaggtgcgtgtaaccgccgactgcctttttaaacgggccaaccatgtcgagcccccaaaccgcaaacggccaagacagtgggatggtctgcaactcttgagctggtagatgaatttgtctggcaaaaaactggcaaccttcgcacgtgcgcacaattttgtcggcgtcggacactgcagtaggcaaaaaaaaccctgccggtaagctttgccgacaatggtgcgtgcggcagcatggtttccgcatatcccagaatgtatgtctttcagcaattgtctcccttcctctaaagatacgcagcgttgcagaatccctgaagggcttttcttgtacaactcagcttcatgcataacataaagtttgcttcgtcttgaaatccgctcggcttcatctttgtcttgggggagttcttgagaagtcaagaatcgtatgaggggctctcgccagtcggcttcaaccatagctacgtcatgagtgcccgcaacttgagtagtatctttgtgaggtactgtcggcgtataaaggtgttcgacgaaaacatcggagggcgccacctcgcgcttggatccaaagttggcaagtctgtcggcggcttcattattgtgtcgaagaacgtgactgagctcgagtccatcgaacttgtcttccaatttgcgtacctcttgtcgatatgccatcatgttgtcgtcaaggcaggaccactctttcataacttggttgacgaccagctgtgaatcgcctcgaactattagacgctttatccctagggagatcgcaattcgcagtccatgaaggagcgcctcatactcggcgacgttgtgggacgccgaaaaatgtatccaaagcacatagcttaatctttctccagctggggaaattagaaccactcctgctccagtgcccgaaagtctttttgatccgtcgaaatgcatggtccagtgctccatcttctccgcgggggtatcctcctggcactcggtccattcggcgataaaatcagctaacgcttgggacttgattgaaattcggggcttgaatgatatgtccaaagacatcaactccaaagcccacttagcaatccgtccgtttgcttcgcggttgtgcagtatatcaccgagtggaaatgatgtgaccaccgttaccgagtgaccttgaaagtagtgagatagcttcctggtagtaattagaataccatatagcagcttctgaacctgagggtacctcgttttggagtcggctaggacctcgctgacaaagtaaatcggtcgctggactttctggacatggccttcttcctcacgctcaacgactaagactgtgctcacaacctgggaggtggctgatacatacagcaacaacggctcctgcgggtgtggtgaggctaagaccggtggctcggtgaggagtttcttaaaatcttcgaaggccttctgtgcttcgggtccccattggaaatcatctgttttcttcagtagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatacccctatgagacaccataaaaccaagcagcttccctgacggtactccgaaggtgtatttttcagggtttaatttcatcctgaaagcgcggatgctcgcgaaggtttcttctagatccgagattaaatcatccttttgtttggtcttgacgactacatcatccacataggcttcaacgttgcggccgatctgcgttgagaagcatctctggatcatacgttgataagttgctcctgcgttttttagtccaaacggcatggtgacatagcagtatgctccaaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttagggcaagacttgttgaggtcagtataatcaacacacatgcgccattgccccgttttcttccgaactagaaccgggtttgccagccagtcgggatgatggacttctttgatgaagcctgccgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggattagaaggatctaggggaatcttcttagtcttggcttcgctttctccactttttgaagtcttggtagcgggcacttctccttcgctcgccgtggctgcagccagtcggatatcctctcgggcagacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtctcgaaatcggcgacttcaaagctgatattctctgtgcggaagttttcccgagtgccaaaagtgaccgggagggtgatctggccgagtggagttgcggataatcctggaattactccgtgaaaaggcgcattgcttggttttagctcggagcgaggaatctgcatatcatccaaggtcttggcgaagaggatattgagtgcactgcctccgtcgatgagggttctgcgaagcttgacgttacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccgccgaagatatggttgagctccttgcggtggtcttgaaattctaccggggtgtcgccgtcgtccttcttcctcgacgtgctttgttcttcgtcggagttcttccgtgtagtcttggcgtattgctccgcgaattgcttgtagacgaaacaatctttggccacgtggttggagttaggatagtgcgggcattgggagttcatgatcttgtcgaacgtgttgacgcgcgaacgctgtcgagaagagtgaatggcggttgcaacaagttcctcaggcttacgcttgcggtccttatgattgttacttccacctcctcccgtagccggcgtatccttttttggcttccaactgggacccgactgctttgatgcggtgacggcgtcttcggctttggcgtactcgttggctttttcaaacataagtttgactgtcctgggaggtttacgcccgaacttgccgaccaattcttcgtggcgaatccctttggtgaatgcggcgatgataacgtcgtcggtgatgtcggagatcttgttacgttgttcagaaaatcgccggatgtaatctcgaagggattctccggacttctgaacaacgttgtagaggtcgaattgtgtgccgggacgctcgaaggtaccttggaagttggcgatgaagtggtcgcgtaattcggcccaagatccaatcgtaccacggggcaatccatggagccaagatcgggcggaatccgctaaagccactggtaaatagttcaccatggccttgctatctcctcctgctgcgcggatcgcgagaccgtagacggtaagccacgattctgggttggtggtaccgtcgtacttctctattccagtcggcttgaagccggctggccaatccactcgacgcaggtcgtcggtgaaggctgctactccatcaaggtcgtcgtcgtggcggtccggcgaatgatgatggcctcgagctgctcggcgctgtatgattgtgtcgcgaagatcgacggggcggcgacgaggtggtgagcgaggccgttccactcggcgctccctatgatggtcgggaggcgagtgaacggaccgctcgtcgtgacccctgctcctgcgattggatcctgcgccagtgatgctgaggcttggatgacggtagtcatgagatcggaagtgggggagtcggctgccagtcggcgtgcggacgctttcggagttaactgggaccgaagccgcaatcatggtctttgtctggttcaagatgttgacgacgtgatcagattgattgagctcgttttccttgaggagggtgtcgaggagggtgatcgcggcaaccgcattctgttgaggggtgcggaaaaccggtgtcccttcaacatcttgttggccgatgaaatcacgcgctcggcgccctgcttccaaggctcgctgctgtcggtcctcagcctccttcgcggttcgctcacgctcctgctgctcacgccgtagccgttcttgttcttgtgcttgacgctcctcctccagtcggcgacgctcagtctcgcgacgtgcttcggtttcccgggcttggcgttgctcctccgtctcgttatcggccatgaagacgccgaagtagagaggggtgtagttgtcatctaggcttccgtcgaagtcgtcgagatccgggtcgttgtagcgagagctaaactcgtcgtactctacgatgtcggtgggacgcgagtcgacagtgggagagctgtagtagccatccagctgatccgtcgaaaccgtgccgagtggttggaggatgacgccgacttccctgaagctaggcgaaatcggtgttgaagccgacttccgcctaggcctacgggatggagacgctgtcgtgatggagacggccgctaaatcgtcggggagcttcatcaggatcggtgggtaagcctcatcatcttgatctggtgacattggagaagatgcgatctcgcccgagtggtttgaagccaactcgattgagatggtcttgaagtaactttcagccgcgtttgggagtccaaacgggactgaaatccggttctctcccgactggtctgactctgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgcacccctacctggcgcgccaactgtcgaaactagatttcggcaataataaaagggggtggctatcaagctggagaagtgaatgggtttggagacaaaggatttatacaggttcagaccttctcattcaagaagtaataccctacttctgtccggggatgaatccgccgagtatcttattgattgtatgatttggagaaaatcaacacatgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggatatccataatctccacactaatgcagtcctacacagtaaactaacagggtatttattactataatagtggctacttattaccggttggagaaagctaaaaaatgaaaaaggagaaaagggaaaaatcgtgctagtcccttcgcattcctcgccactaagcacgacaattcgctgcttgctatctgctccgctgagcctggctgctcgccatcgttgccgcatccctagaccactccaattggttgcgccatggatctggcaaggatgacggcgacgacgacaagggtgcgaagttaatgaccttgacctcgacctcgaccattccaattggttgcgccatagatctggtggtgccgagctcaaccgctcgaacaagtcgccgccccggatctggctgcgacaagcttgtccacgaaaaatctgacggtggcgaactttcagtcccagttacttactgctagaagagatggtcgccgatctttgtcaagcttctctctcccttcatcgcgtcaccggtgagcacagtgaaacctagtttggatcttgtggaggaaaaatgaggaggctgggtgcacccttgcacacgcgggtgcagccgggtgcacgcgcgcgtgggtgcagcacgttgcatctgtcgggcctggctgaggtgcgaagctcaaatagagcgtttccccgcagccagcctgaggaaccctttttgaacgagtggagccaggctgggaaggtcacccaggcaaccaaacaaagagagaatgcatccatagatgcgggccaagctgaatgcaagaaacgaaacacaccctaactgatcaggcgacgcaactgcctgcacgtggagctgcacacgcgtgggaccacaggattacatgcatgcagttgttacagctggtaaaataacatactataagtcagctataaacacatatcgagaagataaaagaggagagagaagagcagcgtgctacatatttatagccagctgcagcacagactcttacacacaatgtgagtatgacaaatggaaccatgtaataatagtgtagtatatgtttataagtaattattgtatgaattggctattaagttgactatagttgatttggagctagtagttggctatactattaaacttgcacttagtaatctgcatgtgtttggatcaaacctgttttattaggggcagtttaggaaaaaattaactctgcatgtgagctcgttggtctcggtgaatttatttgtgcgccctctaaattggtacacaggggtgttgacggtcgttagcgattagtttcgaccatcaatattactaaaatagagaagaactagttatgcttgcaatacatatccatgttagaataataatatttcactagtatttggttcactaaccttttatagacaataaccataaagtggaggagaatcgacaacaaatcagatgataaatcaatcggacaatgtcgagaatcagacttatgcatgaatgggccaagaactcagaattgacacgaccaattgggccaaaattcacaagtctgcataggagagcaacggaggaggccatctgccgattttgggccaggcccgctgtcacgcccagaaatatagccctaaatttccagactattttgtgtattaaatccctgtccaggaccagccagggtacacaaaaagacaagtaatatacagttccaaacataaataaagcgtaaaatacttacagaaggggcacttagtccccacaccgaaacgaaagcagcagcagcggaaaaaggcgatcctaacggggcttcaggtccactccacaggcaaactcaactggggtctgagccttggtcttctaacttcgtcttcaactcagaagcactacacttctgaaaagggggaataatagcaaggctgagtacaaccaccgtactcagcaagccgcaccaatgatgcaaacgtgcaaggggatacaaggatggtttgtggctatttgcataaaggcggttgtaaaacattttattgagcaaaacagtaaaatagttgagtaattaaagtaaccttaaatctccactgatcaacgctacaccacgttgaacaggcccaaccaacccacctgaactacagtgcattaggtcgatttattaagtgtgagactaatcacggtgaatctggtcgaccacccataaccgcggacacggctattcgaatagttttactctgatcagaggtgtacaactgtacccacaagacacagccccacgacacgtttccgtgcgccgacatgccaacacgacataccggaaagaggccgtgacaggacccttcgcataaccccctctaaccgatcgcaccacaccttaaggttcgcccccgtccccagcaggcaacgggcagcccccctttcgtgccgcggtgaatctagaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaattgccatgggtgcgactagcgaaaccatgcacccacagcccagcatgtagtcgcattttagttggataattacgaccatgaagcatggccaggtgtctcgagcacgcagctcattctgatactaaaaaggtctaatattgtaattatcccatcaactgagctagtgttatttaagcagggctaagcatatagttctagctaggtcacataagtaacatgagctagtcgatttattacccacggttgacaaagggcagatatcaagtaaacatggcacaagcgagcagataggtaatacccgaatcccatgtaattaacaaaacatgcatatttatttgtaaacggtaaaatatttataaattgggatcaacatgctcaaggggaatgtgtgacttgccttgcttcttcaaacaatcttccgaactcttatccttgcgaccgcgaacatccgaaacgacggattctacacgctggcacgcaaaacgaggaaaaactctaataaagaccaagcaaacagtacataaaaagtaaacaatcatgtagagctcaattttagatgaattttgcaagttgaacggctcaattcggagttcgaatgaattagatatgaattttataagttttaagccatttaaatgaatttctataattattcacgaattattgcgcaattattatttattttctcaaaggaaaaggctgtggtaacgtcagcaaagggccggcaccgacaggcgggccccactcgtcagcggcacaaggggcaagcacacggtggactcaatccatcgcggccgaggcggcaccgtggacccggaccacggaagtggtccacgggaccgacgccctggattggcccaaagcctatccaacggccatgggtggcgcggctggggcaaggcacggctcaaagccggctggacgaacgacggcgcgcggcggcgcggccacccgcggcgacggccggtgacagctcacgcgggcgaaagcggcgcacgcgagaagagcaccggcgcggcgcggcaaggggga

SEQ ID NO: 81872 - DNA, 674 bp, Oryza sativa
ttttccggtgcgtgggggaaacggcgcggacgtgggcggcgaccgcgcccacgcatgcgcgggagagggaaccgcgcgaggaaggcggcgacgtggggagcacgggcggccatggcggcggttgtgaccggcgtgaggaaggggatgggcctgacaagtgggtcccgcggtcccacttgtcggcctaagggagagaggaagggcgagggggggggggttatgtagatttttcaagggagagagcaagcaggccgagcggatgggaggcaggaggccggcccagatagagagaagaggggagggggattgggccgggcccaaggggagaggggagggattttatttgttttacatttaatttaattggtttaaatgaactttgtattattataattacttcttgtgctccgaaaattcgcgggaaatttcagagagtattttagggcacaaagaatattacaaaatattcccgaccaatgatttttaaagggaaaattttaattctcccaataattcacttggataaattgcttaactttttatttaatttctaggaaatgcattattaaatgatttttaatcccgaacgaaaatcggggcgttacattcttgctcttggtagaggcagaagcgcccgcttgcttgctgctttgctttccgtgaggtttcttgtg

SEQ ID NO: 81873 - DNA, 5315 bp, Oryza sativa
ctgcagcccatatcactgtatagattgaaaccgagaggagtgtgcatgggatctcggactcaaaccgagaccgagaagaggggtgtgttttattttcctttttaggggggaatcggatctagagtaagacttttttttatttttttcgctatttatattgttttgacgggagtcggacctgagagggagtcggactttttttttatttttttcgctatttattttgttttgacgggagtcgaacttatttatttatttttttcactatttttttgacggacgaaggaaacctctcttattttttaagtagtagagatagagatatatagaaatactatatataaaaaatttaaattcaaattcaaattgaatcgggtatgtaaacttttgacttataaactttggatatataaactttaggtgtataaactttggatgtatggaaatactatatatagaaaatatttaaattcaaattcaaatttgaatcagatataattcaaattcaaatttgaaacggggtatataaactttaagtctataaactttagatgtatagaaatactatatataaaaaatatttgaatttaaattcaaatttgaatcgtatatataaacttttggtctctaaactttagatgtgtaaacttgaggtgtataaactttaggtacataaatttactaaaatagaaaattgatacggtaccaaaaaaagaaaatcaggtggagggagatcgctacccaatcgccctggcaatcgctcgcccattagagcttccgccttcctgcacactctcgcaggctcgcagctccggcgtgttcatgtcgtgtggctgactgcgtcatgctgacatgtaccatcgttgacatgtatcgtgctgatgtgtgcacaattattgacttgtggcagccgcgagatgtttggcgaggtgaagactagggtgtggtgggaggagatgttaggctgcagctgcacgcttgcaccaactatactctttctgaagccttaatttttaaggcaatttttgaccaatttttgacgaattacattagctgctgctagtcaccattacaagtgaaatgactcctccctccagccaaatttacccagttttgtacttttgtgccagcctgccatgtggtacatgctgattatgatctcttccttaacatttttatctggagaattaatgctaattaatgattggtcgtgtacgtgtcctcctgcatgattaattcgatttctttgtttggcacgtgtttatatacctaaagtttttatacaatgcacctaaaaaaatacaatgtacctaaagcatctataccagaaatttatgtttgatttggatttggattcaaatattttatacaggatgttgttatataaaagtttatgtctatgtaaattttgtgtgtataaagtgacatgtatagagtgaaaaaaattatacgtgaatattttatagtacaatggattttttatttagttaccatttttttatttttttaaaaattcatttgaatggatacgtgaaccagtagtaagggaggcgcggatgtaggggtgaaaacggagcagatattattcgatccgatccgcttcgaatccgtctgatgtgaggatatagtaaggatttttagatatccggccggatgcagatgcggattcggattttgtcatgcggatgcggatatggtatcaacgatatccgacggatgcggattatccgatattttaatcggattatccgatgtactgtttggcggataatccgcaactttcaggccacacaacaactctatttagcccattttacatcgggcggcccatctagcccatctagtgtaacctaatccaatcctcccctaaatctctctctgtgtgactcttctctcggtcccttctcttgctcccacacgcgctgccgcatggcaccattaccataggtgcgccgcgccacctttgcagcctgttggcgccaccgccgccgctcctccttctagtccaccgacagtgtgttgtgtgctatatggaactagtgtgttgtgtgctgtatgcagtgtgctactgtgttgtgtggctgtgtgttgtatgcctagatagctgtatgcctcattgcctcatgcgtgtcgtactgatgagtgaactactgaactgaacactatatttttaaattttaagcaacacagtgaactgctgaactgaacacttatattatatttttgattgatgtgttatattaagcaaaattatattattgatgtgttttggttggatttctctagagagctgaaatcatgttcatatgttgttttgccatcgtattgcggctaattgtattgccgccctcttgttttacggattgaatacaaacttaacatccgacaactttttgtccgtttccgaaccgagtccgcaccgacttcgcaccgaatccgacgtccaaaataatccgctctgcatccgcatccgcacgtcatccgcacccgctccgcattcgcttaaaaaaaatagtttaggatatgatatagctattatccgtccgaatccgctccgttttcacccctacgcggttgcgcgcgtgcattagccacatcctctttatcccaaactctcgtatgttatgcacgtccatgttaatcacccaaatgattaacatttgacactatggctatttatccaatccatgcgaccgtgagcaagtcgtcggaacagcgggaaccagagcactccaggtctccagccgtctctgtgagcaggtcccttgcctcgtggagatggaggaattacacgagaggcagcagcaacagctcgtctgatcctcctggctccttcgataccatgaacttgtattctggatttccagtacccaaaattctttcatcaatattgcatcatggctaatccaaaaatccctaaatttggccatttctaacccatgcttgtatattgtccattttatctcccaaaatcagcaatgcacagttttgcaagtcacacataagaaccaaatttaccaaagtgaaccaaaacatgcatgataggagagcctgctacagtaatacacctacccataaccttggtcttctaagcttgccgtctccctcctcgagcaatggccgccaccaccgtcatcgttgagcccgtagtccacagaagcgtcatcccattctggtggcgtcgtcgtccttatcgggcgagcaagaaggaactcggactcttaaagttggcacccctgcatcctgcgagttctggttaagttgtgatccaaattcatttacatataataaaggccagcttttgccggagcaaagcggaggcccgtttgaagctagaggcatgggccggagcgaagcggatcgttatccttttagggtttcaccttcatatatactccctccgtactcataaaggaagtaattttggacagcgacacggtctccaaaacataaccttaacttctcgtttctatagaaatatttattgaaaagtgatatatgtatactttttatgaaagtatttttcaagaaaaatctattcatataatttttatatttccaaactcaacaacttaggagttatttatgatttatattcctaaggtttgacttaaatattgtcctaaacgatttcctttacgagtacggagggagaacttcttataagccgccgtttggcgttgtaatctcaccaccgatatggtgaagatattttgctggttggcgcccgtggttttttctctcctacttcgaaaggattttccactttaaatctcatgtcttctgtgattgatctattgttctttattgtttatttgcctatcgttttctaacagctctcagctagtggcatcctcttaggctgattggaggtctgaggaggaagaagattccttgagaccctgacatgtgggccactagtctaaattgcacattggtacgcaacaatagctggtctaaagtgaaaagttgttaatacctagtctaatctgcatatcaggtaagtaaacctagaccaaaatgcaattcaagagggtgcatgggtgggaggtgtggttggtcgaagcctcggaggcacgcgaccaggttggtagcgtgcaacgcacatagtactagttctagcaattttatacaattatacccactttcataatcatcaattttacgaactgatcaacgtacatatttaacctatttgtgctatttatttgtcattccttagttagaaaactatttatatgctcaaaatattaaaacacatcctttattgccatccatttattattccagaataggatgattagatacatctagaaccacaaccgcaactcgaaattcgccgaattatgcaatggtttggtggttgcgtctgattacatgttgactcgtagcagcatgacgatgcaaagcagttgcttcccttgcagcaagtgcatggatcacactctcttgtaacggataaaggaaaatagccggcttcactcgtcgtgttcatggactgcattggaacaatattccgagtgctcttctcttccattgatcctgttcatctattcatatcacatacttgtgtttatttatttgtatgtgtaacaacacaacaattgtgtacaaatgattttctcacagcttagcatgaaaagtagaattactacgaattcttattaaagattaatatttaaaagaacaataaaatattaattcattttgccaagaacatattctgcaaacaaacaccacatgacataaagtaaaagagagcttttttaaaaaaaaaattggagcgcattcttgtaatgcataaataaataattcagaccaataaaatgtgcatataaacctttggcctgaaggccagtccagagaaggggcaggaaaacaacggtgagcgacatttgaaacagctttgccattgatggtccttaaatgttaaattgaccgccaattcctgcataaaatcaattgaaatgaaaccattttcacaagtattcataaatatttgtatgtgggcaattatgaataaaatagacccctcatacgacgaaatataccaccagccaaccaaacacaattacgcggattgaagcgcccaagaaaaagagcaaaaccgatattatggagatccaatccactatgcgcaatcatgagggcccacttatcagcctcactcagaaggttggtggccagaggcggtttcatttggcagactagaggaaaaccaatatccgaagcaagtgatagaattcacgcttaacttaatttaagaatcttatttaagtatcttaatctacatcctaagcctttattttagttct

SEQ ID NO: 81874 - DNA, 720 bp, Oryza sativa
tattgacctttgcaacggaggttaggtataataacgaacgaattgatgatcaacaaatgtagtcaagtttatcaatctggagacggattgattcataataacaacacacgtggaagaaataagaaattctgtagtagttgtattctaaactaaacttattcctttcgacgccttgccaggcccaactcggtgagaggcccatcagtctagctgatcctggccacctctaactaggccgggcctagcaatctgggccgggcaagcatagctggcccagccagccgaccagctcagcaaccgggcaagccgctgcaactctccttgctgtcctcgttgcagtgttacaattattgtagcaatagatcgtacagccgccggtgccgccaaaattggcatgccgcctccgccgctgacctgctatgccgggctcacacgcgatcgccggcgtcgatcgactaccgcttctcgatctcaacccgaccatcccaaagttagccacacgcggttgtgcctttccccgaccgatttagaccgggaatcccgctggatcgatggcgccgcccacactccgccaaccttgggagctcatcatgtcgccgtcgctccgccatacacagccgcggctctaaacttgggttgaaacttgaaacccccaacccttttttcttttttttttgagaaaaaccaaactgattcggatcgaggctctcgaattaagag

SEQ ID NO: 81875 - DNA, 577 bp, Oryza sativa
ttgatcccagccgttcccggcccaaccgaacaatgccttacagttttgtaatagcctggaaacagtgctactatggctccgttcaagtttactgcagtaaattaagtacgggcatgaaaagaaaatcattaacatataattaattaaactttagttactttaaacataaaaatagatttatctaatattttaaaaatagcttttatataataaattttctcatgaaatatgccgtttaatataatttaaaaaacgtgctaacgaaaactgaagtaacatctgtatctagccgggcctgtggtctaatcctgaatacgtggacatcacaaaccgatcctcacatggcctcttaaattcagcacagtacaattgaatatagcgtcgtgtatctacatccttgatgatcttgacgacgtcggaaagcgattcttgatactcaagtacgagatttatgaatcctcaattctcatgtcccttgagcagtacgtggacttctgctgttgccgactgaattcttggcattcaattctcaactgatcaacctaattcagctctcacatcaccgccggccacttgg

SEQ ID NO: 81876 - DNA, 1104 bp, Oryza sativa
ccggcaaaagaatcatgccagtaaccagatagtccacgctgcccgttattcaaaccacttaacacatgcaagctgccattgtgttatttgttctatgcttctataatagtcacaccctgagaccctctatatttgttgttcttcatcccagatgccgaaacaccaccacaacagcttgtatatatcaatcctttatattacaccaattgttatctctatctctctcacagacacaaacatcagctgctatgcttcctgttttgatcttgtttgggcttctcttctccctacagtgcaatttccctgcatgctctgccacaaataatggcagtactctcatggcaggccaagtgctcaccggtggaaacaagctcatctcaagcaacggcaagtttgcgctcagcttcttccaaacaggcagcagtaagtcatcagacaacaccaccttgcccaactggtacctaggaatatggttcaacaatatcccaaagttcacaactgtgtgggttgctaatagagataagccaataactgaccccatctttaaacagtcagaactcagagtctcaagagatggcattcttgtcatcttaaacaaggtggccaagtcaatgatttggtctagccaaattgagaatagaccaaaaaccagcaggaacaatagtgtagtgctgttagacaatggaaaccttgtcatacgagatgcctcgaacccatccaatgtgtggtggcagagctttgatcacccaacagatgtcttcctccctgaagcgaagattggtcggaacaagattactggtcagaaatatagttttacttcaaagaagaattccgaggacccagctctaggcttatattgcatggagttagacccctctggttctaggcaatactatgataagctttgcaactcgtccactgtgtacttttccactggggagtggaacggaagatacttcaactcagtgccggagatgtcaagcaatgttttatttgactcccaattcattgacaacgatgaagaggagtactttacttacactccatttgataaaacagtaattacaatctgcttaattgatgtatctggccttacaaagcagc

SEQ ID NO: 81877 - DNA, 1538 bp, Oryza sativa
gaagggcctttgtgggcttgggattacagtcacgtgcggcccataggccttaactgactgacagcgattctcttgcggcccatgtaatatggcccgaacaggatcgcgactgattgcaggccagacagtccagcccagcccaggacactttacggctgttttccgtgacgacagctgcattttgtctccatccatggctactccatcctgcctagcttgaatgctggaccgatcaggtgaggggaggaaccagttgaaggccagtggcttggcgttggcgttggcattggcattggcattggcaactactgactgcatcaacactctaccaagaaacagctttgccatgggcatgtttggtgcacctatttgggttgacgcccatagggtgttcgacgaaatgcctctgcgacaggagcctttgcgcgtccagattcagtgtatgggattccgccggcaatcaagttatgtgtgtgctagattgctaatactctctacttgcatcagcaactgactctagctgtagttgtacaaaaatctcaaactgcagagtggggactgcgcttattctgggagaagcagcagaacggccggtgcacagatactgatgtgatctgtgcctgcagcgatgttcagagaactagacagctccgattaacagcattgcttggacagaatcttaggtcagcccctttcttttcgtttaaacactttaatcaaccagaggcctgtgattttctttgtttggtctatgctcattgttaaaagatataaggagttgggttgtcttcaatcacacatatcgattcaggcaatgagccaattttgtgatctcgacagaatatggtattcaggaaaataggaataaaattgttcattgccactggatggtgttacaacttacaacaacgtttagttctggatattttgttttttcttctggggtcctttatatgcaattcttttttttttgtgtgtgtgcttttaaagcgtagtacctaatatacttgccataaaaaatgatctctatctttttaaaaaatagtgggctggctggttcagaaacaaaaacacatgaattgttttaagtaaaattttcaactaaaaagttgtctcgctgctagccttacacttaatttaaggatcttatattgttaggcactgttcttggtacaattgcatagcaatgatatcatttaggcataattaccatgaaaggaggtttgaccattaggaaaacaaaatatttcattcatacatgtttgcatccacaagtaactgaagcaactctgtcctctctctgaacatgctgagaggagagagagagagagtaaatattaaaacatcttaatagctaatagtagtgttttaataaataagtaagataatcaaagcttcaccagcctttccatctaggatgtgcacaaccattattttcgctatcaatagtgtacatggaagcaagataattattctgttgaaataccactgatctggtccaatttgaattcttgcacgtcacccaaaatactttcaag

SEQ ID NO: 81878 - DNA, 5651 bp, Oryza sativa
cggcccaagaagggaggaggagggggaaaagacttcttttaggattttctttttataaaccttttcaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttatttcgggatgaatttatcaggacgtgacaccatctgtctgcgggtgatacgcggtgctgaaatttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctacaatttccccgcttcatactgacccaccagtatttctccttcaagtctaagtacatcttcgtactgccagggtggatggaataaggactttcgtgagcttcctgaagtatcaactgtttaagttctttgttatctggaacccctactcgatttccgttccatagggtcccgggtcatctttgggaaacccccaactttaccctggttcatatttttgaagaatccacgcatgtccgggtcgttcctctgagcctcgcggatttgatcgagcaaggtaggcttggcttccaacgcagccaagaatccgcgaccaactatgcttaggttcagggcttccatctgttgattaagtttgggtggaatgccacggacgttaagagtgttgcaatagctctttcgacttagagcgtcagcgaccacgttggccttaccaggatgatagtgaattcccacatcataatccttgatgagttctaaccatctcctctgccgaagattcagatccgactgggtgaagatgtatttcaaactcttatgatcggtatatatttcacagcgattcccaatgagatagtgccgccagatttttagagcatgaaccaccgcggctaactccaagtcatgggtagggtagttgcattcatggggccgtagctggcgtgaggcataggccaccacatgaccgtcctgcatgagcacgcaccccaatccttggcgcgaagcgtcacaatacaccatgaaatccttgcgagtatctggcaagactaacactggcgaggaaaccagcctttctttgagagtttgaaacgccttctcgcattgcgggctccacacaaatttctcttctttcttcaacaactgtgtcatgggtcgagcgattttggagaagttctcgataaacctccggtagtatcctgccaaacctaagaaactgcgaatttgagtgacggtcttgggttgcttccaatcagtgacggcggtcactgtttcggggtccacagcaacttctttagcagatatcacgtgccctaagaatttgacttcggacaaccagaactcacacttgctaagtttggcatacaattgatgttcccgcaactttcccaacaccagacggagatggtgctgatggtcttcctctgattgtgagtataccagaatgtcatcaatgaaaaccacaacaaacttatccaagtattccatgaacactttgttcattaggttcatgaagaaggcaggagcattggttaaaccgaacgacatcaccgtgaattcatacagcccgtatcgcgtggtgaatgcggtcttcggaatatcttcttcacgaatgcgtaattggtgatatccggaacgaagatcgatcttggagaataccgtggcacctttaagctgatcgaacagatcatcgatccggggaagagggtacttgtttttgatggtgacctcattgagagctctgtagtcgacgcacatcctcttcgtcttgtctttcttctccacaaaaatcacaggagcaccctagggggaagtactcggacgtatataccccttttctttcaactcttccaactgtttcttgacttcggccagttcatttgctgccatacggtagggtcgcttgtacagcggagtggttcctggagcaagatctatccggaactcaatctcccggttgggcggcataccgggtagttcttccggaaacacgtctccgaactctctgacgatggggatttctgacagtactatctgatgaagttctgaacttctgacagaggttgggggtgcaaagaaaacaaccggttgttccggccctcggtacagagtaaccgtgcgtctcgcacaatccactactccttggaattgagccaaccaattcatcccaaggatcacatccaagttcttggtgtctagcagaatcagatccgagggaaaaggaatcccctgaatttctatagggacggcagggctataatactttgctgtcataacccctccaggggtggtgatgagcaaagggttcctaagcctttctacccccaactgatttctccccacgaatggcacagatataaacgagtgggaagctccagagtcgaacaaaatggtagcagggatggaatggatgaggaacgtaccaacgatgacgtctggagttgtcagcacgtcctcggccgtcacatggttcacacgaccccgaataacatccttaccaccattgttggagcggggaggcgcttggccttgctggcgcctcggcttcgggcatttatccgcaaagtgcccgggctcgaagcagttgaagcacagacgctgcggaccttgagcgtccctgcggccttgaccaggctgcacagttggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcatcctgttgattgcggaaattcgccaagcggcgcttgtgcgactccagttccttgtgcttggcttccaagcggatgctcttgtccaccagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccatcacagagcggttgccttgcttcaactcccggaattcccttttcttaagggccatgactccggcaggcacatgggtcctccggaaagcggcggtgaaacgggcccaagtaataggctgcccctctggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatccacggggttgttggagctagagaaggtaggtgggcggatgcggaggaactcggcgagtttagagtgttgtgggggtggtggtggagcattctgttgtggcggattttggaggtggtggaggaaagcagtcatcatgttggcctgctgggcgaggatttgggtgagaatggcgttggtatctggtggtggtggtggaggcggaggaggaggtggaggtgggctgccctggtggttgtggttgctgccttcaggttggttgccatcaccggtattagcacttctcctggtcatcaccatctgaaaaccccacacagaaccagcaaacagagagagagctgacaattaaagctaaccacccacgactaccataattcttgaatttattactgctattaaattggttcattaaagttcaagttgcttagacgaataaaataaagacaggctccgacacagttataccacacaccggcataaccatgccccacacgactccaacaagaagacaaacgagaaagaacacacgcgcaagcctactaactgctcgtctaccgctgcgacgggccaggacggaaggtgagcaacagcgcatcctccgtgctaccaacgccggaggcttccccctcctggggaaccacgggcgcgggctcggcacgaggggtctccacgaagcaggtccacgccagggactgacgaacaagctcgggcctggaggtgcttttgcgggcggtgatcttctggctgcggtagacgcggtggcgcttggggcggcagacctctccctgggcgatcttgagctgatgcagctgcgcctccactgcgtctaggtccttcttgagctgcaggttctcctgatgcagctccaggatcttcaagttgttctcgaccatcccacggcgcaccatctgatggaagtcgatacgagccgcgtcgtacgcctccaccatgcgcgccaggtgcacgatggtagcgtcatcctccgagctagcatcccggaaggtggcgtagtcgcgggctcctccacggcgagggtggtagcggtagggcgagtgctacaactcgtccgggtagcgctggtgaagagtgccgatggcgaggagagcggcgttctggtaagcggcggggaaagaatctccacccgcggtgactgccagcgaagtccgctcgggagagccagtgaggatcactgcagtaacctcccacgcagcgtggggctctgcatcgtcaccctcctgatccggaagcggcctggcctggtagtccactccatgcggataccccaggacaacgcacatgccccgcagctccaagacgaaaccagtcatgtccaagccacgacggctgacgctgccggccatctacaaacaaaaacaaaaagaaaagcaacatttaaaaaggtcagattttggcgataaatgaagcagcaagacagagagagactagagggttttcacaaatacaaaggatttttatttcgaaaatactgctatggcttgggatctacggctcgtcctagggtcaagggtggctctgataccaacttgtcacgaccggaaataacccaacgggcgttccttacgtgcgtgcattaatccttgtcccaggaggcaaggtacaccaaaagttgatacaattcaaagtttaacaagcggaagcgtaaatagttaatttattacatgggcagcgaaggcccagcacacacagagacaaacgagaaacagcggaagactagggcgacgaccacaggcacttgacggcaggcacgagctagacaccaaagccttcatcttctaggggctcctcttctggggttgggaaaaattgagcaagactgagtacaaccaccgtactcaacaagacacacccacaagtgcagaataaatgcaagggagtacaaaggagttatactataaaggtttagg

SEQ ID NO: 81879 - DNA, 779 bp, Oryza sativa
tgtttgttaaccaaatattgctcaatgtttcagttccttgcgttcctttgttggaacgaatagtggttgcactaaagggattttagacttagtttggtataagatgagaattttgtaggattacgattcacattatttgcgccttggtactgaaattgtaaaatcgagggttagggcaaaatttggtcactgctaaacattctaatgttaccaaatcccaactagacaaagacatcacatgttatctgtagtagtgcaagatgtgtctgacaggtggttcctgttattatgttgtctgaaatactgttgatctggttggagacttataacagatagcatctggtggtcatcctgaaaaaatataataaaatgtatgaagaaaatagaaatggatctttgtctgaccagggaacatcttcgagggaatctttggatatttttttttttggttggcaagatctcagtgttactgtttgcttgctcatgtagatatatatatgtcagttaactcatggattgtatagccagtttaaaacggttacatataccattagctaagcttcctaagaagcagaaatttggcctatatgctgatgaaagacagctgcctccttagcttccattgcgtcaggtgcaccttccctttgtctactccactaattatctcatcaataagatccttaaagatggatttttcaatggccaaaacaattccttgccgttcactgtcggagctcttccactctttcatgccttgcattgcatcctctgctagcctg

SEQ ID NO: 81880 - DNA, 3723 bp, Oryza sativa
aaatatgaggattctggcgaacacatgggttcctaggtattcctcggaatacccgaaatttatattcgaccattcaatttttgtgcaaatataaaaaaaattaagtcatgctttaaaacatttgacgataaatcgaataaaaaatgataattacattttatttaacaagagaatggtaaaacgtactggaaaaagttaaataacattatatattgtgaaatcggagggagtatttggcacggatgcaggtcgtctgcagcgttgtatgtgcagttgcagtactgctcatttagcggtatggcatgggccagcgccttattaactccgcactgcagcagccggtgtcacgtacggcagcggcgtgcatgcgtgcatccgactgcaggtgatgcagccagagaagcttttgctattgctcgtgatgcccgtgagcgaggcgcacacacatgcgcacacagtcgcagtcgctcccagatcgacaccgtgcggcgcgcggcgatgaacgtctaacaggtggtggcgccgatcgaggcgcgaggttcgcgccttggcggtggcggctaactgcttgtcgttcgtgtctacgactgcacccgcaaaatttatttttcacccattccacgcgtattaatacaaaaccaacccaatttcaatgtaattattcttttctcaaagaaatatggttcaaaagtatacgcaaaaaacacgcgtacacttacatctataagcacacacgcatgtgtcgtcccatacgccctcggaagactcgccatcgccggtacatcatataccactgaaagaataatttgttgtaaatatgagcacttattgactcatatcaagtataggatttaatccgagtgggctagttccaccataacaaatctaatctgttggcactaacttcattcttttttttattcataatatcttgattccctactctctctatcacattttaaacgtagttataagtttccgtgtctaattttaatcgtccgtgttatttgaaccatttatgagtacccgtgtctaactttgatcgtccgtgttatttgaaccagccataagtacccatgcttccatggcatgagatgggacgtggggtcgctgcgcgtcagcgctgctcacccgacctgcaggagatgtcccgagtaaattgtgagatggcaggcgctgcactcgcacagtactaaaaatgtgcgcgcccgtgccacgtacatgcagaatagcagaattcatatgcatcttacaaaaatgaacgtgtaaaaatcaaacagagatagcacctgcaaattaatgaaatacaccagaaccaaatgaaagtgccgatggatgaaacgagtagtttgtgagaagataaccgactgaattttattactactgttccatcccataatataataaattttaactatgtgtctaaacagtccaaaaataaaagtagatacattttaaaactctatcccataatataataacttttaactttttagaacagtgatagtatgttgataagttgatttaaaaggttttctaagattgtcgtcaaaattacgataattgaaccgtttagtatcttaaaaagtatgtacgcgataattcagtgtccatagtagtaataataaaaaaatagcaggctcattctatcaaaataacttgagagctatgttcatcagctcctggatatccaatgcatggcaagtactcaaggtataattgggcagaaatactctcaagcagatctagaaatgtgctttccggaagtaataattcatgtgtatcatgggtactatcacatcgtgccagatcgaaagggagtgtccaataccaatcatacgaccatgcacaagactacgtagagatcaagcaattcactacctgtcaacactagtacaatttggatcaatgctactggaacgaaagggatatgaatcgcacaaacgacctgccagaatcatgccaaaacagtgtcagaaagacgaaaaggcattgtcgattttgcttcaaaaggaagggatacggcaagtgaggaaaaagttcaggcaagaaagacgtccaaactccaaatcaccttcccttcggcggcaagccagtctcttttacgtacaaatttgacatgacaactactttggttcaaagaattggcaagatcacaaaagtcaggacatgaaaacaaaccaaattctggtacaaaagacacttaaaaatatatgttttggccgccaaaaagcactttaacaagtactcctgaaagcaggtaaaatgcacagaaaagcatagcctcttgttgcaaaagattacatacgtctacaggagaccagatcaaacttggcagtaagaagagaacatgcagggacgacattcagggtaagttttctgatattgcctcaattaatcaaatattcaaatgggagcaaaacttttgtaatattccccaatatctcaagggctccttgctatcattcaacctaattaatccaacttgtgatgtgaacctgctatccttggctttctttggtgccaccagactccagtctgatctgcatccagaattcatttgacactcaaaatcccaaagtgaggcttctcgtctagtggacactgttaatcagttgaggcaaaaatgtgccatgtaggatcacatgacaatctcagcaagcatcttgctttcatcaagtcctcaaatcttctgacattgcggaaggtatacaatgcgttgtcagaatatcctgagtagcagcctttgccgtttttgcctcaagaacaaccagctgccagatgataccagtcaattggaaagtgctcacaggaagtagcattgaacaaaagaggatgataatttcactatgaacaatggaagagagaaagggcgctaataatccacatctgatacctgatcgtagtccatatcaaattttaagtattcctcgttacaatcttccaccatggttgccaagtgctttaaattttttactggtttgccattgaaagaaagaacctatagagaataaaaacagtaaaacacaattaatttaacacatcaaaggcaattttgttcagaaaattttggtcttctactactcttagatagtcaaatatagcaatcagaacaataaaatgtccattacacttggtaactaactaccaatgttgttagttccctcctgagatttatttccaccaatttcaaacagaatactgcttatggctgttaacttagctaatatatataacagcagttggagacaaccaattctgatcagcatcattcaaaatatgaaccggtgtagtgcaattgatacggtcagttgaagaacacccttttctggtatggagtatatatatgataacttgtgaaaataaatctcaaaccataaaaatactttcagtagtgatcattgttacctgaatattgacaatttcttcataaccaatgttgatatctgctacaagaacctgaaaattcatcattttttttcaaaaaattgtcatatgatgaaataataaataccaagctctaaataaaagcaagaaaggttagccatctcatttataacataaaaacataggttagtacagaaagaacttgagacctgtgacaccaccacaagctgctcgtcaggtgattgagccattgcatgtaagtgcttgtccaacaacttgacaggggcatcatactcatagtcttttccatactgatgaaataagattgtagttagt

SEQ ID NO: 81881 - DNA, 1182 bp, Oryza sativa
gtcaacattttcaaccaaaatcggataagcaactagtagtccaacatagaacagacatttgaaagatgtcattcaggtggcaatatcgcttccttctacaaggttggtgaaaatgacgcgtgaaacatatagtcattgatatttgtgaacatgactaaaaattatccatgttttcacacacaccagagcacaaacagaaatactaaatcactacaataaaataagttgacgataatatataaggtttgtgaaagtctgttaacaaaatacatatacaagactaagcacgcggtatatatatatattcaatttaaaaaataaagagataagttaaagatgaaaattacaattaagatcaagctttccaaaaatgcaacaaaattgtactgaacatcgtacagtagtagaatgaaaaattgacaactgaacaaggatgtaatatcttgattattatttcacacataaagctggacaagggagatgacagcatacctcagatcggagatatggaacagaaacaaccataaaaacgaagcctgcaacaatgtaatatgatggtggcctgccctttatatgagctggaatgagtcttttgtgagttgccagcttaatgttaaattcaagaactttcgaattccgcagaattttgacatgggccttctcgccagtgtacttctgcgaaatgaggtagctgaagccaatacgctccccatgtctgaaaggaactggataaccaagataaacaaaatgtaagccaatactctcctccttaagtcatacttcgtaggctacattggagacaaaccatttggagaactagtaataacagatgacaagaactaagacatgcagcagacttttaaagaagaaaaatcccaatgctttgtgctagacaatacgtgcacgttgaatgatgtcatttatggtcagtggagatctccattcaataaccccgcttagaacgaatccttccagaaccaaataatctagaaatggcacagggagtggggactagaagttgaacctgagacaatggaatctctcttgcatgaaacagagtgtcctagaatgcatgctcccaaatagatacaagaataactggccaaggcaaacaagttctaaaacaaaagcagtagaaataatcgctagttgtgtaaagctctgactaaccgggctgcagga

SEQ ID NO: 81882 - DNA, 2109 bp, Oryza sativa
  unsure (1)..(2109): unsure at all n locations
taatagaatttaagggataaaagtattctccccggcaacctaatttaacttttaaaagaggtggacataaaagaaacttccaaataaatccattctcttttcgcactccagtgtatggccccttcttctcctgacgtgcacgaccttaatggttgggagctgaaatctcgctcttcacaagtagggataaatattttcggaagtttgtttagggctaatgttgaagactatttttttttcttaaacaaaaacctaaaaatttaatgatttggagtagtatagctgatctcacgagtatatttcccaaacttaggggcctgtttggatgcccacctcactttgccacaattttgtgtcaaaggtgtggcaaaatgtacattgtggctctataattgatgaccacacttgtggcaagctttgattaagaaaaaggtctataactagtgggatcaaaagagatctaagaaagtgcggcatgctaaaattgtagaatcaaaccaatcctagctatatttgatcatattaacctactgcaagtgtagcaacatgtggcaccaaccaaacatgccttaaatcccagtcggacgtacgtgaaaatctaaccgcccgccccacctcatggcatgattgaggagatcaaccaccggatcggtggccccactgtcttagctaaaccatagccccacgcattagtgggtgagagatgattaccgcctttgggtaaaggaaagccagtcatagtattaaaccctgagtgccatattagctcattcatagtgtgtcctactcatttgaggagcttcggagtgccacgtaggtttaggttacagaattcctaaaaaatccttgnagttcttcnaatatttctttcacaatgcacctaggtggcattcagccccaacatgccaactaggagatcctttccacgtctgtatctgtcatgccccaagtatgctcctcgtgcaaagcaagcgagaatgggccagacgagcccccagtcaaagccactcgcattgtaagaatagtttcttatacgttcttcagcttatgtggcacatagctttttcgtgagtctcctcatagatggtagcaacactgctctttccctgcaaagtggctttagaagtggcttcaattttatagcttatcccctattatttttgtagttctcattttatttttcaatttatgtggaggtccaaaatttacaccgaacaccctaaaatctagaaaaaaattataatacccccctctcctttctcccttatcctttccctacttcggcctcctccttcggctaccctgccgcatccctctctccttaccacccactatcggcacccctctcccccttcaccactttccctccccccaaccgttgcccgttggtgtggctctccctccaccttcctcgtcggggcgccgtcggaaattgagcgacagaatggcggatcgaagcgacaacgagctcggcaccacgtgcgtgcgtggatggcaaggagctcgagacggatctagcaatgttggcgtgtccgtctcgtcggcgcgaccgggcagagaggcggccaaagcagcgactgtgtcgccaagcggattgacggcggggcttgctggatccagcctcaggcggcagtggcggcttgctggatctcccctctctcccatgggatgagctcgacgatgacacggaggctaggaaaaacgacaatgtgctcactcactcatgcacgcgggagcgggagggcgagggcgagcgcggtaggacgatgaaatgaggtcacgacctccacaacacaccgcttttcgcccctggattagaccgaggaacgagtgaccaaagttggacgcttggacttcagctcggtttggtagaagctaaaggctgtgtttagattcaaaatttttttcttcaaacttccaacttttccgtcacgtcaaatgtttggacacatgtatggagcattaaatgtggacagaaaaaaaccaattgcaccgtttgcatgtaaaatcgcaagacgaatcttttgcctaattacgccatgatttgacaatgtgatgctacagtaaacatttactaatgatggattaattaggcttaataaattcatc

SEQ ID NO: 81883 - DNA, 1041 bp, Oryza sativa
cacacacacacacacacacacatatatatatatatatatagctaatataagtctattttatgtccctacttgttggcccatgccatataatatgtgtatttttcatccctattctttgtgccgtatcttacatatggttgaaaataagtctgtttcacatccctgaacttcgtgtcgggtcctgccggcccagcgtgccaaggtaacagcccagacatggcactgccgtgcctgggccaggccgtcgggcctcgggccatatggcctcgattccacgcggcgcgtggaaccgcacacgcttttggctcggctcctttggcagaactaactatgtggcgctcgcctattaccaggccgcgtaccggttccgcggcaacacggcgtggctcaacttgcccgacaacgccgcatcccgtgggttgcttcacgcctccgtggacgccaagctctaggctgtgccagaacatcatggccgccaagaacgccaagtcctccatggcaccgcctccacttcagtctctgccactgccacctcctccgcgctcatcaacaactgctccttctcgtcctctggcaatgcaccgtgcgctgactcatccctttccctgtcatagtcgttgttgatgaaaaacacgaggcctgagagatctgcttaactccagtgcaggtccaaaactcgccttcgggtatgctagcatgccagttgatttgatcctgcaatcaacatgaaataaagacaaagaaagaactaaatcgataaacgatagccgatcggctaagtgccgatgacatatcatttatctttgagccgatgtcatatatatacatcgatcgacagttataaatgaataataaagaactaaatctacttgatcggctgtagatattaacaatatataatccttatgtggatatatacttaaatcaagtgattgggatagatcggtcgccatgccgagacagtataaatcacttagattgaaatatatacaaacaacaaaactatatatgttcatagcatagccgatcagatagatctag

SEQ ID NO: 81884 - DNA, 1305 bp, Oryza sativa
acgatcttgccagatcctcgttgaattgccatcaccaattcggcgcacaagccccttgaacagaatatctcttctcgctaatatagctctccaagtatggcttgaatgtttcttccgagtggcttgtaagaactctgactcatgatagtatctgcctttcaacactcgggcacatagtgaattaggatttttgatcagtctccatccttgtttacctaacatagctaggttgaacaatctcaaatctcgaaattccatgcctccatcagctttcggtttagtcagtagttcccatcgctgctagtgaatgcgtctgctatctgccgagctcccccaccagtagttcgctatcattgatttcattttccgacaagtatcctttgggattaggaagcagctcatgggataggtcggtacaacttgagcaactgatttgaacagcacatccctacctgcacaacttgcttcacggccactccatgttccaactagatttctgattttggttggcataaattcaaaggtgtcctttgttgcccgccccaaggcagtagggaggcttaggtacttctccgctaatgcttccatatcaatatgtaaaacttctcttacctcccgtttgcatgcattatcgcagttagcactgaaaaagatcgctgatttatctctgttcaccaactgtcctgatcctcggttgtataagtcaagaatatcttgcaaccgtcaagcccctctctacgaagcttctaagaaaacaatgcagtcgtctgcaaacaggtgtgaaatccatggagcgtgtatcccaacctgcacacctctggcaagatgcaccggtccaaccacccttaagaggcaggagagaccttcagcgcacagtaggaagagatatggggagattgggtccccctgacgaatccctctcgacggcttgaacgggttcgaaagttgtccattgacccgtacagagaaagatactgaggtaacgcatctcatgataattcgcacaaaactttctgcaaatcctagttttaacatcgtaccttggagatagtcccattccactcgatcttaggctttcgccatgtcaagtttgactgcgcatgcccccgtttttcctttcttcctctttagatagtgagtgcattcataggccactagcacgttgtctgtgattagtcttccaggcacaaatgcactctgttctgcagagataatctcatccaagaacactcgcagtctattggcgagtacttttgagcacaacttatagaccacattgcaaagagagatcggtctgaagttctt

SEQ ID NO: 81885 - DNA, 768 bp, Oryza sativa
caatatgcaagtttagtgtcacaaatgtggtaccattagatatttttctggaagtaacttcttgttggcaatatatttgaaaaaaatattatacatcaactttcaaattggttttgttattatcaatatatactttcagtaagctcagttctttaattgctgggcatcttttttataatactattgaatgaattggctagtttccacatccagaatggacaattgagtaattcttgatcattttagcctttagtcctgaatattgctaatttcacatgctgatctttatgctgcaaatcgaagttatgcatgaggtatgatttggacacttgattgtccttgtaaaccatctctcttccttttgggcatatgttacgtatgtctgctggtaaattgtgaatgcttggttggtgtctggtaagaaaggatcagtctacactgagatagaaacatagttacttatccactatttgcagtatgagattgaataatttctgattcatggggcttacttatagttctctctggcaatttcattgtcatttcgcaggatcgcccttcgaccaaggtccatgctgcccctggtggtggatcttccctgggctacctctttggtggaaactgaaggagtgatcctggtgcactgtagcaccggatgaagaaggaagtctaccgctatccttgtttatcagaactgggaacccccattgttttatcattctctatgcatgtcccgtacctatgactccgtggcaaacaccctgcctg

SEQ ID NO: 81886 - DNA, 1084 bp, Oryza sativa
atgtggggtttcttagtacaacgaatctgaactattatgttggtttttttttacggagggagtatgttgtttggttaaataaaaatgatattgctttttagaaaagacgaaaaaaaactgcatgtctaaccctataaatggctgattttcatgtgttatttggatgagtacgtttttagtctttgctcaaaatgaggcatgacaatcagtcattgttacgtcaagtctcacttgttggagcagacaacaatagaggtgttcttcaatggtgatggacagagacgtggcaaccggatttgcgaaagttgtttctctttcatatcgaacttttgccaaacttgtttgtgtggtacggtagttctactgtaatagtgttgatcgctgtgtataccatggtcagaatgttttgaaagaaatacgaagaagggtttttttaatcattatatatcctgtaattatcatggaaaacatttcgttttaatttggaacggggggtgaaatagctgagtggactaaatagacagaaactcagaatgtgatagatagatgcatgcatgcatgtatgcgttcgtggaattccatcgatttctggcagcaaatcaaagatgcctgcatgcgaacggcaaggtgcagatgaagtgatgtagaagtagctagctagtcaacgaggactagctatagctagcgctagttagaccattaattcacaatgctcccatgtggcttccacccctaagggccacccccggagaccggaaatatttcggggtggccattttccctcccaccagcagagcttttccaagactgggtagctctttgccatcggttcctcatcagtttttcaggaagagagaaagagagaagaggagagggatgcgtcgtcgtccccatgctccacgccgccgcggggaggaggacgaccggacgccgtcctcgccggagaagctcgccggctcaatagggggaaagcgacggcggcggtgaagatcgatttggcatcggcgaactcagagagagaaagaggggaaattcggcgagttgtcactccgcccggctccgcgaggaccaccgacggttgggg

SEQ ID NO: 81887 - DNA, 10115 bp, Oryza sativa
acgacatccccgcgcgttgagtgaacgatgttcacctgctttgcacagcagtctgagaagagttagcctcaagtttcagatggattcacccgacaactttggagctcggcttgtcagattcttcgctcaaattacgctatggttctagaagaaatgtgcatcgatagtggtttgtactccctccgtttcaggttataagatgttttgacttttgtcaaagtcaaactactttaaatttgaccaagtttatagaaaaaagtagtaacatttttaacccaagacaaatttattatgaaaatatatgcaattattgatttaatgacattaatttagtattataaatattactatatttgtctataaatttagtcaaatttaaaaaaaaccaaagtcaaaatatcttataacataaaacggaggaagtaataaacagaggtctacaatgaaacaaatgtggcagcagatggctcatccaagatttctctgaaacaaaagaacttcgttgatggttcgtcattggtcttctcaagaactcatatccaggtaggagtgaccaacaagctttatggtgttaccacttgaaatggggaagagtagtatggatgatttaagtttgatctgattctgatgtggaatgtaataaacagaggtctacgatgaaacaaaacaattcttttttttttgtttgtttctaaagcctatgcgcgttgagcgattctttcaatttactatagcaggcctgaggcaaaaaatatactataaacattagagtttaggataaggttcggtccaaaatttaaaacattgatcatcaattttatattagaacaagttcagaaaaaaaaatctaataactttacgatattacgataatacttttcaaggcaattcacatataccattaaacttaagcatctgagaaatcattattggtcaaagttttaaaagtttaactaaattttatcttaaacattaaatatttatgtatggagaaagtatcatgataagtaggagtaatagacacatcaacatagttttgctacaaaaagtactgcaatatttttttctttacttcacgctttttcaccatgtgattaattgctaactctacctactaagtagtaagtatatgttcgtctctctcttatctcttattttttgacttccatttttcattttttaatttatcagtccattttgcaccgttaattttcaaggaatctagtagacaattaattatttatgtcctagttctcactagatatgagtactagaaaaacataggcttagttcggcatcctgagttcccaacccatctccctcgtgttccgcgcgtgcgcttttcaaacaaataaacggcccgttttttacaaaaagtttctatacaaaagttgcttaaaaaatcatattgatccatttttgaaaaaatagcaaataattaattaatcacgcgctaatggaccgctccgttttccgtgcgcggaacatatgtttccaactagcagcagcgaacacagcattagtcatgtgatttgcaattcatagttaaatatataaaattccgtgtaaaataatacaatgttaaatatatgctgaaaaatttgagttttctattttctccttgagatacttcttcttttaatttacctttttttattggaattaatgtttttggactagttatttttgttttgtttttattttggatcatctaaactctgttttgtgagtacattagcatcctcataccgacaatcatcctttttacgtgcaactcatcgtcaagaagagtggttgcatatgcctagataaacgcatttgggtggtccaaagtgcattaaatgaaaaaaaaaagtaccaatccaaagtgaaaaagattcagtacagaatggtttaaagtaaaacagagaagctaatggagtagcgcactgtcttgctcagcttgcaagacggtcgaatcagtagatagtgtggagaggggaagccccaacgtgtgtttctgagcttttggctcatgattgtactcctaatacttgattaataaagctctctgtttgcggaaaaaaaaggggagtaaaacaatcggtaatgtttggctaatagaaatgggaaataattttccacttaccaaaagacatctttaaatcctaaccatttattccccctcttccatttaatcctaaccctttattcattttacaatcccgatcctttccctattttccattatccaaacacacccattgggtaataacaaccggtgcaaaagtgcgattcattccttttcaaaatgggtgtaggcacaagtaggtacagtatgtgactacgagcccacaattacccaatgaagtttgtcctgtttttattgagttgctataacgcctccctactttgaagcatccatgaattatccaatcctagggtattacagtgtacacttaatttcaagtagctagcatgccaagtggcagagtagtcaaatcacctctttgttacctaacctacgtaccatgatatggtactcctaagagtgacatatataacacatgctaatctcaaagagaaaaaaaatcgaaaggattggatagaagctttggccgttgctgggcagtttcggcgatccatccggcacgtatatacccgccaccactctacgcacgatagaattgcaaccaacgacactactaaagtactaaacgttaacttgacccaggtcaacaacgtgactgaattaaaattttataatatagctgaacttggaccccccacgttaacacacggagcagtagcattgcatctatcagcttaaaaatgttagatctgacggtaatggtgtttactttgaaagataagcatggaccagaagagtaatctagtcgtcgatagcaattagcaaagggtcgatcgaagctagaatatatatataatatataaatgacacttgatgaatacaatgataagcatattttccgagcgtcttcgttagctgttactccctcctgcctacaatataatataacgattttgagtttttatttgtaacgtttgaccactcgtcttattcaaattttttttcaaatataaaaaacaaaaagttgtgtttaaagtactataaataataaagtaagtcacaaataaaataaataataattttaaaaaattttgaataaaatgagtggtcaaacgttgcaagcaaaaactcaaaatcccttatattacgggacggagggagtaccactttcgtttttaacgtatgacacaattgattattttaaacgtttaaccatttattctattttaaaaatttatgtaagtatcgtttgctttattctgacttaatttattgtcaaatgttttttaagcccaacttaaattctttatatctatataaaagttttaaataaaatcgaatgataaaatatttataaaaaactcaatgacatcacatattaaataaacggagttggtatgagttgcaactttgaaaggtatgcgtctgacgttgagttgagcttgatcgtcatcgctacttaagtgcctcaccgaggggcagcaaacgtatcgatcgatcatcgcacattttgatcttccattcctcaatcgcctcctctccggcctaattctcctccacctcctgtgatctaatctctccccgtgtgtgtgcttctcttctcccaaattaatggcagcttcgtcgtcgctagccaagaatcgcgacgtgatcagcaccaccacctccgccgccctcgtgatcgccgccgccgccgtcgtctacttactcctgttccccgccgcggccacgacggcggcggcggcgctgtcacgcgccgcggcggtcgtcgccgcggcggcgatcaccgtcgtgccgcggatgctcgccgccctgcagtcgccgtggttcctccgcgccggcgggggcggcgcgctcacgagggcggcggcggcgtcctacgtccaaatgtgcgccgccgcgagcccacctcgcggcgacgacgacctcctcgccgccggcgcggccatggcggcgctgctagtggctgttctcgcggcgtcctacatgctactagtagctgatcagtggacgtctcgatcggcggcgagtcgaaaatgcaggcagtaaattaataattaaaatcggagtgaggcctcactgtagttaattaactgggtttattttttattttttacttttctgttctgatgacgagtaattatattctgagtgaggggctttgcttcgccgtttgatttatttactgtacgacttccttttggtccgtagtggttcactctgtcgtttgaggactttgtattagggccgaaatcccgaaattttgaaaatttcggaaattttggtccgaaatttccaaaattttgagcaaaatttagttaaatttgaacaaatattacctaaattcatgaaaaaattttggtcgaagtaatatcgtatcgaaggtgactgaaatgaccgaaatttccgaggtccgaaatttccaacctactccgtacttctctcgatcagtcttttgtgcatgcatgaatcagtttatatgacattagaaaatggccgtaggaaacagacctgatcaactgactttatgctttatgctttatgcagtttgcagttgtacctgatatgtaagcgatctctctctatacttaaaaattagtaaaacattagacttgttcactttgatgccaaaaaaaaccttaccaaattttggcatagttgtcaaaatttgccaaaattttgataaaatttcttatatagttaccaaaatttggtagcaaactaaatgtagccactttttttggtaactttaccaaaatttggtaaggttgaaaatggcatcaaagtgaacaagatcattgttatatactccctccattctataatataaaacacaactatttttttaggtgttccataatataaggcatgcatgtttgcatacaattaactaggacatcttctctattaaattattacttttttaaatcctccacccttaagatctctaattgtaacatcttgggtatttagctatagtattaatcacgctaatgacttgatcacactggctgagagcggtattgattgagccacgattctggctaggacctataaatatgttgattgttgttctattatggatcttaaatgatatttcgatcgttttcttgtcatttatttatcaagtcatatccatatgcatcattgatttattgttagttagactaaatctgttgaggagtgggataatttagtttcgatcaaactatacgtagattagttgtcacgaagctaggtatacatgcacagtagaaatcagaactgaaactatagtaaattattcacaaactatttggttataggttgcatacatacatacgtacgtacgtacgtacttacgtacatacatatacagactggcatacatccatgtgtacacatattcattataaatcttatacgtatgcatctcatatattgtgcagatacatggtgcttataaatacaaactgaactcatacgctctgcattcaagtaaaaggagaaattaaatgtattaggaaatgtttatatgattttagaccgcacaatttctatttaggaggttgcatatttaaaactttagttgtagtagcaataaaggaatttttgtgttgtctcaatctacaaattttgcatccaaccaaataggggcacaaaagatgtagggcctgtttactttgatgccattttcaaccttaccaaattttagtaaagttgctaaaaaagtggctacatttagtttgctgtcaaattttggtagctatataaaaaatcctgccaaaattttggcaactatactgaaattttggtaatgctaaaatttggtaaggttttttttggcattaaagtgaacaggcccgtaaaccgagccatctcaagccaaattccaaaattatccatttttgcataaaactccctgaattctagggcaattattaatcggtcccttaactctggagtaacctccaaaattccaaaagcttatagactagaatgcaaaattactaagtattccaatttcaccagatttccattaaattgtaaattagtgaaacctctcaaaattaatccaccgaacatgtcatggtgaggtgtcaatcaaggaagcagccaccaaacaacaagtaagtgagtcactggttaagttccaccaagttaactagttcagtgtgaaaccattcattccaaccaagcaactgtatcgtcgataccaagagactgttcactttaatgctaaaaaaaccttactaaaatttagcatagttaccatactaaaattttgacaggatttcttatatagttattagtaagattgaaaatgacattcagcagtaggcacagcagtagtagtactaccattttctactgcaaagagcagcagcggcagcggcagatcgccatagtggcagcaacattaggggcgagtagcagctatgaagaacaacagtacaagcagtagaatctcaactggagtaaggcagtcttgactagaaatcagtagaggttagggagataaagagatattcaaccagaaattatacacctcaccaacaccacagctcaaccatagtatccacagtaaagcaacttggtagagagaaagagagagatgaaccaaatctgaagaaggagaagtaggggtgttcggttcctgcatgaacagtgatttcagctctaggaggagatggtacttcagctcaagaaacaagatggatcagtaacagcagaagcaggacaagaagaaaggaggagaacaggcaactgttgtaaattggatcaggaggtaaaatcagcaagaacaagaaatcagaaaaatcgttagcaagggtgcaaatcaagtaggaggtacctgagcttcaagaagagaggggtttcagtttctggaggagcaggtggtgcttcagctcaaagaggagaaatcagagttccatcaggagaacccttgaatcagagtccagaagagtagctgcagaaccagagttccctatatcagtcacctaaaatcatggcaggtaatcaggagattgaaatgaaagtacaatcatatcatggcatgattcttgagtgatgcatatactagtatgtgtaggagttgtgagttgcatttgcatccattagaatatgaacaagaaaattaagtaatttgtgaaggataagtctttgtagtccttggtcgtggttcttcctttgcttttgggtagtttcaccttttaaggacagcatctactcctttagcatactttcagttgctaggacagctgcggttagtaggacaacagcagttagcatctcctttatgcctcatttatactttattcagtttggatgccttctaggacagcatcctattcaaatttcgaattttagactagggtgcagcaataggcttacagccagctatggctatatatatgtatccaacctccctcgggtaggtatggctttgagtttatgaataaagaaaaccagaaaattgccccatcctaagtgccatcctcttctcaatgagagtaactattaaaattctaacaatttgagctgtagagtaggaggtgtaactagtaggacataaatatttttttatttaactgataagtaaataggttaatgttagtttataattatttggggttagtaacaagaaacattttagtttttctagaatcattatgtaaatgcatttaggtaaacagctgcgcatgcatttgtttggtgaatcctgaaattataaatagttagaattaatgagtagagttataagtctctatagcagagcatctagggcaaatgattctagattagagcatggcatatattagttctgtaagtattacttcctccattttataatgtaagactttctacatttcccacatttatgtaaatattaatgaatctaaacacacatatatatctagattcattaacatacatatgaatgtggacaatactataaagtcttacattataaaacggagggagtaatcaatataaatcgtattccactgtgagaaacattagcagccttaaaaatcaaccaatgcattagttcttaatattagtgatactgaatgtataggattactctggatagcaagtgcacaggtatatctttagttcgaataaacctaaacttatgggtctctacagcaagtcatctagagaagagcataatatcagaatctaaactttagtagttgatcagcataaccttgctaagaccaataccataaacaccattatttaactgtgatttcagtagtaagtatactttggcatcaagatgaagatttataatttctaggtcattaaatccctcaagtgatactaccattatgcatcatgtatgaatgaaatcatattaatcctctagattactattcagcatggcaacataaggatctgatcatgttagtttattagtttgtaacaaattttaatatttagatgtgttgctttttctaatacaaggatctaaatcactaatggaaacgatagagagcaagagaatagagtagagcaaagaagctacattttcatatattacataagccgtagacaccatttacataggggtatatgtccttttataggacttttaggtcggtttctacaataagcgacccgctacaatagcatgtttttacagctcatgttacagctcatctaatagcacaaaactagcttgctaccaagacagacgtgctgcttgccaagcacaagcagtaatgaaactacctgatacagtgtacacctttgctagctagtaaaatttgctttgtatccttccatgccaacacaacaaagcatacaactcacttgtgtattctatagcccattatcactcatttacaactaagcttagctaatttgtgctagaaacttcaagcagcaacaagcaaccaacttgaccaactagtagtcaaatccaatttgactttgttatttcaagaacacaaattaatttccaacacgatggtcattgcataagcataattaaggatttaatcatgctagagtgatttctattttagtaatgcaattcatagacctattcatgtcagcattcattcatcatgaacatataggcatcatccatcttagcaacccaatttctctagaaccctagatccagtaaatacaaccctaagtataacatcatcaagtgaatcattaggacaaattcacaagcatcaccagtacatcacaatttacataacaacaccatacaagagaggacaccacactagtatatcacaatagggatcagagacgggaggatggaataggtagctcacctatggagcagagggatgcagccaccggagttgcctgtgtttccaccggccatctccacggtggctgcagtagcaggagaccggcggctggggttagtttaggggcagagaagcgaggatccaagaaaccgattcaggccggcgacggttgcggggcggtggctagaagggtcgccggagtggggtgtggcagcaggcgcaagggagagcgacggcactgcctgggaagcggcggcgctgggtggagagcctggttatgtaatctggatgatattctcaagtttggtattgaacttgtttgttctcaaatggttatatgtgcattatgggtacatgctaccatttttttatctatgtcaagtgctttcttgacttgtgtcaaatgctctacaaattgcaaggtacatgttgccaaaatttagggtacatgctgtcaaaattttgcttacatgctgtcaaaattttgccatcggagcaacagtttatgaatacacatatatacaatacatgcagcaatatatgcagcagttatatgcagcaatatactccctccgtcccataaaatatcgaatcctagaagcccgatgcacttttagtccaagcggtgaaagatcaaaatacccccatcaagtacaaccatgattagcacttttgttttgaaaaaaatctctgtgaacactaaattgttcccagccccttcctcgatacccaggcatcccaccaccggatgttcgccgtcgatgcatcagggctgcaggaat

SEQ ID NO: 81888 - DNA, 27294 bp, Oryza sativa
tccccagccgaagttcccttaggttcctcggaggccttgtcaagatggcgtaaagggacagtaggataggtttcaacgctaggtgtcgtcgtggtaaggaatctctgggtaaaacacttggcgatagtgtgtacttgataccaactttgttggagtagaggtagtaggagaatcgctacaccgctggtcgaggaccaggtagtagtcgtaactcgaccacttgaagtaaaaggtagtgggagaatcgctacaccactggtcgaggaccaggtagtagtcgtaactcgaccactggaagcaaatgtacgagagatcactacgatcaactggttgagaaccagtgagtaggtgtctctcgatcatttggagtcgtggtacgaggaccgctacgctgccggtcgaagactagttgtagctgttcctcaaccatctaaagtcatggtgcgaggaccgctacgctgccgtagtcatacctcgaccatctgaagttaaggtgcgagagattactacgtactggttcgagaaccagcgagcgagtagaattatctctcgaacaccaatggaagttgcggtgcgagagattgctatgtactggtgcgagaaccagcgagcgagtagaattatctctcgagcaccaatggaagttgcagtgtgagagattgctacgtactggtgtgagaaccagcgaacgtgtagaattatctctcgaacaccaatggaagtcgtggtgtgagagattgctacgtactggtgtgagaaccagcgaacgtgtagaattatctctcgaacaccaatagaagttgtggtgtgagagattgctacatactggtgtgagaaccagcgaacgtgtagaattatctctcgaacaccaatgaaagtgctagagttggtttattacatgtgtatctcatgtggccagcatgactcacatacccaacttatagcatatccggatatccgttcgcaatcatgtcgggtgatcaagccgacggcgttcgtgaggaattatccgttaacaaccttttcttgagtagtccagcgatggccggtgctatgagatagatcgtcggtcttcgttggtaggttgggtgcgataactccgcatttgtcgataatgttctcgataatagagtgtactcgaccataacctactcgagtgctcaattgttcctaaaaaatattttctagaaggcaagatatatagcagataatatcgagtatgtacttaaaaaaactgcatggatcttctagcattatcaggatataacatgcagatgtaaatatcatgcattatgtaaaccgtaaacaagcatgatttatacagaagaaaacagagcgagcccccagcgttaggccgtagttggcctaacatcggggacgcttgcacaatagatattgtataaaaaatatgctctaggtaaacataataaattatagatctgataatgctgtatgatctgaataggtacgataaattacatataaaatattacgtacttttgtagatacatgccggatatatctacgaaattagtagattaatttaaaaattcaatctgctaattacctctgttgatgtagttggataatctgcacatgtacaagtgaagcaaccgtggatgagtactgtggtggttactcctgtatacacgtggctctttggctttgtgcccacgcatgtagacaaattgacagcaagaccaaaatatacacgctgtaacagcgtgacgttaggtcctctgccatggtttgtattccgagtagaaatcaaggagattaatggatgcccgctagttagcctggtgcatgcgagtggagcggcatacagggcagtttcgctgtccttttcgtcatgtgcttgtgtgtcatcgagaatcaacacgaagccgacgaggacagggctcaagcgggagcactctcctgattagatttttggcggcgacgtggtctcaaagtaatcaatcgggccgaggcctcacgatcgacaacattgaaccgttgttctccgcagcggcgacatcttgaagcttggtcgatctcgccggatcgaatagttaatgatgatggttccgatcttgtcggggcacgtactctggtcagattagatctccctctcaaccgaagtcgtcgagtaggttgttgttggagaatccatctcttaaactcatctcgtcgaaaccctgaagcaccaaaatccccctacctggcgcgctactgtcgacgtttgatgtcgcaattctggtatttacatagtatggggatcgtcggtgctaggatatacgcgagactgaggtaaaagagacggagacagggatttttatacaggttcgggtccctgagttgtcaggtaataaccctacatcctgttggccggagccggagttgcttttattcaccataatcacaccagtacaatatgtggggtagcctatctaaccgtcgtcgacatggcggtttgaatgtctgactcgtagtcgatgacagggtagtcttcctcctcgaatccgtgcccggcgagatcagagatagcgctttcgtctctcctgacagtatctggagacaccgtatgggactagccgtgcctttctctgaagtcgatatccggcgtcttgtcttggcgtatgttggcttgtatgttgtcccgtgtattgtgtcccctcttcttctaggggccttgtatttatacccatataggtgtccccttgtctaagtagaactagggaaaccaatatggatacaatccgagtagcccttgtcgtttccatgtagaactctggttgtctttccttatccggaactccctccatatctgaagttagtttccgtataagacatggtacgtggtgcgtcctgccgagatgtagtcgactactattaggtatgtggtatccataaccttgacagccgcggtatcgagatactagatattgtaatcagacaatgtttgaatctagaaattagaaccatctgaattggtttatgttcatctatgaaattatgtagtagtgaataataataataataataataataataataataataataataataataataataataataataataacaacaacaacaataataataatagcagcagcagcaggagactgttcgatacgtgaccttaaatacattcttgaattgtttttggggaggaggacagataaatatcactgagggttgatggataggatcttctagggtaaggaagagagagggtgaatcctatctccatcatcatggctttggacagatgtccgcttcagactgaaggaagctgctctatttaagccgtacgtgatcctacagctcttgtctcatgagtagtacttttccctgcgctggctgtggcaaggtccatgagttgagtgattagagctagtagaagccttcccggtaattaatgtatggaacattgtcctttggtttttgtgagtacatggctagaataaacacctgatgtctagctatagaatagatagattagtgtaaaaaatatactaatatattagtgaaaagactaatactctggctaacagcagctacatgcatgcatggaagcacctactagtacttgttggttctgtccctttagcatagtcacatcaactagctatcttctattagtagctgtcatgcatgaaaatttatatattgaggctgtgtttagttcgtgtgctaattttttttttaaatttacgaacacacatttgaagtattaaacatagactaataacaaaacaaattacagattccgcctgtaaactgcgagacgaatttattaagcctaattaatccatcattagcaaatgtttactgtagcatcacattgtcaaatcatggcgtaattaggctcaaaagatatcgcaatttacagtcggactgtgcaattgatttttttcgtccacatttgatgttccatacatgtgtccaaatatttgatgtgacagaaaagttagaagtttgaagaaaaaagttggaatctaaacacggcctaattaatatcaaagatttgcatatttggctaggcgaaacgcacgggtagaacgatagaaaactaggcaagactacgcccatcaactattttacttaatcatctctaactaaatttgcttaccattattacattgagatggtgatactaacaatctaacagtaaatattattaatacacgaataatggattgatgattttatcagtgagaataataacgtgatagtgatacttagcctgagacggccgatacctgaaacaacgatatcgagtcggctgatatcagtgtgagatgaggaatgcctcacacaactagggaattcagcggcgtgattctcagattagggtatcactaattgggggagaaaatggattgaaggaacgatattatgacgattattttaatacctctgcagtgtatttttaactcatttactatgttaaatgtcttctattatttatcggttgttaatatctaagggtagtagtattttctgtctttaaaaacatctatatagctatatgtactaatcttgctgagtatgtgtaatatactcatatatttactatttgatgtgcgcagaaactagtcaagacgagatgtccgagggaaatgatgacatgcaaacctaatggggagcgtggtctacttagtctttagaagcatacaagaggacataccatcatgctaggtatagggtatcgtcttggtaataataagttggtaagcgaatcaaccgatgtattatgcaatgtagctggtgaaaaataaatggaaccattgttgaaagtgtccaagctctagttgtgatagttagatattacatcttgccttatatccttatggacttatatatatatatatatataaggatacgacagactgtcaaaaaaaatatttgggtcgtgacaaattatgaatacaaactcggtagtttattgtcaggacctaagttaaatgaaacattatctctagtgtgtagttttctcttgataaatatttgtatgccacatattattattactctattcttgttctgaacggttacatataattgatacaaatacggattaatggtgtagggggtgatcgcaaacgcgcgccccaagcggcaatgaggaagaattgcatttgcgtgcgatagcgggtcacagttaaggtacgaatttccccactagcatgaactctgtggggtcttcaaatataagaggcaaccatttcttcttgatacacaagcacaagcccttttgagaaacccttgtagattgctcgatggggagggaggcagtgctgctaggatataaattaatagccgaccaattcggcttcgtcattccatctctcctgtagaagtaaatagtgcggtttcttgcaaaaacctctctctcggccagttatctttcggaaatgctaatgggcgggtgatcgctcccccacccgcctagcgatcacccgcccaccctctcccctatactactagatgtactcctccctcttctcccccttcctccttcccttctcctctttctactacagtaaaccatacaattttttttaaaaaacaaaagttagaaaaatttatgtatagaaataccatatataaaaaaaatttgaattcaaatttaaatttgaatcgggtatgtaaacttttgacttataaactttgggtctataaactttaggtgtataaattttagatgtatagaaatactacatagagaaaatatttgaattcagattcaaatttgaatcagatataatttaaattcaaatttgaatcgggtatataaactttaggtatataaactttaggtgtatagaaatacttatatatgaaaaatatttgaatttaaattcaaatttgaaatgggtatataaacttttgacttataaattttaggtctataaacttgaggtgtataaactttagatgtatagaaatactatatataaaaaaatatttgaattcaaattcaaatttgaatcggatatataaacttttgacttataaacttttagtctctaaactttagatgtgtaaactttaggtgtataaactttagctgtataaatttactaaaatatgaaagtaatgcggtgccaaaaaagaaaaccagaggagggaggaaggggggaggtggggagcgaatctgatcgctatcccatccccacggtgatcgattgcccattaggcgtacccgttatctttcacgacagagctatcctttgttgacgggtcgtgccactagattactatcgtctatggcccgcaaactgacccaaatataatttgttttctctatgaaatccgagatattagagcccatcgtgtctgtcctgggatcataatagccaatttcaatctaatctatcgagaccaagaaaaacaacaccaaccttaaccggcgaatgatgggccgcttccgtctcattcttaatgatctagctctgcaggagctagtacatcttaacggtcgttccatacttccatcatgtggtcgaatgcccgggattcccgagcgcctagatagactgttcgtctatgtggatggggaagagtttgtttccctcgttaccttttgaaaccctcttctctccatgttgccggccctgccagagaaaaggagattctaattcgaatccttctggtgtcgtctccctgctccatccatgacctgatcaaattgatgcaaggagaacgctcctgaggaagcatcgaaggcaaaacagtgaggtattttcccaaaccattagatttacaaaatgatctttccgtttgcttattatgtatcaatcttccataggataatcagatggataatttgcatgtttattatgtaaagaaacctagaaccaccgtccaccactaggccgtcgtctcccacggttatccccctaagcccagcgatttctcctctcttccatctatcccaaccctcctcctatccccacccaacccgggaccctaaaggcttaaaccctaactcatcgagtcaccgccggtcgccagagttagagtagaaggagtgcatcacgaatcgggacataatagaaggttagcaattccgatatttaaaacatactacctccatctcataatacaactattctagcatttaaattttatccataatagagctgctgctctatctatttcctcatcataatcaatggcaactcccttttatttagtctcatcctattctttgattattatttttaaaaaaaagtgtatcagtaaaacggagggagtacttagtgtctatgtgatgagtttaaaattttgagaaacaactggttagtaactagcttatgagagtctggaaaacccagcttctagcttatagttcattttctagattttataactacatcttcttataatttggatgagaaactggactatttaaaaaagttttaaattttataagaagttgtagctgttagaagctttctaaacatgtaagaaagcaagaggaatgtgttactccctccatctcataatactgtaatatagcaatttagtaccggttgaaatatattctagtattatgatgaatctaaacaagttactaggttactatattatggacggagagagtatatgtgattttcctaatagtgtatttcctccgtccattaaaaaaacaaacctagcacatattaagacacatcctctccatctcatagtactgtaatatagcaatttagtaccggttgaaatatatcataatagtatgatgaatctaaataagttactaggttactatattatggacggagatagtatatgtgattttcctaatagtgtatttcctccgtccattaaaaaaacaaacctagtacatattaagacacatcctgatactacgaatctagatattgtgttatattccgtactactccttccgtctcgtaaaaattaacctagtattaaatatgacacattctattactatgaatctggatatacatatgtccagatttattgtcctggtatgtatcgcattcaattttgtttttttatagagagagtagatttgtattttatttgaccgagagaatgcatggcttaatctttgagacaagcatatgaaaaggataagaatctgcacccccataaaaaagtagaggcccgaaaagagcccaatacccaaaggaatccacccaagccgatggtggttttagccacgggtctcagtctcactcccagattctactcccgctcctccatcgtcgtcgccgcgagtttgctcctctcggcggcgccctcctcgtcgtccccgcgcgctcgtgccgctgctccggccagcgggtactccccgtggcgaggcaggtgagcggggctcttcgagttcacgaggtgtcgtttttttttttcggggggatttctccaggaggattagtagagatcaggtgtgtcctcctttggatcgcttttatctgttcgagcgattgcttggtccggtagcgattcgggtgtgagactgagccatctgcgcctctgttactgtttctgttttttcctttaatggggatggttttctgaaaattaggatggcacccagcggtatgagattgttgtggattgtttgatttcctggtggttggtgaagtcagaaattgagcagtactctctgtcataagacgttttaactttggtcaaagttaaactactctgaatttgactaactctgtagaaaaaaaagtagtaatatttacaacacaagcatagtttcattaaatttatatgatgctatcaactgtgaagaggcttcgaggcaagatctacaaacgtctgcctcggctcgctaccaaactcgtaagcaaacagcgggacgtgaagcaagccagctacaggtgctagacggctttctcgtcaaagcaataccaaagtgtttcaaagaaggattaccttgacttaggtctgcctccggcctaaattaaatcaacctaagttaaatggagtctctatcgttctgctgcaccccttctcaaacaacgcgtttgatttccttccttataccaaaggaattccttctttctcttgccgatcacatccaagggtcgaatacatcctgtctttgaacctttgtagtcctatgcatagtcagtactatagcctcactgtcctcgtcgaggatagttattcattaaggttaatttgattcaatgaccagaattctgcgaggatatatagctcggagacgacgggcaaaaatgcgttcatttgcctcaaacttttcggggtagaagaactcgttagttgtagttgttccgaagggacaagtcgctcccctctgctgaccggaggaagcactttggaaaataaaaactcgatctatacctccgggcagcagagcagagggaacggagccctcgtcccgaggcctttctatgaaggcgagcagcccagcccccttgttgaaattttgatattaaggaagccgtatttcgcaatagcagctccgagaagctgggcttagggtgcgcctcctgcggtcgtttcagtgattcaattggctggcttcccccagctcagactgatgccgccacctctcccaggaccggaatgattatccctgcccgatgggtctacattcatcctagaatgtcgtcggcatccaagctttgaacaatactaaaagctgcaactcgtctgctattccgatcttcctctgattcaagtgctaccagttccttcttcaactccaggccaggcaagagccgagaagggcttcccaaatttttcccgcggaggagggagaatccgcgagtccacgacctcctactcccgagcggcctctgactgaaaaggatcgaatttatttgagtttggttttacatgcggatctggaaatgcaagaggacctagaagaacgttgctccttagatgtatgcagctgaggcatcctaacgaatgaacgatttgaaccagttccccaacctgctttctccccgagaaagccttcctgagattaaaagaaaaaggtttgaaggttctgggatcagtgatagttcggaaccagcaaagggaggctgaaaagccgtagtgctaacgcacgccctgtagttttgaagcaggcttcgacagcagcgagctccgcgtcgaaaagcgaagcgagccgcgctagcgcgctacgattattccaaaattgccccttcgctttatcaacttccagttataagttgtaacttacttcaaacgatttgagacctcttgatatccaacattgttcttaccagaaccaaaggccacaggttattgctaatgccttccactatactcaacctgcatggcaattacttaatcaaagtcaagatgcctatccacataggaaaaacccaaagtcaaaagagcaattggcctgcaaaaataaaggatttgttctcttttgtaattagaacaaacataaacaaattggatagaaaaggagcggaaaccgattgattgtacacttgctgttctcaactgggcctctgaatctcctctggtttcacctttgcgagtcgaagtaatttccggaaagacacagaggagctctcatgcgtggaccaacagtagccctgtcctctcctctttgttggaagatgagtacacatcgggtaatccgcccacgagagcccaatcacaagaggctcatatagaaagcaatcagcccatagcccaatatcgagaccacagcctattattcaaaccacaaaggatccgtctttcatcgtccaatcttctcgatcgaacatattgacatcaatactcctttccatggccattcacggcccgcgaagatcaaccactcgtgcccgagatcactatccaatcaaaaaccagacttccaagatccatctcactcagacccttttgaatgtagcggataacaacggagcggggctatcgaattgatatgtattcgaatcttaggagctggtaatcactgatatgctcatattggtgacgttattgttgctgtaatcaaagaagcagtgcccaaaatgcctctagaaagatcagacagaagtaagacgagctgtaattgtacgtacatgtaaagaactcaaacgaatgtcaaaacaaaggaaagatgattatcttataggaagactgccaacactgactggggttgttcaatcttaagtggagtgagttaaatgacttggcttgctcaattccttcccggtgtaatttcataaaaggaatagcactcaaagcttgaagataagttttgtactcaattaatttctcagtccctctaatcgggtgggcaccggccggccggatccccctgaaaaccgtacgtgcgggtctcctttttgggtataaagataaaggagtcgagtttacaattgaataaattttcataatacatttgtcttgggttaaaaatattactattttttctataaaattagtcaaacttagagtagtttgactttgaccaaagtctaaacgtcttataacctgaaacggagggagtaatatgaatcactagctagctggggatgtaatttactaatttacataacatgtgattgaccattgctgcagataatatgtcttgtccacttcggctagttcttagtttgctgtattaatgtaaaatcagttttattcagtggacagtgatctattagcctcagtgccgtggttgctttattgggttcaaaagaattaattgaattgttgcaaagaggcaatagttttgatagtgctaagacaatgacttgtattgtaaaaaaaaaaagtgccacatgatggggacagcgcgatgaaaagaaatcagttgtaatgacgcacaattgttttgttcttagaatatgtattgttttatttttatttttatgttgaggacctagtagcaagtcttatgctcgaaattcttggtctgctttatgtagtgatcacttgacccatcttttctggcaatgctgatttaacctcattgactccatctggcagcattagtagaatatcatcgcacccaacagctatggctaccacacaagcctcagaagcagccactgagaaaggattgcctttggggatggatgtctccatggtggatgaatatgcttcccagtccaagctgctgcaggaattcgttaaaattcccactattggcaacgcttggatcttcaattccaagactggtatgtgctgttattgctatctggttttactgaacttaggtttcttactcttcttctcgtgttgtgcagaaaacacatctagggcgatagtttctgttggccaaacagatctgttggcaaacaaaaagaggagcttcctattaaattcccacatctcaaaaaattcctcaaattctgtggatttccagtggtctcccttcccaatcgaaatgagtggagtttcagcagtaattccatcgccatctgggagaaaacttttactaatacggaattctgaggatgattcccctacaaaactagaagtttggggcccctgtcagttggagaacgagattcacattgcacaatctgttcatggatcactctatgtcgacgaatggtaaactatcctgcctcttttagaacaactttcttagttttttgtgtggtagtgggtttttttttggaagaaagacagaggtaattagggacgagagattgctccattcgccactttttgtacttcatgtttcttaaatgcaggtttgaagggatatcgtggaatcaagaagagactttagtagcttacgttgctgaggagcctcctcaaccgaagccagaattcaatgattcaggatacaagaaggctggctcgtctgaaaaagactccaagagctggaagggaaaaggggattgggaagaaacttggggagaaacgtattccaagaaaaggatacctgcattgttcgtggtcaacatttcaaggtgtgtttctggttgttctgaaggttgaatccaaaatagctttaaaagtactgcaattttgtgaggaatagtttcattgcagcggtgaagtgcgagctgtgaagggcataccgagaacattaagtgttggccaagtgatttgggctccatcatcatcacatagcctggtttttgtggcgtggtcatctgataatggttaccaaaagacaccaaggaaacttggaattaaatactgctttaacagaccttgtgctctgtatgctgttcctgatcctttcatggaagaagctgataagccatcacttaagtgagaacacctgtccttgatgacaatatttattcagttctatttcaactatgcaccattgtaggcttcctgttctaacatattaaggtattaattgtcacattttagttattttctagtgatcgtgtgacactgtaaattcttctctcagaataattgtagcagcatatttttttcaaggaaaaaaaatcttccatatatattttcactcttttttcctcattaatcctagtcctgagcagacaaatgctaaatggattgtatgcatcatgtctcaaaaaatagaaagtttatttctgatgtcatttctgtttattgtacagtgtcagtaagggtgaaactgcacctacaaccaagttaacatcagagttgagcagtgcttttttcccacgattcaggtaggactgcattcagttttctttgctcagtactgttattcagtttaggccatatgtctcaactattatattggaagaagtacaagctacacatcctagccgtatttctttaattatgcattataattgttaggcgtaatttttcttctatggtttaaaatattttaatcaaattcccttaaagcatgtcaattgattgttcatgcttgttatcatgtattttaacctaaatatttgaacaatcataattcaaatgggagtgaatttggaaagtggagcattttgggctgatgagtaggtgtctttattatttccttgttcctgtaatcctgtggattgactcagtagatattaatttactgcaacaccaatacattttatttgcacatctacaattgaagttttcatgtctagattataacttagtactggtagctgatgcatgtagatgaatgttaacaatgcgtcgcaaaaatgatatggaatctttattgtacagtccagatggaaagtatcttgtgtttatctcagcaaagagtgctatagatagtggaacacacaatgcgacaaattcaatgcataagattgactggcctgcagatgggaaattggagggcctcagtgttgctgatgtggtacaacaatgcctttcctttacttgttaattttttaatcgatcattttgtttagatggcttccttttatatatagcttcaaagtcatggcttggaaaaatacataaatctaaccagtgtttatttgagcacattgtttgcctgttggctatacttgattaaagatatgtatttctggactttgtgaagtggaacttcaattatttttttaattattgaagtatctaaattcaatttcagttaaaagaacgaagttcagagggtaaaatttataatggtgtgtttctttttataggtgctctgcatatccgatatcaagttcttaatgtcttagctgttatgtaggtacctattgtgatgtgccctcaggatggttgttttcctggtctgtactgctctggcatacttaggaatccatggcttactgatggacaaactatgattttatcttctatttggggaagtaaggaagtaatactttctgtaaatgttgtgaggtgattacaagcatttttatccatcagttagaatgatatggctataaagtttatttatttatgaaattacctattttcttcacagccgtgaagtttcaagagttagtcctcaggattcggattattcatggaatgttcttgcactagacaaggataatattcttgcaggtaattccgtaccgaagttacagttgtatcccatagttcctttggataagatttcatattcatgtgcctttcccaccttttccagtttcaagcagccttattacagttcctcaaatatactatgggtctgaggtttgtcagactggaaaaccaaaccaatgggagtggcaagaaattgcaactccttttccgagtccttctgataaggtataactgaaaaaatgcgttgcttgttcaacttttccccaaaaacactgacaaaaattttggcagtgtaaagtactaacagtttctgtgatgtatgtttggcagatcagtgcaatattagcagaccataagttcagtatactcaaaatcccgattagcaactcttctaacaaactcgctgatggtatgtgtacaacccaaagctcctttctttaatgaaatgacagacagctctcctgcattcgaggaaaaaaaaagcctctgactgtttttttttcctggaattggtactctttggtgccttgtgttttgaatacttctgttactgcattcttcagttgacgctatgtttttcttgagatcagctgtactgtctagtacttgtaggctgatatattctgaactgcgacaaaatctaaccatgttgcatttactcaaggcaacactaaaatgcatttgtaagaaagttctcaaagctcatggtagaatactcttcttggttgtttgcatccttaaggatgcatgctaagcttcatttgcattttaatgtttgaaaatgtactttagtagaatactcacatcctctccccttcctaaatttttatattttataaaattgattcaggtgctaagctgccctttgaggctatttttgtgtcctggaaggattctgcaacaagaccaacaattgttgttcttcatggtggaccacacactgtttacccatcaagctattcaaaatcgttagcatttctttattcacagggatataaccttcttgttgtgaactataggtgagctttatttttttttcttccagtagttcttctgttgaactaggttaaaataccctgtcctttctgaattctgctttggaaatatatcatattaaacactaacattaatgtccacgtacacaccattctgttgcctagaggttcactaggctttggtgaagaagcactacaatctcttcctggaaatattggttctcaggtgcactgttgttgatttatttccatgttttaagattattttcttaagttgccagaaattttatatgaactgtcattacgtacaattgtttaatactcatgaacaggatgtgaatgatgtattgacggctttggactttgttataaagaaaggattaatagatgcatctaaagtagctgttgttggaggttcacacggtggtttcctgacaactcatttgattggccaggttcttagcatgcctttgttattctgaattctttatctatgcaattattcattacatttgcagtttatatttcctttagggattcaattatttgtgcctaatcgtttgcacaaataatctagcacaattcttgttgtaaactgtatatactcatttggacataattgggaacagtgtcttttgataatgtgtattggtctatatgaaactcttatatttgagaaatgtgctgtaaacttataattttgggagggaggttgtaatttgtaaaagagagtagtaagtttaatataagtacccaagcacactaagttatggtcagtgaacttaaaggctcaaagctaaacttggatatttcaggagctctgtagcagtgcacagctaaaaattcttttaaaaaaatgatgacaccaatttatattagctattaaattatatattacattgcaacgcttaagtccagaataatatcctagaaaaacattcttacaagagttaggatcagcatttgtttccttttcttggaagtaaagcttcactgcagtgtaagccgagctgtttttaccttttcatgattaagaagttcacatgtgatattctcaagaatatttcctgattttagaatataattatttccttgacaaaaatagtgagaaactactgctgcatgtgggaactaggtctatacagtttctttatgactatacatgcaagacaataagagttcatgataggtctatacagtttctttatgactatacatacaagacaataagagttcatgatgcacaggcaatagcacatggattcttctatttatcaggtcttcttggattctgttgaccttatgtttcatggactgcaggctccaggcacttttgttgcagcagctgctcgaaacccagtatgtaatttatcattgatggtaggaacaactgacatacctgagtggtgttttgtggagatttatgggaaagaagggaaaaactgcttctcagagtatccttcatttgatgatctttgtcaatttcaccagaaatcaccaatatcacatatatcaaaggtatgtagattctgcatacttaaccttttacaaaatctatgcttgaggaagaaagtgtagttccctcatgcaaatttgctccttgaggactttgagtaatcttttcttgacagtttaagaaaatctgcaggtgagcacgccaacactttttctccttggagcacaagatctcagagttcctgtttctaatggcttacaggtaatttcttatgcacttctgtttcatttttatatgatgaaagggttgtgaaatgattactagtagcaatgttgcattcatgttattgtttgcgtagacaagttcagtcaattttcctgaaaaccattagtgaaagcatatgattcatattgttccactatatactgcttgtatctatttatttattttcacttttacaaatgctggtttatgcctaatcataatcgcaacatatgcagtatgcaaggaccttgaaggagatgggagttgaaaccaaaattattgtctttccagaagatatgcatggccttgacaagttagttgtactttttaatcattttacctttgttaccccgatcagtgtcttctgtgttgcaacatttgactaagtcaaccttgcgtcccctgtgcaggccacagtctgattttgaaagcttcctcaatataggtgtttggttcaagaagcacatgagcaaataaacaacatgcctctgttaccacactctcaccttgcttaataaatgcttgtaatttgggtcaaagcagcccaaggaaacgtggttctgttggcattctaataaattaagcctgctgtaacatttctgtactgggataattcttgaaaatgtaaatgcatttggttataaaattttaccctcgtggtacggaactatggattacaaatatgtgatgttagattatgctttactttgaactttgaagtacttctagttcacggttgctgtcctgtagcctgttgggcttgggcattccttttatttttatctttttttaggaaacaatgggatcataatttcttttgaatttcagtgagaaaaaaatacatgaaagttcagttcaagttaggcacatggaaatgctgattgagaccactgtaacttctgcttctttgcatcaagatcccttgaagttgccttctggataatctcattttcatcagatggtacaaagagctttgttgtttcatacgattttaaaaaggacaacaatataagttattgcaaaggcttcttgtgctgttcgatgctttcttcgtggatgcggacctgacgcaaccttttgtccttattgctgggttcctcttgtctcattgtctatggtggtatgtacgatcattagtaactttttaagattccttttgttattttgggcccattctttgagacctgacacaaaaagaaaaccaaaatttgatgccatctgatcctcaccaattgtttgttgttaggtttgttgggatcgttgctaaggactgatgatgttttaaagctcaactgcagtcttggatcaaccactctgccactagactccatttgcacttcactgcaaaagcagaaaaatatatgtaagtattctcctttccttcgtctcctgaaaggctaatacgatttataatctgattttattgttttgaggcttctaacttgctgaattttgttggtcctaagttgtttcctcctgcactcagtctggtcctcttgattattgctgtagttccagaagaatctgattttgttagtagaactagtcccagacttaacatccaggatttaatattttttagtgttcatcgtattttttagttatgtttatacttttgtactacatgaaaatcaaagcatttagtgtcagagttctccagaaaaggattttggtgggaaggaagaatgaaagatacttcattttattaatcttaggtagccattatagaagtttccatgttttgtttgtctaagtgattcaatattttttcttgaattggtgcattgacaacgtcaaatctgtccatggattgcaagatgaacaattgggactgttgttcttgagttgttaatggaatttatgaagtataaattaaaaaatagtttgtgtctgaactacattaaagtgtatgaaatctgagtcttagtacggtagtacctgaaatttttcacgggtaactgcaatttgaattatgaaagagttaaggtgatataggttgagtggtgtgctctaacctctaggctcttttggcattgaaatgtatacccatacatcatgaagttgaagtcaggaattcaggtttctcagttttcatcttatcagtggaattgacaacaaaatatacttgagcttccctgcagcttgtttaacatactatattcttgagtttcccttcagcttcctcagcatattaacctttgtgacaatgcagatttagcttaacccagtagattgtgtctttccaaccgaccttacaagtgatttgaatcttctttgagaaagacaatccattgggaatggatgcactggcatctgaagaatacgcttcacagtcgaaactacttcaagagttcaccaatgctcccagcattgacggtgcttgggttttccagaccaacaatggtagggatgattttcgattatacctcattagtaatcatcattttactattttccagaagtggcgtaaagcaactcttgtgtcatgtttgcagaagacagatccacagcaatgtattcgattagccaaacaaacctactggcaaacaacaagagaaaatatattttgttttctcatattatgagaaatggtactaaccttctggactttcaatggtctcctttccctattcaaatggatggagtgtcggctgtcgtaccatctccatcgggatcaaagcttcttgtggtgcggaatggagagaaaggttcccctacaaagcttgaaattgttgatcaatcacatgtggagaaagagatacatgtagctcagtctgtccatggtccactttatactgatgagtggtaaaagtacagcataatacctgcacttttcagtccattcaacctatctgtacaatattctggatcatgatactatttttgttggcacaggtttcatgggatttcctggaaccaagaagagaccttaatagcatatattgctgaagattcacctgaaccaaaaccagtttttgatgatactggatatagaaaagaaggttcttctgagaaagactgcaataactggaaagggcaaggggattgggaagaggattggggtgaaacttactccaaaaaagggagaccttcattgtttgtccttgacattaataggtctctcagcaccttctaattaatacataatgttgacctgaccatagatctgacaatacgacttactgaaaccgtttatttgttgtattcagtggagaagtacgagctgcaaaaggcatttcaagatcattgagcgttggccaagttgtgtgggctccaccatcttcatgtggaaggcagaagtatctgatttttgttggatggttagagcacaatgggtttcagaatactcctagaaaactaggcatcaagtactgttctaataggccatgttctctatactcaactctttgccctttcgaagaatcagatgttgataatgcaccagctaggtaagtaactgagcacccatcttcagatcatgctgtaactttgtaaagtttacaaatttactttatttatcactagtttgttgaaataagaaaatgtaaagctctgaataactatgcttatggggcagttgtaagttgatatttccatgacatttttccagtgattctaaattagagcctgcttcagtagcaatcaacttaactccaagcataagcagtgctttctttccgcggttcaggtatgcccgcattagtatttgcgtattttcttgaaggaccttaaaccatgctagaaaaattcttcacggaaaatctctaattattttcaacagcaaggatggaaaacttctggtgtttctatctgcaaatcgtgctgtagacagtggagcgcacaatgcaacagattcactgcataagatcaactggccttctgactggaaaatggatcaatacctcgaaatcactgatgtggtatgtcctcagatttgtcttgaccggtacttatctgctgtctgcagtcaatttatttaacttctgaactgtgccagattccaattgtaatgtgtcctcaagatggttgttttcctggtttgtattgttcttccatgctatcgaatccttggctttctgatcgatgtacaatgattctgacatctgcttggagaagcactgaagtgatattatcaatcgatgtgttgaggtaaacaaggttgctcacatatgcctttctactgcttcaaaaatcattgcaatatcccatgctatttccttaattcctcctgcagtggaaaagcaacaagaataagcccagaaaattcagagtactcatggagtgctcttgcagtagatggccacaatgttcttgctggtaattctaggtgcacataatcagttaacttatgcatcaaattttattattttgggtgtaataattttattttatttttgtttgttttctagtgtcaagcagtcccatcgacccacctcaaattaagtatggccatcaagtgtcattgaaggatcagacatgtacatgggtctgggacgaagttaataataatccattgatggcagctaacaataaggttagatggtgtacaatttgaagtatacttaggtgttctttgatgctttgaacaatgtaatttactaaatcaggcttttttttttcattctcacattaccatctgctgcaggtaaaggctttgttgtcacatcaccaattcagcatactaaaaattccagtcactaacccctctgatgacctctctgatggtatagtcatggacacaaatattttagactatcatatgtggcttatcatccttcaccaagcaaatgttttttatatcctgcaggcagtaagcttccatttgaagctgtctttgtgtcctgcaaggacagttcgcacaaaccaactattctagtccttcatggtggcccacactcagtatctgtatcaagctattcgaaaacatcggcgttcctcgcatcacttggatttaacctacttattgtaaattatcggtaagtttgctgaaacatttctacagttctgatcaattaagcttatggcatcatctcactatcatctgaaaaaaaaagagggacaccgggttttggagaggaggctttgcagtcacttcctggaaaggttggatctcaggtatgtaatccagctaaactctgagtctttgtttctcatgaaccaacctaatttctgatgtgtgtcaaactgtcaagcaggatgtccaagactgccttacagctctagactatgtcattgagggaggacttatagacgcatctaaagtagctgtcatcggaatttcgcacggtggattcttgactacacatctgattggtcaggttagcatcctaacagattttagcctctcaaaggaaaagaagaagaagaacaaaatcctaatagaagttagtatatgtttcttgttcagcttgtaatttgttgttattttgtttcaggctccagatagatttatggtggcagctgctcgtaatccagtctgcaacctatcactgatgattggcaccactgacattccagattggtgttatgcagtggcctgtgggagtgaagggaggcaacatgcctctgaatctccttcacctgatcatcttcgcctcttctatcagaaatcaccaattgcccatatttcgaaggtgcatttctgttctcgccttcattcaaagagcaaaaaagaaatgttcttactgatcaagtcattgttcttaaaaacaaatgaaccagagaaatcaagtgattagctactcaaaaaggctcactgaactttgctgattttttttttctaaaaaaaaaaactttgctgatttcaacaggtgaaagcgcccctgcttatgcttcttggaggagcagatcttcgagtccccatttctaatggcctacaggtacatcaatagccgtttaaatttgcctcagtagtttccactttcaattcgttgtagaaatagtccataacaaaaaggctagatcctgaaacaacctaacaatcccgtgaaaagaaaatcaatcgacgggctacatcaaacagacattctttaaattcatctacactcgattaataacctaacaatcctgcatttgcttcactcatttgtcggatttggttaaactattcctgctcggatgatttcagtacgcaagagctctgagagaaagaggcggcgagatcaggatcatgatgttcccagacgacatacatgaaatcaacatgtaagcaagtaactgaaccgaatttcagctcatctgctttatataaaatgtcggcaacagccgttcggaaaaaaaaaagacattcagatgccattgtactattgcttttgtgcctaattttctccctcatactggaatccatgcttttgttcagaccacaatcggattttgagagcttcctcaacattggtgtctggttcaagaagcatcttagcatatcagcatcagatgcatctgcatgaagtcaacttgaagaaggggaggaagaaattacgtggtttaatctagtccaacaggtagatgccattgtaagccttgttcatggagctcgtccgtagacgagtgctccaaaatattagagacttccctattgaaaaaagtaaatggagactttaattggtttgagttctttccttttcccttcaattcacatgcttgatgattggatgcaaattcagtcggatttactaattactactagctactgctctgaccgtgattgatgatcagtccaacaacaatacttgcaaaatagtgcaatccaggagggtgttgttctttatgcacgttggcccatgatttttttttttcaaacaaagtcaacagccgcgcgagcaagtacaaacctgattcattaagtaaagtgtggttttgtgaattttactcttgcccggcgaaaaatttactgccccctgtgaattttcctcttcattctgaaatactttgcacaagccaactcacccatcaacatgccaacttaatgtaagcaattaaattggtgaaaaattaaacacgccatcagattgctacgttaaaactacaaagctggaaagcacaacaaggggggcgagagctataacaattttacaacaacaattgactatatcagatgtaccaaagaccatgtcagttcttcgttgaggcttgggcaagctgagatgctactttgtttgagaagaagctctcgagcctgcacaaaaagaaggaataaaaccaaatcaattagacaaccaggtgactgagatgctactttctttgaactctcgagtatgcaaaaaaggaacaaaaccaatcacttagttagacaaccaagtgactatggccttgtttagtacgcgaaaaaaaaatttttgggtgtcacatcggacgtttgaccggatgtcggaaggggtttccggacacgaatgaaaaaagctaatttcataactcgataggaaacagcgagacgaatttattaagcctaattaatccatcattagcacatgtgggttactgtagcacttatggctaatcatggactaattaggctcaaaagattcgtctcgcaatttccatgcaaactgtgcaattagtttttttgtttatctatatttaatgctccatgcatgtatccaaagatttgatgtgatgtttttgggaaaaaaaattgggaactaaataaggcctacgtttcaaacacggacgataaataattaatgccagatttcccccaaggtgaatcttctactggttatgatagaaagacattattgagtgcacataaatccaacatgagatgtaaccacccacgtttctattaatggttaggctaaatattttcaaagaaacattgacagatgcctgacttacaggtagatgaatatgcaaacacaagattgaagttcattgctcaccgtgaggcacacttgtaatagattgtatcgggagagttataagtttttgcattgctgaacattctcttcatgtcagctacaaacatctctagcgtcacataatactgctcagactcaactctttttgacattgtcttcaaatctgcagacaagcttagtgttcagaaactgaatagcttagatggcacaaaacatagcttcgccaagctgggaaaagaagggaaaataatcccctaaatcattccagcataccaataggatctttgataatgtcataatagtcaggaacatcacgtgaatccactggctctttgaatggccaagcatcaggatgctcattcatattctacaagacaaagctcttatatcagaattgataaaagtatgaagtatctttcgtaagacaacagtagatccaacacatcaggtcattgcagatctacaacatctttggaacataatcctttgaaaaaattgtctatagagcactgtacttggttgtcatgttaactcccaatcacaaaacaaaattagctatatctgctggcagatactcttttgttgccgatacacactaaaagatcaggtctgtttgcccatagttttgtttgctggtggccattgcaatccattagcatagtagcatatgcacatgactttaaggtgtgttttgagtaatgacatggatccttagtgttacattggtgtagccagttttgcctaatttctaaaccacactggactgatggttgagaatcactagtggctcacctgacaatcagcttaacgtttcaaaggataaatatgactaatgtctgaccatatgaagtagagttcacagtgaagtataccagaaatatttgaatattaaacttataaaatgtggccatttcaatcattgaaccattgaacagaccatccagctggtctggctttagaaaatatgcttgaaacagaaagggtgcaaaaaattcaaaagggagcaagcaaagtacaggtttatccagtgaggtcaaaccaaatggttgcatgtcatataaaaagatttgcgaagataaaagacttgccttcaacaatgaacgcattagattagtaagttgttgcctgtaagtactgtaatcaggagaaaaggctgatcttgatttggaatgcccccactgatctggcgtccacccagcttcccctgcatcacattgattgttctgatcaggcttgcatcatagctaaaccagtaaacctaacaaggcggcaaaacaaatatggtcgaataagacagatggatgaacatcttattttagaattctgttctgtatatttaacaatctccagttgccatatgatcatttctacaattggctctaaggaaaacatccttgggagaggacaggaatgcggtagaagcaatcatcatcgatagctgagaggcagcaccgcagtccgcagcactccaatgggatagcagtgcactgaactcatgaatgtcagaatgcatggtatcacactctggacaactccttgcatcctgactgaggccctgtttggcagggctacagctccagctccacctctactggagctagagctcaaccaaacggtttcagctccacccaaaaagggagcagagcgggctggagtgatctgaaaaaaatgaagtaaaggggtggagcggggttcaggccactccacagctccactccacacactgctcctagagttagatttaggagttaagagccctgccaaataggacctgaatgggggatgatgacaaatttgatagaatatttggatggcatgcatggccctacgtgtcatactt

SEQ ID NO: 81889 - DNA, 3229 bp, Oryza sativa
  unsure (1)..(3229): unsure at all n locations
atatgtggctgacatatgggttctagtgacacgtaagcgtcaccatggcatgccacgtcagcacacagagtgggttggaatccgttggacctatatgacacccgagacaagttaagggacccaaaaattcatttcaaaagtttagggacatagttgacatatccacacaagaccggccatacattttactcttttgaacgatggaattgtgaaaaattctcacggtttggtttggtctgtctcgtgtgtgtgatcactgatcacctccacatggcaaattctcctcgcagtaatcagaattcgtcactgggccaagccagagcccagtttgcggcccatcatcccggtaatgggctgaattcgtaattgggccgaacagatcgctggcacctctccacattttctcgtcgtatctttctctgttctctccaactctctttgatcttccggtgatttcgcatttcctcgccgccggcgtttgattccgacgaactgatcatatccgccgccgccgccgccgccgccgccgctgacgccgacacggactcacgccgtcggagcgaaagaaccgccgcgattgccggtggggttccgctgctcccgcgacagaatttgggttcagggatcaaccacagccatgtctagtcttacccaatccaaatcttgcagatgggatactccgacgatgttcaggtgatctcccgcccgacgtggatcattttcctttctcccctctcgcccgtacccttgtcccttgcagttgtaagcaacaaaatgttttggtcaaatcatctgtagattggttgtgttgtgtctgtgtgtatgtgtgtgtgtttcaaccaagtgttgatcaaatcagctgcagggagtatgtttgtgactagaagcacggtccacattccctgtcacccaagttcctttcattcagcattggtgccttgttcatctgaaagatccatttgtgaaattgtgatagtggcgtagactgtagagtgtgacgtagttggaatgggggttttgcaagtgggcagtcttaataactcttagtgcaacctgacgaaaggtgtttttttcggcaatacgcgaaagatttgtgtatcattgcattattaagatggacaaagcagggctgaaaggaaccaaaatctgtattagatgctaagcacctgatggtaggtatttgtatgcaatgcattcccatatgctagttaactctgttaaattttgcacttattgtctttttcggaggatcgagtctgcacgaaccatgtgattcattttctcatcaaagtgtagggttgtatttctccataggattgtaccagaatttcgtggtttactcctgtgtcgtggtctcatggatttaagttttgaactagaatggttcacaattgccttcatgctcttgttagatttgaaacttatagttactataatcatatatatttcaaatctatgtagatatatttccttgccttttgttctactagacagataatataataattattcttgtttagaggactttggaatctgggggtaagatataagagcaattctacggtccttgaggaggtaccatgaggtaccaaaaatttaatgtaaaatttggtacctcatggtacctcacagtacctaagtaccaaatttacaatagaaaaagtggtacctcatgttacctcctcaagaaccgtaaaattgctcaagatataaagcttcatctgtaaacatcatcatcagaggtacattagtacttccgtagaaattctgattgctatccctcatctgataaggcatttaataattactttataatggtagactaaatatattaatgatgttcttatgcctattatctaaatgatcacatcccctttaatttgtccttgacaactcatagctagttgctttgtttgtgtcaatattcattaccctgtatgtgttcatgttggacttcagacttcagagtctagacagtagatagacatgccaacttcctgaaagtgatcccttccaacttttagttgggacaataaacaatatgatactgtcataactgcaatcaagtatatgacatatgtgagagttaaccacttgttttgcttgtggtctgtactctgtacgttaggatgctagctgtaatatctggatttctttcagaatctttctaataacttatctgtccctcatcaggaaaatggcaatgatttagctcctaaatcatgacactctttgtgcatgcgcactagaactgttctcaggtagatataataatttaaatatacaatagtgcatcctagctatcttttatcatttgacaacctcagtttcagtatttctgaataagacacagatacacataggcatgacctttatattgtcagatttggatctgaagcatgacggccatcatacttattcatgatgcaattactcttaatttaaaaatactttataagcacgaagcaactactatatagaagaaaataaagtacttgtcaccaagaacttatatgagaatatttcagttacagctaggaagtgataacgctaaataactgcaaacattgtaagaagtcatatgtgggtttgtatagatttatgttccttagatttatgctgttattgagcactgcaacacatttgggcctcttctggaactcccttgtagttggttaaccacatgcatgttttgcagtcaagcaaacatgcttgatgcttcagtttcttccacaagtaagagtcttatatgacccatagtattgatcactatctcaagtaacttgctgaaactgaggtgcgtgcatagaaagtaatggttagcaacattgtcagcaccttcttggtctcccactctcactattggtttttggttgaatgtgcatctccaaatacaaaatactagtgtaatacacttaccaaaccccaccagaaaagtccctgttagtggctcatcataggaaagatttggataactagatttccagctcattctgcaacagcaaaacacgcattgcacgaaggtgaaaaaagcctatgncgccctaggtttcacaagtgcatgtgggtgtagctctgagactgtgcatgaacaccagcctatcccacttgagtcctccttcctgagctcgctggtcgccactgatcccaaataattgcaccgagagcaagctaacaccatgtttagatcccaattttttcttcaaacttccaactttttccatcacat

SEQ ID NO: 81890 - DNA, 1893 bp, Oryza sativa
cgggtgagggggcgggcggcggcttcggcttccggccagggcggcggccgggcttgcgcttgggggaggaggtggaggcgagctcgtggttgtccatggcgacgagctagggtttcatgaaggtgggagaagccaatgcccgaaagggttggggttggctcggtcggtatttcttaggtgcgggtcgggtcgggttcgagccacaaggtcggttccaaaggagaaattggacatcctctgccatcgtaaaaagagggtttcctcatattcaccatttttcacgttttttaccattttctacgtttgatttgaccaaaatactctgagctcgggttcgatgggtgtggcgtggcattggtggggacggcatcggccgttgcggcgggggaaggggggaggggctcaggttgctcaccgcccaataggctgtcagcgataaccacgtggaggaggatggaggataccggcgttgatccactgtgctccagcttgctgatagatcaatcgatgaagcccgccggtaagaggagcaacgacgggggcagcggtggaatggcattgctcgatggcgatgtcacttgctttgatgtcaagtccttcgccacctccctcgcgctactcaccctcgtcatggagctctgacagctccacccctaccaactccttatcctcctctccgccgccagctcaacctcctcctcctccattcccccctccaccccgcttacccaccatcattgcttccgtttcttccctctccaccgccgccatgcccgctgctaactattttggtcaagccaattgcggaaaaatggtaaaatcatgtgaaaatggcgagtatggcaaagtagcggtttggcatcggttgggagtggctttttaacgaatccaatctacggagtggcatttgagcgaaaccatcttttggtagtggcagaatgtataatttctcgttccaaagtggtggcgtgtctgtgctttgcctgcacaactttgtgttacattcttttctgtgaactttttatgtaacgagagaatccacttcatggattgttctagttcaaagatttttcattgatattgtcaatttctataatataccaacgagtttatcatttattctataatacagtgttaggctgcttttttttccagaaataccaaaaggttaccaatttatttaccccattattttaaaaaaaatatgaaattttttatgtaaccttcttgcacaatatggtttttttatctaagtttcaagtttttatattttaaagcaaaatatttttctatggtatatgagagtgaattgcttacccaaaagataaataacacaaaaatattgtgtgacatataaaagataatttacattaaaaacaagaacaaaaaaatattttatgtagcatataatgaataaattatttttttagttgcaattgaaaattctaaaacttatacacaaactttcacattttgttaagaggctaaataaactcgccggtatattatagaaaagagcaatacaaatatcacatcattaaattgggataaattatatttatcaggtgctcagtttcctttattctgcaccatgctaaagatttgttcaaatttcatccgtgttcagaattcaaaaacttttcatggtagcaaaaacacttgagaacatcagattgtcaccagttttcaagtccttataaagaacagtctcatcgtcttccagccggtgcatgttttctgaggagtgaagtgcacggatggtccctaaacttgtatgggtgtgtcaactaggtccctgaactattaaaatgaatttttgggtccctcaacttgtctcgggtgttatataggttcaacgggctccaatacactccgtgagatgacgtgcatgcc

SEQ ID NO: 81891 - DNA, 716 bp, Oryza sativa
ttcatctcatctctctatattgtttatatcgggttattatccattaccaaagagagaaaagattgaaagatcttggattaaacaatttgtgtaattgttgctttggtgatagatgataaaccaatgtttatgggattaacctctcttttacataagttgtcaactaggttatttcctgataatgaaatgtggtagatatgtattcttttgtgatggaccttaatcatgataaggatgaaatgcatggagatagagcgatatgtatcacttcttatctcctactttttgataggttcatatatatcatttccatgttattgttatataagtgtgagactaatgtttacttgagtcttatcttatttagtctcctttacattgagacatggacatcatgaaggtatgtttttttgtttactttatcattgctacatgccttcttcatgtgtataggatagaccccattggttcttctttaattatacatacacttgtctctcttgtatagttatttgtatgcatatatttagggcgagcaaatcctatacatttattgcacatgttctagatccatgttcacctattatttatattgaatctttgcacttgagcttatgcacgagtatatgacacttgtggtgttaatgaatactcaacgaacatattcatatatttcatatgcaacccgggtggtcatcaagtggaggatgacaacc

SEQ ID NO: 81892 - DNA, 1500 bp, Oryza sativa
  unsure (1)..(1500): unsure at all n locations
gaaagctttttatatgaaagttgctctaaaatatcagattaatccatttttcaagtttgtaataattaaaactcaattaatcacacgttattaccacctcgttggtgtgaaacacttaatctttatctcatcttcaggagattcaaacaccaccatattacctaaaaatcatgtacatggtgatcaaagatgctcttcattacacatcaaacacgcagctaaataggggcgaatctttattatttatagcgagcgtgagtggttacggtatgcaattcctttcatcagcacagtgtgagcatcacgcgtccccgtcccgtcggcgcaccagcacagccacaggttggcccagagagggtgcttcaactgtcggcgcttgcacatctggaccgtccatcgcggcgatcggacggccacccgtcccgcaaccccgccccgcgtcgcctatacaagacgtcccacccccccccccccgtacgctcctcccccatttcgaacggatccgggcgcagggtgcgagtgcgtgaggcccaatccccaaatcccccccccccctcgccgccgccgccgcccgtctgcacgcaggcctcctcgtcggtgaggtccccccgctgatccgtctccctcccccccttcctgttgatccctgcgctgtggagtggcccggatcctcctgcgagatcccgtcgcccccactttctttgtttttttattttttacttnnttctcgggtgttcggcgcgggcaatgctggatcggtggcggatttcgctcgccgtaggtagcgcacggcgtgatccgttcgtctgtagggtcgtttccgcccaccgtgcttttgggcggttgtttgtgctgcgtctgtgcgttcctggtaggtaggaattgcgtggagagcattagcgaggagtggaatgtatgttcgagattcggctgcggaagctaactttgtgggacgatttctgatgggtccttgtatggtctgtggctgtgtgatgtgtagaattgtggattttgttttaggcctttggaagaggatgccacgatctgttttgtttagtttttcggtccgattggactggatttcctgaatcattctgtgctgatctcatccctttgatgaaacatagtgatgtacgtcagtatttgcaacggtgtggtcgttcagatgagcctgatcttgcagttagatttgaatatctagtaagcgtgacatgaacgtcttaataaacgtcacatgagcgtcacctactgttttctagcggcatagacgcctagtggagacggaagatctttctttattggttatcttgttgttttgcacaaattacttggtagtgatgttgctgtctgtgtacttatagacaatagaaagttgctttcaaatgtaatacttcacaatgttgagcagtaaacgcaccagagcgtaaaggttcttgtgttgtttatacttcatgaatagcaaactaccatctaggtgcttatagccaccttttatgcttg

SEQ ID NO: 81893 - DNA, 665 bp, Oryza sativa
tctttatagacttctctcagcctacccatataatagttagctttttataattaatacgtagcccacttgtctgtctcacggagtttttttggttcttgtgtccaagccggctgtaagtttacagcccgcttctcctctctctcctctcttctctcctccacctcagcatttagctggcttataaccttctattatacttgctctaagggacctaagatgaacttattcctttatttgattcgtcgattttactttagctggagcaggatggcttgatgtgggccagacgaaactggcataggaatggtcgacaggccgagaacccagctcagtattcgcatcgccatccttcggaggattcttcggcggagttattttagtactcccaacacgggtgcggcctaccatggacgacctcgccgtcgtcagcttcgccgggggcctggagcccagccagaagccgccgacctccatgagtttcagttgccctgttcgtccatatacaggtcttgctcgcttgaatcctaccacgcttttctttctctctttggcttcagtttcagttggtgcgctactgaaatgctctggcgaaatgcgtattgagatgaatgcaaacgttccatggattaaggtggaaaaactgccaagaaatccaactgggttca

SEQ ID NO: 81894 - DNA, 3101 bp, Oryza sativa
tcgctttcttttttctgctcggcggtttattcttgcatggattgctcattgcaaacgtgcatctactcctctgcttctaattgtgtttgccctgcgtgtagatgtagtccagatgagccacgagcaaacgctccactaggcaatcatcttcttcgcaaccttccactctaccatcgtagtttcccctctccacaacctgtgccacgatacccacaacatgatggtaaaaaatcggttaaagatacgttcaattaatcaaattacactacttcgtacatgcaaatttatcaaaggaaaacatgtcgtgatgcaacatgatatcaaatgtacaactgaaactaaatttaaaagaaagaaaaacagtttttttccttcaccttactggaagctttgctgggttcaattggcccaattctaccaccatggcttatgctgatgggaaggagaagtgctacaaggcaaatggctatgaccttcggtgacatggcgtgttatgtttgtgtaggactagtatcgaataggtcatggaacctgcatacacaatggtgtcattcagacgctttatataggactcaaagcaggggagaaacggtgtcaatcgtatcaattcttttacaaggatttttgtttcaaaccgatttgagaaaaggaatatactgtagacaagtatgggtatagttatgctgctgcggtggcaagtaagagtacagttgataggtttcctgaaaaaaaaaattgccacaaagaaaacatacaggagtatattcgttagttatggacgtgcgcattcagacaattgacaagtgacgatgcttctcgtcgtttattataccggttcatccacgaagaaaaagaaaattaatatatgctcttagctatttacaaattaatattgaagaataaactacgataaaaaatcttaaaattatcttgaaaataagttccaaactattttttttcggctgataagtcaataagcaaatgataaaactgtgtatatggactccacttgtctataaatataagtattccaggcatttagaacttgttcacaaatggattcgtgcgttgcatcaatcatcttagattcatttttttaatttactctatttgtttcaaaataaattaactattggatattttcatatttgtaaccataaattgctttccaatcttactcatttgttgcttcatcaatgggaagtatctaaaaaaactgtcgcattttctttaggaaacactttcaaatataaatatattataactatattgtaactacgatataacttacgtaaaacttgtattttcaactatggtttgtttggctagtgccgggatcttacgcatgacatgtaaaattttctttatagcaattttttctcttcatgcagaaatctcaagatgatcgagaacgaccacaaatctataagttttggaggaaaaaactagcgaaggttttctagcgattccggtgtcaatataattgcagtcctcgatcgttacctagatagtcttgtgcatgtgagtatccgatcaagatcattcataatgttctcaaaaagaagagagagaaacctttcggaaacgaaactgaagtgtctctttcattttaagttttgcaatccttcattaagtagcactaagatactaatcacttactcacttatcactttcattttaagttttacaatccttcgttaagtttgcaatcttattaattaccaccttatttttaaagtgtacaacgttattaatttttctcataaggtttaatattcttcttattaaaagatttagtataaatatataaaattataaattaagattatattttatttgataataaaacaagtcgtaacaaaataaataatattatactacttttaaataaaacaaatagtcaaacgttacatgaagagttaacgatgtagtagcttaatttaccagtcctatttagagcaggtactcagattataagctagctagctataaatatattttatagaaataaaagagaagagagaagagcaacagtctatctgtagccagctgcagtacggactttaatacgtaatgtatatatgacatgtggaactaggtattaataatacagtaagcaattattatatgaattaagagtattaaattagctataaatattttagagctagtggttggttataatataatattaaacttgctctaagctggggccggtcactatctgtgtccatgcgcagacgaggatcgcgtcgctttccccgcgatgattacccccggcccgatcgagaagaagacacagatgatcgagtgggtgaccaaggacgacggcaagtcgatccaacagatgagtaggtcgttctttaattgactcccattgcctacaacctggggaaaccaaactctggttttcccaggttaaaagccccaaacgagagcggctagccacagtaacacgataacgtacataacaattccagctgcgcgcggtgtatggcggcgccggcccgactccgccggtgcacagcccccaccaccagcctaatttgttccaacgcgcgcgcgcgcgacagagagatcagcgaagctgagcatgcagtgccctagtggccgcgtcgtacgtacgcatctctaccttaaaacatacgtgtctttatcactaccacgtgagctcgataaatactcatacatccacccgtcaatgataaatgtatggtgcttttaaagataaaggatctgaatcagagtgtgtttagttcacatcaaaattagaagtttagttgaaatcagaacgatgtgatgaaaaggttaaaattttacgtgtgtatgaaagttatgatgtaatggaaaagttgaaagtttgttgaaaaaatttgcaactaaatacagtctcagtcgtacgtcgagccgcccgcaggagccaaaccacctaaaaatcccacagccatcaacgtactcgatcgatacagatatagatggatggatggatggatcgaccgcgcgcgcgggcaacgacggcactgatcgatcaccttaatttggttgcaggttgcgacgtcgacacgggtgcgcgtcgcggggccgggggggggggggggggg

SEQ ID NO: 81895 - DNA, 25939 bp, Oryza sativa
gggtatctgcggccgcggcgccgggatcgttgatcgtgcgtgccgggacatcgcggctttggtgggccggcctggccatgttggctttaacttccgaagctgtggatcgttcggacgtatcaggcccattacgccatcacctgtatgtattcctgtactcatgtagttcgttgggagaggatcatagaaaggaaaagtccctcagattttcgtgtgcacccttcctattctgctaaataatatgtttttaatatattttctatagataaattattgttttgagaaaaatcatattaattcaattcttaagtttaaaacatttacaattcaattaattatatcctaatggttaatcctgtttttgcatatcttttttccactctttttttaatccattgctttccatctacactacaacaacccagctttccacacatcgccggcagcatcaacaacagcccttctcttctactccctcggtaaaaaaaaaaagacaaaccctgagtttccgtgtctaatgtttgactatccatcttatataaattatttttataattactccctctattcctaaatataaggcacaaccacccttaacccaaagaccaagaaatagttattatcatcttgtaattgaatcatcctaataaatgtaatgcatgcatccaatagagttagagaatgtgaggatgaaggatttaaaagaataggagtgaatttcagaaaaccccatgttttgaggctaatataacacataaccacaggttttgtttattttctcacataaccccgtgcattcaatccaattaacataataccacaggtttaagtaaaagaaagtgccacaagggcaagtgatatggcaaacctgctccacatcagctggccccacctaccaggtcaatacatggcctattagggtgggatcacgcgggagaacagaagcgcgtgttccctgtttctacgcacacgacacggcgcctcccgtctttcttgcgcacgctggcggtggcgacgttccccaaccatctcttgcatgatggcctccggtgatgatggtgatgttgacctagctggaggaagagaactcgttgggtaccattcctagcaggtaacattcatcccttttcttgtgatgatcatatgaattgactccaaagcatgctggttggtgatttgcaaggacactctgcttcatggttctttgacgaggaattaaatccagccattttgatcatgtttggcttgtcaagaaattaggcctagtaaaatgtaatttaggggaaccattattgttagggcattacaactatgcaatcgttcttctgtttgtcattgcaaaattgcttttcatcatttgaccataattttttaaataaaaaaagcatgtagattggaccgtgtataagactattgtattacaactattatattgcagtcagatataaaactaaccacaattaacatttaaaggcctgcaacatttttttctgcttcacaaaagagcagacatggcttcctctttttttttctcggtaaataggttgtatttttctctgcttcacaatgtatatatttcagatatggattcgttttgcaaatttcctatgccctggacctgcaatgggtcacatattaactgttgctatggtgcttttattcagacatgggatgtttttataacgtttgctccattgttctgcttaatgcatagaaattgtcagttttttcctttcatttttttttcataggaacacagtgtcaggcaccttggtgatcgacctacttacaaaaaattcgagcagaaacattgtcaggtcctgccgtcctggccacgtttaatcaaatacacacacaagctttgtattagaagataggaagtatatgtacagtttgatcagttgatgcaaaacagaacaggcgatgcttgcctttgcatgtgcacgacgagctgcccctctgaacttgtaggaggaggaaaactgccgcagcgagcacgaggaagacgaggggtgcgtcatcgcgtgcgcgggaacagaggatgggtgcttccccgcgctaaatagcccacgcattgatctggcaggtggggccagctgatgtggagcaggtctgccatgtcacttgccattgtgacactttcccacacttaaacctgtggtattgtgttaattggatagagtgcattgggttatgtgagaaaataaatagaacctgtggttatgtgttacattggctccaaaacaatggggttttctaaaattcactcaaagaatagtaatttaatgaagaatacatgcatgtcttatattatgtaccataaaaaagtggttgtgttttatattatgaaatagaggtagtagtatttttattattgttagatgataaaacatgattaatactttatgcgtgacttatctttttaattttttttcatattttttttaaataagacggacggtcaaaacgttagtcacggaaacccaatgtttgtttttttggacggagggagtacttgccctgcccgtacggtgtatacgtgctgtcgtcgatcttgccttacgagactgacaccggcccactcaaaagggataccataccaaccctgtaagactcttaacatttttttttggcaacattgctcatagggttagtacacagtacttgctgatccattgattgacagccgtttcattgggttgatattcaagggcgagaggacagtacattagaagtactagtaatcaacaaaaaaaaaagcattaatttcttcatgtacgtgggcgtgcttacttttacatatgtaccacgcatgcaccttaaattctcttaatttagagctcatcaacagtttgtatgtacacaactacggctgtctgccagctagcttttctacgtatacccttggcaaaataccctaatttacggttatgttaattaattgtgatgaaatatatatcctcctaagtcctaataacagtctattgccacatactaagttctggaggggtaaaacatttcacacacaattcagagaataattttggtacagctccacctttaatggttcttgtctagctctaacttcaattgttgcgatgatcggatggacgttgtttgcgtcgtggatgtaaatttcttctttgtctagaagacattgtcatatgtttcttggtcattggttgtacatacagttgtttattcataggaagtcagagctgctcttttgagctcgacaacaataatttatgtgttggaattaatacgtggctaaaacttatatggagattaattctttgaaaaatcataaaagcccatctcataataaggtatacatataaatctttagtaccacctcacttattataggagagggatgcctcctaaaaaaaggagattgctcttctagttacttgagccatgtgagatgaagaggactagagaaacgcacgtgctcccagacgaggcggcgtgagcatgaatggtcacaaaaacggtatttatttttggaaaccagttttaggaaacacaccgaactgcgtggaacgacatcgagtttggataagttacacacaacttatccagttcggttatacggtgaaatttggtgtttgttatcggaaacataattgtaggaaacacgctgaataatccgttgcgtggagcggcgtcgagtccggataagttacgcgcaacttacccggttgggtttatagtgtaaagatcgtgtaggtgtcctgatcacacgtcttgatatctctctctatataaaccgagccaccacctcctcacaacatacgccaaaacaacctagggtttgtctcctcctctatactacattattgctcgtaatctactacatcccgctcgccggcattcactgatgatcgggagagcaggtctccgaaaccttcgccttcggtttcatgcaccgggagaaggcgacgataagagttttgggaaacgattcgtgcgactggtcgctgttctttcacaataatttgtcttcctctacgcttgacgtaagattaagtgagaaagctattatgttcacattttagacaaggtagtgtcttaaatcactttattttagtctacaaatgtcatatttggcacagctcaggatctgacattttctggagctgggtgttcctagcttcacaaatccatggattggatttaggattacattgataatatatggatgaaccattttgttcgtattttataaaatttcaaactgtactataacttaatatacaaactttaaatttagtgtatctaggatttagagctgtaccataccaaaccagaccaaatttagtacacactccatatcatgtaagaatattaaaaaaatatatagctctaacaaaaatctgaaaattagctagagctctaccaaaacccggagttttcagctgctggcagcccacagacgacaaaagcacaaaatgccatgatacagcgcacctttccctttgggcaccatcatatcagtccagcgcaagtttaacatccgtgacataatttatgtgtacctaatgtggcccccatgccatcaccctacccacaaaaagagacaacaaataactctagtttgctttgctagccactcccttgttttatgaccaaacttaaactttttattagtggccatcaaattgaatataacggcttcccttttagactagaagaggacgacgcagagagaaaactgaaagtttttttttcactaatgtcttgattaatctcaccctcagtgacgatgcgacactagtttcatatctagattgaaattcactaagggcccctttgaatcacagaaatgaaaaaacggaggaaaaaaacataggattttgatagaaatacaagtgtaaaacaggtgattggaaaaaacaggaaaaacataggaatgactgttcgattgggccgcaggaaaaacacggaaatttaaggagagataaaagactcaaagtattctttccatgaggttctacctcatgttaaatttactctaaaacttacatggggaaggacaatccataggaatttcataggattccataggatctatttctttgattcaaaaggctatatagaaaaaaatcctatagaaatgaaatactctaaaatttctatgaatttcctttgaatcaaaggaaccctaaagttttatatcaagtacaaattgggaaattaccggttggtaggctagctaactttaacttaactagtggcgccaattaaggatgtgttcggacccaagggttcccaacacctctccatggttttccgcgtgcacgcttttcaaactgctaaacagtgtgttttttgtaaaaagtttctatacaaaaattgcttaaaaaaatcatattgattcatttttaaaaaaaaaattagctaatttctaattaatcacgtgttaatggactgctccgttttccgtgcgaagaagatttgttcccaacctcccccagcaaacacagcctgaagaagctttcgtgcagcgcggcgcgcgcgcgcttgcttctcctttttctttaagattgcagctaaagcaaagagctaaaaggtggcgaaacgggaggcctttctcgccgcgctgcgccccctcttcttcgtgccatcgccattgccgcgcaacatctgagctcgggtagccattgctagcccatgcagggcctcgcgtccccgcggtgcgctcccttctgcggccgctccggcgccggcgcgggcggggcgccacgcgcgcggcggcagcagggaggtggctgcgggcggccgctggaccgcgtggccgggtgggtcggcggcggcatcgccgcggcgttcttcgcctccctcgagcggtgctcctgcgtgaacgtccgcacgcacgacgagctcgacgacgagacgagggactccgaggcgctgctcatcatgttcgacgtcgtcgacggcagcgaagacgctgcctccgccgccgccggcgccggcgggaggaggggcaggaggagcgagaagagcaagcgaggtggcggcggctgtggcgggcagctatggtgaataattaattagcagctatatataatttttgctatgtatgatcgagatcttgatgatgatcgatggatgcttgttaagtttgtgcaagattatttacgtttatatatatatgtctagctttcatcttgtgaaagatacatattttcttggatgtatggatcgatgataaattgtattcaaggtggttttttgaagttcaatggcaatggaacactgattctcccttccttttcattgtgttctcaagatgtattttccatcctcaaatgatacactgttctattctcaagaaaagttttaagttatatgtaaagatcaattatatggcataatatgtttttatatggttagattgttaaaaaattttagggcaatcatcctatattttgttagttcattcctctctttttttaatgtgcacactaaagcagtggtggttctcactgcaacaaaaagcatctctacggattttttttttcaattgaacatgattgaaaaaccattttcttatggggtaacccattttcttataatccacctaggcgttcaacccaaatgcttcctggctctacgttctaacataatgtcgtgtgtgctccgattttctttttgtaatcatcaggagtttcgttctcattgatcgcatataagagaaggaagaaagtgttccattttctttaagaaaaacatgtgctatttcatgtttttaataataggctcagagcctcagattacaatcggtggaaaaatatattacaatgtcgaacaaaatatgctcaattgccggaagcacattgctcaaccaaacagccaagcttaacacttcctctagcaaacttatttaagtcatgaaagacatgagttattcaggctaaattggagcaaaattaacatcccaacaaagcccataactttatcgcaacgtaccaagttgttctgttcgccagcattcggtttggcccatcaatgtaaacccactgccttattttgaagcccagctttgctttctcagctatactacccatttaacaaccatcattgatcattcccatcatcatctccattttagttgtgcaactcaactgacagagatttcaacaaagcatgaatgcatcacacatgcacatacacgcgagtgcgtccctttagcacacatctctgtatataacattcacattgtttgcttatcatttgagtcttactaataaacaaattaaggaagaacaagaaaccaaataactaataacagacaaagtaagcaaaagtatgaaaggcaatctaaccaaagctgctgtgcccaaaaggccccaagacactatatcggcatgctcttttacttggacacctgtcccaataatctcccaagatcaaagctgcatatgcatcccccatgtctgcctgacaaacacaaccaaaaacctctcacatgcaggcctctggaaagctcaaaatactatcaaattcccaaagcacaatcagggagcagctagccaacagcctttatcccacaatctcgatgcatcccatgtgtttggctacattgcgtgcaacttttgcttcaaaataaactaagtacttcatccgtcccaaaataagtgtagccatggttttccacacccaactttgatcgttcgtcttatttgaaatttttttaaaaaaaattaaaaatataagtcacgagtaaattactattcatgtttatcatctcataacaacaaaaatactaattatataaaaaaataaataagacaaacaattaaagttgggcacggaaactcatggccgcacttattttgggaggaagatagtaaaggttatggagaccagtaccctcccatcaatcatcatgcatgcaactaactctctgcatatagacaggcagctctggcatataggcttggaatgatgccatctgtccttttgcaagtttgcagtctttcttttgcatatatggcctgtccgttgcagcttaaacatctccttttgtagttttgctagctaagaacaagcttttttagttagttaaataggtggctagtgacacttatatcaacattcatctcacagatgaatagatgtcgttatgtaatacgtgcagttaaacctcgaaaccttaaataattaatttataaaatatattaggagttgatacgagaaaagtgtcaataggtgcagtcaaacctcgaaaccttgtatgattagttaataaaaaaatattaggatttgatatgagaaaatgtcatttgtagatttgtcatgaaaaacacatttatattgtttacttttaatggtttttaataaatactacataagagtaaactatgctcacattacatgaactttcgtggtaggtgtaaataggtaaaaaaattacaaaatgattagtctatgagaatagggacgaaatgatccacgcaaacaaaattgttgcaacgttgcaaactgatggcacgacagcttacatgtatgaccatgttttagagatcttatttgaaatctaaagaaaaatagaaatatgtgaaagttcatttttcatgtacataacagaatttatttcatgtcttggaaaaaatttattcactatataactcatataaggttaacctatatgttaaggaccagggtaatttctgccatgcctttgtacaagtaactgctgaaaattacattttaattttcatgctcagaaactcatttcaccaaaaaaatgtttttttaaaagcttactttcatggttgggcatttttaattgtttcgctttttgtcgatctaattcttaaaaatatcaagcgaataatagttacacattttgtccatataaaatttgatgtgcaataataattactcatcaatatgcaccacattagatcatattttgcttgcagagattgtattgacccaggttcacacaggctaggcatgttgtaaattgttgtatctatttatacccaccatacaagctgatgtaccgtgaatgtaatttactaaatatgtaatttagtgataagatatacgtattgggaacaacgtgtcaatataaaaaacgacaaataaaatagaacagaggcagtccgtgtgtagtgtggtgatcatgggcaacggcaacggaagggaggtttttaatttaaggttcctttaattcaaaacagcaatttctttcggttcctaccgaaaatgaactgttttatgcgcaaaaatcatgcattctaaggtagcgtactcctgcatgcatcttgggcatcttttttggctcaattgatctctcatgcagcccacttggtgcaaatgttggagagaagtgggcgtccatttaggagaatgctttgggcgaaaggaggtggatagctttagagagagtgagacacttgccatttggattggttataaaaatttccctagtgcagttaatgttacaaaatatatatagccctgtttggttgtacatcggatgtttggacgttaatttagaatattaaacatagattaattacaaaacccattccataacctttgactaattcgcgagacaaatctattgagcctaattaattcatgattagcctatgtgatgctatagtaaatatttactaattatagattaattaagcttaaaaaattcgtctcgcggattagccctcatgattatcatagtagcagcctatttcttccttgcgccctgaccctaatgattggtgacattgcagcaactagagctagattctgtgtgcattaagttgttatatttatggggtttcctgcaagggatcgactaatggaacatgttgtccactgtccagtggtttagcatatcaccttcacaaaagtattatttttcgcaaagttcaatctttaatttgtatctaacatatcttttgatagataaagacatagaagaatatcgtatggttctatcaattatagtactcgaaaataaaagtagaaaattgacctccaaattcgttttcaaggcgtacaggttattcctaccatgttaatcaaagaacaaaggagaagggaaaaaaatctaacccgttgagtgtggtgtccggatgacaataatgtatatttatctgagatggcatattaggtgcatgtcaaaagaaaattgccaattgaattagaaatcttaggtgcaaatgattttcaaaatagagtatcaaatttggtgcatgctacagttattgagaagtacccctccatttgttgataattgacaattttaacttttccaattaaactttaaccattaattattcttaaaattggcatatcaaagtgaacaaatgttctatggacatacagcactctaataacattgtatcatttctagtatttatattttttgaaaaagaaaaagacgagcaattaaagttcaaaaatgaatatatgttgtttaaagttgaaagagaagaaagtcaagaaaccttttctctcttttcttaataaactggccagtccaggagagattggccggagaaaagaagtgcaaacagagtgagcatggtagtgtgcgtgagctatgcacaagtttggggtgattttgatggaagacgacccgaagggcaaaatcttcaaccttaatcacgaaggaaacgtacggcccagatatttaattatctcacagcagtccaccccatgatgatttgaagttactctgtctgatggccctgtatcttgtcagtaattcggtatgccggaaactgggggcaatgtcaaagtcttttgggcctattggttaattaactggcagcttaaactggacaactgttttattggctcaaattttgcctaccacttttgttcctatattatggacttgccaacatttttgggtttgttaaatttggtctaaaagcaaacaaaaccatactttggcttgtcaaatgaagacatggaacagaacaaaccagacacgcgcattggcatactgtttaataaggaatactcataatacttgcgaatcattttattaagattttgcgcattgaaatattacatccgattcataacaattgacacgtggcaatattccctatattccaaattacaaaacgtaaacaattcaactctaataatatttagctaacaattaatttggtataaattaaattttatttgatgaaaattatattattgtattcatatttggatgtgcttccttatggttatcttttgctactaataaacattgtagtaatacgagaaattaaaaatcaaatattagttttagagaactccgtcaagtatggaccgtgcagtatattctaggacgaggaatcaatagcaaatgcaaagctaacttaaccacaaattcactcacaagaattttgggatattttattttaacatgaggattatggaatatggaccccaaaaagtaagaaataccaataatacccctcctaaaccatctataaataccccagcccttcacttcttccctcccttttccctcactcccgtctctcccactctaatacgttcctaattaccattatgcccgtcatgcacctcctggccccaccagcgcaagccttcgtcgtcgggcccccgcgcgtcgcgcccgcgttcgacggggcccccgcgccaccgcgtgaggacgacccagccgccgaccagccgccggagagggaggccgacgccgacgagcggcgcctccgccggaagatctccaaccgggagtccgcgcgccggtcccgcgcgcgcaagcagcggcacctcgacgagctccgcgcgcgcgccgagcggctccggcgctgcaaccgcgagctcgcggcgcgcggccacgccgcccgcggccgcgcgggcctcgtccgcctcgccaacgcgtggctccgcgccgaggccgccgccctcacccgccggctcgcggcggcgcgccgcgcgatcgcgctcggccagctgtaccgccctgccgcggcggcggcggcggcgtcgggacgttcgagcagacgatcgcctcgctaatcgcgtagcgcgccgccatgcacgcacgcatgcacgttcttgatttgattggctgcaggttaattaatggaaaggcaaatggatttaaatatatcctgaaatccaagcatagcctctggatataaatcgtcaagtaaaagaatgagaaagaattaatggcatgactaatttgtgagcctaaatcggtcagaatgtttaattactggccacctgtatttcctgagatcgttggatatttctatgcttaggttctcagattattagcactgatgtcaactggcgagacacatcagaactgatttcatttttgaccttcttcggaattgatgattttgtcgggaattgaactgattttcatggaagtctcttttaagttttttgcattccaatttccaaacgatatctgatagtcttaagagagcctacgtgtgaagagagtactccacctgcagaaagacgttttggacaaagatctttcataatctcataaagattactatttggcctcgtttagttcccaaaaagtttttcccaaaaacatcacatcgaatctttgaacacatacatggaatattaaatgtagattaaaagaaaaactaattggacaattagggaggaaatcacgatacgaatcttttgagcctaattagtccatgattagctataattgctacagcaacccacatatgctaatggcggattaattaggctcaaaagattcatctcgtggtttccaggcgagttatgaaattagttttttcattcgtgtccgaaaaccccttccgacatccggtcaaacgtcctatgtgacacctaaaaatttttatttcttaaactaaacatgccctttgtttgtaaatttattttgtacaaaattatgaccaaatttgcactgacaaaaaaacagttcaaatgtcaccttttttaatcgtagggagtaacgtacaaaatcaatatagaagctctcgacacagtccattccaacaatatgattccaatataatcatcctctaaaagttacatcgtcggctacaaacatagccaacacatacacctacaataaatggtgaccttgtttttttaaaaaaaaacaaaaaaaatcaatgtcaccccaacaaaaccaaattgacaaaatttaaattaagtcccgtgcacaattagaataagatcattaagccagttgctcgacaagttaattaggcgcatttgtcaaagaaggtagattaagctggcccacctatatagatctcctcattagattattcttttcgatgaaatggttaatacattatacatacaactgaataatatttcctcttccttgttagatgaggagcactagaacatatctttctcattacatcgtttttgttaccgaatctataccactacatatcaatccagcttccaattggcttctatcactatcttcctgcccttcttctatatatccctcccaaccacggctttggaggcatcacttctgctttaccacttatctgtcaaccttccatcgccccaagttcggtatatatggaagtttccactctaaatccttaatctggcaggacaccccatcactatcagttgttagtttttaccacttaggttctctttggaggtaggaatgctaaaagcatataaataggaaaaaaataggatttttatatacatgcttatctagaatagaggaacgtaaaattcaagataaatgtatactctctccgttctttaatatatatatatatatgatatgttgacttttaaagatatatttgaccattcatcttataaaaaaaatacataattattattcattttattgagacttgatttatcattaaatgttctttaagcatgacttattttttttatatttgcaaaagaaattgaataaaacgaatggtcaaatgtttataaaaaaatcaacgacgtgatatattaaaaaacggaggtagagtagtacataaacaatcatttagatagaccacatggaaaaacataggggttagatggcaaagatggacccaaatgaaattttttgagagtttgaaccttatgctaactatcctggaaagatctccattcgttgagcatttcatagctagaattttaatggtatccaattctttgtctcaaagtgtcatttagacacaaatattagggaatgacctaataacaaataattagaatgtgtgaggctttaaacccaggtcgtctagcccaccaccttgtggagctagccggaaaatccctaggcgtttctcaaagtgccattcaggacaacaatgtcctatacagggacccaaatcctaaaaaaaaacctccatttgtcatttggatcatttgttcccaagggcgcaagtaaatagttaaaaatgtagcaatgctatagtcacaaacgtttcaaatcttaccatgagcaaatgaattgatggtacaactgatacagtgatactaaaaccccaagaccgtaagaaaacttattacgccataattaatgtgcaaacactttggatggacaacggccggtggatggatcttgatcagacaactgaacgttctctcgtacgcgtgtggtggccaactggccattagttcatgctagatttgattggtcaaccgatcgatctggtgcatgcatatatgatgatctgatcgaagtggacgtcgttgtttaattcctgtgattaaaagcgaggacaggatgctttccagattaattttgccagcagagcttaatgcgtcttaaagctgtgcctgctttgggcgttaatatcgttttcgggtgcgattaggaacttattctgtgggtgggctgttgctatcgccacgtcgaaagctttgctgcctcaaatcgtgttttaggactcggtactattgacgcctttcagataatccgaaagaaagaaatatgtcctctggccgagaaaatatatacaggtctgtttagattaatttgctgtggcaaattattttggcaaaaattttggtggaaaaagatttggcattgaagttttgctagttggtgtgtaaatacatggtagagttttgccgacttttgctactagtgtttagatccattttgacaaaaggtgctctaaaacagcaaaacttttactattttagaataactaaacaggggggcatagtgaaaatcacgtatgtagtaaaaattatcgtaagatataatagacgtatgtgatttatctacattactataagttctactgtggtaaaatttttacccatattaacgtgagccaattcttatcattcattttttttcatcttacaataatttccactacatattttctccctagaccttattggtttgcgatgctaacatgcatggcccacctagtcacccgctgtctcgatgggtttggcccaattaaaacaagcccatttggtatccatttcacctccttttctcccgaagatttttctttccattttgttctagcgaagaaaaaaatactaaaaatagattaatccatatccaaatgtataataatatatttggattcatagtattagattgcgtaaaatataatactagattgctactccggttgtcccggaaaaaaactcctagctagcatcccaagacaacaacaagagtagaaaagatcgaaacgttccttattagtagaaatttagaattggtggatgagggatatggacagtggtggtgccaagatttatggaagactagagctggatagagcggtaccatgtgatcgtgggttcattccccacggacggtgccagctgttgtcgattagacaatatatagcgtctgccgaaagacaatattcactcaaatatttggaaaatatgaatggtaaatgtattgatttcttaataattggatcccctattacacatccattggggtctatttatagttttatagtccaggtttataatcctaaggttgttggttactcgggaattgacttggcttctcttatgatagggacgtttataggggtaataattgtcttttgtcccagtttacaggcccatgggccctaaaggcccctcactaggccgtttattaggttcgcagggcgaaagcctctacgaagagctcatcctccttcgtcgtatggtgttcctttgtcccatgcttggcgaaggtcttttgctctgttattccatgggcgctaagccactagtcgcttgccttcattacttatgcgggcttcgcccttcaacgtctggcttcgtgacttgacaggtgtttcggtagtctgatcaaaggtactcacaacatgcctccaacagttggttgaagacattcatgacatgtccctgacagttagttttctataagatttatatggtgatttaataaaatatagtcgagattttagaggcatgaagctatcctaggtctacctctgaccctgggtatatggaagggatatattttctcgatttataaaggtatgtactctctccatttaaaaaacagttatggatttgaatctgaaaaatgtgtaaaaggatagaaatcggtctattttaagatgaaatttaaactgtacgagttttttttttttaggaagcgtaagcagttaagctgatgtggatgcagagttgcagacagtcacaagcaggcggaggttggtttcttggtttcagtggagagattgacaggtggtaggagtagaaaggataggtgtggtgtaggagtacgggcggaaggcggcgaggacagcaggaacgaggccggccaaattcccccaggggggggggaccgtggtttggactttttaaagtacctatcataactatctatcatatcggatgtttagatgctactctcttcatccataaaagttaaacatattttacatttgagtttttctaaataagttgatttatagttcttatgcattcaaaacttaaatagagagataaattaaatatttgattagaacgtaaggagtcatctaaatacttattgattgcatgcttgcattcacttcttgagtttgtaatatccaagatgatttaatttctccttggtcgtaatgataaaagtaatatgtgtaaattttgtggatggagtaatttggagtattaaacatagactaattataaaactcattctataactttggactaattcgtgagacgaatctattgagcctaattaatccatgattagcctatgtgatgctacagtaaacatttgctaattatgaattaattgggtttaaaaaattcgtctcgcgaattagctctcatctatgcaattagttttatcaataatctatatttaatactttaaattagtgttaaatatccgatgtgagacagactaaaatttaatccttgtgtccaaacaccacctcagtgcccgttgctgtacgccgtgagccatcagatcaccgccccaaaactatgagcgcctttgcgcctttcgcccgggccggcgtacgcacgccgacgcagcttttgcacaaccacaacactgctgctgacatgttctatgctactgttctaccttgtgctaagcatgggccattagtttagctctactacttcagttactattactactgctgttagtttgttactgtactagtactactccccccatgctgtgcctgtatggtcaaagaaaggcttgctggttaccacaggtgccagcatcattcgcttcagaaatcagtgtgtgttttttcatagaaatggaatgtcagggaatcagggatacaccgttcaaagggaccaaaacacacacacacacacacgcacgcacaaacacacaacaccgctcctctgagttctatcctgctcccattgagctgtgtgtccatggctctcattggaactttcagctagcaataaatttacacaacaagaaatggaaaggccccgtcctccccaacgagaggcaaggagaggactgtcgtcttggttttggttggaggctggcacaactctcacactcacagtcacaggcttcacgaatcacgaccatgagctatacagtactggtacttgcactagggcccagtttagtttctaaaaagtttttctcaaaaacatctcatcgaatctttagacacatgcatgaaacattaaatataaataaaaacaaaaactaattgcacagttaggtcgtggccccctgtatctgtctctcaaaacacacagaaaccactaggtgtgctatggtttattggtttagagcctctttgaatcgtatgattgaaaaaacagaggaatagaaaaaatatagaattctgataggaatacaagtgtaaaacagagaacacaaagaaaatacaggaatgatcgtttgattggaccgcaggaaaaacacaagaatcagataaaaagagatagattgaagggaagttttccaagaggttagagtggatgctaaattttctacgtttttcctctagaatcgtgggaataggaaagtttcctacgttttttcttttctcttcctacaaatcaaagacatgaatagtgtagggtttcaattcctttgcttttcctctatttatcctccaattcaaaggggttatgtttagtttctgaaattgggaagaagtttgggaaaagttggtagtttggaaaaaaaagttgggagtttatgtaagtaggaaagttttaaatgtgatgtaatgtgatgaaagttgggagtttgggagaagtttggtgcgaaggccttaacagggttagtaaaaatgtaaaatgcaggagcagaagccatggaggaccttgtcctgtgctgtgcaagaagctggctgtgcatagaaaattggagtagcagtagcatagcacctgtgctcccttgtgctgttcctctgaagaggggcagtgatgagagattttggggggcctccactactctatagtcaagctttgaactcaaaatattgcaaggtgcatcgtgcatggatacatatatactacagtagtatttgccagtactctctactaggcgtactacggagtactatactgtagtatccgtgaagataacatttttatgctgttccttgtaatctactcaagtagttcagtaaacaggggaaccagcgcttctaccaaatcacccttgctctgaactgtcgcgaaagcttgaaattatctgatgcatcgagtagaccattgcagcgtgtgctgtactccgatgtaatgttatccattcggagtactactatcagtgttccgtactgtgtcttaagcctaaccatgagagtgtgttttgctgcagctttatatggtcgctgccactgccactatagctgattcccctgatccgtcttcaggtgccatccaatcaaacaaagcctatatgtttagatacaaagtttgaatccaaacttcagtccttttccatcacatcaaccagattacacacacaactttccagtcacatcatcttcaatttcaaccaaaattcaaactttatactgaactaaacacagccaaagttgaaggtatgtttgaagagtttcacagctacggtttctcctagaattagagggtgttttggtgaaacacccccttaaaatcttgctaaacagtttaattttttttcaaattgagaagctatggttgtacaatctaaaacataaatcaaaatttagaagttaaagaaacccagattttatatattttcaaaagttgactaacaaccagttacttccaaaatctcccgagccccattggttgccctaataaaccaaaactgaaactaaaatttgaattttcaattctcaacatggtttcttttctagctttgatttttaagttgttaagaacacacatataaatattttacctatacattattttttattttttaataagccgtttttgttctactagagaatatatatgggcgacagatgagatcccccttctctcaaatgccagctgacctgcttcaagatttgtacagaaaccctgatcccccgaatgtgtaacatctgatgatactaagttggtttttttatagaacggaagggaaggagtaacttgttctgtttacagcgccgtcagtagccaataaaacgccagcgaccgcgacgcatcgtgccttctccgttggttttactccttcgcctcgcaccgcaccgcatgcggcgagcgcgacacaggacacactcggacgctcgctactcctctccgctccgggcggatggatggctgcgctacccaacaagtaacagccatcgtccgtccctggggaccccgaccgcagagcagacgccctcctcctccctctcctctccccacccatggtgttatgaggagaagaatactatgatcctcttcttggcttcttcttgcatcccctcctcctcacatgccaacaacaacaacccttcctcctcctccattcgccacccctcctgcttccatccatggacgccactcccgtcttcttgattgctgattagtcagctgcctgcgctgcgttctccttgtgcttgtgtgcgtgtgagagagtgttcgagcgaaggagaggaggaggggaggcaatggcggcggcgaggaggctgtcggagctgctgcaggagcagcaggagccgttcctcatcgaggccgccaagatcaggcggctgcggcgcggcggcggccgcggtggaggtggaggtggagcgtgctgccccgtggccgcgtgcaggaggctgctcaggctctgcaaccacgggttcaagaagaggcgaggctgcggcggcgtcggcggcggcggcggtgtcggcgggggcggcgtcagggggctgaggtcggcgctgagcaaggcgctgtgcggcaaggccgtgaggagggtgctccgctgggacagccttggctgcttccccggcggcgtcgaccgcgagttccgccggctgcggcggtccaccggcgacagcggcgagtgcgacccccgcgccatggacttcagcggccacagcaacgacgagcggccgccggggaggtggaaggcgcccggcattggcatggacatggacgtcgacgagtcgtcgcggcagctcagcccggtctccgtcctcgacctgcactccgacgacggcgactctcctgtgcactgccgctgtaagttctctgacctctacagtgccctctgcactctgcactactacgctttaccattttaccaacccgtcagtacttttgattaggcattcaatgtgtcttaacatttcgatttaccccccatgtttattactcttaccaccttaatcaacattttcccctctctctctccagcaacaatggttaaaattaacctttactacaaatgctacttattaacatgttaactgcacatttaatgtgtcaccattgccattaacccgatgtttatcagtactccatcttaagattcatctttcccatcttaacactccatttctattatcacaggggaggatgcaaagccctcgacctcagggagctcgccaccatccgagggcttcatcggcgccacctcaccatgcttcacctacaacatccatggcaagatcatcccaatggaggtagaagaagacgaagaagaaggcgacgaggaggaggaggagatggccagagccggcaagtccatcgagcagcagatctcctcgtgggagaggatcgcagaggacatctccaacatcccgagaatggtggagatggacttctcccagtcgatacaacaatggggcgagctcaagctcgaggcagccatggagatcggcacgaggatagagaccctaatctttgatgagatcaggagagaaaccgtctgtgacatgcttgcttcacactgtacattggcagctgcaacatcttgttgaccacagaaaagagagagagagagagagatagtagtatgtggactgaggaggaggagaggggggtgtggttaaaaaaaatggaggatctgtataatttgagagggttcatgtggaattcatttttttccctaactccaaagtcttggtcccattgttgtcccgagctccatgtttttcattctgcaaatattatatatatatctttagatgatggcaaatattagtatatggattgaaaaaggacggatttttattctttcttaaaagagcagcagttaagaggcctaacaaacactaaaaatatatcaagagatgtgtagacttttacatgcctgaaaactctctgaacaagaacactacagatgagtgcttgtcttgacaaagaaagtggggcttgtctgtccatttactctcattgtaaattcaccaggaaacacgccattattccaggtaaacagaaggagacaaatctgtggtctcaaaagtcacaggaccaaagctttgcattgcatggacatatagacatatggtcatatagtataaaagcaaagcttagcctttttcattaagtgatcagtttttgtccatttcacaaaactaacaacctaaactgcacatttggaatctgaacactgcattgaaaacaggtgtggcttccaatggagactctgtctgtagggaaagccaagtcctctgctaaaggacagggcatcatgtataggataccctttgctgctactagttgatgtcttaattagtgggggtcaaagaagcagccaatgctgctggcactgacagtaccttctttgcatctccccatggcataatatactgctaattagctcttagattaaggagactggtactaggtgcacccttgtactgctgcttaactaaaggtttaagatgcaactgaaatgattccgcatttccactagggaggagctagagaattctctcacaagattagaccaaagaaagtagtagtaggccacaacgtgtggactagtgctcacaattacgccacactggaagaaaaaaacgtgacttaaaatatgatgaagagatcgtgcgtggttgctccaggtaaggagtacaatatgaagaatacaaacttaggagagttgagtggtatcagggttttgctttcactgaagtaatctgaaatcggccgatcgagcttgtctcttgttgatcaggaggaggttggtaggacagaaacctgagagagatcgatcatagccaaaacaaatcggcagttagaggggaagggggcaatgcaagagccgctccgatcgccgtcgccgtcgccatcgccgtgcacatgcacactgcactgctcggccctgcgaaaaattcagagaaccaaacagaaaaaaaaaaagaaaaatacgtttgcatctaccaccagtctctgtcttgtgccatgaatctctcagcagctatacgggcaagcgcaatgttagttgccgacttcggcaatgctgtgggccaagggattaaacggtattaaaccatcgcacccttcacattgtttatacgcgttggagaggaataaggtgggcccagctaaataaaaaaatcaccgatagtaaaattcccgtgactgctgcgtgactccttctcgcgagttatgtcagaaacattgtttatctcttgttcatcagtagtagctgtatgaccaggttttaactctttgctactctcacaatgctttctactaggtaggaagagagcatgtattgcttattaccggctaaaaagcgacaatgtggatgccgtacgagagtaaaatgcgtgtgcgtcgcggaggtagctgagcagagtgaggagaagcggagtggagtgtgaagtggggcccaggtggcagccagcgtggcgggggccatgtgggcacaataaatggcccggcggtgaggcagattgcgcggttgcgtcgcacaaggctgctactgaagtgatgccccacccaaccgccgctagtgtccgtcctcgtcctctctctctctctctctcctgtggctgtggggcccgtccgcccatgcactatgccttgtacgtccacggtacaattatgtggtctctacactcgtccggttctccggccccttcccttcccttgtggccgctttgtcactctttctccaaactccaagtggaatccatccagtggaacaatggaagggatcgagtttaactgctttgagtggtgatagggaaatcatacttaatactatactatgttgataaacagggaggatcgatagaaagagatcattttgattagacaaattttactacagcacatctaaagtttatagtcttcgctaaaagacaccgtaaaacgtgaaacaattggtagacacccctaaaaaattactctctccgtttcaggttataagacgttttgactttggtcaaagctaaactactttaaatttgactaagtttataaacaaatatattaatatttataataccaaataagtttcattacataaataattaaatatattttcataataaatttatcttgggttgaaaatgttttttttctacagacttagtcaaacttaaagcagtttgactttgaccaaagtcaaaacgtcttataacctgaaatggaaggagtagtaatagctatgggacaccgaggctattattattttttggtccaaataaaaagagaaacatttagaaaaaaaacaattttgcctctagggccatatgcttctaacctaactgggtctgattaaaaaatagggtttggagaggggatcagggatgaagattggcctaattcttgttgaaaccaaacccagtcgtcttacaagcatttggccccatcggtacatttgtcttttccacattgtttctctcttcatttgaaccaaatataataaaataatggtttcgttgtcccaccgctattaccattttttgggtgcccgccagtcgtgtcatgtttctgtgcgatgttattttagcaaataccacaaactaaagctgcgtttggaagtaagggttgggaaccctcactccccagcacgaaaaacggagcagcgattagcaagtgattaattaagtatttgctatttttttaaaaaaatggattaatatgattttttaagcaactttcgtatagaaactttttttaaaaaaatacaccgtttaacagtttaaaaagtgtgcgcgcggaaaacaagaggaggagttgggaacatgtccttgcgaactcagccgaagtgtcagtagtaaattttgcattatcctgcattaccacgaagtgtgactatacaggcctataaaaatggtgcattcttagtagagctaaaaaaaaaagaaaattgatttcacccacgtgagttgaattgttatcaagtttctaaaggtcactctataaataatggaggagactatacttaacaacagtaaattgattccgaacaaagcgggcatccattagctgaacaccggccaaaaagagaagcagtgcacccataattgaagagtatcccgcacgccccggataataatgtcttaggaccaaaatcataattgaataacaatgtccagagaggagaaaatctcgtatgtcttcttccctgggcatttaaacataagccaacaaaaatgtgtgtgtatatgcatagatcaaaatggtccaaatctatttgtgaaggatatgtaacggccaacggggccgttgcatgcaacagcagcatgtgctccaatagtttgcaacatgtaccagcagttattaggtttaggcaccgcctgttgccttgttgtcgtcgaacggtacagcgctagtacgtccacacattttgtagtttgtcaaggcaggattaaattaaaccactaaaattgcaaaggttaatatttttaatgtgaaatgctaagttaagagccctttgattggtagggaaaatacatgacatttataatcctttcaaataagtaaggatggggacctgaacactgctggagaaaccatctttgatcggtcgaccaaatttcataatagtcctggttgtattaaaaatcgggactaaaaatatctttagtcccggttttaaagctccaggggtact

SEQ ID NO: 81896 - DNA, 1218 bp, Oryza sativa
aactccactccagactcaactcctggagttatatttaggagttggagctgtaccaaacaggccctaagactttctagcatttcccacatacatatagatgttaatgaatctaaacacatacatatgtctagattcattagcatctaaatgaatgtagacaatgctagaaagtcttacattgtgaaacggaggaagtaataaaatgtatttcaacttccttcatgcaaacaattttgcacttctcaagtcccagctatatgatgagttgtggatgatgaacttagcgcatataaaatgcataagaacgatcagtaggatttggcttaatttgttgaatgtagacatgtactggatatatttccacctatgaactatatagccactgttgcaaatacaacactaattgaaactaatactgtgaaaaacaaacaattccccccctaaaaaaacaattgtgcacagccagagttaggttttcattttccatgttggaggttgtgaagtacttcctccgcttcataatataagactttctagcattgcccacgttcacatagatgtcaatgaatctagacacatgtaagtgtatagatccattaacatctatatgaatgtaaacagtgctagaaagtcttacattatgaaacggagggagtactttgtaggctttacttgcatgggctcttttgagtttcttatttaccttttatgttcattcaagcaccacaaggaagtgtcttgcattgaatggttggattctaagatggtttctaattgcctacattctaataaccttcttaagctctccttcccaatatgttcacatcagactgaatattatcttatctacttgtctctcctgctgtctgtgtgcacacgtgcgtgctcgtacatgcgaaagaaagaaaccaaaacttactgttgccttcttgccacaggggtgtagccttcggaacacagagtacattgtgggggttgttatattcacaggtcatgagacaaaagtatgaacatttcacttttccctgtatatttaacttgaattcatgatatctgctgttttgaagtttactggatgtggaacattgttacaggttatgatgaattccatgaatgttccctccaaaagaagtacattggaaaaaaagctagataaacttatccttgctctatttgcaaccctgttcacaatgtgtgttattggtgctattgggaggt

SEQ ID NO: 81897 - DNA, 5534 bp, Oryza sativa
  unsure (1)..(5534): unsure at all n locations
tggtttatatatatatatatatatatataggtatatatataaaccatgcatatatatgtttcaatacatatatatgcatacatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtacccgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgaatcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccctgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctttgtttgcatggcgtccatgctctgtgatcctacctgccccgttgaggcgcagctgctacggtttcctgacgggctcaccattgcaggaggaatggtcggctggggatcatgggaccgatgtgcggccatgcgtttatcaaccttccttggcacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcctccactgcatctgttagtcgtcgcgcagcctcttgtatctgatagccgaagaccagtgagccatcagctgggttgagcgttccaccgtgagcatagtaccagaacttcgatcgttccggccaattggctattgccagttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacatgcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctgattcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattaggataaatgcgaagtaacatatatatatatgtatatatatatacatgtatatatatatatatattgcatttcacgttaacgttcgtcctcgttcgttcgctcgttcacgttccctagctcgttcacgttcgttcgatcgttgtcgttctcgttcacgttgtcgcggcaacgtacgttgacgtgttcgttctcgctctcgttcgttcgatcgttctcgttctcgttcgttaacggcggtgtggcggcatcggggcggcggttggcgcggcggcgtggcgacggcggcggcggcgtggcgacggcggcggcggcgtggcgttgtggggccgtggcggcggcggcgtggcgtgccgctggtggcgtggcgtggcgtggcgncgtcggcgtggcgtgacgacgacggcattgcgcgctcggcggcgaaggcgccggcggcgtggcgttggcatgcggcggcggcgttgcgcggcgtcgaaggcggcggcgtcgaaggcgacggagagagatcgagatcggagagatcgagatgcatgaagggagatgcggcggctctcaccccagagatgcggcggcagcggagtaggcggagccggcggcgaggacgacgagctcgagacgacggcgagatacggcggcgtcggcgcggggatttgccctaggcagtggcgggaaggagagaggccgagagagatcgatcggccgaaaacgttaagtgttggtgaataagacaagggcgcaccgggaatatatatacccctggatctttactcccggttgttctcaacaaccgggagtaaagatctctt

SEQ ID NO: 81898 - DNA, 6580 bp, Oryza sativa
tgcaaaagaatatattcaaaaatgcaaaaaagctaaaggaaagaagacttcagaaatacccattaagatgactataaaagaagaagggttttttaaaaaacccacatacaaggaatgcttaacaaaaggagtggatccattagatggggaatatattgattggaagataatagaaaaatttgaagaagcctccccacagttaaagaaggaattgaaggaagaaatacttaaagaattaaaacaagaaatggatcagaaatttgagcaaataaaaaaggcagtagatgagaaattagaagtttctttttctgatttggacacaatggatcttggtggccatgggcaaccagatgaataaattaatataagctaaatatgtttttcaatatatattgataatagaatatcaacaatttgggcgtggaagaagaataaaagaatgaagaataaaagaataaaagaaattcagaagattacccaagaaagaatccagaaggacaccctataaaggataaggggacaatatagggtgcggtgaatgacatatcactgtgaagagtaaaactttcggtggaaaggcctcgactttagccagctcccgtgaagatacagtagcgaagagataagcaggaggcacaggcgacgccatccctggcctctataaaaggagacgttggccttcactctggagacacacaacaacaacgaagacaccattcagagcaaagcttccaagcgcgctctcaccctccattccaccgttcttagtagtagtgactttagcctaccttgcatagtatattgaagcaaggagttgtgtaataacgctgtgtaaggtaagaacagcttgcttgtacctaccttcgggtttcccgaaagggaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtgacttggaatatcttgttaagttgcttctaaaaagatagataggtgaggcttacggtgagtaccgagtaggactttacatcatccgaagcaagcttctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgttttgaacagtgtatattgtctgaagcataggtttgtctgaagcataggtgtggtgtattttgtctgaagcataagtgtctgaagcataagtgtggtatcagagcctggtaatcatagagaagctaaatttagaagctaatattggaaagttaataaataccaaagataatatcaacataaggtgtagactaagccatactgaagaacatagttggcactctaataatagccaactaaatttaattgtagatttaatatataatttctatataaattggagtaagagacaagaagatttagagcaaaagttagaagatatatataaagaacaaaagcaatttgtagaacaatattcttttcttaataataagctaaatactacattagaattattagaagattataagataaggcaaaataaaatttcacagaatagtgattatattaaagaattactagacaaaatcaactctagtaaaggtaaggaaatagttttggcttcatctggcatagtctcatcttcacaagccattaattctgaaaaatggacatatctaggagtctctttagaagaatagcaagcagagatgataactgttctgataaacaaaaaggcaaatatgatgacatagatgagctgaaagatgttgcacaagtagataagcagctcgaaagatatcaacgagatactttaagggcaataaggcctcaacaagtatactgcatgggattttttgagaataagaatgggctttatagaatatctagagaagtagaattaagtgttctaacaaagccagtagaattaaaaatagtagctaaagaatttgaaaatagtttaagatattcaggatataagtatattcaccaaggtatgtacataatagatatcaaaggaatgacaagaaagaaattaggagctaaagtgctaataaccttattagataaaagatgggacacaataaacaaagcatctttaggctatctagaaggagatatgaatgaaaatatgttgataacccatatagcgcctgattcaatgatgcctgtaaatgaattcatatataaaatgagttttggtttccaaacaaaaggatactaagagtttaagggaacaaatttattaataagtatagaatttataggaagattgactaatagaagtgcctccaaatacaaaatcaatgtaaatgatgtgatagaaaaaatgcattctaaaggaataaaattcatgagccctttaataatagactctgaagaaagagcaggagaaaaatggccaattagtgaatttataaaaaataaaaccttgagtcagcctgaaaacttcataagttaccaagacagcaaagggaatgttagtattacatctacaaattataaaaccagagacttcgcatgatttggatgcagaattatctgacagagatattttgcataacagaagacctattatatctgaattgatggaaaaattagaccatgaaagtgaaataaaatattatgaagataaattaagagatatagcagatgaatataataactctatgaaaagtgagtggcctaaaattagagacaaggaactttatttctatagagaactatccaggattaagaaacaaaaaaaagagaaaagcttggtcatagaaaccccgagaacccaggaaattaaaatagaacaaataaagtcagaagaaccaagagaagaaatccaaaagttagataaggtattaagtgaggaagagcaatgggaagtaaatgagaaattattactagagagttatgaagaagaaaacaacctgatagaggaaatagagaatatagaagaagaagataatgcagaacaatataatgattttatagactcattggatgaggaaggtttgcataatctagataatgcaatggaagctatggaagtagatttgggaataggaaaaaggaaaagatacggagagggttctgtaaaaaatgaaggagaaagagaaagaccagccagggcagcaggaagatggcctccagaaaaagaagaatattcatatcattatatcccaggacagtataggcacatgggcactaaaagaagagattttgagaaaccaataaaatttcaaaatcaaaaaagtgatggggctatactaaatctagcagcacatgatcccatagactggccaaatatcattagtatttggaaggggttaatagttcaaaaatacatacaaaatcagcataatatagggaataaggtgggggatatgataacttatttagaaacatttttgggtgaatctgctaaagtcctatgggaacaatgggttgaaaagaatcctaataactatgaagagctaaaaagagcaggaagtaatcctcacaactttgcaaatatagtatctaatattatcatagctgaagacccagaattaggatatacaaccctgcaaaatgaaagattaaaagaaatagaaaaattaactttaacaagctggaaaggtataaaggaattttctcaacattatctatataatgcaacaactgctaagcaaggatacaataagggaatagttgagcgatattttaataaactacctgacccattaggtagtatgatttttgaggaatataaaaaggaaactgaaggagctgaaattaatatttcccaagccataaccttcgtgttcaaacaattaagaaaaatatgcacaggaatacaagcccaaaggtcaatgaaacattttgattataatttttgcaataaaataatacaaatacctttatcatatggagaagataggcctagaaataaaagaaaccatagatatcaaagtagaaatagcaataatataaagacaaagaaaaggtacttcttaagaagatcagataatagagcacctttcttacataaacgaaatgtaagaagatataacccaaagaaaacttatgataagacatgcagatgtttcatatgtaattcaccagatcatttaagtagaacttgcccaaataaagatcaaaaaagatattctagtaaatatgaagaacaagagagagttttaattatagatagcgtaaatgaaaatatattagtatgtgatgatgaaataaaagatgacgaatcaatatattctatcatagaaacagatgaaattgaaaacaccaatgaagagtatgaatcaaccgatgaagagttagatttaattgacgaactagccggtttaaaaatagaattgatggatcagttaaattgtgaacatgattggattagaggaaaaggagattataacattaaatgtgctttttgcatctattacccaagccaagataatagagtaacctgtagtatatgcttaaaacaagcttgtgctgaatgtataaaagcaaataaacaaaaatggagaaaagagatagaattagaatcagatgaaaggatattatctagtagagtacgagttttagaaaacagaataaataaactagaagtggaactagagaatctaaaaattaactatgatattaaggcattaccagaaaataaggatatacaaaataccgaatttaaagagcaagtgataacattaaaagacagtaatactgctaaaataattcaactaaaagatgccataactaattttggaaataaatatatagtaaaactgcctttcaaagaaattttgggaataagaataccggtaaaagtaaaactatcacccaaggtatcatataaaattctagcactagtagacactgggtgtacaaaaaatattattcatgataagtacttcataaaatgtccagaaatagttcatacaattgatgataataaggcagaagtctctacagacatgtccggaataaagaaaattcataatcagctagctcataatgttgaagtatacattaatggaactaaatatataatagatgagattacaataagaaacttatccatgataagtgatgacatgataattggcctaaggtttttacaacaatcggtacaaaccacagtaatacatgagcaaggaattacttttatcccatatcaaaacaatgtaagcggcgggtatcaactagtattcctaatgaaacacgaccaatcgttgcacggcctaaccgctcgtctcaccttgaaccgctagatcgagggtgccttgtagtggctagtgcgcggctcagataagtcatcctcaacggcgatagtgacatagatcgactttggcccggtgtatatagatggcggtgaaaattgggatgctacaaccatgacggcggtaaccagaattgcactacatgtcgcggcggttccggtggtgatgcattatatggtggtgggcagaaaccactgagaaggccgagctcgactaagagcaggtacaataacagactattagccagctacaaacatattttaatgagataaaaatgatagagaataacagcgggttacagatctgtagccagttgtaatacggactctaatacgtaatgtgtatatgacaggtgtgaccatataccaatagtatagtaagtaattattgtataaaatagctattagattggctatagctgaattggagctaatagttaactatactattaaacttgctctaacattgatggcgccagtggcggtggcaagcagcatgtcaaagcatatgtacgcttgatacgatcgagattcgagaggtgactgagagctcgagccaagagaccgcgagcctgtgcccgaaaaaaaagaaaaagaaggtgatctcaaagggccaaagaaagaaagaaaaaagaaaacgtgatctcaaagggccatattctttttccattggattgggccgaaatacagtttatccaatcactcttttgagcccaaggtcagaaaattcttaaggtcatgtatttctaaccccggtttggggccaattacattacagtccttccaatctggctctttccttctatccgaattttttcgtttttagattttttttaatatttacagaaataatctatcgaccaaaaaaattacagaaatagcccctgccgccctaatggtgggcggcaagctgacgtggcagacggtgggtcgaccgcgccgtctgccaccgtcggcaaaaattgcgattaggcccttgccacccatacagagggctgcaaggggctaattgcaattttggccgcccataaagagcttgcggccgtacttttt
